United States Patent 7,960,114 (GENE SIGNATURE OF EARLY HYPOXIA TO PREDICT PATIENT SURVIVAL (75) Inventors: Renaud G. Seigneuric, Crimolois (FR); Maud H. W. Starmans, Heerlen (NL); Glenn Fung, Madison, WI (US); Balaji Krishnapuram, King of Prussia, PA (US); Dimitry S. A. Nuyten, Branford, CT (US); Arie van Erk, Eindhoven (NL); Mic) - sequence listing, part 3

SEQ ID NO: 117 - DNA, 1021718 bp, Homo sapiens
gcgcgcctccgcaggcggcactgcccgcggcgcggcgtgtgcaccgagcgagtgaaggtatgtgtggcgggcgcggctggagctgccgccgccgccgccgccgcgccagcaggtcctaatgcctgtcacttcccaggacgctggcagcagcagcagcccggagcccccgagccctcggcaggtttgcgtgtccttccccgcgatctgattggataaagtgggggctcgacggtggccgacgtgggacagtctggctgtggcaggggtctcggaaaccatgggttattgcagtggcaggtgcacgcttatctttatctgtggcatgcaactggtaagtgacacttgggtccccttattctgtaatgtgtctttgagatagtgggcaggggagtgcagcaaagggtctgccattgactagaatggacgaaaaagataaaagagaaggtgacagatatattgcctatattgaagatgatttcagggagacgcactctggggtacaggagaggtgagcctttccgttcccacctatttctgtcccttttaagacagtttggcaggtgcgggttaaacttgtctttaatttctttaggaaaagcaagatgtagctcttgttctttatgctttgcattcctattcatgtaacaacgtgattgtcacctacaatttaccgtacaggttgttaaacagaggaatacggaattttggacttttcttctctatactaattttgcagtatctttgtttcttcatagacatgttttttttctttttttaaggaaaatgttgtctttaagtataatgctctaaaaaaaccactgtttagggcacatggtatccttacaacagtctaatttagactgtttgagttttagccacattgagtttttaaagtatgcagattgaacaaaaatacttaggtgaactcagcaacaccattgtcatagacggaaccagtaacctttaaatcacaattaacacagacaattccaagaaaaactattctgtcttacattatgcatattattgctcctgaaatagatactgttgtctgatcctataggatggagaattctatgtactttttgaggaatgttgtacagttgcaaaggggcaaggaaccaataatggaaaacgtcatgtctctgaatttcaattccctaagggcaatggaaggagggtctgagtagagagttgagaggtgaaaaatacaccactctaagtggttaatttgaggtaggagctacttgctcacacttgtcattaaatatatttccttagaaagtataaattaactggaatagtcatgtccgttttcaacaactgtttcataaaggttgaagtgactacaaggcagaagatgtttaagtgtccaatcagtaaagtgttcaaaagagcaaggatttgccattgaaactggcagaggaattccttaagtgttcttgtttatcagttgtcgtgaagcccatgagtgttagttattgctgctttgtttaatatttagctgaaacagtgctttttgttgtgtgttgtcttaggatgtttttctttcccctgaaagttatctgatggtgtctattttgatctgtgatttatgcgcttatgcacttggttgtaagacaaagatggaactataaatgtaattttcagaatgtggtagtttctcaatgatgtgtaaaccagtttatttttctgtaccacagattcatataagttttgcaatgaaggatttttactcttaataataaagctaaccaaaacaatgagggagtttactttgttaaacaacccattaggctaagtctgccaaactgtataaaggttttcaaaacattcttatttttatatattattcagaaaaagaatacatttgctgattcactgtgtgaaagcataaaaatgtgagaatgagtgggtgtgtagatcattcttatgctcttttcgatttaaaatttgaaaaatgtgatttaacttctaatcatgtaatataatagggctttcttatggcaaatgtatgcactaggtctgtatgacattttgtgtgatgaatacaaactcctcaagaacttaattttagaaaaacataaatataccagtagggaagctatctattcaaagtagaatgataaagctaaaggttcctttgtgtttttatgtgctcacatatgtgtgtatgtacatatgctcttgagtacatgcatgcatccatacatacaatggtgtcttggagagttgcaccatcacttatgaaacagaaattctgaattataattaagttctctaacagaatagacgtagctgtaatacagaagagcacaatctaagtaagtgtacattggaatcctaaggagtttttatattatatgagaatcatgtgatttttcccattcagactttatgtgccaccaggctaatataattagcagccatgttaacgcagatgcagaacaaaaaacaaaggacaaagaaaatgcaattgttttgatagggtgaaatgatcacacctcaaaggacctcagagattcttggtaattgttgctttttggaaatacggtatttgattttaaataaaataattcttttgcaaattaatagttgcaaagccctgcactaaaaaataggtgggtgtgtatgttttccttttgctctcaatagatttttaaaaactttttatgtctttgcgctattatgagtagattgttttacaaataaaccaggtttctagactaagttatgactcatgtaccattgactgaaataaaagttaacccagttttgtttacttctcaagtgtttagtatgtgttcttgtaacatttgggcatcttttttttggtaactgtacaggaaaaaaggccaaagagactctaagttagaaactttattcagttgctttattatgtgacttgattaaggttctggaaacattaatctccagtcctcggagcaaagtatttgtattttaaataaatttaagggaatatttacatctgtaccaatttgcagctaatcttaggagaggatgaggtggcttttggtattgtggatatggtgatctcatttattaagttattatcagaccagacacggtgttttgaccatttaacaattgagggacagaggcagattcttcagagacatttacctgtcagaattctatatctgtgctttaaattagttaaatatacatttaatttaatgtttggcagactacaagtattgataaacatatactcttctcaaaaatcaggagatccgtttataaaacaagaaactagaattccataccatagagattcatacaaaacttccattttatgaaaaactgtttccatatatatcataaattaaaatctttgagttgtatggttatgccaacttcagattttagggtgattcctacgtaaaggagtatgatctctggaaacagatttattccatgtgcagaatccagagcttaagctcataatctcaagaaggtaattttctttttatcattgctgtccttaatactcagaaactgaagatttcagatagtaacaaaaatcatcactgcatttgcaatggtggatgtagtggtataggacaagaagtttttaacttcttatttactatttgtaactttcaacttgtgaaagttttggcatgttttccccaatgtttgattgaatcagagttcttttataaatgtggaaaaaattactctgatatctctcagtgtgaaaaaatacgttaaaatatgaaagaatataacttaatttagactgaaaggacagatttgttttcaagtaaggaaactcaaaatcccctattttgtactttagacttctgggtggcacaaaacatgtcataaactattgaaagaaagtttagatttacactccacagaataacacttgaaaaatgccactattgccatgggctgtatgaaatattgttaacttggagcaggtgcaactaacaattaggttagtacacattgtgtgtgcagctgtgtgaaggagtacatttgaaacttaattaagaatgatcagttactttctatcacaggattgctaaccattttcaaaggtacatattttttttccttaagatgttgtgagtgtagactaaattaaaaacaattttattataattatggaatatttcagtgatcatgattttatgcagtgttcataatcatgtgctattttattactttttagaaaataaagcgttgctgtgaagtagcttgaaaagtgcaggtagaatcttatgatattcctggtatacttctgacaagtttgacggtttttcagaagtttataactttatctgccacaaaacttcctggctcagagaattttaactttttaggattcagatgccattgatgataaaatcttgaagttgttaaccaaacttactcatgaagaagactgaaaatccccatacaatactttagaaacttatcatgtaaaaatatgttgagtttgctaagttgtaaaatgataactttcttctttttaaatgttttctatttatgcatcctgaatattgttgcacatggttttgtttttaatttattctcactgtaattcagcactactcttctctgccttatatataccaggagatacctagaaacttcttccagtgtccaactcttctttcttcgttcacaaagcaggtagcgacttattttcttgaatacagctaaagtttcaaaaagtcaacccatgtggagctgttctcctgctttctcaaataaaggcttggatgggcagcattttttctgcagagtgccagagtcatctctggcatggggcccgtatgtgggtaatgacccagaaatgcaaatgtgctttgctacctcctttccctctgatgctgctttactttgaggtcagattctctacttgcccagtcaggaatttcagagtggaagtcagggattccttaaaataggaagtctttattttttgttttttatttttaatatgtgtgtgcttgagagaaataaaatctgagagacagaaacatattttaacatttctatgttgatcctggaaatataaatacaaaagttaatggcaccaattgcattaaatattcgtatatacagataatgcctacaattccaaaggttgtatttcagttatgttatttggtagaatttcaaacagtgcagtatacttttttcataagcagttttgaaactaatattgctattaatggaaattaccctatttccaataacatacaaatgtcagaaatgaaacacacacataggaaaaatatttgtttcccattttttttctgatataatgaactcttctgatttttgttatttttttcccctcatggaaacttgattgttgtttattatcaatataataaaatacataagccatcaagatacaatgtatgtagggctaccttttttcatacaatgatagaataagtactctatttattcctaatttctataggatggaaataaaattatatgaagcatttgttcttaccattcccaagagattaaagcacatttaaaaattatgaaggaacaagataaacttctatatcattttctttctccaggttatggtagaaatgaagtttataacttggttttctcctcttttagtatttcaggagttcatattttgtaatactgctgtgcacatgtgcgcacgtaataaatttgttacgctttttcttttgttaaaaaatacttcagttgtgtttagatataaaatgcttaatatataaagaaattactagcttcatcttcctgaaataagtatttttctttttctttccttgaattataaaacaggcagtgggtctagcttataggaatattctaagatttaatcttatgcaggtatagactctttttgtttttccaacctgaaataagaataaggtgacttcaaaagcttatgatttttaccctttcagctagttgtggatcacatgctaacttgatccctgtaaaaactccttgaaatgctacatataaactgatttttaagtgcattttgaaataaattttttcatttcatacatttttaaataatttgttatgcatttaaaaatctagttttataaaataataatgaaaactattatttattggaagcttgttcttggctaaatatgtttttttttccccccactgaatcctctctggtaatcctatgaggcaggtaatagatattaatatcctcactttaccagggaggagatggaggccttgaaacgttaagctgtgtttttaagtcatcctcttagtaagtggagaagcttggattcaaacccgggtctgtctgaatctcagcctgactctgaacctgtgccacactgcatcccttccatgtaaaataaaactatagcagcctctcatgttttttttttcttaaagaaagtaagtacctacctactaattccttagtgacccattagtcaacacttaggtttagagaggtggggttgattgatgtcaggctcctgtccaaacctgaccgacttaggtaatcttggggtttgacaactatgagcagctggtgtatggactagagaataaaagggcagaaggggaatctcctcgctgcagagcaagtatccattgctgttctcatgcatttgggccaacttttgacagataaccatgaaatagggtcttggaaatttgatatgtaagcttaaaatgtattatatggaaagaaaaaatatattcttttttttttttaaatccagctctttttaaaaccactccttgatgaatggccagtgcacagtattgttatttgcctgttttttgtttgtttgtttgctcgtttgttttttacatgctccaaatcctaaattcatccagaccaccattgaccaataatatttgccataattattgtacttgggaagaaatagagtaaatatgttatttaaaatatgtgttgaatatgcttgaacacattttgaacctgagtgtgcatcagaatctcctgcaggatttttaaacatagatttttgggccctctcctagagtttctgactgcagaggcctgggctaggaccagagaatttgtattgctaaggaattcccagatgatactgatgttgatgatcaggcaccaaattttgagaactactggcctagaatatgtgtcttcacctaatggtgttacaagagaaagtgaacctgtttttgaaattcttcaatccaactagataattaactaaattcttcctatggccttctactgatatgagagaaaacttttcttcaggacctatttctgacttttagcttagttctattcagaagtttaaataggagaaatgcaaggtctttccagcgcgtttgtgtctttgtaatgtattgaaatatagaggaatctgaaagcaagcaccctcatgtctggtaatgctagaacagaattggatccttcacctgcctctctttactagcctagccactcattagggtaagcacagcgctggggtgggggttgtgggggggtgggggagagagggagagagaaagagagagagagagactgaaaaagtactgggctaagttagaagctggattttaatataccaaggagcttagtgcttctgtattgggtgactaaataactatgactttgcttgagacatttatatttctgggtgctgtttcctcatttgaaaaatagggcaaataattcctgacctatttaccctatagaataggagtatctaggggagataatatgctaaaagttaacatctttacagttttaatgttttaacctttcagaacagtccatctagtgagcccaggagtagttaaagggaagtttatggccaatggccctagttagaacaactagttttttttcatagaatcatttttttcttcacccacccataaattttgtgaggctttataaataattaaaacactaggtacaggtagtttgaactagataatatgctatgcgcctgatatacgtactttaagtattcattaaaatgaaacttggattttacaaacaagtcaacattgttcttcaggccagtatttctaaaactgtgttctgtggacactagttcagcaagacattctactgagcaagaactcttatgccccccaccgcccccaccctcaagggtcacagtgcatattagcatattagcagctacaggaagtcctgcactaaacctctgcttaattccatttaactcagcaaatatttacagagtgcttgcagtgaaccaagaaatgtctttttctgatatcccctattaatcttccatggaactagcattttcagcaatacttttcagtgaaatattactccaggctaatgatgcagtctacaagttaatattcagtgattgcctacacaatatttaaaggttaagaattcagtacagaaactcaactgattaagcagatatctaacaaataatgcataaagatatttaagaatatagaatattatcaagttattaaaacaaatgaatagaaacttgttttcagatgcttggctattttatattatatatgttcacttgagtttcttgaaattatgtttcggacactaaaatcaaaacccttaactgaagctcagtcaagtccaattgctgatgttgcaaagaggttgacatgttgcagtagttttggaacttctgatatttagaactccagaacaccttggagagggcatttgcagaagcactttcgttttaaggcagtggatgaggagcaatgtctgtatcctacatctctaggcaggctagcttttccagcatctcagcctacatatttgccttaggcgggggagtggtgaagaatcctcatactgacttttgttttttaatcaatgcattacactctaaaacagtaacacatttaaaacccccaacaatgttgcattctttggaaacaaatgagtcttagtttgaaatggaggaatcaaattggtacaccctactcttaacagaagtctttgtgtgcatctgtattattctaattacacaacagaataaggagatatttcaaatcctttaactgacagctgtgtatcaaatgatggaagggtctatgttacatgtgaactgttcggtggtagggaattcatagtatcctaacctacacgggcttgcagccataagagttatacaaggtggatcacccagagtgttatttgtattatagtctctgacaccacttggaaacaaaagttataagaacctctgcaagccacaatgagaagagaaaattatactggggtggagtgctgccttctgtggtcttggcctctggagaagggctgtgctgattgtcccgggattgagcacttcttttgttaatggcacctgcagtggtggaaggcaccttgatgctgggaatcataattcatcccggtgggcatagtgattctgacctcactctcttgttagtctataagctagcgatcaggtaccctataagagatggcatatgaaggttttacctgattgctttgaagtgcggggatgatattagggtttgtggatatgtttacccctagttattgggaactgttatagaattacatatttgaaggcttttagaaactattgtagatttggccaggtgtgatggctcatgcctgtaataccagcactttgggaggccgaggccggtagatcacctgaggtcaggagttcgagaccagactggccaacatagcaaaacgtcatctctactaaaaatacaaaaattagcggggcatggtgttgcgtgcctgtagtctcagctactctggaggctgaggcatgggaattgcttgaacctgggaggcagaggttgcagtgagccaagatcatgccactccagcctgggcaacagagcgaaatcccatctcaaaatgtagatttgatgatacataggtggtatataaagagctctggacctttttttttttttcgtctttttttctgtttaaataaaacttgctcacaactttagtgattagtgaacctatagcctgagattttctcaaatattggagcaatgtataggattatgtgtttcttacccttatcaacaggaattaatggagtttcatttttgaccatgttttataaaatgtggttccattttattcacccaaaagatagtaaattacagctgttcagtagtatttatgagtttgccttttctatgcacctggaattaaaggcttctttcattttcctacaaggcagggggtggagggatgggtggaactcctgaatgttcaaaagcaattaagtactattctacttaaaacaatgttttaacattcattgtgaattggaatccacaataaatcaaattaacgaatgaattcatagattaattttcttaagaacatatttctggttttatcaaaagcgttcttgggaagtttcacaggctcttagagatacggggcaatgcatttttagtttaccattttatagactgccctggaatagatttatttttattcagaaaagctgccttaaaaatcaggcaaatagggtaagttcagtttacatttagtaaatataaatcttgcaacaaaaatatgtggtgacatttaattatattcctcttttattataatcctaaaggtagacctgtggttttcactttcttttcgtaagaaagaggtgttaatgatcactctgttactgtgcctagctttactcacactctgttaagtaccttaaactcatgtcatattttttcccttacattgagagaaataaaccccaatgaatttttttttgaagtttacatagtgatttgatgcaaactttacacacaaactagggtcattgcatatttcctactggtaggcccatcttttaatttaatatttcataatgtgaataaaaatttacatgcaatggatgaagagccagacgtgcaggccctgccctggatgttgggagccgaagaccctggaaaacatttgcctggaatggttcttagcctgcagtgctgtgttgcagtcatgatcatttaaaagtgaatgaagtaatgaatgaatagtgggaggaaattaagtaattactaaatcagcttcatcaagtaggatttatgaaatgtccacatacgaatagcataatgaacatgtgctgaataaattgtgtgtttctaccctttggcaattaggatatgatgtaactgaaaagaacgtcaagccgtgtttctatcgtaaatctagtatctagtggttttaataattcaagattagtttaaattgcaacctgttctttatcatttatttatttattaagccatattacttacttacttatgctagaagctaaacatgctttactgtctttcattcattgtgtactataaaatcacatttatacttactgtaaataagatcaattttggtgagacataaatgtggatgtctgggtcattttgccccattttaaagtgttaattcatataagtttaattcatattatctagcatttgatgcacttgatgcaacattacttccaagagttttgttaaatcagaacgtaaataatgaagttaatattgtctttatttttcatatctctagagcagtagttttgaatgttttttgtttgtttttagcttgtttggcatggaatcttgcaaatctgaaaaaagctactaactctcttaccaggaaaatgggcttcaaaaacttgtgagctcaatctatgaaacttagatgaaaacccctagtataaattcttaattttttttgtctgccatttcatgaagagcttctgcttatcaacaattttgattcagttattttgagctcaggaaacatttaagagattatatacatacttgatatatacaattatatattgtaaagatatatgtatacacacacacgtatgtgtatatagtgtgcaagaatgtgtgtgtgtataatgcaaaatttgagaacccaggagtagagttggggaatagaaccaaactgacctctgtcaagcagattaaatgtggcatggtagatataccgttaatatagggcagcatgataagaacttaagataattaagaataaaatacaaaggaaatttatgggaaggattatttatctcctcataggttgatcaaacaatatatgtggtactagtatacgatagggaggatttctatagctagagattgcaaaaaagagtatcccaggtggaagaaatgatggtagtagaaaggtgagaatgaaagagaatatatgtgggacaatgaagggtccagatgaatggcaagtagggaagaattgtgaggtgacttagggaatggaagggataggagtctggtttagtctggttcatggttgaacttgagctccttggaaggagtttgggaccttatagaataggatataggtctataggtctctgtagatgttaatcatcaaggcgtatgtcccagtgccctacagtagaataagaaacaacacaatgtgagagtgaaggcttggggtttggagcaagccctgtggggaatgtgagggcaaagtagtaataaattaaaagattgctaaactgcttcaaagtccccggtgaaattaggtggcaagcatttgtaagagaaccaattatttctccgtcagcacccaactttctaagaattggaatgaaaaagcagaaaatggaagttgcagggcttgtgagggcttatgagagctctaagatgacagtgagaataaaatgtctgagcacaggtaggtgtgggtgggaaaccatgctgtcagaatgggaaggggtagttagatgattgaaatgccaggcaaacatttgagaataaggaggtgggtacagcagaagtgagacactagaagaggtgagaggtaaggtggtggtggtaagagacaagaacagaagtctagatcttgaagaggaacacttcatggatgacgcaaggcccttgattggccacctaattggtagagtgtctagttattgagaaggataggaggcaatgaagctcagctgttagaagaatcatcattgtacattttggttttattaaagatgcttggaaataagagacctaagaggaacacagtgaggagagaaaaagattgttctgggggttgtatatactggtgagagtttggggagagtttggtgtaagcagatgaaaggagctggaacagaatgatgtttagggaaagtctggagacaactggatggtgggggatgattttggaggaatagaaatgtttgtttaatgaatatgtgaatggagtgattatggaaagagtaaagtaggcttcaggcaaagcatttttctcaatgttcacaacattgccattttggaatgataatgataattatttgttatgaggagctgcattgtgtattataggatgtttagcaacatccctggcctttatacactagttggagtagcatacaccccgttttgacaaccaaagtgtctctagattttgtcagattgcaaaatagtccctttgtcgagatcctctgagctaatgtaaagagctggaaagagcacttagaaataacaggacactttcttcagaaagagtttgaattgtccagagggcagctgaggagattgtgaagggaaagaccagactggagcctgacggttgcagacctgtgagagtcatgctctttatcccgaggcccgtgtcagaatcatctggaattttcaaagatgtcaacaccagcgccccttcctccatccctttgacctatgaaaacggaatcttcagggaggcaacccagccatgtagccattttgaaaactccttagattattttggtatgtttctaagccagtggtaaatgaggagagcaggcacatgaatagtgggtatgaaggcatggggaaaaaacaggatgaaagtaaaagaagattggaaggtaggttgagacatacattaggaaaggggggtgctgaataagcatttgtgggagtattgactggagaggcaatgttgaatctagatttatttgaaagctactttttatggtcaattatgtactcaaccaagccttcagtattcttggctgttttactcagtttagtttgagccaggtggattttatctaagactcagtgaatgtcacctttcttttagtgccagtaaaaaccgctgatgaatatttgacacttttaatttgtcttctcccagatgcaatattctgttaaaatatgcatatagtatatgtttcttcatgaaatgtcttaaaaagatttaagataggaatgcatattaattttcagacatataattattgttgacatgcaggacaaacacgtatttctgaatgtagaagttttaggtccaagtatgagtttttaattcaataaaatatgtggataagagttaagaacaatgtgattgtaaatttaaaaattattttttagactctaacaaattttcagacttcttgtggaaacacacacacacacacacacacacacacacacacacacacacacacagaggaatcataaccaggaacttctgtttgaaataatattaagctattaacattttttaggtgatcccaaacccaagaaggttctgcaagaattttaatatttgatatcctaattcaccagaaggcccagttattgccaaagaagcataataaaacagcagagatttatctttttaaattatcctgctgtataattttgcttgatccaatttgatttccttcggtaacactttttggtggactctaatttgcatgcctggagaaaggggagtaaattacaagacttcttgaaggtccttttaacttgatggttttatgattaaatcttgcatcttaaattgcctttctctggaagaaccaggcatttccggcttcatttttgtgtagaggaaattcatatatcacctcatgtgtttttctgtaagaaagaaccagacaaaatagcagtaatagaggcaaaacaaacaaacaaaacgttataaacttagaactagatgtagatgaggcttatcttatttgcaattctgcaaggatgtacttgggtccactgaaagtgcaggtgagtggaaaggtgtgtgtttgtctgtgtgtgtgttaagtgggtgtaggatgtgtaggatgtgagcaaagggggaatgaaaatgataccgttcataggtgttaacttcgtcaggtgttctggctatatgtgagaagaggaaagtgggttaactcagaatacattctttatttcttagtatattgttcttctggatgtggtaggttttcaacaggtctcgttaatagataatctgcagtgctcagggtgaaaagcaggagtcttccatctgtatgcctcgggaatagtatcaatgcagaatgaaatacagacagagattggagaaagactactgtattcacttgaagccaatggaagtttaggtgggcccgattgcaattatcccccattggaaattagccaggacacacattagtgcatgctactttctgtctagcctaattaaaggattgttgagaactaacaaagttggctgacttgcaaaagtcagtgcttgctaaaatttgtaagttataagtgcttaacaatatgacctgatttttctgctggggtcatcttattaattaaagttttccaatcgtctaattagaaaatacagtctgaactgagtctggaggattccgagtcttacttgctaatttaaagaaaagtggaaggaagaagaacagctcccaattaaagcaacgcaacggaaagctggttctggacatgcccttggagatgccccataccagcagggtaattatttaggatgcacttccagtaaagagatgttaaagggacaccagtgagtagcttttaaaagtagaaatctgtgccagtccccaaattaactcttggactagaatgcaaagctggaaagcatgaccagcactacagatttatgagaaagagtttgttcattgcttcacaagttatgcttgatttttttcagctccaatagtactttcttaaaatagaggaacgaaaagagcagtttgataatgttggtatattttagatggtaacctgacactttaaaaaaggtagataaaattctctgtattttctaaagataaggtcctggaactgagatgtcacatttaagtccttaatagcctcgaatttagttatcatcagcgtccttgtaataataccaggctagagcagtactgcattcaaaataaaaatctttcaaaacaatccaatcaacatctgctatgtgccacccactggactaagcagaaagtattaaaagaaggacaaaaagggtgtggccaatgcaaaggatacattgattagtgtatatatggcagttcactagttactcagagtttctgattctcctgcttacatagctaaatgaactcttagtgtttatatataggcagtagaaaatacactactgggacagagaagaaaataaattatttctttatgatgaaattaaaaggacagaagataacttttaatttttgttggagatttttaaataagatgcctgtattataagtggccttgatcagttctgtagacacatgtttgtagatgcacttcccattaatgtggcagcaacagaggagggtgtggtggaaccagtatgctccctctgcctttccatgctgaccatccagatgctttacagatgaataagtcaagccaggatctaggtggttgtgccagaccagaatctctccttgccagccattctgtacatcatgagtggagatcacaggtttaccagaagtatatttatttatgtatcttgtaactgaattgaatttgttaaaatttgatacttgcttgaaattaattgggatattgttgccaacattttgctatttagccgtacccctcaatgcttttgattttgtttaaagcctataggaaaatgctacctaacttaaaacttgaaacttaaaatattactcttatccattcgtctgtaagagacttgcaaataagacatgtcaagttaaaattgcagttttaggcctcattcaagaaacaattagaatgaatatatcacaaaccatagcggggaaaacactttagctgtttcacaatgaattggcctcagaaacaaagcagctgatggtttacaccgaggacattgatcaggattcatttgggctgttgctattgtgttttaatgagtaacattacatgccagccaatcacatgtcactagatcattatacaaattgacagtttggaagagtataaaaaacgctgacctgaaaggggaattctgtagaagtgagacgtagccactggatatttacatcatttttcttgttgttgagaaattgaaataaccctttaatgaaaatggctccttcatattgtctctcactattttagatcaggcatcttatttttagtttggagaatgagaacagctggtgtcaggccaggtgctgatagtactaatgttgatgtaagatgctgctcaaatggacagtgcaaagggaatcattgtcccttgatttgatcatgctggctctaaaatttattttttgatttggcatttgactttgcattatactcagagagttggaaatcacaaagccgtgcagctgcagagtatatctagatatagaccctgtaacgttacctcataaacccagcactcagtattagcagtctttgtaaatggaagaattctgttctgtaacaaaaggtagtatttttctttatactgtgagggaggcctatagtttgaaaccactgtgggtgtgtagagggacaagcggggggcccgagggctggagcaaggagtgtggctgtgggaggatgagggagccgtgaagttcaaaaatactgttggcttttaaggtctccatgacccttgaatatgagtatgaataaagtgattttagaatctaagaagatgtcaaatatttttcttaaagctagtaagagtagcaggggatggattatctgaaaatcagaaaaatcagaagtcaattattatgcacacacagttaattgaatttgaacactttttcttttcagcatccatttttatattgatgacttttccctttagagtgagaaaatatgattcagattaaataatcacttaacataaattaactctttcaaaccttatgtggaattaagaactaaagaactattgcttaggaagtattaattttaggaagtattaatttgaactttgttgtcacgtttaatgagataatgtactatatccaggtaagtgatttacacaaatgccagaattctttgcactcggatgactgttaaaaaaaaaactcctagtgttctgacaactaattttttatgccttgtttgtgtactcttctctttgcatttcctaacattggacatttctgaaggcctagttctttatttgctattcgtctttaagttttgctattagaattatacattctggagttgataagccagttggttaataaatatttattggatacacacagtgggacatttacagagcctggtattgtggaatacaaggaaataagaaacaataaggagttttccatgtggttagcaatattagaatgcttagactatcttagggaggttcactgatgtggtcggtctagttgagtattaaaaaatgggtaacatttacatggtttaaatcagagtttagaagggagacatgagactgggtttatgagagacatgatcctcccattcagattgaagtatttttggaggtgtagtgggggttgtgaaaggatagagttgggtaagattatggttttttagagtataatgtttatgagagcttagctgctggaatctgattctcaaatcctgtctccaaaattcctgtaactttgcacaaattatttctctatgcctcaatttcttaatctgtaatgtatttacttcagagagctgttggaagaatttgagtagttaatgcatttaaaatgctcagaatggtcacttagaacttagcactctataaatgatattttttgacattatgaagagttttgaaatctagcaaaagagtttaaattttatgtgataagtaacgtacagccaggataaattccttattatatgttcaaagcagcatttaaggaaaagtaagtagaaaacagaggaccaattcaaatggaggaggctggggtgaggaagaccacctactaagctgtagtattcggaaatatcaggttttaagttaatgagaggctaggataatagctacaacaaatataatgattaataaaaccgaaacctgtattttctttacaaaacacttttgacataacagtacgtcctggatacaacagtatctctaatttggagacaaagaattggaaacttagtgctggcttctatcattgtggtaagagtgaaaataatggatacaaatcagatacctgaggatctttagagaagtaattgttgagatgtgttgacagatgggatagtttgacagagtggttgagagggtgctaggtcagttctcagagagggaggagtaaggaagtgacattactgttgggaggtaattgagttgggagagggaaaccagttaagtgagagtgataggaacttgttttgaattcttttgtacttgatgtgaccgtagcaaaggtgatggaaatgtacctagacagttgtagaatgtgtgtagaggtcaagcttatcaactcagtcttgggccttatcaacaagtgggaagcaagaagagggctgggactgtgtattcagaaatgccactcaggggatttgaagagaagaagaattattgaagagaaaagaagtaatttgagtagttggagaaggatcaggtagtgcatcatcaagagactcaagaagaggaaggagcaaaccagaagggtgaaacactgaagagaaattcaaggaagaggaggaagactgggaaagcatttggatttgaaattcagggagtttttgatagggtagtttcattagcattggaaaaatcaatgtgaaggacttaagaagaaataagtagttaggaatagatggaaaacacatagcatattctttaagaaattaaaaaatactgagctgggaagtaagatccttggggtttagctttagatttgccattaactgcatgacctttgatactttgtctgtaactaatagaatttatctgcatgtaactgaaagtacttatttttcatttaggaagcacttttgacctttttgacaatcttattatatatagaaatacaacacatagtcaggatcctgaaagtaagtggaagaggcccctgaggttccagacagacggatctcacaaagtccatgcactaacacttatgcaccctaccaataatcaccacccacaggctttcactgaaactgccttattcctagactgaactattatacatgaacatgattatctgtattgtaaagggcagcaagccatttgagaggacaaggtgaagaaagatctttctgggagctacactggtggcaataaaaattacattacctagtaaaaactaaaggtgcaaaaacccgtctagctacaattcaaaagagtagcagtttgaggacattttgggagggtaccatcagctcctatgcacctcacttgcctttgagggccttattatagaaagttggagtagtttacagtttaaaaattactatcccatagagcattaggacaaatacctaatgcatgcagggcttaaaacctagatgatgggttgataggtgcagcaaaccaccatggcacatgtatacctatgtaacaaacctacatgttctacacatgtatcccagaacttaaaattaaaaaaaaaaaagaaaaagaaaaaacaattactatcccattatccagtcagcaagggaagagttttaggtttaggatcagggctccctgtttggagggaggacaccaggcaacctttttgcttttctacctgatggaaaggttgggttcaatgtgctctgcttcagaaaaaagcaaggaagtacatgatgtgctttttgaaaggcttccaatctgtcttaacccatttgggctgctgtgacaaatggcatatcaaccacagaaatttatttctcacagttctagaggctgggaagttcaagatctcaccgggtgtctggtgaaagcctgatttctagttcataaatgtgggcactttctagctgtgccttcatgtggtggaagaggccaacaagctcccctgagtcttttttaaaatgacactaatcccattcatgagtgccctgccgtcatgacctcatcacctcacacaggccccagatcttaataccatcaccttagggttaggatttcaacacgtggattttgtggggacacagactttcagaccacagcacagtcattaagggtaaacaaaaaataattcctaaagaaatatgcttctattatctgggaagtagcatttgtattcaaaaggtgtttctagcttaagttgttgatactagttaattgataagttttattgaaaaatctgttttcagagtatcctaacacattgatacctatttggaacacaaagatatgtaccagtataatatcctaatcctgaaaggatgctacctcacccagccccacatttgccaactactgtatgccagcaaatggataatttactttttctcagacgccattaaaaggatcattagagtattcaggatggcttgaaatgggcatattcagctaccccaaagcaaattttcagactgagctttgttttgagaatcactgaaactgactcagctgtgcaattcagtaactgtggacatgtcaaaacacctcattttgtcatctattaaaatcccccactgtgtgtgtttagagatttcctttgctttaaaaacaatgataaaaaccctcatgcagcatttggtatgatacgtgttttcaaacagtagcccatctcatttcaagagatggaataagtatcattaaaatggtaactcaaatcagtcgaagcacttttctggaatacttagattaaaagtgattaagaactgctgtggtttgctgatagttactgttttgtattacattaatttctgcatttaaaaatagataactacttttagtgtcttaggataacatttagtatccactgaaattcatggatttagtggggtgatcccattctatggtattcttcggccggaaaagaatgagaacactgctgacagaagtcccagcaaggccactccatcagccccaccattaacagatgcatgacataaactctgggaaaagagagatttgtcagatttttgccttcagaatggccaaaagaaatctgaaatataaaaatataactagttgaacagtttccaaaacgccatgggttttttagttctattttttatgttttactttattaagacaagatctggagattcagcttttttaaattgttgtaaatcatacataacaaaatttactattttaaccatttttaaatgtacaattcagtgtcattaagtacattcatattgtggtgcaaccatcaccaccatccatctccagaactttttattttcccaaacggaaaccctttcccattgaacagtaactcaccattctccccttccctgagtacctggcactacccttctgcttctgtctctgtgaattttactgttctaaatatctcatataagtagaatcatatatcatctatccttttgagcctgacttatttcccttaatgtaatatcttcaaggttcatccattttgtagccttcttcagagttccatttctttttaagactgaataatactccattttgtttatccattcatccatcagtgaactcttgggttgcttctatcctttgaaaattgtaaataatactgctatgaatataggtgtacaagtatctgttcaagttcctgcttttagttcttttgggtgtatatccagaagtggaattgctagatcatatggcatttctatttgtaattttttgaagaactgccatgctgtttcccatagtggctgcacctttttacattcccaccagcagtgcataagggtttcagttcctctgcatcctggctgacacttattttctgttttttttgataatagtcatcctaaagtatgtgaagtggaatctcattgtggttctgatttccatttccctaatgtttagcgatgttgaatatcttttcatgtggttattggccattaatctatcttttatggagaaatgtctattcaagtccttttctattttttaatcaactttttgttgttcttgctgtcattgacaaaaacattgttctgaacagaagtagttagaagtatggtgttgaagtgtattaatgatcatggcaagagatcaggcaaattgaaccaatgaatttcctgtcctgatgtcttgatatacaggaaccctgctactttgcccccagaacaactctggaataactttgcagcttttatttatttgcttaatttaggcttcttctggactatttcttatacatgtaccacatgaaaaaattgaaaacaataaagttcaaatacttgatagattttgtttttattaaattcagcatcagccagtaagaagtatcaatttagccagtaatttggatatatatgtattattacttcgcacatcaaatctcttcaagaaatgtgatgtaaaagaaatattgagtatgtgaaaatattaactgtgtattttaacacagatatcatttgaatttgaacactttttatgaaatggtgctatgattaacatagtaaaactcagaaatatttaaaaatgttttccaagttgtttcaaattttgaaaaggtgtaagttagatctagagacaaaggtagggataaaggaagagaagaggaaacataaatagcattggctctgttaaaaaaaaaattacagagtagaattaggatttcaaaacatcacaggatagcagttcctctctctctctctctctctatatatatatatgtcatatatatatatgcaagttcctttgtctgacttaaaagacttttgtagaatcagcatacctattcaatgtgtattactttgtgtttgtcatgaaattttacttcccatttgcctttggttttccttttctttggaatagccttctgtcatgcactgcctgttaaattttgtttaacctttgtggtcctgctcaaatgccatttcccctgtgaagacttccctgaggcctccatccttcctctgcactcacatagtccttaggcttatcatgatttttctctccctgcctctaagcagtaagcttcttgagggcaagcacatgtcttatttgcctctgtattacctggtccagtcaacatttattaaatgaatgcacatttttggaattactggttaacctcgaggactgctgtaagatctccagcaacactgtgttaactgactaaagagtatttgtgtgaataatttatatgtgaagtgtgatactcaaataaataaaagttaagttaccaatagctcataaggcagtgtttggcattctggaaggtttcccttgaaaataatgttatgttggctggattattaagcaactcctaaaagcctatttaatatcacaaacctgaaatacagttctgatgttattctatgtcattcccctgcttaaaactaattatgtcttgttattgaagatagaggccaaaatccttcatatacagcctatatgatctgatctccacttaacttttgtgcctccctctcccccttaagacttgtcattcttccacttcctaaaatatctcaaacttcttctcatctcagaggttcatgctgtaccctctctcatctcaggagcttcatgctgtaccctcaaccagggattttcttacccccccttaccccagctggccttgcttctactaaactttcaggtttcagcttaaaggtcttctgggaagctctccctgaccttcaggccagatcaggttccctgttacaagctatcagagagatctttcttagaacttgagagatatttatgcattcatgtcctccaaactatgcctggcattctgtaggtgctcaataaatattcatggagtaaaaacaggaatatatgaaaactgcttaactgtcattgaatagataatgattccaatagagactggtacctgtttatctattacacctttacaactttaaaaggaaaataactatacttctgtacttgcatgtgtgaaatccctatctgctcttgagctaagattctttcttattctaactctactttctccttaagcaatcttgtccatactaacatttttttattatcaccgttactcagatgattctcaaattaaaattttccacccagagttctcccttgagctctaggtctaattatctaattgtctatctgacagcatcctgtgggtgtctcaaaggcttatcaaactctgtgtgtttgttaggatattcctagctgttgtatcggacatagccccaaattccattggtataacatgataaaacttgatttcttgctcatgtgacatcctgattcagggtttctagtcagcaagcagcttcctacatgatgagtcagggaagttaattctcaactttactttgtcttaaggcttgtggacttttgcttgtagactgcttatgcttcctggcccagaaatgctacatagtactcttgtccatactccattagtgaggaccaaccacagagtcccagctaaatgcagaggggtggggaggtttgggaagtatagttattggtagaacagctaatttctcataatgactcttcactgtgaaaagtcaagcactaatccttggctgataactagtcatctgtgacacattcaacgtaacgaaaagtcagccagtttcccaaaataagcaaagtaactaactaatcatgcagacaaacagaccagtaaaccctggccttctttcagtgttctttgttttggatgatgctacacttctgcataagctggggacatgtatattgttgttgacatcctcttacccttaacccttatatcaaagaagtctataatttgcctggcttctttaattaatgactaaaatcttggaaatgaaacaaccttaaatgttagggaaatgggactcaaaagccaaggaatcattcctgacttttctctcgccccgtgtgctgtcattatttggtcttgtgtagtttgcatcctaaaaatttattggctgggttcatctcttcttagtgacagtaacactgccatcctccttgcttagaccactaaatagcctaacttcacttccacatgtcctctggctcccctcttgtcttctttacacagcagccaaagtgagcatttaaaatgcattttaaatgcagatctaatcgcattatttccctgctgttaacacttcaaagccttcctgttgctctaggcgtaaaggcaaaactccttaacataatttacaaggacatgcctggcctaaccccttccctgtctcactcccctttgctaataaatttccccctgtttgagcctcactgtcttctggtattctccgtgctaccctctgccatatggcctcatctgcaaaattattttctcttgttctcacgtagtttacacttacatatccttgatatcaaagtaaaataagtttcactttctcaggaaagtttttgctgacccccctagtcaggtcaacttcacccactgaaaaatttagaaacaacttgtatttctcttttgtagcatttatgataaataaattctcacatttcttttgtgaatattgaataaataactgtgtctgccactggattttgtatattcagtaagcagggattgtgttttgctcaattttgtctgtccagcgtgtgtatcacagtacctggcaagggattggtgttaatttgttttgaatgaatgaatcaatcagtgactgacgaatgaatgattttgtatatcaggtggttctgtcatctggggaatgaactgctgttatctctgcaggtttgtagagatattaatttaggaaatcagaccagctctggtaaatctgtagctatcggcttttgtaagttgcatatttaaggttactttatggaacaatgcaagtcttgcaaaggtcagagcatgaagactaaaaatgaattagttctgcttagagatttacatcagatctttccatgcttgaaactttctttttttcttcttcttactgggtttcctagcaacatattttgccattaccatgggatattctgatagtgaaactgtagtgtctttgcatttatctatcctgaaataatatacttggcaattgcatttcctaactagctatctaattttatatatataatgtatatatatatgcatatttatgacatttgatgaaaatagtatgtatgcatattgtgtaatatttaaatcttttatatagccatgattctcaaaagtatccttggcaataggatttatttttaatttctgggaaaagttatctaagtgtctatatacttagttttaactcttttttttttttaagatagccacactggtttttttgtgttgttgttgttaatttaattatttttattaaagactttattttttacagcagttttaggttaataccaaaataaagagacaggtaagaggttttcccatacccctctgctgttaaatatgcatgttcttccacatcagagtggtacctttgttacagtttttttttttgttttttttttttgagacggagttttgctctgtcgcccaggctggagtgcagtggcatgatcttggctcactgcaagctccgcctcccgggttcatgccattctcctgcctcagcctcccaagtagctgggactacaggtgcctgctaccacgtcctgctaatttttgtatttttagtagagacggggtttcaccgtgttagccaggatggtcttgatctcctgacctcgtgatccgcccgcctcggccttgcaaagtgctgggattacaggcgtgagccaccatgcctggcctatagttgttgagcctgtattgacacattgtaatccctgaatccgttttcattagggttccctattgatgttatatattctgtggatttggacaaatgcatagtggccagtatccatcattatagtatcatgcagagtactttcactgccatgacaaacctctgtgctccatccattcatctctgcgccccagccaacccttgcaaccactgatctttttactgtctctgtaggttttccttttccagatatcatatagttggaatcatacaatatgtagccattttggattggcttctttcacttaataatacgcatttaaagttccttcatgtcttttcatggcctgatagctcatttctttttagctgaataatatttcattgtctgattatcacagtttatttatccattcacccaatgaaggacatctcagttgctctcatggtttggtaattatgaataagacagctatgaacatccatgagcaggtttttatgtgggtataagtttttgacacctttgagtaaatgccaagaagcgcaatttttgtattctatggtaagaatacatttaattttgtaagaaaccgctaaactgtcttccaaagtggctgtaccgtttcgcatttctacaaacaatgaatgagagttcttactgcttcacatcctcaccagcatttggtattgttagtgttgcagattttggacattctgacaggcatgtagaagtatctcattcttgttttaatatgcatttccaggtgatatatgatgtggagcattttcttgtatgcttatttgacatctgtatattttctttgttgaggtgtctattaaagtttctgacccacttttaaattatgttgtttgttttcatattgttcacttttaaatgttctttgtatattttgggtaatagtcttttatcaaatgtcttttgcaaatattgttgcccagtctttggcttgtcttcatattctcttgaaatttgcttttaatttagtgaagtctaccttatcgatttattttttatggatcatctctttggggttttgtctaaaatataaataccataaccaagttatctagattttcttctgtgtcatctcataggagcttatagttttgtgttttacatttaaatctctcttttgtgttgattttgtgaaaggtgtaaggtttgtgtctagagtcacttttttttgcatctggatgtccagttgttctaccatttgtagaaaagactatccttgctccattgtactgactttcctcctttatcaaaaatcattgactatatctgtgtaggtctttctgtgctattttgttccactgatttatctgtctgttctttaggcaataccatatttttttgatgattgtagctttatgggcagtactgaagctgggtggtgtcagtcctctcatcttcaatattgtgttgactattttgggttttttgcctttccatataagctttagaatcaatttgttgatatgtataaaataagtttctgggattttgatttagatttcattgaagctatagatcaagttgggaaaacctgacatcttgacattgtttcctattcctattcatgaaaagtatttttcaatgtatgtacttctttgattttgtttttgtagttttcctcacacggattttgtatatcttttatagatttgtacctgattttattttgggttgttcttaagcaaaaggtaattttttttcctgtgtgtgtgtgtgtgtgtgtgtgtgtgtgtgtgtttcctgtggatttttttttttttttgagtctcgctttgttgcccaggctggagtacagtggcacgatctcggctcactgcaacctccacttcccgggttcaagcaattctcctggctcagcctcctgagtagctggtattacaggtgtgcgccaccatgcctggctactttttgtatttttagtagaatcggggtttcaccatgtttgtcaggctggtctcaaacacccgacctcttgatccacccgcctcagcctcccaaagtcctgggattacaggtttgagccaccgcgcctggccagtattgtgtttttaatatgaaattccacttgttcatagctggtatgtaagaaggtgattgactttggtatattacccttgtatcctgcaactttgcaataattccatattagttctaagagttttttatttagttagttatttttggagatggagtcttgctctgttgcccaggctggcgtgcaatgacgtgatctcagctcactgccacctctgcctcccgggttcaagtgagtctcctgcctcagcttcctgaatagctgggattacaggcgtgtgccaccaagccttgttaatttttgtatttttagtagagacggggtttcaccatgttggccaggctggtcttgaactcctgacctcaggtgagccacctgcctcagcctcccaacgtgctgggattacaggtatgagccaccacacctggctgttccaggagtttttttgtcaattcttctatattttctacatagacaatcatgtcaccagtgaaaaagactattttattcttccttcccaatctgtgtattttaattcattttctttatcttattgaattagctagtacttctagtatgatgttgaaaagtggtatcaaagagggagcatcataaccttgtttttatcttaatagaaaagctttgactttctcgccattaagtatactagctgtaggattttttgtagatatgatttagtaagttgaggttccccactatacctagtttactgagagattttatgatgaatgggcattggattttgtcagatgctttttttttgcgtgtactgatatgatcatttgatttttatttattagcttgttgatgtaatggactacatgagttggtatttgcatgttgaaccagccttacatacatgtgataaatcccacttggttgtggtgtataattctttttatacgttgttggatttgatttgctactgctctgttgaggatttctatatctatgttcatgagagatcttagtcttttgttttcttgtattgtctgtatctggtttgggtattagcacagttctagccttttagaaggaatgagaagtattctctgcttctatcctcattttagctggataaatgaaaaaataatgtgtttacttaaatttagtaaccatttcaccgacatctccttgtatccagtttcattcaatcagttgccattactattgaattatatcacaaaaatagaggagcatttgaaattccacccacccatgtttgttaatcagactgatcagtttattcatgtttaggttctcagcctaagtttttctgtgtgcgttcttgtttttggtacgtggctatcaaagtattctgtacatagttgtcattttttaaaaaataggaaaagagataaatctatttacaatctatctgcccatctattcatgcataagtaaaggttatttatgttttgattatgcctttctctcatgactaaagagtaatcttgttttgttctttttcatagatattttcttgagtacataaagcaaagcaagtgtggtgtttactcttcaattttggaagagactctctatgtgcagacacagagagacatcacattgcataaatgagtgaattctttattttgtggttatgatcttatagctgtttttcagcttgtatttaatggaatgtatgcacctcttctcttcaaaacaattgtgttgtcttgggctgctactgcctagaattctgtagaaatgctttatcgcgtgaaatgttaccttattataattttttgtattcttctgtccacactacttagtgttttcttctccggctccccctgaggttcatggttggacagtacactgtggttcctgcttaccccagtctctgttgtgagttgtatacatttataagcattaaatcaaatactcacctgtaaaacgttcattaaaatacaccttctctacaatattattggaaagtcaaaatggaatatttcaaaaattgaaataatacaaaaataaaaatactatgatacaaaaataaaaatactgtaaaaccaaaataaaacaaatatccatgagttcatattagtattaatacatgatcaaataacaaatggtggagaagggataatgcctcattatataaaaatattactatctttagaactcgctactctggaaggtgaatcttaattccctacccttgagtagggaattaagggaattgagtaggctggacaaagtgacttatttccaaaaggtaatatatgaaaagggaaaaacagaagtaaatttacttttgagaatcttggcagtaagaaccttaaccaaatgacaaagattaatattaccacgagaaattttgttgatatcatgtaccccttgatatgatgtgatgagaagtgcactgcacttctgtggcattcttccccaaaatctatagctgcagtctcatcatgagaaaaacaggaggtaaaaccaaacggagggacctcacaatacctgaacagttgtcttaaaaactgccaaggtcacaaaaaattaggtaagatgaggaaccgtcacaatttggaatgaagctaaggaaaatggtgactaaatgaaatatggtgtcctggctttcatcctggaccaaaaaaaaaaggtgacattagtggaaaacacggtgaaatctgaattatgtctgtagtttagttcattgtaatgtactaatgttaattgtttgcttttgagaaaagtacaaatggttatgtaaaaatgttaacattaggggaagtgtggtgaaggttacacaggaactctactgtctttgcaacctttttgtaaatctaaaattatcaaaattaatgtttatcaaaaaataaaatattatgagtacctcaaaacactcctctccgacttatttctcattccccacaaacgatgcacattaaaataaccttgatcaacaaatgagtgaatgttgacatattagaatatgctctgatgttacataaatccgaggtgtttgttacattcattcatattgtaaaagtagcatatgctcattataagtatcagaagaaatgaaatcacccatattttgttttaccatccaggaataactactcttaactgtttatacttaaaaatcactttacaaatgtatggttggtattttatatagcatttgatttatgctgcatgttttattttatacctgacttttttttttcatttagaaatgtgttattacaccattctcggagaaagtgacttttaagattgtgtaagcaaacctgctatgtcaaataggatttccaattattgtcttccagctccataggtcctacaaccctctatcataccccatttgagttagtgggattctgtccttccagttgttagcaaaaatggtactcatccttgacaactcttgtttctcttccacccacatttaatctatcaagacattgtgttgattctacctttaaaatatatccagaatccaactacttctcacttactcttttacccctcaggtccaagctcatcatctttcccttttgtaactgtttgatttttacgaatgtaacacagtttattctcaatgtaatagtctgagtgattgtgttaacaaaaattcatgtctttcctccactcaaaaattttccttggcctatcttaccactcagagtaaaaccgaagtccttactatgctctgacattctttctgatttttttttctgatttcattgtctagcttagtgttgggctatttcttatttagagggaatctgagacagttttcatttctgttttactgtggaacattccatcttgtggaaagtgatgtgaaaattacctttcaatatattatttccaagatgtccttgtgcatggaattagttgcacagattgtgggaagttttgtagagggaacttgactttgctctgagaaaggacagtgtgtataaaacagagttatgcaagtataaagtataccttggtagtaggatcttgcagaagaaacaagactttgaagtggtggaccataataggagaaaaagttagccctaaataggattttccaggaaagaatggcagagtacctaatacaatattcttagaaaatatacaccaaaagtttgtttcaggaatgcaacaatgattttaaattttctctttttttctgaaatcaagagaactgaaataagacaaatacgatgttttaataagtgaataaccataagccaaagtccttaagtcaaccttttagtttctaatatacatggaaacttaaccgaaagggttttgaaagctacttcataaattctctccgttatgaatctatattttgctgcttttattacctcataaattctggagaatgatttatataataatgagtgtccttgtctctccattgctgatcaagagagcaataaaccagtttttatataaaagttataatatttattctgctactgtctgaagtagtttttacttgagttatgtcaaatttccactcttaggaaggttttcgattttacatttggaaaaaaagtgatactgtaaaatgccgtttgatgaaaaatacctaatatattgattttgtttcacataaggaatcaaaataaatgtgcttcaggcaaaagagtctatctacagacacgcataaagtaaacacaactcttggagggatcattatgttaaagcagtgtgttttattacctttctactcaagggggtcaggggaccagcgcatctttttaaatgagtaattgccatttaaacgtgcatttgaaatcaagtgtctttcaaaaaagtgtgagatttcaccctgtatgctagaaaaaggcaatttacctcctaaggttagattagaaaatctattctttctccctttgcccacttaaggatgctgctagcaatgtgttttctcgcatatggataatgactctctctcacaatttaacctgcagaattgctagtcatacttagctttcagctccatctgcaccgtagctatcctgccctgcttcaagtccaggaagcagaacagctcaagaacagagggcagcagctagtttatgctgcttagggggagagggactctgtgtgtcctgtttggttagcacagaaggctggcagaacagagcatatccttcccacttgaacttgcagaaggaaaaaggatctcgaaggtcattaaggtacttctaaacctaaacactccaaaaaaaaaaaaaaaattggagtcaatttcagagtaacttttacaagtcgtaaactttgtaattaatataatttttagtactttaagaaaaatactgtaaagttatttaaaaatgacttatagtctcctcatctgtaaaagttattttaatttgatttgatttatggaaatgtgattagcagacaatctttagatgcttaagtgtgtctataaagaatatgtactccaatcctattctttctgttgagttactcctaaacaacacaaaataagcatttcgttttgttttgtttcattaaaaaaaatgttcttagagagtttgtagttccctttaatagcccaatctttttctaactttacgaatttcttttcactttggctgttaactaccctctctcccacctactttttcttttgcaacactacagcaaaattgaggttagctagtagcatactgttagtcattaattctgcttttaaataactgaatggttatatgttatttccagtctcctttttgattcatgggtatttatctagggattattaatagagagaatataggaatgattatgacagaagatgttcctatgctcaaaatgtcgctcttcaaaatcagaagcctcttgaaggatataagcaaatgttacagaaaacatgcttcaaatgtcaagaaaacaatatacaaagcaaaactcttaacagcaataaatggatcattaaaaaactttccctgcaggtggatatgattaaaaataaattgatttctaacagtttttgttttccacattttcaatttcatggatgttatttttggcctaatattttagataaaataataatcaccttgaaagctttttttcttccacagtttataacctttagtattcataagtatggcaggaacagtaattgacaaatgctttatgtttatgtgcatgtgttagtctgtatgtttgtgtgtatttaattactactgttatccagagtacttaggcaaattctgtattcttcgtatatgattatataatgttctaaaaacattcacttttttaaactataaaagtcatattcagaagatttacgtataaatttatatctcttctgccaaaaaattatacaaccatagggaaaaaatgaaacacagtttttccttttaatcaaagatgatttttaagcttgcaaaactatcagcaaaaactcacatatttgtacctaaagagatgttagattgaaggaaaacttgtaattgtctaacctgattatttttatgatttacattgaagaaaaacaataataatttttaacttcgttatatttttatgattttaagtaattgcttatgtaggtattgcaattctgaaaggacaaaatagtcatggatgtcaaacatctaagatctttttgaggtacttgtcctgtcttgaaatacacaagaatttatagtgcttagaaaaatgaaaatgcattattcagtttttattgtactctggcttttggggatcaaaaagcagaaaatagtacaataagactacatttcattatcctgggatttgtatgtattagaaagaacactttcattaattacacttgatatttttatagtttatatactatttatatatgtttcctgtagggatgttagaaaacttttcaaagtgtagtctagataggattttacagctttctgtaaaaggaaaacaaattgtttctttgaggccatcaaaattattacttttctttctatttcacaattgcttaaggttgcaaaccagtaggacttctttcctctgtgttttttaaatgcaatgtagatctgatacaaatgtccaaactcaggtacttttgaactatagcacaactgttattctatacctgcactaagcaaattgcctagtctagaaagtgtgaatagggcggtatatgtacacaaatagaagaagaaaaagaagcttaaacatcttcttttttcttttgcaccgtatctttgggaactttaacatagctctctcattggaaccaatttgtaggtatgattaactgctaacaagtacttgagatattcttaattcaattatcttggatgaggtccaaagtaaactggcctaacatctataatcagtgttacaatcgtgagatgtcagagtatagtatatgtgttttcaaggcatagtaattaaatatggagacataaggctgaaaggagtgacttgctttataacactatatattacagtccctttgaaaagtaagcagaccactgcccttatcactgcagggacaaattcagttgtgatggtaatttacacctcataactttcttttatgacatccatccatcatcaacaggaagtctgtacacagtctaaggaagtttcccagatatgacattctgggtagggctcccagtctcctgaagagagtaatgcaaccaatggtcacgggaaccacttcaccttaacagctgctgagtcggccctacataaccctcaacgtccaggatgctatggatttttaaaacatttcaatcattttcatcagcaaaaggaaaaccaacaaagctaacagtagcaatagtcaagggatcctccatcatcattaagactgtggcttaagttttcttggatcagttattgtataaccttgtcagtcaagcaactataggatgacttacaggatgacaggtgtaggatggttttcaaaagtcgcattgagagctccattttatgcactactaaactgttggatactgttagtagataatgggaagattccatagtagatgaagtggaaaggttaattagcccattgtgattttaggagtatctgtctaccaacatcagtagacatctgatttttctttgttgtttccctagctccaaggtggtaaaataatgctaacaagacaatttattcaaattacttggagacattatacacaaaaataaatttgtggcacgtattagtctgcttgggctgccaaaacaaaataccacacactgggtggcttaaacagcagatatgtatttctcacaactgtggcagctgagaaatccaagatcaaagtgccagataattcagttcctggtgagggctctcttcctggcttgtagatgggcaccttcttaatatccttatgtggtggagtaaaagtactctcatgcctttttcttttcttataaggacactagacctatcagattagagccctatccttatgaccttgtttaacctttatcatctcctcagaggccctatatacaaatatagtcttgttgggggttaggacttcaacatatgaatcttgaggagacacaaccatttagtccataacagtatataaataataagattgatatattctattgcacttcttaagaactttacaacttcagcaagtggaatctttggcaatgatgactgatttgactcttgtctatgtttttgttttttttttccctaatttaacgtccacttagaggattagctctgcccaatgctatgggatcattcttgttctgaaactaggaacagctaaagaccccatgctagttaatgcttagtctgagtgtctgtagtttttgctctgaatttctactcaagctctacgagtgaggctccttcctcttatctggtccagttctttatgtgaactcaagtaactagatcctggtcttatctattcagtgctgtaatacataccttcagggtggctgatttactcagccactcaaacccattgtgggataggggtacacaggtgagcaagtgcacgagctggggcaagtgcctttgggtgctggcaggaatgaaccctgtaccggcctgcgacaatatctagggttgtccatgacctctggagccccagagggtgtgtggtacaaacaattctcttttagctttgccactgcacacagcttaagcgttaaacactcagtgaagactcagtgtgacagactttttgggttcccgcacccagtgtgtcccgaattcttgtccagaatccaggaagaatcaggtcacacaaatggattgaagggtggtgtatgcagagagttttattgagcaatggcagtgactcttaataggatggggagctggaaaggggatggagcaagaagataatcttcccctggagtttggctggggatgaaccatagtccccaatgttcagctgcctcttctcctctcaatgttcagatgcttcttctctccttctctgccgagccactctgcccctttgccaggggagcttggggtttttatgggtacagggcaaggtgtgtggagggccagggtggttttggaaaaggtatcttttggtcgggacaacaggaatgcatatttttatttagggctgtgagtccaggcttgagggtggagccctcaccagtgacctcgccctcttctacccagtatttccctgcatcctgtccttatcatcacgaaatatgagacttaagaaagggtaagattattgaaacttatataggatcagagctacagaaagaacaggggtttggggcttctgacgggtggtggcgacgcaagttatgggagggtaatgggggaagtgtatgggtgaacaaaggttgtcttatgatgcagctaaagtctctcaggtaataaaagttttctaggaacaaccctaagaagaataggtgatagcctgtgacaaagtccgggcatgattttgacctcgatctctgctcctgtgatacactcttccctggttcatgagattcccgtaatggggattaatgacaaaatgacagataagttccgctttggaggttctgtcatcaggtaggtaagagaacttatgagaaggcctctgccctgcccttttggggagaaagatgggtgagagacaggagggcaagagaaggtcggagaagctttggttctcctttaattcaaagcactcagcatgccaaagtgccatactttgcagtgtcattctctgaaccccaaccgtgtcctaaagataaagaggagttagataagtgttgggaggaaagcgattctggcagagggaaccagacgtacagagcattttgaagaaggtagtgtttagctaaagcatagattatgagagaggaattagttttactttgttttcactaacatttttcaggtattggaatttagatattcaatcccatttttgtaggtttatttccttctgctccctgcctctattgctcacatcccctttaactgctgacatcccctttaaatagcatcccctttaaccaaatctctgttactcgtctccccttaatgatctcttagtagctaacctatacacatgttttctgaccagatgaaataactttcaggccatctaaacttcagttcacaccaggacagatctatgaggaagaggaggcagagcctaatcatactacatggatacatatgtgcttcttcacaaatgctgttgtctaaagaaagtaaccaatccagattgatggcagagtttatcttaccatctgatttaaatcctgctgtacaaggctaacagatgtgacaattcctgaggtcctattttatgttccttctacatcaccatatggcaaccatatttatatggtcagtattagacatatactcttcatcaagaattatttccaatttagaatgatttgaggagatttgctattgtatgcaggcctatggctaaatctcaacaagtaaagccaaacaaaattacttagtttgagtgacaaagggaatactgaacaaaagaatttaacattatctgagaagaaatttgttttaagatgttaattggaaaacaaccttaaacaccaattgaacagaagtgttttgacttttcaaggggtcattgtagacttttgagacaaatagatgttgaagtgcaatattctgattataggtttatacgcttggagtgaatcaatatatgtacttctatttgctggtagcttgctacacttctgaattagagtacaaatactataaaatgtgatatcttctatggcaaagaacagtttaataatatgaagaatccagtcatctgcaatagtttaaaaatggcatagaattcaaatagctcacaagtcttttgacataaataaaatgtaataactttcaaacatttcataggtagacatgcagtcatcaaaaagaataatacaaaagtgacatgacaaatagagatttaacaatttttgctcatgtgatgcgttttccttttatacttaacaccaaatcctgtgttatcacaagtgaattgtataatttgggtttctcttcacctttctgatttttattatacagttgactcatgaacaacacaaatttgaactctgtgggcccacccataatcaggttttttcagccaaatgtggattgcaaatacagtattttctggatgtgaaatccatgtaataaggaaggctgacttttatatatgtgggttttgtaggtccgactgtaggacttcagtgagtctgcatggattttggtatacacaggaggtcctggaactaatcccccacggatactgagtaatgactgtataccttatatttctgatagttacagagaagagaaaaccaagatcagtgatgctaaagcgttccaagtgaaaatgccagttggacaaacttgtaggaaatttgagtttctattattcatctaacatatatacaaattacttccctttttttcttccagcatctttaaatactctatatttttattacatgaacactttaccgggtctctctgactcatcccaatctctcttttctttgaattctacccattctaattttataactatgcttttggaagcttacatttttatatgaatgttttatatgcatcttctttttctaaccatgcaggagctatatttttgccctattaaagtgttaaacttggagcagcactcagtgtgtatatgctgagtcgttattaggctttcaaccctatcatttctaggtgtgtgtaaacctcaatgtggtaggaaagtttgggaagctggcctgaatgaatggcttttcttacttatttagttaagtcctcataggctaaggatttttccccttcctgccactccaaataggttgtgcttttgcctcagttcttaaaaagtgaaccctgaacttgcttctagtcttaccagaacattgagccaagtaaaggagagatgcaaatagctatgggctgtttttatttaaaatctctaccccatgggtgtttcttgaaattggctagtctaacttgtaaacatctgttgcttagacttcttagtctttgcagttgatgttttgcattttagaggtgatattatctcagttgtgatgaactaagtgggatgttaataggaagaaaaaatgatttttatagcaacattgcatcaagtaaaactaggttgatagagaatgtgagaacagtaaaattcttcagataaaagaaatagcaagcagtatatgcacgtggtcttcttgtcatttcaatattcttcaaacccaggcttcctgatgagggcgctaatgaagaatactgttggaattatcttttctaaaggcattttcattctattaccaccccccacgccaccgccacacacacgcacgcgcgcacacacacacacacacataacacatgtctcttatttcctctttcattcacaaatatccactctattccaggcactgtactggagatggagataaacggatgaacatgtccttatcgcacattcagtccagtactatgtaagatggctaagagcagaggaaaattgttgactaggaatacattctttatttcagaattttatgtcttggttgaaaggctaataaattctaagtgtgcttttatctcttcctaaatcagcctgtgtcatctgtcaatacatacatatccacagtagtgaacacgtgtatatttttaatgaacatgtaccaaaggaaacatattctgccatctctgaagacatttttatcacaagctgactttggggaattctgaatatatgcagtgccaatatcctgaaaggtggtggaaagggattagatcttatagcagtaatggcttcattttccttagctcatattaaatctttcagccaaacagaaaaaaaagtaacatatacaaataattgtattgctcagcaaagggatctgaaggatgctgtattttgattcatcaaaccaagtggcatgtatcccggcggatggaactttctgcttggaattagaagactagtgttctgaggcctttgggaagaaaagaagaagaaatggaagatggatgtcttattctactgcttattattatgaacttgagtatattacataacatttgaaggatttgtttccttttctttaagacgattaaaataaataccagttttgtctcatgaggatcccatttgtgagaataactcataaacagatgagaatgatacagctctatctttgtttttaactattggccaaatattacctaaaacttttcattttaattttaaaattgctgtatctaaaatccaggcctatcagtctgaagtggtgaaactttatactggctgcagtttataattacctaaaaaatcttaaaaaaatgctgtggccttggtaattgggatggtacggagcttgagaatcttctgtctttaaatctctccttgggatccactgtgcagtcaggttgaaaattgttggtttaaagtcaagtacttcaaacatgagcacctttatatatcaagcagcagcgttctagctcctagagcagtaaatgctatctgtagctaagaattaaataggagatattctttatcgaaaagccatcataaaggtggacactgttaagtgaggaaagtggaaatacttcctcaaagagtatgacactatagtgactaaactgtatacatttactgttatcgtgtggctgaaagacaaaagatgctttagaaacctgtactggagcctagagctttgattgataaatagccatacccagcaatgagagaccaaggatgaagggatgaagaatctgtagaccactgccaactaccgtatgattctaaagtgtgaatatttgcatgctacctgatatggtttagctgtgtccccacccaaatctcatcttgaattgtagtttccataatccccatgtgtcgtgggagggacccggtaggaggtaattgaataatggagatggttgtcctcatgctggtctcataatagtcagtgagttctcacaagatctgatggttttataagggacttttcaccctttgcttggaatttctctctcctgctgccatgtgaagaaggagatgtttgcttccccttccaccacaattgtaagttgtacaggcctgtgcaactgtgagtcaattcaacctctttcctttataatttacccagacttaggcagttcattatagcagtgtgagaatggactgatacactgccacagtctgtttaaggactggggatgatttgactgagccaaagggtgtgtgcttactttcagagtgcacccgtactttagaatagacagaattctgggtcattggtgatatctctttaatatatttcataccagcattcagatttggagagaaagagctgaaaaacacagcatgtctgccagttttaaagagttcccactactacatccacaaaagatagaaaagttctaggacttagtgatatttctgccaaattatttaagctaaactttaaaaatcatatgacatggtcctccctacttaaaacatttctataattctcagttttctattgaataagctataagcccattatcttgacactcaaagcctttggagattttggcaaccagatttcccttaactttgctgtacttgctccgggaatcctacactgatcctgatactatattagtttctcttttgaactcttgtactactttgtacaacttttagataaactgattcactcatctttatattattttccgtcacttttagttataatagaattaatactaataacagctgtcttctttcagaagctgaccttgaggtaattcatgtaaaaatgatagacgaggaagtgttcctaggaaaaaaccagtagcagagttgggaagtagacatggaatggcaggaagccaagcaatggtgagagatcctgtaaaatcccaggaggaggtgggtgtaatgtaacttagttctgcaaggtagctctgcagatagtctgaggctcaccttagagtcccacttaggaagccagggggatagagtctttgtacgtccctacccctgttagtcattagctacaggcagaagtctgggaggtggcatgaactccctgcactttcctatctctgtgggtgtaggcaaagcagtttcggcagtctgcaggcaactttgcgacaaggagctacagaggctgggggtgggtgccagtgtgcttgtagctggagtgcaggaagctggtaaggggagacaaggtaatatgggcagggtggccaaatattcttttaacttctgtgttaaattacttcttggattggaagctgcttggaagcagatatgtatccctaattcttataataccttatctaaaatattaaaaataatgctttcataagtattcagtgattagatgagtcagtgtttattattatttacaattttctttaaaaaaatttttttgagacatggtttcactctgtaactcaggctggttttttttttttgtttgtttgttttttttttaactttctgtggagatgaggtctctctttgttgcccaggctggtctccaactcctgggcttaagcagtcctcctgcctcagtcttccaaaattctgggattacaagcgagagcccgcatgccgagctgctttttttctttaaatgtttctaactgtagaacatgtgcactgataatcctttgggatgtgatcagatctctctcctggtgctcatttcagaacattctcctgagctcaaacagcaatgattgaggaaccccaaattagctgttacacagagagctgacctaagatacctcagagtagaagggactggatcacatttccccgcctaactggctgataacacttgcaagctgctgaaaaaaaaaaaaaatatatatatatatatacacacacacacacgtatatatttttttcccctccaagctaagggctactggtgggtctaccagtcaatgttatcaacaaagagaagcagttagaattgaggcaatgagtaatccaacgacattttatctatgttcttgtgggaacaatttttatgtgtttagtaggctaatttagtagaaggtcttctttaccagagttcacttctaactttgtttcactttgtaattttattttaaatgtagttttaattgacaaataaacattgcatttatttattatgtacaacttattttgaaatatgcagttgctaaattgagcgaatgaacgtatgcattacttcacacgcttatttttttgtggtgggaacacataaaatctactgtctcagcaattttcaggaatacagattgttattaactgtagtcaccatgttgtacaataggtttcttgaacttagtcctcataatgaaatttcgtatcttagaccaacatctcctgagccactggtaactactctctatttctattagttcaactttttagattccatatataagtgagatcatgtggtatttgtttttctgtgcctggcttatttcacttaacagtgttctccagttacatatttttttcgtaaataataggatttctttcttttttaaggctgaattgtattccattgcgtatagatatcatattttctttttccagtcatcatccattgatggacacttaggttgattccatattatggctattgtgaatagtgctgcagtgaacatggaagtgcaaatgtctcttcaacatactgatttcatttcctttggatatatactcagtagggggattgctggatcatatggtggttctatttttttttttttttttttttttgagacagagtctggctctgtctctcaggctggagtgcaatggtgcaatctcggctcactacaacctccgcctcctaggttcaagcagtcctcctgcctcagcctcctgagtagctgggattacaggcatgcgccaccatgcctggctaagttttgtattttttagtcaagatggggtttcaccatgttggccaggctggtcttgagctcctaacctcaggtgattctcccacgtcagcctaccaaagtgttgagattacagttatgagccaccacgcccagctgttttttattttttgaggagctttgatactgttttccataatagccttactaatttgcagtaccaacagtttacaagtgtttccttgtctccacatcctcaccaagacttgttagtttcatcttttttatttatctgatgattagtgatgtcgagctttttaaaaaaatatacttgttggccatttgtacgtcatcttttgcgaaatgtctattcaagccctttgcctatttttaagtcttgcgatagagttctttgagatccttatttattttggacattaattgattttctgatgtatggcttgccaatattttatcccattccatagactgtcacttcagtctgtttattttttaattttcattttatttttattttttttgctgtgcagagattttgaaattcacataatccatttgtctgtttatacttttgttgcttatgcttttgggatcatatcaaaaaaattattgcccagaccagtgtcatgaagctttagccatatgttttcttccagaagttttagtttcagtttttacactgaagtttttacctcattttgaattgctttttgtccaatgttataagggtccaatttcatttttctgcatgtggacatccaccagtcccagcaccacttattgaagcgacaacatgatcttttgatatatgtatacattgtagaatggctaaatcaagttaattaacatatgcagtacttcacaaacttctttttttttgtgatgagcacttaaaatctactctcttagcaaatttcaagtacacagtatattgctattgactattgcacctctgatatacaataggtctcttgaattttttcttcctgttcaactgaaattttgcatccttcagctaacaccttcccagtctccccaacctccactgttttactctctaactactacatgatccagcaatccccttaactgagtatatattcaaaggaaataaaatcagtatgttggagggatatctgcagtcctgtgttcattgcagcattattcacaatagccataatgtggaattaacctaagtgcccatcaatggatgatgactggataaagaaaacgtggaaaatactattcagcctttaaaaagaaggaaatcctatcatttgcaacaacatagatgaacgtggagaacattatgttatgtaaaataggccaggcacagaaagacagatactatataatctcacttatatgtggaaatcaaattcttcttatcccttcctgaactttactataaacacacattgccacagaaaatccaaaaagaggtgttgttgtgtagagtagatgtggtgctccgtggaaatctttggaatcaagagaataaggcaaatatgtgctattatgtggcattaattaaatgtttctaaatgttgtaccatgttttacagatgctagtgtgatagccccaagcattctgtagactttatcatcatgttgagtatcatcattgatgtttcctaaataagcactatgattcagagtcctcatgtcttgatactgtgtgccacagagtacagtaaagatatatgttttaatgtgaagagcaagaatctttttttggatcagtttcctataactgtttagctttatcttggaggaaaaaaatgacttgtattatgacagtagaaatttagtaattacccctaagaaaaaagatctttcttctttcaccttaagcttactcagtgtaagtggataaatgccaaagttctgtaaagtgcaatgcattttctatacataattcacaaatctacaatagaaaaattgaatggtctctttggcgtgcagcccaagtagacagtgaaaacctatgggaaatgtaatattaataaaaaagcagagaattagacctgacatttcggtcattcattctacaaacatttattatattataatgaaatattagttattgcattatcagataagcagaaacaaagcactgtgttagaaacactagccttttcattgtatttatgaaaacataagaaaaaaagaaatacaagtgacattcaggtacatggagtaatgacaaaaaggaggagaatattcaggaggaatattcaggaggaatgacaaaaaggggggatgatatagaaaaatcagactagcaaaataattcatttatgtgatttctaatatttatctgcagtttacatttgaatgaaattgtaaaagataaatttccttttttttttttttgagatagaatttcactcttgttgcccaagctggagtgcagtggcgctatctcagctcactgcaacctccacctcctgggttcaagcaattctcctgcctcagcctcctgagtagctgggactacaggtgcccaccaccacacccggctaattttggtatttttagttgagacggggtttcaccatgttggtcaggctggtcttgaactcctgacctcaggtgctccgcctgccttggcctcccaaagtgcagggattacaggcatgagccaccacacccgcccgataaattttctttccttactcatatattcctcttagtacaaggtaaagggtttaaagatgaaccatgagggaaatttaatttcaaagatatatgggaatcggtgctttcaaaacaaaatttgaaatatactttgttatgcctttttcatgctgtacaaaatccatcatttataaagatactgattctgtcagtgcctcttttcaacacaggacataaggcagagcaatcaaaagacattttaatttttaaaatgcactcatctgcttttccattgcctttggtagcttatacaattttagaacatatgctgcatgccaagttgtctggctttatcttatctgtagaggaaaaatgtcaccacgataatgtttgactgtttgctggaaatggagattttccatgaatcaaacttattatgggtattaaaacattaacaatttttattattagttaaataatacattaatgctacacttaagtacttttatatgccaggtgctgtgccaaatgtttcacatacgttattacattttatcttccaagcaaccctacaaagttctcatcaatatccaaatttacagacaagtaagattagccttagagtacataagtaacttgtgcaaggcccttcatcttaattgagaagagctcaaggcccaagcaggaaggtgaagctctgtagtctggagggtgggtgccctcactgaacttttctgtgatggaatcagaaggtcattaactttattaggtcttcaggtttttcctagaaggatgctgaacactgaggtggatctaaaggaactttggtcttctgcgtctttccttggctgagacaggacaccagtgactattctttttctcctggcattatcactgaaatgaaatgattctcttcactgtctttggagcagcattcatacctctactctgtccgaatgtcattatattctaatgtcaaagtcagttggacagctatgagtttgaaaagtgataaataaaatagcatacaagaaaatagtataaatgtattcctttacataaacagatttaatataatatatgaaatttgcattgttggaaatcagttctttgccatgggttttaaatttatcgcatttatgaattttcctaatggaatttcatctctaatttttataaattaaaatattgtgaacaaatattattatccttctgttgcaatacatatgactgaggcaaacagtgaaaaatattcttggctgttttaagtctgacatttagaacccgggtggcacataaaaaaatactgtcaatgtgacatcatatttcccactgattccggaaactaatttaaatagcaaacacttaaacttgtattttatatgaatgtcattttaagaagactttgattattgcaaattgacccagaagtgatgagtgtaaagagatattatctagtactgattctttgtggttgggtgtctccatacttgtcagagcaccatatttgccacccagctttgttgccagactattatagaccagccacggttactgcagttttctgtcagccacccttatgtgctgcacatgccatgtctggggataatggaaatgagacagatatgctggtgtttttgcattaaggaggcagttcctgagtgacaaggctatttgtgtatcctgcatataaaaattgcctcacaatgtctgagttcacatggattcaccatagaaaacttgcataaatgccagaaaattaattgcactgctgagacgtatggtagaactattaaaatgatggctatgttttgaggaatactaggttggccttattacttgtaccctgcagggtgtaaatgcagttttagcaattatcagggtgatatcattttgaagtttacaattaaaagcactgtaccctcccacaatatcttttaagattttatagtttcaaattatccatagtttaaaaacaccaaactgggaataatggttaagatgttgcctatatccttgatttcttttgatttcttactttttcacttatcataatgagctgtcaaatttgtatggcctgtttattttagaccttgcaataaaaccccttcctttttttcctcctagacatgtagaactaaagaatgtttgagaattaactagaagtctcataactttcctgacagctttttgatcctataactccaacattatggatatgttaagaatgttattgttaagccgagaaactgtctcggaatatagaataaatttttatatttaaccctcagtcttgtaatatttgtaatgtaactttgtgattatttggttttcacttattcctattttagtgaacagtagttaataaaatggcttctgaaattatcatttgatatactgaaaattattaaaagtagccattggcatataaatgtttctctttctttggatttactctatatcgtaaagttggtaagagctttagttgttgctttttggaaaaaatgccaataaacagaatcttgcctcagggatatctagtttacagattacaacaaactatttaaagataaatttgtaatggattggaagaaatgaagtgtttctcactaggggttctgttgaccacctatatctgtgacaccccatgtgcttgttaaacattcagatttggggctccaccacagccctacagaatttgtgggaggtggagccggcctctctactataacaaacccccaggttgttgagcctgctcaagtttgagaattgcttgtgtcttttaataccttcctctcctaattaaatcaatttaatcacataaacaataaaaataactttctgattgatttctggtaccaaaagcatacaaacaaacaacaacataagacacagtggggttgctaattttccttttctgactacaataatcaaatctcaatttaattgtttatctttttttctcatgtttttattcctcatagttgaagtataatactcttaatcttttatttattttgatatggaagtataatggactgctttaacagtctgggaaagctatgaaacctctgtccagaaaaatgcctgtcacatttttacatacagtgtcaggggtttatggaacccctggagttcatcatggaccctaaaataagaaaccctgtaccagcaggacctcatcatttaaaacaagcctgtgatttagattttttttttttttgcatatgtgatgattattggacagtgcgaccaggggcttttcaatgtgtatattatttacttggtagtctgtaatggttcctaaggggctataagcttgtaaagttgtaattatggaattaaaaacaatctatacagtttttcagatggttcataatagcaccaatgtgtataaacatgcaactatgtttttttacagttatatttaagcaataggccataataattgaaaatttttattttttaagttcgtagaagattaaacgtggagaaaaaattatgtaaaaccagagcccattgtcttaccttatgtgatgttaagacaaaattttacatgagaagacactttttattctcagaaattcatttaatgcagaacaaaacacatttatttaagatagctcttctggcagttcaacatgcttaataaagacatgtttaaataactgatttcttaggaaaaaagaccatacatattgaagcagaacactatcgattgtattcatcaggcacactgcaggccagaagatcaaagcttatgctttcataatatcatttaacctctccaaaatgtagtcagctgccccatatgtcagtgcaattgtatttgaagagtgagaatgacacagattattggcctgacaaggctaacctcctaaacaaagacatatcagatttatctgttgacttggagagatagtgtgaatgtgttctttcttctgcagtttagagagtatattagggagatatgaaactgataaaactatccactcctgggaagaaaggaatttaaatattttcacatactatgtgtggaactatccttcctaacattattattattatttttttttttttgagagggatactcgctctgtcgcccagactggagtgcagtggcgtgatctcagctcactgcaacctccgcgtcccgggttcaagcgattctcctgcctcagcctcccaagtagttgggattacaggtgcccaccaccacacctggctaatttttgtatttttagtagagacagagtttcgtcatgttagtcaggctggtctcaaactcccgacctcaggtgatctgcccgcctcggcctcccaaagtgctgggattacaggcgtgagtcactgtgcccatcctctaacattgtctttttaattttcaaaacctgttttatagatgaggaatttgagggagagactatataggggaaaaataatttttccaaatacatatttacatttaagggacaggataacatggagttatagaggaatacaggatagaggtcattaaagcagaaagtactgcctttagagctatgcaaatagttctttctttagtagtagaacttggatgagattctaggctgatggacttcaggtcagactgtgtggatcagaatcacagccatattgggccaccatcaaaatcagagtcatattgagtgggaaataagttcagcacattattgaagcgtcagttttgtggaagcagctgaggtcagtactgggaagttcttgaaaacagtgagtgtgatgccagaagatttaattgagaccagtcctgggtaagcagctatggtgatgggaatggatctgaggacaccaaatgctaagacaggtgaactcattttttttagtcattcttatacaaaggataagattttggacatatcttctttataagcacatatattgacatatgtgtgtttcattatatatgtgcatatgtataacttaaacatatatatgtacataaattactagaatttatattgttttaaaggaagaattaccacacagcatatgactgcacaatttagtatacaactaataattaattaatgactacacaattagctcctttttttggaatgacataagaaattcaatcacaaatagaagctattcttttgaattgctattagaattcactgatgctgtgaacagattccatgtgatcagtacatttttccatatagatagactgtatggaaagcaaatcatatcagtgatatgtgggaagcaaaattataatcaaaagattatgtgatgagttgggtgaatcaatgaggctggtcatggcagtgataacagtcatattgcaatgagaccattggagtatttctgttccctccacagtgtttctgttttcttctgttatagacacaccgagaatacattttccctggacttgtaagttgcaagatgttattttaaagaggcagccaattcaggacttgacagatttctctaaatcttgtgcagtagcatcctcaagagcattttgagaaggaccattttagcatgtggtccatccattggtcctgttatctaccccctgtttcatctgtaacactctcacattcatcatgttagaacagggatcatctaggtatctgcctatttacttttttttgtttgtttttgagatggagtctcgctcttgtcacccaggctgtagtgcagtggcacgatcttggctcattgcaacctccacctcccgggttcaagtgattcccctacttcagtctcctgagtagctgggattacaggcacatgccacaatgcctggctaatttttgtatttttagtagaaacggagttttgccatgttggccaggctggcctcaaactcctgacctcaagtgatccacccgcctcagcctccaaaagtgctgggattacagtcgtaagccaccccgcctggccctgttcgcttttgagaagcaaatttgcttgtcaaaaatgtccccttttagttagttagcactaaggataaatcagatgtgataaggaaagtcaatgccacagtggaagcacttctacttgaagcactgaaaacacatctactctctaaaagtacaagatgttgaggagatggtgtctggccccaagaatttcaccaaacatcagcagagcatttactcacccacaggctgaggcaggagagaaatacagatggaagaaaagatgcacccatctccctcctgccaattttttgttaaaaaaaatgctgggaattatttaaaaagtatattatctccagaaacagtaattataaggctggggatgtggatttgattgaaaaccaactgcaccaatgtgttcctagcgtttaaagtaatagtgtatgtattattattatctgagacaggatgtcactctgtcagccaggctggagtgcaatggctctgtcatggctcactgcagtctcaacctcctgggctcaagtgatcctcacacctcagcctcctgagtagctgggactaaaggcacatgccaccatacccagctaatttttgtattacttgtagagatgtgatttcaccatgttgcccaggctgtcctgaaactcctgggcccaagtattctgtcccccttggcctccaaagggctaggattacaagtgtgagccaccatgcgtggcaatagtgtatatattaatctctactgaatttattgaagctttttatatatgaaaaattatttccctctcttctgaccacctctcacatacttttctccctctctgttttgcacttctcatgtcatgtctccttgcctctaattcactcccactcagtgtttgcccctttgagaaagcctaccagaaatatcaactccattttcagaatgcccgcagtatgccagttgtgtgcccaggtatcttcccaacatctctcctccatgccccagcattgccactcaggtgttcttcacaggtatcctgtaggaacagcagaggattagagacactaggtgggtccacatcgatgggctcccaaatctgtgttcttcctataccatgtcacctcctgtgctattaaatgatgtattaggggcagataatggcttccaatgagtgcttagttcacaattaccacagagcctttaagatttctgtctacttgtaataaatacttctaataaatcctgaccaaaagaggctaagtaaatgtaaattgaagccagaaacaaataagaggaagtctatttcattttagtagcatattttagaggtcagaagcaaagctttctaaatatctgctcacagtctaatattatattgtctgtgtgtccaaaattaattcagtctataaaggtcaataatgtaaaatgtattcatgtgttcaggtaaaaatttatgatgtgctataatgtgatgatgtttgactagtttacagtcctggtgatacaccattggaagacatttggaagtgataaaataagggcagatttttgtcgtttctttatagaaacagtaacctgaaagtcatactaaattttattgagagtccatccctaggtaacattaaaataagtgttcgtctctctaattctgtcattttcgggagaaaatctagaaaatatgccaattaatcatgtagttagataattcattttattatcttcatccgtgtagaaaacaccagagtgtgaaatgtaacctgcaagttttattttttattttttcctagattgtcctctaaactggactttaagcatagttatattttacattcttggttaaatttcccctctggtttaattttcctttaatttattttgatacctgttgtatcaaaatgttatttgtactgtaatattgccagttagctggagatgaggaaaattaaataaggttaatagattaaacatacatgcatatgataatttgatgtcaattaatttgtatatctgggaacaaacaggatgaaaaatatattttcgttatcattattattactaccactgacattcttctaaaggctataatataatcaagaagttttcaatctagattccagctttgtcacttactacagttcaaattgaccattttctcaaatcctctgtttcttcatgtataaaatgggagaattgtttattaatttgttatagtggggaatgaatgccagaaaatatatgaagcatttatggggttgcctcatgctccctcatgtcactgaagttcactatctcagaggtgtcattaaaatgtccttctccagtgaccctgcagccaatcctttgcaaactcagttttttagtttttgactctatcttagttttattgctcttgcccatgttatcattttcattccagatctttatcacagcttacatggactatagtagctgcatcctgatgagccactctgtctcctcacttcatcatccaaaaaggttaaacgcagtaacacccttacctggttcatattctttcttataccccttttgctgattgaactcaaatgtagcatcttagcatccccggccaactacagtatggtctctcagttcattccctactgctccatagtttataccctgtgatctaataaactgaactttttattcctatgcatttttccttatgccttacttttgctcatactgttctttctgcccacaatatccattgttactatccatttctcataacctgtctccatgttggcacccacaaacgcacacagcattgttttacactggactctcagagcccttgactttccttctcttatggcatatatcttatctttttctacgtatatgactgtcagtcatgtatctgtcattttcctcctactgtacggtaaagtctttgttgggtaaagatttagtcttatttaccactgagtccctgggagcatccagtgcagtatacatagcaggtagccaatgagtaattgtcttattgaatagctgcatctcaaagagctttattttcctgttattagacctgtaggattctctaggtgtaaagatcacaatattcagagcataagctttaaaaacagctattctctcttgccaactggcctctggaggaagcatcagagccacagataaggacagagccctgtggaggcagagggggaaacatttatgttgaaagagcttttaggatagaagtagatattaaaattaaatgatatagattttagttttataactggattgtaataatttggtaaatgtagagtctgtcagaagtaatccacatttgttctaattaggtttatagataactgtaacaattaataacttaatctggacttcagttttacttacctattcccctcactcttcattgttacttccaaatgaagttttatgttttaccaccttatcttttatacacaatatctatgaacttttctttatgccagcaaattagataattaacgtgtagagggatgaaatagtcttctcagcccttcttggagtttccatcggatcattacttaagttgtgatcagatgatctcacttctgagaaaactgtttgtggctttagtgataattggcaggaaagatgattactattcaggccctcttggcctgtgggcaccattgggagtagagttggtacaccttggtgccttccatactaaagttcctcctggacttacaacaccagcacctaggcccatatgctgctcttaggacaacaatgcagtttgctgagggtaaaaattcttctctcatcttataaatttgggtctcctcttcctctcctgtccactttgaccctttccatctcagcaaggctagtttaccaaagctcatttttttttctgccataacaataatgctatgttataaatccagttatatggctgtcatggaaggtatacttaatgaagaaaaaaggagttcagatttaacacttggtatgcatctttccttctttcagctataaagatcaaaataatcaaagaacatgataatcttttaaagacagatactactacttcctctagcctcaggttgtgttttcttttttgttgattgcttgcttgcttgttttgtttttctttatttcctgttgttgaaagcatgagaaagctataaaaaaacattttgggatctgccagctagtgtctcccagatttctatagcctgttttaaacattgtaagaagtagttagactgaaattgattctagtgttgtgagcttatattgtaaataaataggcaggatgacgtggataacttacagagtaaaattcaatgatctcgactcctctgtttcaatgtcaaataaatcatctttccatctttggactgtaaatgtaagatttattcattgagtagatgtttattgactttattcctcctaccaagtactgttgtctgagctgaagatacagaagtgaacaaaactgagtccctattcttatgaagctaacatccttgtgtagcagacagaccataaacaaatatataacatggcaagaggatagttagagatgtggatgtgggaaggtacattttcatttagagcggtcaaggaaagtatttgtggtaaggtgacatttgagcaaatctgaattaaatgagcgagggaaccatgtagataactggagggaagaacattttgggcagagggaacaataaatgcaaagccctgaggtagaagtgagcttggctaagttaaaattttaaaatatattaagaataaaaattcaataaattgagtgtaatcactattcaagtgttctatatttgcctctaaagctaaaaagtgtgctaactgaatctcagttaacctcctagaaattaattggttatttagaacaattagcaaaaacattatatcaagctttaatcattaaaattttacacagaaatatcttggttaattatctgtgcttttgttgaggttttattgcatttttatagtcatctgtgctccaagaatatgttcacattttttctctaatccttctaattaagttaaaaccactgtccttagaaaagaccattcttttagtctaggacccttttagtaaaaaaagaagaaagtattctttagaatctcttaaaattgtcaataggtctaacacagcttctttcaatgtgagcaatacattgctactgacaaattaatatataaaaagcctattgtattatttatgaaacaagtctcttggatattttggtaattttatcctggtgcttgaatttttttcaaagagataaatattattaatagtttttggacagttgttcaatattaacaaaaagctatatctgatactatattggtgcaaaatatctttatttttaattcattctagaagagtcttgatgtaaagacaactctaaaatggcatctattccagtaagcagtatttttacattctctattgaactatatggaaatctttacctcttttttcaattatttctcataatcctcctttattttttatgattgattcaaaacaagaaattaaatatcgttatatttcacttatttttgttatatgttttattctatgtgtaaactaaaatatttccaaatctttaatgcagttatttcacagcctgcttttaaaaataacatatcaatattcttggaaataaacttcagaattccagatggtttaatatgtactagttaagtaacccctcagggaccatgtggttccatgagtctatgtcaagccattgccattacaccaaaatcaatggtggttggaacaatcaaagagaagaatggctttgttgaatattgtgaaaacaaaaaaatgcatgaataatttgtaatgagagaaaaagacagagtgtgcaaataattggaaacacataaatatataaggcaagattttcaaaaatttgaattgtacaatgtaacaaaatgtattttctcatatgttttaattaggcaaataacctagctctctttgtgaaatgatagaaaatgcgtcacttccaagggtacccatgaaggataccataggtagttttggagtctatctccctagtataaaccataatgtgatttattacttaagtaaagctgacttttccccatggcagttgcaaccagaggtaaacgtctctcatgcatttcactcagtgccgttggttatttagttttctctcccctgtacctttaacatctcttcttgtatttactctttttccctctccttttgacaactccatcctcatctgactattacactgcctgtctcctatccttgacagccacatttcttaaaagagtaattacattcattgtttttacttcttcaagtcccacaccttcttcaacctattataatctccttcctaggcatttcgaaggttctaaggaaacaagctaggattttcattagcaaacataatacacttttttttttcttttttgagacggagtctcgctctgtcgtccaggctggagtgcggtggtgcgatctcggctcactgcaagctccgcctcctggattcaagccattctactgcctcagcctcccgagtagctgggactacagacgcccgccaccaagcccggccaattttttgtatttttagtagagatggagtttcaccgcgttagccaggatggtctcgaactcctgacctggtgatccacccatctcggccttccaaagtgctgggattacaggcgtgagccaccgcgcccggcccacagttttacatttgcttctcttattgtcagcagcatttgaccatgtaatcctcctgttaaaacctgtctaatcccttagttatgatagccttactttctcttatttgctctccctctctggattgctcttttcctctttcctcagaaaccccataaacttggtatttttagggttctgtttatacagtctcccttccctcattctaaaattctcgtgttctcccatagtgactttatttgtaactgtgccttatttaattaatgctgcttacataaatgacttctcattcctaaacagaccttccttctgacctccactattatctgtctgttcccaagcaaagcctgggagatgtttcaatattctttctaaccatccgtatctaatcagctactaagtcttcagtttacctcctgaagatctcttgacattaggtatctctcatcttttatctccactggtgccattagtcatatctactttccactggaatagaataatttctgtaacatatgtaatgccctgtcttaaaaatttgtcagtagccacttatgccattaagaacaagtacatgttcctcagcagagtattatatcatttttggctatgtttatattcttttgtcactttacttttattagccttaagaaagtctgttatattggttgattcgttaaaagttatgaaatcagattactggagctcaagtctaaattctgtatgaattgcacaagttatatagttctcctctttgtttcctactaaaaataccatgagaataaaagtatttacttcacaatattgttgtattaaatgaatgcttgttaatattcttggcaaataaatagggactcaaaaatgttggctattgccaattatatgtggtttccatgctgttttatactatttcaaaatgtgtgtctttgcataaaccatttccctcatgcaagaatgtactttgacacctttgtttcatcattcaagatttacctcaaacatttcctcttctctgaatctttctcaaagcacacctcatcccagctccttcccctttactcagattgctattgaaatgaaagcttttatgatatttgagcatcagtcaattattcactgttgtactgggttcattttttttttttttttttttgtttcagacagagtcttgctctgtcgcccaggctggagtgcagtggcgtgatctctgctcactgcaagctctgcctcccaggttcatgccattctcctgcctcagcctcccgagtagctgggactacaggcgcacaccaccacacccggctaattttttgtatttttagtagagacagggtttcactgtgttagccaggatggtcttgatctcctgaccttgtgatctgcccaccttggcctcccaaagtgctgggattacaggcgtgagccactgtgcccagcctgtactgggttctaattgtggacttccttcagtctcctgcatgaggctctaagctccctggaggcatggctatgtcatatgcatgtctaacccatcaccattgctcaggtgagagtaagactgagactaagtagattctcaaaagaatttgaagtaaaatgaccaaataaattaatgaaaggctgggacatatgtatgcataaattaagcttcacaggaccatttttccataatagtttgccataagaagagtttttgtacgtattaattgatttttaaaaattttcaaactgcttgtggtatttttctgaatgctgaaattgacagttaatccattcttcctgactaccaataagatatagtctccagctgagtttctcagtaatacatgaatagagagtgtgctagtaatatcactgatttgatgaatatgaatatacaaatagtatggtttagaaattaatcaaatttcaaaattatttacaaatctctgcctttactttgtattacctgaatataggcaaagagagaaaagttgattacaaactaaattgccccattggcttcctcatttaacatcttacacattttgtgtagaaataattactttaccacatgaccaactgtaccttgtactcagaactctgcataatattaggaaacattaatattgatatgataattatagaaatcatctgatcagttcttgtttatattttagagatggtgaatacttttttaaaaagaaagaggataagcagaaaaggaagaaaatgacctacatattaatgaagtctgtacattcatcaggaagaattttcatgtcccaaataaagtctgtgattgattggtcatctttaaatcctaaaacatccgaagaactggaagatcctgaagagttatttagttctaaatataaagtgctttaaagacaaattgagaaagacataggcttttaacaaaagggaaaataaacactttggaaaatgaaatttactttgagtagctttatttgtcattaaactcagttactccataaaataggcccacacttattctttcctagacctaattgacctcttatcagaaagtgttcagtatgtttgagatgaaaaagtaatctctaagcttattgcattggtcattagctcttttacagctataaaaccagaagagattatagattttcatcttttataccaaccagcaacagaatgagtgggtttccttctgcagctctcatactcccttcaagagctctcagcccatgcaactgtgaattgatttgaaagctaaattattaactcattatacttgcatccatcctgagttagagtttgttcacagaaaaaataagaacaccatgattcgcctgtcattaaatggcaactgaacaaattgcatagttcagcatctacagggacacgtttgaagtcattcaattggattcatatcaatttcttgaataactgtaaatagcagtgctttctgctggtagggctttgggagaacatatgtgtttctatttagtttacttaaatgaaactctcccaacaaagatattgttctctgtccatgatacccacttaggacaacaaggcatttacttatggttggttatcagtaaaagtaaatactttaaaggatagccctggagaaagcaaagataagtttacaaattttaaggcagtcttaaaagccattctttacataggaaaaaataggctgtctaaatggacttgtgcctgattttccacaaaagtctttcctccatgctgtctttttgtaagttgaaaatattttatcaaaacatgataatctctgcagcattatataacgaataactagagttgggaatgtaacatggtggtgaagagctcagattctaaatctgtaattgtcagtaaacttgacaattatttttttactctgtgtgccagatggtcatttgagcactgggggtataacaggtaagagacaaaaattcttgctcttattgagtttacatttaggtgataaggcagacaatagacaatataaataaatatggtatttcaaatggtgaagtactatggagaaaagcagcctgggagaagggaaagctggtgtgtgttggggggagttggggaaggaggaagtgattcatttcaactctgattgatttctgttttaaatagagtggtcagagaaattcttctaagatgggaggatttgttcaaagacctgaagaagtaggattgcaagccatttagatttctggtgaacaagcattcccaccagagagaacaaaaatcttagtgctgtcactttctgtgtatgagactgagcaacgattgatgttctctaagctttagttttctgctgtgtaatatgtggaccatcctaatgcccgcctcaaaggaatactgtgaaaattaataatgctgttatatatgtagtggagatatatattaaacactgaataaatgttaggtattatattgttatttgggaatttagagtttttctttcatgtcactttattcaactccttcacctattcattagtgcccggtacgattccttgtttgaaataggcagctatagtgaaaaatattctactgttttcagtggcaaatacatgttgagtgcttaagtgctgaaatattagataggagaaaaattgctcaagctcttctttctctgtttttaatgttttgctttactaaagttatatatatagagtgtatatatatgtctttttttaatataatctcctctctactcccattttccaatcgtcagaagcacctcttcaactcttcagctatttttcttgatatttgctccatatacttcagtggcatgcttacattgctgattcttgattttttcaattttacacattacctattcatttcccacaacaagaactggggatttggcttctttctgccatcatatatgtccagtttcgatgtccctatcttaccaatacaattatgtcatactttttgttagatcagtattgtgtggtcatgttgtgactataaagtactcttcacagctgtaccatacatattttttgtttctctttggctttggttcccttttgttaataatgatcttttttattattgatttatttgttcaccacttcatccccaaaattctcccttaggagtataaatttcgctgaaatatgttccaacttcagtgtcctcttagttgctgcttcttggagatgccttgctggagcatttcaattagccatagtctgacctgactgctccccaggtctgcttcagagctagccttcatcaccgtcacctcctagagaccctctttgcctcctccccccagttgaatgctgtttgtatatcccatatatttcttattcttgctttattctcttgttttaatagtgtacatatccaggagcttccagaaaaagggggcataggagatatatttggacacttttcacatctgaatgtctgttccacttacaattagttgcctggatatagacttctcgtatggaagtgatttctccctagggttttgaaggaatttcttttctgtgctttagcttctaatgttgctgttcaaatgtctgctgccattcttatgtttaaaaagttaaacattttatttaatttaaaacatataaatattcattcattgactggtattttagttgtaaagtcaagtttatttctttgaatatgaatccccgattgaatttccttataatctcacatgaaaaacacctgtaatgcatcatctataatttgtgtttcctgttctttaaagagcagtggattctagatttttcatttattgacatgccccttccaattttgacatccttttaagctgatcattttattcctcactgcttacccagtgttgtgctgttctggtagcatcaccaaaaattacaattatgtttattattattaatttttttcatattttattttgcttctattatttgtcttaggttgaattatttggaagtagaacctgaggtgaggattcaagtaaaagcaatttattaggaagtgttcccaattaaaactgctaggaaaatgagaaagtggtcctgaaaaggaagaagttcacatatgagtgtaatatcaaggataatgccctgaggaagctttggagacagtgcagaacacaccttagaattattcggtttactagcagcagccaggttgtttacaaccgtgtgcattttagtcactgggtaatggtgccctgggagggcataaattcccaggctcccaggggtctggggcaagatgggatccagcagcttgaggtacctctctatggaaagccttgagtgctggtgttggactgaaggcacagcaggtactggtgttcatgatgatggttgaggaatttgaggatatatgagcagaccactgaatgaatttgctacattattttataaaaattagctaataagaacccagagttctcatgaacacactacggctcacacaaagatgagttgataatcaccaagaatgctgaaagcaagattactttggtctcagtcaggcactcattgctcttaaatcacttggctcctaatttagattatggggaataaaacaaaccaagagatgtttttaaatgcttgatacattattaaaattgtctaaaaggtaagtgtgattgattatggaactctaatatttttagctctccaggaaattaatccttataacacctaaaattattattggtcaatcctacattctggtatcacacacgttttaagaacaccctattaaatttttcaaaaagtgtttgttgaggacttacttgtgctaggcactatttttgttgttggagttaaaactttgagcaagatggacaaggtctctactctgatggaacataaattctagtgggttgagaccatgaacaaataatgattaatagaaatatgagatagtgataaatactgtaaagaaaacaaaatggaatgaagtattatagagtatgttcaaggaggacccccacccccacccgccatggaagagctaatatatataatctaaggcatgaatgatatgaaagagccaagcatgggaaaacctgaggaaaaattactccaaggacagggaactctggtgcaaagagagggatgaggttgttgttagaaaatctgaaagaaatttatgtatttggagtgtcagggcaaaaagaaaagatgaggttcaaagttattcagggccaaataatgaaaatccttgtaggccatgggaaagaattgtgtgtttctttcactttgttttaagagtcatgggaagctatgagaattttaagcagtgcactgacgtgatctttatatttttgaaggtttctctgaagtgtgtatgcaaaatgcaggcgagaggagagaaaggggaactttataggagggcatttctttagaatgaggcatgatactggagtcaaagagaagtaggcagattctgaaaattatgtggaggtagaattgacaggttatatttatggagaatagataagggactgaggaaagagtgaactcacagattcctaggtgattgtcaggagagactggatggatggttggaccattttctgatctttcgttatgcctataattatcaagtacaattgatttgaagcagcattgctgtactctttattgtatgtagagtttaactataggtaaatgcacgctgttcattcagacctttgtgctttgtgatgatgatttttgcccttttcctgtttgtttatttatttatttattgttaaaacaatgttttgacatacaggaggagcaagaaaaaatatctgctcatattatgccatctgctcctttttaatttctttcaaggaaattctccaagggagtatcttgtctcattgatgcccatttcattgtcagagaccattacatcccaggttttaaccctgacctgtcctgtggctgtcagaactggcttactggagacatttttttccaccatggagagcacttagctgtgcatcctgccggacttctaggaaggagatggtttccttccctcttctgctgaattcaggctgaattcctaaattctggtttgtgacaccattgtgttatattgtatttgtaactcagtagattcattaattatttctgattttaaaaaatcacatgagaaacattccaaattttctggttaatctaagtaatctcttgtctttgactgctagaccctgatctcagaagcatgccggcttgtttacagccctgactgggaaaaggcatgagtagggggaaatggatattgcacaccatcattattgaatacattttagcagccatgtgaattagagtagctcttaataaagagcttgaaggagcttattttggcactaagtgaaataattccttagaaaacaaaatactaatgcaattttaaaatataattcacttctctagaaatatatatttttcagaatattggctcttattaaaatgagatgcaaaaatattatgtgaaaaagggttcataaaaattgaattggcctataaaatatttttatcacttcttctgattataaaaatatgtctattgtagaaaattgaaaaaattataaagtcataaagaagaaaataaaaacaacttgtaatcccactgtcagaagacaactgtggttaccattattggataattctttgatcttttctcgctattcctacatacatacatacatacatacatatatatatgtgtgtgtgtgtgtacatacacctatataaaggatatgaatattttaaactatatagagattttaatgatttgagctcatactgtttgtactattttatacgacttttccatattattataggtgcattggaaaatttaatgactgcattatattttatataccataatatatttgtcctgtttttccatttggggacatttaggttgtttccattatttttagaaactcagatttttcttttatagtaaataacactgaaacgaatagttttctaaacacttttttttacaggttttctcactgtttccttagcataaattcctaaaatggagttatttggttaaaacgtatgaacatgtaaaggttctttttatttattagcaaataacttactatatgcataaaagtatgatatgccttgttaatttttgccaacttgatttttaaaaaatgtaatttgcttgtttccttttgccttactttgattattggtgaggttaaacatttactcatacatttatttaccattcatatttattctacgaaatgccattcatgtttttacacatgcttcttattagtgtttttgtggggtatctatattttaatgattgatttgtaaggtaggtatcgtactcatatttgttttaagtatgttttctaatcggacttttcttaaattttttacaaaacgttattgatatagagaggttttaaggtttatataattaaacctatttgccttttcttttgtagttttatcccatatttcagtgcttagagacattaagctggaaaatatctacttgtcttctatagctttacttaaaattttaatcaatatagaatttatttgatttacaattttggatatgctaaaatagaattttatttataatttttattaaacttccctaccttcatttgttgactaatttgatcctttgtgaaatttcctttacaaaattgtttttgttattattattattactatgtattagtacatatcaagttcatatataccccaggaagtttcagggcagtctctcagttctgctattctgtcagtctttcgtatgaccacattgttataattgtttcaatatgtgtatatacacacccaagtcattttttggtgtgtttagctatttttttgtttatttagactaccagataaaatagttctgagaccctatttatttctttcactggaatttcattaaattttactggtaatttgctatagtctcagaagtctgtctgctcatacatatctgcaaccgaaaaatatacaatatttctccattctttcaaaattatttttatgtttctctataaaattatgttttatacatagatgtatcccatcatgttgtgctcgaatattttaggttgtttatgatttttcagctatttagattataagttgatttttgctttaaccagctttgcatatacatagctgtatttagtagggattttccagagaacagaaccaataggatatgtatacacaaacggtcatatatatacatacacacacacacaagattttataaaggatttgctcacgtgtttatggcagctgagaagtcccacaatttgctgtctgcaagctagagacccaggaaagccagtggtgtagtttaaaagcctaagaactgatgagctgttggtagggagtccagtgccagtctgaaggcctgaaaacaaggagcatggagggtagcagaagactgatactttcagctcaagcagtcaagcagagagtgaattgaaccttctccctttttattctattcaagtcctccagggattggatgctgcccacccacattggggagggccatctgcttttctcagtccactaattcaaatgccaatcttttctggaaagattctcatagacatactcagaaataatgtttaatctgtggcccagtctagttggcacataaaattaactgtcataattgcataaacattaattattataatttaaacttttatcctgtcttattgatttaaatatataacttttttcacttgtttttcaggcacaaaaattaccccaaaatattgataatgttatcttctcatttctaatactttttgctatttcatgtctgatactgttggctaaaatttctagaaaattataataacaattagaaatgtgtttttcttttggtccagattttattagaaatctatcttttgtttttacttttgatattctgtgggcctaatattatttaacatataaattattctgtttttattttcccaggaagtgcatttaaaatcaagtgtgcatattaagatttattaaatgcctttttagtttctattaaatttgtcactttttctttgacctgttattatgcaacatttgctacgtagatttctgaatcttaaaccatccttgtattattggggtattccttaccagatcataatagctgaagcttttaatgtattaatgaatttagaatacttatattttatgacacatattcatctgtaattggaattttagatgggcatatggaatgtatgggaaatagatttcaagccaactacaatccttcagtggtaacaagcattactatgttgagaattactgtgaagttgcaggttcagtcccatgcactctaggtaatgatggaatgtgctaagtggtgactgaatgccctgtagacagaagtctgtatttgtatgcttttatctttcaagtctgcctcctcctgttcctgcccctgttctttagtgctattttgagaaaatgttgatgttgggagtggagttatgcttcattaaattaattagctaagtttttgaacacataatcaaattatgtagtatggcctttaaaactctgagaagtttttagtaaactttattttctgggatggttttcgaaagtaacttttaattataatttttgataattattttactgtatttctttgtgatttgttcaatttcgttagttaattttagcttttaataaattgtaattatcgccgggtgtggtggcctacgcctgtaatcccagcactttgggaggctgtggggggcagatcacctgaggccgggagttcaagatcagcctgaccaacatggagaaaccctgcctttacttaaaatccaaaattagccaggcttggtggtgcatgcctgtaatcccagctactcagtaggctgatgcaggagaattgcttgaacccgggaggcggaggttgtggtgagctgagattgcaccattgcagtccaccctggactacaagagtgaaactccatctcaaaaaaaaaaattgtaattatccagattttctagaaaaatacataatattttctgaggtaatttttcccttataactttaaataactttcatatgtacacttttccatttcttactgaattagtcatttccttccttttattaggttcaactattctattattttttaaagatgtcagaacctttgttcagtcagttgtcaagacctgtcattgtcaaccttttaattttgtccggacttctatttttatttttattgccattgatttcttcaggcttgctttttcttttcttgctttcctttttttggtttacattaccagaaccttttaaaacccttttcctgcaggctatactccatgttgtgttcagaataatttttcaaactccaaatatgataatatattcattatttaaatttttgaattattgtttatcttcggggtaaacttcaagtgctgtaacatggttccacccactactgatgctctgaatgctgcctgcctttcaactgtttcctttctttctgtactctatattttggcattgctggacctgtaatgcccatctctccactgcctctccttcgttctcccttccaacctccccctcctccctgcaccactcatagccttgcctacctggtggcaaactactactcagaagttcactccaaaatgacttctgcatggttgattttcttgcccttactctcagagatagtactttttcctacattctgcactctgcctttttttccaatactgaaaatgagtggctttaattttttttagaagactctgttttctttaaaaagcatcttaacctctaaggcttagaaaagaaatagtatgtactatgacatgcaaataattgcattgagagttctcatgattgtattccttttctaggcattgtcatgcttcttgggagctgagtcgaactgttggggctagaaagtcatcacagctatgccctcagttcaagatcaaatggaacttgatataaataacccaaatgctttttgtgaatatgcttcatgtctgctgctcagatgtgtctatttatgtagtatggttatcttgtctccaataggtaaatctaaaggatatagttgatccataatgcagaatttcatattctgtcctgtatgtcctggcccaccccattttgtattggggtgaaggctaagttgctataacaaagaaatctggaatacagtggcttttaagaacatatcaattctcattgctcatgtaatattcttgaaattagtgctccaggttattgacacagctctgctcctggtgatcattcaggagctcaggttctttctaccttgtctttccactgtcacctaatgacatgttcacaactaggacacaagcacctcagtgttctagctaataggaaggaggagcatctgttttgagagcccccagctaaattggggtaccagtaccagagtgactggcaaccctgccttaaagagaaataaaggggagctggacagacatggctgtttccagtgtacctttcacaggatacttctttcacatagtggacagcctgatgcctatttgtccaacttgtgaccaggggatccttcacacagacaacttgttaatattggcagatgcccttatgactcttgtctgacctgtgttcagtttatacttgcctgacattgctctggtgctgggagcctgagctcatgttctccctggtgtcttgggggaagcccaggctggggagtccctggttcttcagatggatagagcaaattcaatatactactgcagtaggaaacaagttcaaaggtttttacttacagatcctgggcgagaagggcacaatgatttgggtagagctgagaagagtcagtcagggagagaagagcacgaggcattttgcagtatatgtaagggactagagcatggatcattaagttctcactattaaaggataaagcaggaaagtagggatcccagtttgttaggtgggagagaagttatctctgtccactggcttgtgccatttgggtgtggcatagaactggaaatatgtcaaggtctagtgagccctgctgctgatagaagaaagttaaatttctattccaaatgaatgccaaagctacataaaattataagaattcactacaggatcccaggcccagaaatggcacatgtcacttctgcttgaattcatttaaagagaccttagttgcacggaaatacctgcatgggaggcttaaaaacatagcttggcagctgtagcaccattactggttaaggagagaatggatggtccactagccactgccatcacacatctctatttcaagaactgcgtatttgaaaataatagtttgggccttaatgtattaaaaggaactctaaaagatggaagcacagaatgtattattgcctttattttaaaactaccagttagttagaacttatcagaataaaaatattgcttatttaatgtatctcaatatgctttgattgagtcactttggtgtaatgcaaggttgaagtaatggttttcagaccgtataaccataaaaaataaaggtgtttaaaatttttcatcttcaattcctatgcaactgtaaaaagctatctttgatagagtggcaaatatttctctaaaagcaactaattcagagatattctttagtcagctttagtgtgaatgaaaagaattagcaaatataattctgtagattttcaccaaagttatattacagggtgggcaaggctgtgagcaagaaaaaagcttaacaggaaccacaaatggtgtactgagttaggtgtgactagggattttgtcacctaggctgttgggcagtagcaccatcttggctaactgcaaccgccacctccccggttcaagcgattctcctgcttcagcctcccgagtagctaggattataggcggccaccaccacacgcagctattttttgtacttttagtagagacgggatttcaccatgttggccaggctggtctcgaactcctgacctcaggtgatccgcccacctcggcctcccaaagtgctgggattacaaacatgagtcaccatgcccggacactagggattttattctaaagaattagtcagaaaaatagaaacaagtttgtaaatagcaagaatggcttcttctcttccaactgaatgagaatccaaggagggcagaaggacaagcaatacagtatgttaaatgaaatgcagtttacagtgaaaaccgatggagtgcatctagtgtcataatttggattgctcagtaaggaactagtttggtgtcacttctataaagatgtattagccaatggatcgcatagaaaatgcattatcttccattcttaaggaactgtttttagagtctgttttgtgtttatgcccattttaaaatgttttctatttgtggatttcatatataatgatttatcatagtaataaaaaagatgggagttcaaagcatgaaatcatattaggatagctctctgatgactgatatgacagaaagatgagactgatgtttcattctgtaaagcactatcatgacttagctatgaaacaaactcataaatatgttagattgtgtgtggacattctttcatacatgaatatgacacttttagtcatattctgtagatctttaacatggtgcattacctaaaattcaatattattatttttaaatttcaatataccgtattactaaaatagaagggtgccgtatcttaaaatctggattagcttgtatttgattcattgtgtttgaactcacataatggataaactaaaaatctatgaatatttttgagaaattaaagagattgttaaaatttttcatgtcactaatcagtaatttccactgtctgttaggaccaacctccgcatattactcacttttatgttgtgttttaaatttttgcacaataaaatatatcaaatatatatttaaaataaacatatgtatatgtagtcataacttggataaacctaggtacaagacattcagggactttggccattaattatgaaaaaaaatcactgctttagatataaggttgaaaaagatggcatgagtcgctttacatcccatttttaattatgagatcaacttatcactaatgtcctttcaaaccaccctaaaatggggacaattatttcatcttgatttccaatgattgtttttaagtctttatgtaaaattaatagaaggaggtaatttacaggtcctgttaatgaatttgaatgcaaaatactgtgtgtattattgttaattgactttaataatagtgtcatacattatttaaattgaatttatattttatttcatatatgtgtatgtttgggggacatttttaataacttacatttgagtgaaaatgcaaaaatatttcttccaataaaaatgttgccagttttctactgtgtcactgctgtcattgtgtaaagatttgataactggaattttacagcacaaatttgtagtccattaattatgatgatttattcaatatttaataagagcatcccagaaccttataaaagttgaaatgaaaagaccaattgtttaaggagaagaaaaacaaaacaaaacaaaatatgtagatgtagttggttccacataactgtttctcatcatgttcagtaaattcacagaacaccacaatcagccagaaactaagctggtgaaacggtgagccttcttgtttggtctggggtgtgtgtgtgtgtgtgtacgtacatgtgtgtgtttgtattatacacgcattgatatggtttgtgtccttgcccaaatctcatgtcaaattgtaatccccagtgttggaagaggggcttggtgggaggtggttagatcatggggttgatttctcctttgctgttctcctaatagtgagtgaattattattatttttttgagacggagtcttgctctgtcgcccaggctggagtacagtggcgtgaactcggctcactgcaagctccgcctcctgggttcatgccattctcctgcctcagcctcccaagtagctgggactataggcacccgccaccacccctggctaatttttttgtatttttagtagagacagggtttcaccgtgttagccaggatggtctcgatctcctgacctcgtgattcacccgcctcggcctcccaaagtgctgggattacaggcgtgagccactgcacccggcgtgagtgagttcttgtgagatcttgttttttaaaaagtgtgtagcgcctcttccttctctctctctttttcctgctccagccatgtaagatgtgcctgtttccccttcaccttctgccatgattgtacgttcctgaggcgtccccagtcatgctccttgtaagccttcagaaccactagccaattaaacctcttttttaaaaaaaaattttttttaaaattttaaaaaacctctttaaaaaaaaaaattaccggccaggcaatttaaaaaagaggtacattttaaaaaaatgtacctcttttttaaaaaaaattggtgtcaggcgcctgtagtcccagctactcgggaagctggggcaggagaattgcgtgaacctgggaggcagagcttgcagtgaaacgagatcgcgccactgcactccagcctgggcgacagagcgagactctgtctcaaaaaaaaaaaaaaaaaaaaaaattacctagtctcaggtattacagttttttaaattattattatttttaacttttattttaagttcaggggtacaagtgcaggtttgttacatagataaacttgtgtcttggggatttgttgtacatattatttcatcacccaagtattaagcctagtacccattaggtgtttttcctgatcctctccctcctcccaccctccatcctctgaaaggccccagtgtgtgttgtttccctctatgtgtccatgtgctctcttcatttagctcccccttataagtgagaacatatggtacttggttttctgttcctgttgtaatggataatggactccagctccatccagtccgtgcaaagaacatatttcattcatttttgtagctgtatagtattccatggtgcatatgtaccccattttctttatccagtctatctctttatagcagtgcaagaacagactaacacacacacatttttgttccttttaaggaaacaaacataggaataaagtagtaattggaaagactgaagtagtaactgaaagattttgctaagctctctgcgtatgtgggtgggtgtgtgtgtttcttgaagtaatctcttacacttctaattacccctaacaccatagattagtttaattaatcctctaataatttggcctaagagaaatttagcaatgataaggtagtgacaaaaattggttatgatttctacatttttgtatttctgataatttgtttagatattttttaggttaacagtttacagacagtaaaataattcattacaaacattacaaacacttcatgtccactggtcatgatactagataaaactttcattcaacatgctgagatgaccaagtctgtgacaaataaaaatagtactctattttaccctagattactatttcagctgagcaacaacgtcttgattatacctcgatcatttcagtcattttaacagtgtctatatttttagttaattgattgtagtaaatatagctaattctgttgattatttatcactgttctatatgcctattagagttctcattatctcaggtgcagttttaggaggcagttttaacctattaaattcacaaggtttggtccagttttaagagacagaaagaagtaataatatactcacaaattagacttttaaaatactttacctgatttggggccttttaatatatttaatcatttagcaatgtattaacatttttgtatgcatatttatccctaagtcatgtattctggatgcctttgtcttctttctgaacaatgtcaaatagttccagtgtgatttccctttttaattaggctgcaaggacagttggcccctgataggattacgggatggctttgtataaaatttgcttctgattagcagctccaagactttgacatcctacagttttgatctttatctcttatcagttgttctgatagctcctctacaataactgtatttcagccatttctaatgcattggtattgaaaaaggaaaaaagatgtttaggtaggaatttttgtcattgatcagattttgtatgtttttgtttccttaaaaatttttatattggaaatagttcatatttagcttgaaaatattctggcataaataattaacatgataggaaaatgatcgtggataatggagttttaagagcagttaggaattaccctaaattttaaatttgagacaaatgtgttttccgtgatgcaagaactgctgccagtctaaggaagtacaagaaagagatttttgaattagtgagctatataaaattgtcctcacattgattttctaaagtagcctgccaatcagaggtcatttttagttcaccattgcctcttacttagtatgaattttccattttgcacacaaatataagaaatacaatttaaaaaatggtacattaggaaagctaaagtactttacttgactcttagtttacattgccttagtgacaccagccaatgaggaatgaaaaatccaggtgagttagagcaatgatcaaaagaaaaaaaaaaaaagaacaagagtccccccaactagaagaatacaattaaaaaaagaggcagtacacatggttaataaacagatgaaaaaattaaaattcacttgtactataagacaggcagattaaattatttttacctatcaaattaaccagaacaaaggcatgcactttagtgaggatgaggaacatacagattcactggtgaaagtaaatgtacacacaacctttcaagttgatagtttggcagaagttgctaaaaacatttaaagctttcatactttttgataaggctttttattttagaaaacatataaataaaaaagaagaaatacacacaatgatttctttataagtatatattcatagagtattatattacttccacatgatggcatattttgcaggcattaaagtgatattgaagaatagtaaagaagcacacccagtacatagtgttaaataaacaaggacaccaaatatatataccttagtatctaagtcctgtaaaaatatgtgtttacataggaaaaaacttagaaggaaaatgcagaatgcatcaagtctgtgttttcatctggaactatgaatttcctacaacaagcatgttaattatactgaactaatgaaaattgctgattaaacaaagaagtgaatgctaaactcaagccaatatataactgcttttctatgtagaacatgttaacggaaaggggaagcatataaagttaatttttgatggaaatgttcacaaaagtagccaatcaatttaataaaaagaaaaatcaatcagttggtcagttctttcagaacagtaaaacattttgtcagttgccccaactacaattattcctcaattgactgtattgataagctgctttgaagttgtttagacgcgtttttggagaaaaaaatattgttgaaaaatacttagtgaaacttaataacagggcacagtgggagatcattaaaatgaatcctcttgcttggttgaggcaatgtattggaatgcagatcttactgatttactgcaaatatctgtatgaaagtgagcccatatattaaaatctgtgtattatagaagccagaatacaagcctgtttgatgtagttgtgatgaacaacaaagttaattagactattttgtagttagtgggtcatctttagatttctttcgagcattacaaacaaattcattaactaatgacattaactattttatgtccctagtgggcacttagaagaagaattgacagttcagtactttgcctctaagctgctggtaatgatgagtctgtatttgtgacatctagtggaaatagattatccattcacgaggtctacactcagatatgacatgctattgttcttcatggttaagaggcatactttttccagctttcactttattgcgtgacttattcacaaagtttctttacagtaacactgttttagcacacttatctttacatattgcagccattttccacagtaaaaccagatggaaaaatcagggataattggtggcaagctgtatcaattaaagggtattaaatctaaagcaggtcgagctgtgtccttttctgtgtaccttcaattcttggtaccttcagttcctgcacacccagtttttggcaccctgttgctcatgctctcaaccattgtaaatacattgaaggtgaaaagctctaaattatagaatattagaggaagatgagatcttaccaaagatcttccattttcctaatgagacatcagaagtccagaaaatttatggaaattgcctaaggtcagatgtagttagtgacaaaattagaattagacttttgttctgttgccctattatctatcatttccttctgctttgagagactgcagatgactcctttcaatagaatggtgattaagaccatgggctggggagcctcattttcttggttcacattagagccctattccttactagctctgtcactttgggcaatttacttaaccttgctgttcatcagtttgttttgtacaatgatgatgagaatactactcgtattggtaattgtgaagattaaatgacctaatatttgtaaagtgtataaaatagtgcttggtataaattaaatgctctatataaatataaatatctagagtaaattaaatgctctttaaaatataaatatctagagtaaaaacaatctagacaaagaggacacattatctcttatgtatagaatgttgtttttaatattgcagccaaaatgtgctttaatattactaatttaatataaaggaaacataggcaccatatcacatgagttctaaagattaatggaagtcatatgtgatatctttggttaacatcttcagctcttacattttcaaacacacccttcactttcctattgcttagaatgctttttacttgggcctcttttgaattgatggtttttaaaatgcacttttagataacaaaggtaacattttaagtcttagaaaatgtacagaaggagcataagggagaaaatactgagctatgtctaaaacttaataatgcttaagtttggtgtcttataaatcagcctctgttaatattgtatttttggtcttttgtctcttgccacaataatccctgaatattgtcattctacaaacaatatcaaatcaatattaaagttcctatagaatatcttaaatttaagaatatattcctttgttcgcatttttttaaaaagcaactggtctttgttttctttggttttagtactacatttctacctagtcagcggccaaataatccctatatatttattcctttcaaatgacctccatttgcagagaatattttaggggtaagttttaactatttctcttagggactgtccatacttgagaaaaacagcctgaggcttaacattttctgtgtatgtttgaaatggcaactgcaccgtcatgcaggcttcattcttgagctattttcagctctggctgcttttaaaaccaagtggagagtgaagcagcagctacagcagggcgagctgtatcatgtactttcaagtgtagacctagccttaaagaacaatctactgaatggcattgaaaggataagacccagaagagatattattttctctattttaatgctttctgagtgccttgaaagtgatgcttgacctgtgtatcataaatccaaaccagaacattttagaagagtcatttatatctcagcttttcatgcttccattgcagcccatgatagtgcatttcatcatattattagttagactaagtgcctcctagggggcattgtgacttgacatatgcggagctggttgatctgaatggcatattctaagtgagatgtcctgcttaagtcactaagaatggtttcagggagggcagtatattttgcccttttctaccccagaatgacctgaaatgacagctgggttcattctgctgacagtgaacctcttgctctgcccgaacttaggtttcttagaggaaaggaaagaagaatcggttttgtaactcatttgctactggtgacatgacaggctgactccatgtgaatacacgattcagagaatgcaaggaagaagaggaaaacaagcattttgggccagtggggaaagagtatcaccctacattttaaatgagtgtccaacttacttcatataaaagagactcagagaaaaggtttatttcaggccttttgttgaagtaatagtttacacaaaggagaacatggttaaataaagcactgattgagtcactgagttttgagtaagcttatagctactcatgaaattcaggatgttattagaagttagggagcatataattcataccttctcacctttatgttttcacctgtcttaaaagagtttctgtttcttccttgaatttaaaaataaaaccagaacatttaatcagtggtcgaaatattttaattttctcttaatttgggggttggtttttaattttttagttatttgtaagccacaatgatggcagaagatgacataatttgtatgtaaggattgccactcatctgcatgtgttcagtgagaagaacctaccactcatctttggttcacctcattttcttattcatatttgaagtcccctgcaatggtcacagaggaattaggatgcttttgttatctcatactggcttaaaaaatagagcagtttattacctcatgtaaaaagacatccactggtggagtagactccttggttggatgattttgcattcattatatcatcaaagattctgattttcccccctttcttccctgtcatctttggagtttcagtcttgtcctcaggctccttcctcttttagttataagactactcaagcagaaaactaggacagcacattctctatttatagtagtggaggatgaggtggaaggaaaaaaggacatctttcaagtccttaaacatctttccttttgtctgattgactccatcctggaccaaaatcagtaatggggaatactatgagccaatttgctaagtagcatcaccaccgagagctggtaatgcaattgataacaaaatgaaatgggttctttagaaaagaggaaagaagaaatgcatgttgggtaagtagccatcagtgtttatttcaatccgaggccttatgtgaaaaatagtacaaaccattttatatccattaggatggctattattaacaaaacaaaacaaaaaatacagcaaacccagaaagtatcaagtgtgggctagcatggggagaaattggaacactcatgcattgctgatgagaatatgaaagggatagttactatggaaagcagtttggcagtttctcaaacagttaaacatagaattaccatgtgatccagcaattccccttctagatatatacttataagaattgaaaacagggactcaaacaaatacctatataccaatgttcatagtaggtaaaatagctactcacaatagctaaattttgggaacagccccagttgccatcaacagatgatggatggacaaacaaaatgtggtgtatgcatacaatgggatgccatttaaccctaaaaaggaatgaaattttcttacatgctacaacatggatgaaccttgaatacatttgccaagtgaaaaaaatccagacacagaaggacaaatgtatgatttcactttatagagtgactggaataggcaaattaatagagggacagaaaatagaatggaggttaccagagactgtggggttgggcaaattgagagttgtttaatgggtacagagtttctcctggagatcatgaaaaagttcaggaaatattggggatgatgatacaacactgtgaatgtacttactgctattaaagtgtaaacataaatggttaagatggtatatcttacgtctattttaccacacacaaaaagcaatgtagagccaacgggatatcatgtgttggtaacatcacgagcttggaaataagatacaagaatcaataaattagtgtctcttcactcttttttttccttactcctgcataccaagggaaagtggaactgaatgtggactgtgggttgaatgctgttcagcaatacttagtgctctaacttccaaagaccagtgcccaaacattggtgcttattccccataggaaacatggtctctttagctgtgtaaagttgtgataaaccaactgactgcagccattcttttaaaacaaaatgtaatcgcaattataagctttagcaataaacagagggcaaaatgatctacgtcgttctatgtgtttctagtcttcatatttattctcagattttctcgtcaacaaaccaataagctaaaggttggagtataatgccaaatttctatttcttgctttactttttttgaaagaaataaagaatagatactaaaatagagatgaaaatagccttattattggttgtcaagcactttctccatgaagcagggctctgataaactacataaaagagtgaggctcatacctaaaacctagttatgcttttatctcctttggagcagatctgtggatgaggccagtttttcaggacaaatttaatcagtctcacatattcagtctcagagaacctggaagagagagaaaatggtgttttttattttctcagagaaagaaaaaatggggaggtcctccccaggtgtgcctaaaagtaaaagaaagtgagggctccattacacctgaacacaggcaggtcaaactgcattacatacttggccccagccacaaatgtgcagtgccctttaacatatgaatctagatcatctgctaacaaaacatgattcaatgactgtattagtccattctcacgctgctgtgaagaaatacacaagactgggtaatttataaagaaaagaggtttaattgactcagttccacatgtctggggaggcctcagggaaattacaatcatggtggaaggcacctcttcacagggcggcaggagagagaatgagtgcaagcaggggaaatgccagatgcctataaaaacatcagctctcatgagactcgctatcatgagaacagcatgggggaaaccacccccatgatccaattacctccacctagtcccaaccttgacacgtggggattattataattcaaaatgagatttgggtggggacacagacccaaaccgtatcaatgactatcaggttttctgcaatcagattagctgctcctccttccttagggaggaaggaacatactttttaaatattcatggagtgaggatggaaacaaatgtagatttgtatctaacagttaaatgcatactttgtgggaagtggtcatacagactagcatgtacagatgctagtcagtctggtgaaggggctctccaccccaatctgtattcttgttcggcactgtcctaagggtgaaggtcagatgccatatacctcaaatttcttgccttgatattgattgagctcaatcatcacgtatttttttctgaaataaagttgggcaacaagcagaaggcaaaataaactgaagttctgtgatgctaactagaaagtaactaaatgaattttaaacctttctgttggatataggacattcttgcgtctgttttcaaataattgttatataaaatttttagctcttactgctctttcactgaaactcattaatataggatgatgacttgctccacgaacttctttcagttcatacttctttttccttattgtgttgaaaactcaaaggaatgtataatattatagaatatatatattttttaagaccaggtctcaccctgtcacctaggttggagtacagtggtgggatcatatttcattgtagccttgaattgctggactcacatcatcctcctgtctcagcctcccaagtagctaggactgcaggttcttgccactgtgcctggctaattaaaaacaaaaattcttttttagagatggggtcttgctaccttgcccaggctggtctagaacttatggcctcaagcaatccttcatccttgccctcctataatggtaggattaaagtcttgagccactactcctagcctaatatagaatcttaaagctctaaaagataaaaactctctggtcttgttgatccactcattttaaaggattaggccattgaggcaattgatgcctgcagcttgtaagtgacatgttcagtgtcctgtggctatatagtggtagagcaaagctcagggcttaggttatttgtccttttaaattagaatttatttaaatattcaaataaaaggcagctatgaagccttaaaagtacagatctataatgtgaaaagatcacccccaacccttggctttcatgcccattttatccctgtaagatgtctggcagggattattccagggggaggaggcctatttggccagggcctcagttcacagaaggcccagtatcttaaatttagacttttgagcttctctctataggaggttccttagtcccagggattaactgatggatttagagaagatttagagaagaatttaggttcatttatcttaaaattttaaactcaagtttcttctgaattttataattttgtttgggtactacaagtatatgtcctgttgtttttaaattaaaagtgttaatgtgtttaaatgtagacatataacatttatttacatttttaaacctctgtttggcatttttttcagtttttttatgtttttcaggtgtctcaaaaatggacagtgctgggatatctcttgagccctgagctgtcctgttcatggctggtgactgcaaagcctgcttggccaggcagaagctgttcactgtgggtcagcgagtgccactgtttgatagctgtcattgttggaaatttcagctgttcagatcctagccttctgaatccttataggcttttggaattatttgggactcaagaataactcaacgaaatctagaaaccattatgttgatagagaaacagaggaaacaaatggcagagaagagcacagattgtgaaggttagagaaggtgtatggatggggcatagattagctgtcgatgttttcaaaggatctgtaaaacctgagaagcattcaaggaaggagatgaggtagaagctaccagaaaaagcaaagcagagggaaaaaaaggaagagtgggcaaggaagagcaccagtcatggagaaagagaatgagtgagagggacagctcttgggggactttccaggagatgaaaccgagaatcttggatcattagtcatttatatcccaggattctctaaaggaaactcatgtgtctacaatgagtatgtgaatgcggggaaggggcaggggatgaaggaggagattcccctgaactcaacctctaagggcaatcaaaagccatggcaaccgtagcagctcagcacactacacaaggggaatttggctgttttgataccattataatatatcagtcaggctaaattgattgaaagaaaagatcctctcaagttacctcgggaaaaagatgtattttaaagaaatacagaccggaagtggatctatagcgccctagaggctcaaggcatttatagggattgatgggtttctcttgctccagttccttctcctcccctacaccccttttttttttgccctttcctgcccctctgtcctactgttctgctgcctcctccttcttacaaactctccttccctttcttctctctttcctcagttctctctttctttctgtctctctctgtctctctcacacagacacacacacacacacacaagaacacacacacacatacacacagcaacagcagcagcagcagcagcagcagctctgcttgtggttctctttgcccatagatttcattgtttttttactgccagctgactacatcctccttctttccatgtctttttgggtccctccaaattttgtattacacatggcattatttcaccattaggttactactgactggcatagtttcttgttttttcccttgatatattttgaaaacaaagaatccagctagcttagcttactctttcagatctacctataaagtacatcctatgctatgaatcagctgtccatccatctagtgctgattcttggtctacttacctagggacaggttagggtcacaggaacatgaaatgtggatgcttagacaaagaagactgtaactagggtggggagttagccagaagagatcctttgacagctctaatgcaaacgtaagtttaaaagtattatgagatagtagatgcaaatgcagtgaacagagctgtgttgtagaatatggtgtggtacaacacagattccagacttcatttataaaagacaaggccagacgcataagaaagttatgttagctataagagaacaaacagacattggactcgagaggttgatgaatcgctataacattcgttcgtctcccttatatgatatcaaatcttagaaaggcagctgttcacaatttttttgtgtgtctggtaaatcatctcaagctgctgcagattcagtatcatgcatatgacaaaattaggcaagtcaactgtgtgttacatgagtggttcatttcgcctgatgttctattacatttgcagctgcatctgcatctcagacacgtaacattaactgatgttcataatgataaccctgagtcattaaggaaatgttgtattatgtctggtacagtacacttgagaagtaaagagatgaaatggagaaagaactgagacttactgaatgcttgctgtattgcagatactgagagagatgagctacttatgttactgcccttaacaacagaatcctgtgacataggtacagttaccttcattttacaactgagaaaaaaacatgttcagataaggatattttccatatttgaattaggaatccaaatccatcttattctagaatttttgctctccctttatatcaccaacctgtttaattttttttaaaagacatattcaagtcagtatttaaatgagatagccttaggtagtcagtgttagctagtcaaagactcaaactcaaaatattcacaaaagaaagaagagaactaatatttgagcacatgaccattcatgatgatttattccctgtgaactatgtgttattatccccaagttataagttaaggaaattcattaaggcaaagtgacttgtccaaggttgctcattgagagagatgtggctttaatgtgtttttgtttgtttgttttgcaggcttcttttgtcaatccactatgtaaatgttagttttcttaagtcagtcctgagctccctcattttcttctccttcagtttccttttgtaggatagtttcagatgtaagaattctgaaatttataactttagatcccaccttgctctcaagttccctacataacttagatacttttttcatataccgtgaaacactgaaactcaaaagatataattttttcatttcaacagtctccaagtatacctgcaaccccacatttcttgtctaagtgaatgaccccaattactcaagcaagaaatctatgtatcaccctacttgactcagtaggtgctgactggccacctcttgttgtccttgatatgaatctctttcttcctcttcctctaccacttctctaatttaagccagtcctaaacaattgtagtagctatatcagtctgcatttctcaatgccattagagtgaacttcctattgaataattttaatcatatcactttcttgctcttaattcttcagtgatccccatagccaaaagcaaagcatccatactgctttgcacagtagtactcataacccctcatgacctggtctctgtttgctacttattcccaccttcatggtgatatagcaattttgacatacttatggctccctggacacaccgaacactgtcaaagttttctaactttgcctgtttccttcacctgctggtttaccacactattcgtcaagcatcctctcaaatgctttttgattattaagtctttccatctgtttttcagggctgctatgactctttattcacacttcaaatacagcaggtgtcttagtgtactgtaatcacatgtggatttttgctccttggactgataacactgggctgagatgcagtgtgcactgggatggacatactgccctttgtggctggcatgctttctgattaattatatatctgttatgagtggttggtgtttatggcaagcagttgttcaatatcttgaatgtcatctcctgcttactaccaagcaatgtctggcatagagagggtgctcataaatacctgttgattcttgaattaggaatgaatgaatgccgagttatggctggcttcaacttaccctcttcccttcactgcctctggctgtactacactgagctggtcgggtttctgtgacatatctacctgggctggttctgtactgtagcaaaacaaagaataaatgtattttgtgaagagctttcacatatgtgcagaaagtttgcatgtcccattgaggcttcattcctaacaaacaaaatatcctcacttttatcaatgattttcagagacttcttactgctcgtagatgtcctctaatcatacaaatttatacttacagcacaagaatgagaactaagaataataatccagatatgatctcatcattgcaggatgaattatgatgattggatcctgtgagttggaaggccactggcggacactgatacaggcttaatgacatggacttccttcacagccatatcatcttgagcttgtgctcacttgaagtccaggattttactttactttttccacatgagctgccatcacatcagatatgtcctggcccattaaaaaaataaatttgtacttctgattatctcattctgtatacccctttgaccctcattctggtttaggattttctgcagtttgacaattgtgcttttgacatctttcttacaaattatggatgaaaatacataagcagcagagcaaatttcagaatcccatgttacaccacttttcctccagcttcagactgattcattaatcaacattgtttgggtgcaaaatgtccagatatcgattcctggctccaggggtgtttttttttttttttttatttccttctatctaattccgtgctttgtccacaagatataattagaaacctgaatggctcacttaaattaatgagtaccaggcctgtatagtttatttaatctattaatttccagcccttattaggaagtcatcatcatcatcactgtcatcattcatctgttgaaatcaatttaccaaagtaaattcctgtctttggtattagctggaccccagtcctatgtcttggcaacttttaacttagactcacctccagtaccatggcctggaagggcgagattctccccaggcttcctcctgagtcatagggcttcccctgttagcctctctgcctctgtcttctctcaactgccttcataacctcagccacaaactgaagacttttttctggtgaaaaccattcagactaagccttctgtgagtttttcaggtcctgtaaagatggatgtgcacagaggtgggtcaaatcacttattgtgtagacttctgtctctttgttggctctttaagggactttaggccatatgaataaatctgtatctgtatgataggtattgatctcattttgcatatagtgttgctaaactgaagcttaggcagataaattggctttggccaagatccatgactactgagttgtgagggtgaaattttaatacaggtttaaggctcagaggctcacacttgagccattaaattaactcatcctgttgtcttgtgagcacagatttccttccttccttccctcttttcttcctctgtattcccttcattttctttccttttcttttgtgctcaccttatctcctgtctcccttctctctttctccctgacctcatcctccctctatttttttctttttagaattcatgatcacagtaaagttctttcagtccctgggatgctatttattttaacttaggattgataatttacctcacaagccaacttggatttgtcgagaaaactagtccttttattttatgtatagcagatgtaatcttcacgcacctcatgcactggtaaatggaaggaaaaacactacctacaggtcaaatcgatctcaagtttagtctgtctcatgatgtaagcagccccttctgaaatgacaggctctcagatagctttctcttttcttgcttctctccctcaaggatgtcctggtctaggagaggtggggattgtgacttgtgtgtctttacaacactgggagttggggtcttaggcccttgttcagcatatacctgttgaacacacacacacagggtgcagccctagcctctgtagggtcacctgatcccttcagtatgagtcctgggcagggaacactgtcagcttggaatttgcacttcactagaactgagccgagcacgggagtgtcagccaagcatctctctctgaccatgatgctcgacctgcttagcgaggctgggcttacctgttggcctggaaccctcaacccaatggtccctctcacagtgctaggtgtcatgtataggaaagaggcccctggcctaggttcacccgttgtacaccaaagccctcaaattagaaatcggaacatatgttgtctcaccttttttcatataccttccaataaatcttacacgatgaaaaacaggatggatgcggtggctcatgtctgtaatcccagcactttgggaggctgaggcgggcggatcatgaggtcaggagatcgagaccatcctgtccaacatggtgaaaccccgtctctactaaaaatacaaaaaatattagctaggcacggtggcacgtgcctgtagtcccagctacttgggaggctgaggtcggacaatcgcttgaacccgggaggcggaggttgcagtgagccaagatcgcgccactctactccagcctggtgacagagcgagactctgtctcaaaaaataataataataaaagaaaaaagaaaaacgggcaaggttttctgtctccagattagtttttttttttttttttttttttttttttttttttttggtgacttcagacaaacattagtggtagaaggggatattttcctacaatctggttaaccccccgagctggcgtcttcaagcttagtttttgacatacaaaaggaggcaatgaagaaatttggagaatagtttctctagagattgactttaaaagcttttggcttgttgtctaatcatatttttatgtcagaagctgaccatttcttcagcttttctctttgcaggacacctaaaacaaatcttaatcagttccttgggacatggctacctcagacttgttaggatcagcaaaagaagattaaaaatatttaaaatagcccccttaagtaaaagatgggatatatttacagtgtttacttttgcatttgatttaatttgagattttctttgagaagatggaaggaataaagagcagttgagatgttacacttttgatttaccctgcgtatcattccattgtcctctgacccatgtctttagcctattgcatcctcggttgtcttcttctaaaagttgtcttttgtgttgatattattgtccttagtattttaaaataagtcttagttcactttgaactataatctccatagaagaaccaccagcttctaattttatttgtttgttctttgttttgtgctcctgtccctttcttggccatattttcatactaagttttttagaaagcagccagtgaagtagcactgtttctgtttgttgttattcttgttttagtgatatcatttttttctctttaggattatttttaattaaatatttatatttgaggtcttagaaacacttcactatatttgtcttagagcctcaatggcaggatccagtttaatatttcttgatgtttttgaaatatttcataaattccagaataagtgacttagtataccaagcgtttcctttgctttttgtttgtttccctttaatttcaacatggaatgatattattattctaagattcctgtcactgccacaaaaatgaaacaatgtttccttatgggtcagaagtaaatttatggtagacatttcccttccggctccctctgcatatcagtcatttttctgcaaagaaagtgaaaatttattgcatgagaaactttgaaacatcactcagttctcttgtttgtggtcatattttatggctttgagtggggacttctgttcattcccatattatgaacaacagactgttattgtaactcatctgacacaagagtttccacaataaaattaattggaaatttcagagaattgagaaagtatagcttaaattgatctttagttaggtacaatttcttctttaccctgagacatgaagactttaaaatgaagacttaaaaaaaaatgaggctgatacttatttttgtaatatggtgctagttatgtaaaataaagttttgttttaatgggttgttagacaaattttaacgaaataaaaataatgcagaataatctgtctctgtagaagcatagcctcagatttatggtccagaaatctaggagggtggcatgtaatttaaatattgaagggcataacttatcaaatgatatgtcaagtacaaaaatggccttgtaaaaagatgactttattaggggaggaagtaaggcatatagtgaacatactacatagactcacattttggaatcggtatgactacagaaaaccaccttacttggactggatggatttgatagtggaaatgagtggcctgtgaggatggaagtttttgtatttatacaggtttatgcatcagaagttggcactgtctaaaaaatccaaaataaaaaaggctaaaaaaagtttcattttattttgctttaaaacaaaaattcctacatctagtgtgatgttggtggtacagctacttcagtatctacatgttgacattaaaagttgcatgactattttcatattaaatgttatccagaaagtatgacccacctaatattgttattgaaacaccatttccagtcgtgcaattaatcctaattaaacattagcacaaaatttggaagatcagaaagttgttagtaccatcttgaatctcatgattgcagaattaatttaacaaccctgtttgggcataatacattccaaaaaaatatttaaagaagcatcgatttattcagaaggtttatatttgcttcatatgcattcttcagtggtattcaggaaacagctgtcagataaattataaaaatacgtgataaacaaaaccaactcatctttttaattgattttaatctagcttcatctaggcagcataatgctcttcactgatagtagagtgaataatatgaatgcaattacttagcaattcaccatgacttaaaaatatacagagccttaatctattactaatatagtgtaatgtccaaagcagcaaattattggtgggaactattgaagatcagctggtagttagtcatactgctttgttcaaatttaatttcaagaaacaaagaaggagacatgattactggtagtaacagcaatgaattatgggaaactaccactgaatcatttattgattgatagtgagtgaaagtcgttatcctctgatggctgtttgaacagctaatatgaaacgatgcagctgatgtctgtcacgaaacctttgccatattagctgtttcctaattgtcgcttttattttttgcagcagaaattggagcatgggggaagagccgtgaatctaaatttgttttttgttgttgttgtttttttgctgatggagaaagtgcttcttggttttaaattcctaccaaaataagagggaaggaattttatttagttacctgaagtaatgctagatattaaatgatgaagactatcaagattcctccattttatggtatgctttataatattcaacatcaaaggttagcacagccttttgtatattcaagtagataggaatggccctgggtgttactatctaccggatagagcaagagaaagttgactctggcaactgtcattaccatttatttctctcttttccaaacttagcccccttttttctccatagcaattggctagagtcctcttgaagtctgtattgccaaccataagttgtcaggtgtacagtaagttttcaagataggatttgtaaggtagacctaattatcttcttattttggatattgggaatatgcaaaggctatgaccaaaatttagtaatattatttgcctaattattatttaacttggttaataagccctgatttagttacactatcgataggatgaaaacccttgccttgaaaattggcagctgttgtttttaccattgaactgtacaaagctcttccagtctattatacgcattttttttttttctaaagaaaacaagaaatgattggccgggcgtggtggctcacgcctgtaatcacagcactttgggaggccaaggtgggcagatcacctgaggtcgggagtttgagaccagcctgaccaacaagaagaaaccccgtctctactaaaaatacaaaaaaattcagccagacgtggtggtgcatgcctgtaatctcagctacttgggagactgaggcaggcgaattgcttgaacctgggaggcggaggttgtggtgagccaagatcgcaccactgcactccagcctgggcaacaagagtgaaactctgcttaaaaaaaaaagaaaaaagaaagaaaaaaaagaaatgaccaattaagtgtatctgatttaggaaccgaatgttgataacttgttttcagattcagtccataatggaagtctataaaaatgtcaaccagttatcagggcataatgccaggtcatctatgtgttcttatcatcttcaaacagatcagatgtctatcatcttcctgctttgtgcacagatctgggccactatgataatcataatacattagatttacctaatggttgtttcccgggttaccctctcagacttttgcaatgttcagccttgctttaatggtttcttacaatgcacaagtacacttaaattgcagcactggatgtttttctccaaaagtgttatacatggaaggggaagggggtgagaaagatcctgtaattgaatagttaataggcttttcactcaatgaacatgtccatgaacctgatacatacttgttttgacgtctaaaaatgatattcgagatggcttaacttggttgttgattagcaagtctccatctaacattttcagtcaaatatttctctccctcgcttggatgtaagcctagctagctgagctgggggtgagaaggacagaacgagttggtgtgggcagcctggtctgagttctttttggattgcgtgttgtaaatcttcatcctctgggctcaaatgaccaatattatatttttcagaaatcaataatcatgaaattcatcactgttcatttataggtgaataattacacactgaagaggctaattgctattctataatattttgaaaaactagaaaatggaaaattgctaagaaaatttatccattccctttgcaaaaaaagttgggttttgtcaagaatgtgaaaagtctgaaatttttctctactttcaggctaacaatttatttagccttccacagtttcatggcagatgctggcagaagacatgatactcctagatcagagacaaagacttcattacagcacagcaagcaaaacgaactcccttgtccctccaagtgctttggggttgacatagaggggcctcggtgggtactgtgcaattagtgggtttgcatcacagctgaggaatcctaagtttaggaatcctgaatgttttgtaagggatgacaaatgaatctgcctgaactttgctcggaagagaaccactatctttattatattgggccataaacaaagctgcccctaccatctgtttccatgggagacactaactctatattcccagcctgtttactatcaaaacattattgaaaagagttcagaacaaaagcatagttagtatctttgctctcaatatgtacagaaatgtgagagacctatagaggtctagttctaatgtacctaatgtacactgtggactgtgatagcttatgggtaaaatgatgaaaggaccgaaaagcctattgatgagcttgcataatgtatatatttctgactcagataaaaaaaaagagaatatctgggaaacactaccaatggggatggaagtgaaccagttttaccaataaaatcttctaaatagtgtaactaagacaggaatctcattagtcctagattgaattaatgcatgctgtgacacatcaagctgaaaagtactattaatctttgactctatataaaatatgtattttgacataatagtgttagtttagtgtgtatgtcatatatataggtaccagattaagatggattttggaattgttttgtgccttttcaagcagtataatttttaaaaacaaattcttgatacaggtagttgtgattttcttttaacattccatgttaagatgaaaaatactggaattaaaaacccattatgagaaagagtaaatttgaatatttctccattatatagtaataaatgtttgtaaaatcttccttgatctcatgtttccaggttactgttttggaatttgtttggcctttgcataatccttgattgactttggtaaattatatcctagtggaattatccactttcattagcaccactttcttcttcttcttcttctacttttttttttttccttttcagtcagggtcttactcttttcacaggctggagtacagtggtgcgatcatggctcactggctcactgcggtctcgacttcctgggctcagataattctcccacctctgcctcctgagtagctgggactacaggcatgcgccatcacatccagctaatttttttctagtttttgtagagacagggtttctccatgttgcccaggctggtcttgaattccttggctcaagcaatctgcttgcctcagcctcccaaggtgctgggattacaggcatgagccaccatgcccagcctgttagtaccactttctaagcacaagataaaaagcttatctttgcctaaaatatcttcattaccatatttctttaataagacctttatcatctcctgtagtatctgtctgtgttatatgaagttttacagtaaaatttcatatatgccatttggtgggttactatggaaaattttatctgatgttaaagttgtccatcaaactacttgacaataacatctcatttataaacatcattcagatttattggatgatgtattattactcaggttaaataagcattctagtaaactgaaaattgttaatacatacataccacaacatttactataacgttcataacaaattttcaaatgactcaaagacaagtacttttttaagctaaagttgcaatcaaactagtttgatctttgattaatgctagtggagctagaggccttctgttgtatctgatctcctgtgaacagtggcaatttctaaatagttctgaagatgtaatatttgaccaaatctgcccttatctggggttttatttactgcttggcttttctactatcagtatggttactgtcatgtttcacttttaaaagcctgaatacaaaattcataggaaaaaaacgctaattatttctattttgttttttttagagtgtcaaatgcagtgaaccaagttttcctatatattttttcagataaattgaaaatagtaaaatgtaataaaaatataaaatgtctcatttttaaaatgtgaagttcttttagatctaacatttgatagctataatagacttatcataatatcataaaactagaatcccttagtaataatctagcccatcatctttattttacaggtgaggaaattggggctcaaataagttaacagacagactcatgatttcccagattattatgtaaatatatgggactggaaccccagttttccatgtgttaattcattgctcttccataaccaaattaccctgaaactaatatgacattaattttaagttgtaccattacttatatatcactaagaaataagaaagacttctaataaattatgatagtttcattaatgatagcctctcaccccccactgctgccccagcccaatgcatgaatccatcccctcattccctcattgctttgagacattttaaaatctattctgagagtttgggcaagactttccccccttcatcttcactgagttgcatgtcgggaaatccttttgcacaaatagcagtaacaaaatacaacacagctacatatgtttgtgggtatctttctcgtgtttcataggacactttgttgatttgcatgaaaatcagtaattgtcattcctccaatgaagactgttttactcagaccaaatttatgccctgtattttgttgccatgtattcatataaacaatatatttatgtttcagtgatgagaaggtgttttaagtggcaattaacatgtgttgtagcaacaatgcccatagcttagtcaggagaaagagttcgattatctatgtccaagaacaggtaattgcaacttcataatgagtttcccttgcatttatctttgcagtctttgtaagaaaatatcttgcaagagatctcttgatttcagagatgttgacatttaaaataataataataataaaaatctgagtctcagaattggtgaaatatacctccttaagatttgctagaagtctgcttcagaatgtttcttgttgaataatatttttacagaatactatgattatttacttaaaaaaggctcttcagctcttgctagcacatccaaacagagaaataaatctgggactcttgattgcatgcatatcctattctatttttaagctttttcaaatcgaatagattgcttagtaaatgctctttaatacacatgttcaaagttctaactttgtgtttggtgggatgctcttatattacaaaacttagttacaagtagtgaatgtcaaacatgaccatgaacttctaaaattcagagtggtttattcttcattaattttcaaaattgaaatacattttaaaaggacatggtttcaaaatcattaaactcctcaaaggagttcccacttacgtactgtttatctgactcatgtagttgaatattcagtaatacagagtttgattagcgtttttaaattttttactttttggaaaaaataatcttggtttggaatatactgagtctatacagaggacaggaatttaatttcaaataagttttcagattgcttctagctccccatgtcataattactattttgacagttatgtctcatagacatttattttaattgcatatgttagcaattcattttggcatgacactctctaccattgttgtgttgccgaattatgcttacagaaactatgtcagaaattcagcatgtggagaacagtaattaacctgactcatcaattagcttttgtgaatacagatgtcctatgaatatattccagtcattttttttcttttttaattaagtaaaatctcactaccctgattctctccgcaccttctacttctaacctgtctctgagtcttcttcacttaccacctgtatgttttgaatctgtgccctatctaccatcaatagcctgcatatattaacattgtctctcttctgtgttttgcctatttagcctctgtctcccacacacactcttgtcccctctaattcattctcacccttgcaagtagaggaatatttataaaattcaagtcacgtcttgctgcacccacctgctgggtgtgtggaatgattctgggactacttcacaggaaaaaacgaatatccttgagagaggctacaaggctctacaccatcagtcctgccaccctctctgagtctcgccatgtgtgagtctctgtgtctgcttgccacatggacctacattccgtcccttgaaggtagacaccatgcttcttcctctatagggactttgcacatgcaattgtttcttctacctagagcattcttcccacccaacccagcttctcttggccagctccttcatttttcacatcaatagtcacttcaaacattgccttgtctggccacccagacctaatctagggcctctttatgtgttccactggaaatatgaacaggacttttatgattcttatcacagagtacaaagaaatatgcatttattttaatagggtgtgtgtgctggaccacggtgggtttcacagggtaggaattctgtttattcactgcagtatccacaaccatttgcacagcaattagcacgtaagtgtgcaatagttacttgcttaaaaaatgagtaactctactacaatgaaatgggtgattattaaatctaggctgaagtgaaatttatattttcaaagaaaagtctgccataaaaaaaaaaatgtaaccgtaacagtggtccattttaaatggcttttaaagagatttagaatacatggtttggaaatgcacttaataaaaaatatgtcttatcattagagagtcacatatcttatatatttggttaggcacttccacttcccagctgtgcaaataattatctttctgcatctgcttcctgctctacctgctctaaatatgtctccggcttgttgtaaagagaaagcaagtggggtggggtgtgaactataaaacactgtatgtacagtttaactatttaagtatgccatgcagattctttgttagccattgacttgatttttacaacacccttgaaaataatttctgaaatgtctctaacatgttctacattttagattttccactaattaatactgacttttcttttaagtagtctaaattatcatgtatttttagatatcttatgcatttgtttcataaactaacatttgttttgaggacattacctgcaatgcatgtttttttttttttttttttttttgagatggggtctcgctctttcaccaggctggagtatagtggctcaatctcagctcattgcaacctccgcctctcaggttcaagcaattctcctgcctcagcctcctgagtagctgggactatacaggcacgcacaaccatgcccagctaatttttgtttttttagtagagatgaggtttcatcatgttggccaggatggtctcgatctcttgacctcgtgatctgcccgccttagcctcccaaagtgctgggattacagttgtgagccaccacacccggccaatgcatgcttttaaatttagaagtttcacctcatcctgaagaagagctcatatgaatatgattacaagaaaataacatttagattgagcctttattttttctgatgtcatgcaaaatccgtaactatactttttagctctttctcttagccaaagggtagtcaattatgttagtagatgagaggatattattcaactaagtgcaatgaccattttaataatatttatattcacctgaaatgttgatcagacttttacctaggttgctatattctcattttatatacataggtctggcatatagacattttcatatctacctctaactacaaggaatatgtatatacttttttaaaaactgaaattcttttgaaacccttcttctaattctgtctcagtcagttgtgttgctataaaggaatacctgaggttggataatttttaaagaaaaaagatttatttggctcatgcttctgcaggctgtacaagaaacatggtgtcagcatctacttctggtgagggcctcaggaagcttccactcatagtggaaggtgaaagggagtggacatcacatggtgagagaggaagcaagagagagaggaggaggtgccagactcttcaacaaccagctctcaggggagctctcaaggacactaagagtgagaactcactcactcccttgaaaatggcaccaagccattcatgagggatccatccctatgatccaaatacctcccatcaggccccaccttcaacactggggatcagatttcaaaaagagacttggtaggaccaaacaaaccatatccaaagggtagcactatccatgccatgccattattttatatacaaatctggagaagaagcatttgaaatgcaattgtcaaacctatatttgataaattaatctttatttacagcaataagtattgtcttacatctgtattaatataaaatagtcgtatatatacatacatacatatatatatatatatatgtatatatatatacacacacacacacacacacacacacacacacacacacacacacacatatcaattccccccaacccccaagggcatattttcaaactgggcatcaaccaaccaattttacaggtatttttcactgaattcagtctatgttttggactaaagtttatggtccaaattatgtaatgataaattagataagtctaaccattatctttacctctcagatggtctggaataatggcagctcaataaatcctttccctgaaatacagagaggtagatacttgtcttgcttagtacaccaatttccatgttttaccttcaattataataattaaagtgattaaagggtttttattattgacatgaatcatgtgagtcatcttttcccaatgtcaacaatattcttgaacgaaatatatgactaatgactggatttcagctgtaacatgtaatattatcatgtattaaaaatctaatatgataatttatgtattttataataaataatgtatatatttacatattttgtaatttgtatgtatgtaattaatttatggcacactttagtcaatgatagcatttaaatctgagtccatttcaatttgagttgcactaccagcagatttccagcctacattttatatttgaaatgtatttgctttacttcaaattaggtgtatttcttgttttgttaagatactgagttcaaatttatctcttttaaatgacactgtattgacctttgcacattgtctgttgtaaatgtgtaattttatgtgtcaatacagtatcatttgcaaatcagaaaaagaatctggcacctcctcctctctctcttgcttcctctcttgccaggtgatgcctactccccttcaccttctgctgttagtggaagcttagcttcctgaggccctcaccagaagtagatgctggcaccatgtttcttgtacagcctgcaggggcaccagccaaataaatcccttttttaaataaattattcagcctcaggtattcctttatagcaatataactgattgagacagaatcattgcaatatcatttgcaacatcattgcaaattctattaaagaatccattaaatattgtgatttagtgaaagctacttagtaaaaaggttatgttctatttatttgtagtatccctaaggcgaaacctgtaggcttcttagacataccattgaaggctactgaaattattgaattcaatattatagtatctgctagtgcaggccaatatgcgtaggtcaatacccaatcatgatggttaatttcatgagaatattgttgcagaatgttgggtttgagggaacctcccatgttcactgaggttaaaatacatccaaactcatccaacataatttcctaacatgccaagagtgattgggaaagggatacatttttgggatagattaaaataaaaaaagtgataaaacatgaaaacaaatagggcctaaaatcagctaattaattcaaaagtgatcagagaataaaagttctgcaaataaaggttagaatggaactcaaaggaagcaagtaatgctcaccttccctagagagctctaataagaatgtcacattaggtcatgaccatcttctccttatcatgctgctgttctctggctctgttttgatattactgctggttgcaaagtgctttatagtatttagaaataatcagacccttcttactacaaaaaacctcagttctctttattacctagatgtattgtgtaggcaactgccctttggtattcattttgaaggtttagaatgaccctttcagaagatgttaattacatattttgttagggctaagtatggtctctaagaggtagcttcttctttctttatacaaatattatttgtatcctgagatttatatcaaacttttacctaattaccagattttaatattcttattgaccatattggagataattcagagaacattttgttttttttacaagtagttactgaaagaaaagagaaaataactttatattgattttttcatatgattatagattaatcctcaggcaatataattaatatcataattcttcccatcttttaaatgaagagtttacaaaacatatagtatttgttaacacttaatatttactatgtgcctggtgccattctatgtgcttttacatatattacctcatttcatctttacaatagctctctgtattagtcagcttggaatgttataataaaataccacagactggctggcttaaacaacagaaatttattttctcaaggttctggaggctggaagtccaagatgagagtgttacatggttagtctggtgagggccctctttctctcttaccagtaactgtcttctcactatgtgctcataagacctcttctttgtgtatgacgagagagagagagacagacagacagacagagagacagagacagagacacacagagagagacagagacagtcagagagagggagagagggagggagaaagagggagaaaagatgagagagagggaaaaagacatgtcgggaggaagccagggagggagggagaaggagagagtgtgcaggaatgagcacaagtgctttctggagtctcttcttataatgatactaatcctatcagatcagggacccaccattatggctttatttaaccttacttccttagaggccccatttcaaatacagccacacaaagggttggagcttcaacgtacaaaccttcagttcataacaccctccaagctaagttctaatcattcccagtttacagaagaggcaattgagacactgagggtttggtgatttgctggatgttacccactagcaagctttagggctaggattcataccccggctgtctcactcaggtctctctctgcccttaactgcattagccagagatcacagagaaaaggcaaaaagagtagagatattttatgatacggataagagatgagaaagggaacttaaaagattcacattttctacttaaaagcaaagttacaaagcctgtggaattgctctgacttagaaagaacttgatcatgcttttggagtctctatgtgttctctctctgttggttagttttaaatcagcctgcctcacaagggagcctgcatttgattcccaagcccacctcacatttactgaatcaaagtctctgggaaggtggcagtctgagactgtgcatttttaaagagttctccaaataatttgtatgtgttctaaggtttaaaattcacagcttctcgaagaggtgtccagctcaggttaggagatataattggaggtgatacaattatgtttgggccaagcactgggccatgtgtaagctcttgctcaacgcaaaaatctgatatgcaccaaatcctttaaaaacagctctccaaggaaaatttaggtaacctattcatactgctggcatgtgctcctcctgtttccaccctcgtttattttggatatttttccagtcctggaaatcatcttccattttggcaccatttcttgattgccatcttgataggacttttgtctgcccactcccccacaacaaccattcctgtctcccactcactttaccacccaactccctttcttgtctattcctggatgcaggacaccacatagtactttctaactttgatattgcctatgacctagagagtggtaagtcatccatgtgacttggtttgagaggcactgacaggctgagtgactcaacgttgtttcaaagtctagttcctatggtgtgttgctcaggcgcaatttacatcgtatggagcacttactccaagatatacacgagagaaaattctacaattggttttgattgggaaatacttcaaattgatctataagttgtagataaacaagttcttcagggcaggatgtgaaaagcacatgcacgaattctcttgtgtgtctccgtgtatgtaagatttggtaaaagtttagagctgtatatttttcacattttcctaaatgtttattaaataaacatttaatagacacttgtcatagtaaaagttctgaaaagagaaaaactaattctatgtatttcaacacatcaacctccaaatttatttgatcacagaacccatattttctgcataggtgttttgattttctgaggacctaatgttttatgcactagtgtattggttcatttcttgaggcttaatttcccaaagctctttttaaaaacacaaaacacttacctggggcagagagtatggatgatctctgaacacttctagaaaattttacaacagagatttgaaaagataaggatgtagagagtgcaggacaaagataagttaatctagggcacatgcactttgagataagagggtatcatgaaagaattttaatggaaattttgggtataactggggtgattagggatgttctgagttaactccaatattttattttattgattgagacagagtctcattctgtcacccaggctggagtgcagtggtgcaatctcggcacactgcaacctccacctccctggttcaaacgattctcctgcctcagcctcccaagtaggtgggattaaaggtgggattaaagccatcatcatacctggctaattttttttgtatttttagtagagatgaggttttaccatgttggccaggctctccttgaacccctgacctcaagggatctgcctgcctcggcctcccaagtggtggaattacaggtgtgagccaccatgccctacctccagtatactttggagggaacatgaatgtaagatgcagaagaacgaagaagatgatgaaagaaaaggtggatatgaaggtgggagatttgaaagcagattttatgcccttcacagatttttagatgccaaacctgtcaagaagtttgagaattgagatgtagatatatatgtgtgtgtgtgtgtgtgtatctctatgtatctatcttatctatgtatctatgtatctatctatgtatctgtgtatctatgtatctatctatctatttatctatctatcctacctacctacctatctgtcatctacctacctacctacctacctctctctgtatcaagagaactttacatttctaaaactaattatctcaggtctctaaagttaagacctgatgtcaatgtcaaaagtcagtcctcttcaaaacattttaaatttgtgatgttcctgaacaacagaaggcttaacatcctgctgtgtgtgaagataggcgcaccaccataaattagaacatgtggagcttttgtttttcctttgactttcaagtccatcatttttattagtgttcttagaacccctttctctgaagacagactttgcaactttctctaaagtttttaaagagacaaccactttgataaattgaaggaaagcaagaacagagagcttggattttatctgtttttttttttatttttccattagcataaatataacatacaaggaaaattcatgtgtgccttaggtcatgactgtaatgcttgcatcttctctaggaagaagccgtttttttgaagttggtataaaagtatgtgtcaagaacactaccttgaattttaccttgaagtcataagccatccacagaatgtgtacgtttaggcaaaaatgctcattaaataaacttacattctgtctaaaagtttgttgtaaaacttatcaattgaaatttctcaatatttgcaactatgtcgtagcaatgtatagccacatatgaagggccaggtgtaacctgcattttcagtttggcacattgcccttctgtgatattctgctcttgggcctttccttttccgcttgtattccttttctacatcccttcctatgtccccatactgtcactctgttcatcaaagcctgccttcaggagaggagctcacagacgaattcataataagtattaataactgataaggctgaacacattacaggaagatttcattatattttattaatgttaatccctaataccaagtgaattaagttctctttgtaaaattttatccgccagcaatgtttaggaaaagtaaactgcagtggtttgtggagccgctggaccagcttacaggagctaattgttaaaattttaggaatttttgtaagctgggagttaaacatagccaccgttgttaaatatgaaattatataaacttgtaattaagtagatcatattgaaaacgattatactcaaaaattatgtccttattatatgactatattttaatactatccatgctcttgagtacattcttgtttattgtatttgtgggatatataattgcatatttcatccctactccactccagagacatattgttagcttgaaattagtcatagtagatgtatttacattatggaaattaccaaatattacaaataggggtatgttttatcgttttgctgattggcaagacttgagatagtactggagaacatgttgttaataatgcagattaaacttaaaagtacaacatagctatatgctttacattgtttaatatcacaaaaattgaggaaatactctcttagtatttgaaaagtattatccagtttagcataaaatgtcactgttaacattctgacacatatttccttcatttcactctgttagtgttatttaaggtaagagaaaatatcaaccgcatggcagaaatgcccttttcatcaattgcaaccaggttggtggctactgtgttggttaattttatgtgtcaaaaaagctagtccatggcacccaggtatttgagcagacattattctagatatttctgttaaggtgtttttatgagattaatatttaaatcactggactgagtaaatcagattacccttcattctgtgagtgggcctcatccaatcagttgaaggccttactagagaaagactggccttccttataatgcctgcatcctctttaggcaaatgtagttttttgaataagtgtaattcactatatatctcattagacataatgagatataaaagtatgtatcaagaatgcttccttgaattttagcttaaaatcacaaaccgtgtttacttctaggtaaaaactctaagtaaatacatttgcattctatctaaaagtttattgtaaaattgagcaattgaaattctgctagctgactgactcttctttctctctctctgtctctctgtctctctctctctctcagagatatttatgtgtatcctgttggttatgtttctctggagaaccctgacttaatacgaacttggcaaaaaccaacaaaagaattatgtgcaaatgaattggctttagggaatttgtaataaacaatattgtatgttttataattatttgtgaattgtgtgctgtacattctttatatcagtaacatatatcataaacatatatatacatatgcacatttttcttctacagggcaggatgtgaaaagcaagtgcatggtttcttttgtttgtgtacgtaagatttgagaaaagtttagagctgtttatttttcacattttcccaaatgtttattaaatatatttaatatagacaaagaaaaactgcatatattattcttaacattaattgaaagacagaaaagaaatttttattttctaaatatagaacagttactattaactgcaatgtatcttttgaagtgaaattccaaaagtaattagctgttgtttaataaatataatattttcacaaacagtgccattgggatagttctactgcaaaggcaaggttcatgtgtgaataactgcaggtgttcagttttcaaagcctctgaaaacccttgaacattgaaacctacatggtgtgttatctccttaaaggagatatagtttgagtggattccatggttatttgaagtgtgtagttttataatgccccagcatttgaaattcaagatttaataatctctcacctaccaaatcatcaaatggcctttcataacaggatgctgtaccattcatttcaatggcagccatgggataatatgttctgaagccatgatattgataaagagcctggctaccatgaggaaaaagaaaaagaaagattctgcttggacttaatatgtttttgctctttcaaaaggcaggataatgttaactttaatttattcagttatgcatttttcaacttgcagcattaaagaatgtagaaaatagagtaaaagaaacagatatgcaaaagagtagaaggccctttgtatgaaaagtgcctccttagtgttcagttattgattttttttcatgacttggctttgcaatgaatatgatggaaagacaaaatcaatatgaaataaaatttatgtaagtactgttccatgcgatgcagattttatacatttctggagtataagtttgttcttgcaaagtggttttaaaagaagtacatgaaatcagtggcagtaacaacgctggcaaaataagcactttatttctagaatgctggtaatggagtcctggtttctaattggtactttatagcactgacagattttaaattgggctgatttttggtgcacactcctttatgcctggattttaaactcatacttagatttagtgctacttgctatttgtatgtggcaatatgaacaaaatattttcattactatttcattttcagaagcacaaaaacctaggatgcggagaggttaaatagctcccacccttccatattttccatgtgagaaatctagtatagaatgataaatgtcaggtctgaaactaaggtttcttaattctcagtttcaccccagccacccagtccacaccatcattgttttgtccactatatcacagccaagattaggagaataatttagcttcttcaagtctccatataatacctacattcacattttggctacatctgttcaattgtgacaacttcagataggaccaaaaattttgacttcattggccctctgcatctatcaagatgattgtaatggacaaaaacaagaaatgaatcatatctgcatcattactcaaagaattatcttcataagtcaaaaagtgtgctagtatcattgcaaaagatgtcagacaagaatacgtgcatacagacacatgcccgcacacacataaggatgttgtttgtaatctaagagcactttggttcttttccactcctgttcaccaggaattgggatatgactgtggggtggagtggcaaaattaaatgaataagccctgatgaattattctgttgtaatagtattttctcacagtggacaatggaaataagagtggaatatcaaggcagagggaaaattcacaaattactgtcctaaatggagaaatgagagaacgcaatagtgaatcttaaagaggaaatcacagcaacacaggaacttttaaaagtcagccagtttgtttgcccatctgaaaggcagtcccttctcagatatccaagtgaaattctgcctttagagacaggctttttccgttgtcgaacaattataatttataaactatatgttaaagcaaaactctgccttactatagcttaaactaaattctgtgattctggaataattttctggctctggaaataatcagcaaatgatttgtgcattaatttattcattccctcagtcatagagtaaatatttaacgagtacctataacgtattaggcattgtgccagatgttcaatgtatctaactctttcttcttccatatgaaattccttcaaatattggaagtcctgtagtcctgaagttgttttagcgttcattactcagagggcgtaattctgtgtttttcactgttctggtctctctcttctacttgcattcaactgtcaaatggaaagaagatgaccattggagatatttaattaaaggaaaagcatttcttatttcattaattatgatatggcttcaggagaacatatagtgtacatcacttatgagaaactcaaaaactggtgttagcactttgtgaccaccattctattattttgtgttttaaaaatttgccgctactcaggaggctgaggcaggagaatggcatgaaccaaggaggcggagcttgcagtgagctgagattgcaccactgcactccagcccgggcaacagagtgagactctgtctccaaaaaaaaaaaaatgcctaatgttgatgaactttagagagtgataaattgttcagcatttttatttcaaggtgtatgactacgatgctgtgcccattaatttagctcaggatttctgaccttacattcttcattagagagacacatgtctaaatgtttccttttctaaaaatcagaacacttgtccagcagccaaatgttcttccatttctcagaagagtcgttattcaaaaaaccagtatttttggttgataggcaacttatttaaatagttaagcaagtttctaaacttctcagctattgagcattattttatttttaaattaatgctatgtagcctctaagaaggaaatatctatggaaatgagaattggagagcttgtattgaaaataaatcctcacctggattaagtttcatctgtatgtgctgtgaactattggggaatgaaatgttttacatatgaaaattctgttgggttgtaataacttcttggtgcctatttattcttatagaaatctgtcctgatgtgaaaatcacatggacagtaaacttttagatgaatattgtaagtttcttataactttttcagtcttctttttgttgcttgcctaattctagcatttccctgtatatagattttggtcagttttggggtggggaaagggcaacccaaattttagaattatgtgcaacagttataaaatatagtgtctggctgagggtcgatgggactcaattttctcaatgtgcatggattgtacttacaaaggaatcttggtgtctccattgtttgctcagttatatttctcagttgtttccttgtatatgtattggatataagaggtaggaggtaattagaaagctaatattttaatgaattggcctcttcttactttattgaaagataaaacataatttactttttaatttttaacatggggaaagttactgtgctgtcattagaactcacgcaggttactgtgaatttcagatgaaatacatgtaattatttttgtagctagtatataacttgagaggagttacagctttgtagttacatttgtgggctctagagtcagactgctgtggagtaagctcaggcaagttgtttaacttccttgcatttcattttcttcttctgttactggggcctgtaatagtaactacttcatagagtttttcaagggattaccaaaaaaaacaaaaaaaagacaaaaaaaacccacaaacacctaaaacatgtaaatagccatggtaatgccagctaccatattactttgaggaaacaacttattgacttcactcacttattttgcttgtgaatgaaattaaagcagataattctgacaaaatattctatgaatggtttgatggtttgtttagtttgtattaaagttgacatctgtaacttttcactataagctttttttttttggcaggagtgggggattgattatattagagtttgtaaagaaagcctttgttgcatttcgcagaggcatgggatttgtaatgtccattcatggtggaaagacatatccttatacatctgaccataatttgaaagaattttggcactattcacaatagcaaagacttggaaccaacccaaatgtccaacaatgatagactggattaagaaagtgtggcacatatacaccatggaatactatgcagccataaaaaatgatgagttcatgtcctttgtagggacatggatgaaattggaaaccattattctcagtaaactatcgcaagaacaaaaaaccaaacaccgcatattctcactcataggtgggaattgaacaatgagatcacatggacacaggaaggggaacatcacattctggggactgttgtggggtggggggaggggggagggatagcattgggagatatacctaatgctagatgacgagttagtgggtgcagcacaccagcatggcacatgtatatgtatgtaactaacctgcacaatgtgcacatgtaccctaaaacttaaagtataataataataaaaataaaaaaaattaaaaaaattaaaaaaaggattttggcaaagcaggtaacatgttgaatttcaatattaggaatctttaaaaatatgaataatattttaatggtttaaatatagaagtacctaatattaactatagttttagaaatttaaaattttattgtcaaagaattttctattcttttcagttgaattgaagaaatgcatttggcaattatttagcctattgggtaggtgatatcacttctgaggacagtctgaaagtaagcacaactcacctagtaaaattccatctgggtggcagtaatgccggtgagtctttggtctctgccctgatttcagttccacagttcgctggtataagcagccattttaatttcaaatctcacatatatatgtatagaatgttagaaacaatttggaattcacgatttgtgtgactttaaatcatttagctattctaaacctcagtttcctcatctgtaacaaagaaagaatctttctattatcacacctcatgaattttatggtagagatcatagctttataatctatacagaattatatgtttataagctattctgtggaatttgtattcttctgcagaatttatggcccatggacttattttttactataatagaagtttagaattacagtagaaagagaacagggatgggactaaaaagacctggatcgttcagttcagctttctgtggctccatttcttcatctatgtaacgagtggactggactcaatgatatctaaaaattcttcctagccctaaattttaactataatataatttcatgatatcattattattttacaggaattatttcctgtgtaaattcacaaaatggaggaaatagttttgctttcccttcagatgtcaagaatgaaactaggagataatgtgtgagatccttataagtatttgtaatattatatatacatataaaatataggcacacacatgcttatgtttggttacatgtttgaataaaatatcatgattatattattttgtgtattttataattgaaaaaatataactaaaaccaaaaacgtgtttatgtaccagaatacaatatttcagctacttttcatccagaatggaattttttttgttgcttgaattacttgtccaagtggccatggtttctattataggtactacaatgaatgtgcttatatgaagtacacattttcttcataagtatagtgtatatttgttaaatgagtgaaaaatatgacctgcagtaaaaagaagtaaaatagcttgtgttttttatacccaatgctaagtttgaatataaaacattgtgtataaataatttctattcaaggaaaggacctcaggattaagctccaaataaaaaggcactggatctggaaacactagcagtatttttgaaatgtccaagggctataaaacaaagtggatttgactagaactgttttcaatttgcacttgcctcctgggtatctgttaaaacctgcttatgaatagactctgactgatttgtgaagggggtttggcttttgtttcatagctgtgtgaatcattcatgtataagccacaccacttccctgttttgttatacattacactacaagttgtcctctgtaatttaaaaaaacagtcatttcatgatgaaacacaaactagtgtatgttgctttggttaggtctgcatgtgaaatagttctgaaatcgttactctgactacattattgagggtgcaggggactttttggtgaacttcattctgctcataacatttctacattgtctttgaaagtctccaactgatcccttagttttcctcactgatttttctttttgctcttcttccaagacctggcatttcacatattatttatttgtcttaatttgttcaggttgctataacaaagtaccataaactagatagcttatataaacaacataaatgaatttaatataattctggtggatgagaagtccaggatcaaggtgctgacagattcggtgtctgttgagggcttactttctggttcatagatggtgccttctcactgtgtcctcacatggtggaagggactagctagctctttgtggtctcttgtctaaaggcactaatccaatccataagggctataacctcatggcctactcatctctcagaagccaacagcctaatatcattacattgttgatgagatttcaacatatgaatttgggaggagggggtcacaaacagtgaataatccttcattctctctgctttttgctctgttcttctcaggtatgctaatgattgtaaccacagctctatgaatcaccagctccaagtctttgtggatatcaggaaaatatttacagctgtcttctggacactactacttgaataatccacatttacctttaagtaccctgtcttaaacctaagtcttcacttctgcagattcctgtggcagtgttccccagattcccgctgcagtgttccccagatgcccactgctccgttccccagattgctgctgcagtgttccccagattcctactgcagtgttccccagatgcccgctgcagtgttccccagatgcccgctgcagtgttttccagattcctgctgcagcgctacttttcttctccccacctgcctcgcaacactcttttcattctctctagagatattgcataagttttgctccccctcatcttgattttaatagtcattggttttttcagactgtgttaatattttccttatctaaatgagtagtctgctaagagctctccttaccactggttcatctctagtcaacctttggacatgcaaccagattagttgtaaccttactgcttaaacagtttgtatggtcacttagtgtttaaagtccttcataacctgacccaaattaatttttgatattcatttttcccctttcttggactcctcatttatcttaatttggaagaagctgctgctaagtctaccaaaatctactttattcttcttcctaggaacaaggcaaggctagggattctttacagttaagatatggcaatataattaacttgctgataatgaaatgagagaaagtgctgtgttacacctctggggttataagctgagacatcaggtatattttcccgcatttgcttcctactgactggaatccaaggcaaccatgtggccatggagaagatgacagtgggagcaatttaaatcccttagtaactaaatgggatggagctgtccccatcagtatttaatctttaccttggtatgattttatggaagcaaagtagaatctttttctttaagccactaagttttttgtagtctcatgcttctaattaatatttcttaatttttcatataaacattctgttttgttcctaggaattccatatcttggcagaatggtgataaccaaaaagcctcatgttagtcaatgaaaccttctccaagaatagcaaatatctttctgtagatatactgcttatcttatattctggcattagagataacctctactgccatcgtaggggaattaaaactataagctggtccctggattgctggaatatgtccgatgcctccaattctagcttccatatgttaggatataacttaagttgttttaacagaccaaaagagaaagtggcttaaacaagaaaggtgcttatttctctagtgaccgtcccaaacagtcctatacagggggatagagcaattgtattctacaagatgcttcttcagtcttgtagttctgctattcttggatatattgccattgttcacatggcaaacatgtgtcttcaatgctacattcccttttcagttagtaagaggggaggagaaggaggagggtccaactattcatattaaggttctatgacctgtaacttgcagatgtaacttctgtccagattccattgttcagaacttgatgtcctggtcagatctacctacagtggtggctgggaagtgtactcattgattattaataaagaaccatgagcccagttcaagcttggttggtttcataactaaaaggaaaaagagataatgagtttcgggggaaactagtggtacatatataccatggcatactatgcagccacaaaaaagcacagaataatgtcctgtagtggaaacataaatgcagctgaaagccattatcctaagccattactaatgcagaaacaaaaaaccaaatactgcatgttctcacttaccagtgggagctaaacattgagtactcatggacataaagatgagaacagcagacacggggaactactagaggaaacaatgtgaggtgagtgcaaggactgaaaaactatctattgggtactatgctcactgcctgggtgatggaatcaattgtaccctaaacctcagcatcatacaatatacccatttggtaagcctgcacatataccccctgaatctaaaataaaagttgaaaattttaaaaaatgaaataaagtgtgacgatcctttatgttgtatagataatgatgtagacactggattgcgtcttttacatttatttggttatttatttctcacctctatttggacaaaaagtcctccagagaaaattctatttcttagcctattttcagcctcagaagttaacatggtttctggaatatagtaggtatgcaatacatgcctctttaaagatctaagaatattctcttaaatatttctagtagaagagtgaattgtttaaccactttgtaaaaacaatctggcagtgtttacatagtctactgtatgaatcagtaatttcatttctagtcatatatcagacataaatgcatcagcatgtgtgcccagagtcatggatgaaaacgtccatggcaacattgtttatagcagctgaagaatgaggaatgaagcacaaatttctatcaatattataatggatagattgtggtgtattaatgcaatagaattctgtacagttatagaaatgaacaaactatagcttaatgaaataacttggataaatatgtcctccaccaaaaagagcagaaacattaaaaaactccacactacatgttcctacctgggttatgttccatcctatgttagaaattaggattgtggtttccttgggagatgaaggaaagggtagtaaccaggaaggataatgaagatgaggttctgatgtactgactgtgtttcatttattgatttattagttgcatgtatatattgtgataaataattgaattttgtgttttatacttcagcaaataatgttaataaattagtaactgcatgattgatatgctcagtgaaaaaggatctagaacaggtcagttataaattgttgccatggctttttggatgggtgtcctgggataaatactcaacctccctgagtctctcttcctacctcttctcacagaggagaaagaagatttgtctgtgatttccaaagtttattccagatctggcattctatgcagaaatcagaaagagatgaaatgactctgtttcatatctttttttgagactgccttacacagtagctcagggcaaattaaaagaaaagaaaatctaactttttgcatgttcatgcttaaaccaagtcaatgttctgagacaccgataacaggcagcctaaatgataaatctattatgaagtatttacattactattactttgaatatactgtagtttttccagttggcatagtgaaaaggtgcatcactcaccataatacgtagagcaaacatcatgttgtagttctcaatctttggggttttacatttcagtatcccttatctgaaatgctggggaccagaagtatttcagatttcagatttttttaggggaatgtttgcattatattacccagctgagcatccctaatccaaaaattcgaaatccaaaatgttccaatgagcatttcctttgaacatcatgtgggcactcaaaaaattcagattttggagcattttggatttcaaattttcagagaatggatactcaacctatagtgagaatttaccataaatagaaatcagcagcctcaataatttcagtccatgaaacatttaaaaccaagaccaatgtacaactcttggtcttgtacaatgttggtgttgtacaatgtacaacaaaaccaatgtacaactcttcaaaataaaaatgaaagtcctgtaatgatgacagtcagcacttaaatcattcccaagtaccagcttatacttttaaataaaatgcaaattgatattgttttactgataattaagggcaaagcttcaattattgggctttttaaaaaatccattttcagctagagttgtttgtacattttatggtgtagatatagccagagtaggatttagttggaatttttcagattacataattatttaatctacttttgtccaactttgctttgtctttatagaactaacagtagcattggtgatagaacatatgataatcttgcctttcttgattatactgcatatggagttattagtcctgactctgctcctgtaatctagaatataagttaaaggaaaatgttttggaaattcctgacaactagtgagatgaaaaatcacctttaaatatgaagtatgtattttgaattctacaaacattactgctatggtaccttgttttgtacaagttatatattagatacacaatttaatagtataacaaatcccctagaatagtagaggagagaggaatcttcccctgatatgtttttgtaatacttcttcctcctcttcagtcaatagggaaatgtttgttgaaagactactttgcagacatttagaaagatacagagtaagtgtaagatgtccctccttgtccttgaggagtctctagtcaggcacaggtaggactaaatgaaaaacaactacagaactaagtagaagagtgtacaataatatggggaatgtggaacaagttatacgattaatagaaattcagaaagaaggatgattattctggacagtcataatctcaggtgatttcaggaggaaaatgagctcttaaaaataactaactgtgttttgcctgcgatgaaggcggggcaggtgttcaggcagtgcaaatacatggagtcagtcagaagtcctattgatcttttctttgtagaggctctcatagatgttcttaccttctttctcagtaggtgaggttacctcttaactcaccgagaccatcaaagctttctggcctgagttccctcatctgaaacagttcaatattgtctcttcttctcatttacatagctctatagtttcctgtgttcttttctctctcctgctggtctttgaggaagcggtatcagtatttaattcttggtccctttttttaccctttctgacactgtccctgagtaacctttccagattcttccatttcttactctccactgaaaaatgtatgtggtactcttgaaagttaagaaataaaaataaagatttggcttatttatttcttcattttattatgatatttgctggattctgcttgatagttaacagtggaactgtaagtatatcccctactctaaactcactgagggcagcacatgtattttttatccttattttctctcattgtaccatgcacatagcagatgagtaatattggataaataagagactatacatttcttcatgcttcatcattttttttctttcatcctttcttccattcatttatctgtcctttgaatagtcaaaggattttaggtagtctatgaaaataatctaaaaagtaagagaacaataaaaacataaatactcattttaaatgttttttcatttatcttgaataaatttcatttgatctactaaccctactcacctctcttctatattacttcactctgcccaaccaatgcacatcttaaaaatgagcagtacccttgcagccttcattttatcatcacccactcaatcttgaaactctctagtttgacaatatctgaaaagctactctcctgaaattgcttcctccaaggtcactcaagaatatatacttaaaaattcaaaacacttttatcatttttcactctctgctttgtggcatacaacagtattctactcgtttcttaaatgcgttatcttccagcttaccctccctgagggttgctgtcatagctctctgcataagtttggctgctccatctccatcacaagtactggctgctcttttcccccggcttcctaagctttggtaagtgattaagacttaggcatttgtgacttgccttctctctcttctctttccttcagagattttatttaattccagtgagaccctcaatgtccataatgacagccagatttccattcacttctcctgcagcatccagtaggtcaatgaagaattactcttcaatgactctgttccatttacaaatcaacatgtgtggagtagagaagtttggccttttctgtctttcttttttttttttttttttttttttttttgagaaagagtcttgttcttttgcccaggctggagtgcagtggtgcaatcttggctcactgcaagctccgcctcccgggttcacgccattctcctgcctcagcctcctgagtagctgggactacaggtgtccgccaacctgcccggctaattttttctattttttagtagagacggggtttcaccgtgttagccaggatggtcccgatctcctgaccttgtgatctgcccgcctcggcctcccaaagtgctgggattacaggcgtgagccaccgcgcccagcctttctttcttgatagcattgttagccagtcatcgaggttttaacgtttggggacttttttttttttttaatttctccctttcattttcctttcattttgcatcaccagtgctttcattagattttcttttcctctgattattttctttctcctgtcttccctttgcaccactctggtgaaggtcttcattcctcaccagtctgctatgaacatttccaacagatctccctacatttattttacttacttccatcaggcctctatgaattaaaccccacgacatacctatctcctcaaaatactttactgtctgtctgttaccaacatcagcaattcttagccctgatcatcgcaattatctgtcagggccagctgcataatttgcagggcccagtgaagaatgaaaatatgggaccccttgttcaaaagcagaaaaaagtatcattaaaggaactagaaaatttaaactttcctgattttccatggcctttcactcaacttgtcatgatgttttatttcaaatttgtatttaatgttgcattaagaaaaatttaaattttaaattgttaacatatattttactgttcatctctatattttgcagtgaccattctaaatgcaaataagaccatttaacttatttgcataaacagtaatgttacacagtatatagtttgtagcttatatgtacatatatatttctctcttgtcagaacagtggaaatgtggcacaaaactatctcaactgatttaactttttgctttggtctcatttaccaacagtttaacttatcttacagatgaataaagaagactgaaaagcaaagaaactacgggttcctttgtctttctctttccttctctgttattttcagttggctaatacagaaaagtagcgtgagcaagaaaggatatgacaaggttctttggtcatttctatcacctagaatgccattgcttcctttctaccctcaaagcaattctggttcaagcagaaagcttggccttttgggggctgtcagcacccccatttacccagtcataggcgtagcccttaccttgtactcactttgagtcttgctgaactcccacttattttgagctccctggaattcagtgctcacgggtcattttgtactctacatgtgaatggagtaagaaggaatggcagcagacaaaattactgataaaattattaagaatttcatgacagctacaggagagtattaagccaaacatggggctttgggagatggcacagtctgaatgcccatgaagccactactgtttgtatggatcctttaaaaaatagtctccagcctcagcctctgttaatcacagtctccagggaggggtctagacatatgtatctgaaatcaacaacaactactgcaacaacttcacaagtgattttatgagctgatataaaagtctgtaatctcttaggctagcattagaagatctttataatcaattccttaactacttgcttaattttatcacattactgtctactttgagcccttgcctatgactccatagaattatttgatgtctctggttatattttgtgttttggtccaccctgtgatgctcatgccattatcctcaatctcagtgctcattctctccttactacttatgggaattatgctatcatttctcttaaacacatatcaaagcctaagtcctctctaaaaccttcccccactactccagcccacagtgaatcctccttttcctcagtttttataggacttaggttctagccatttattttatgcacattattctgtagtgtgccattacttattcttttatgtgcatgttctttcttcctcactagactcagggtttctttagtacttggtattctgttgaggcttaaaatggccatgctaggatctaagagttatgatagttcctagaaaatcttaaggaataaataactctaaaaaataagctggcttctatttcctaatttgattggaccacagtacttttcaggaaggaatttacattcaaaatgtatttttggccagtcaccgtgacagtgcttttaaaattatttaatttctgaaatttaaataaaattagtaaaattcatctgaaatgtgatgccttagctgtgctgttacaagtctctagaaaagttgtaaaatctattttctacattttttccctttccaaatgagtagtttgagtagttttcctaaaagacagaattttcaaacaaaattaagaaactgtcttcaatgaataaaaaggtaactttatcagactgacatctgtaaacttaatttggagccagaaagaacagatataattgaaatatatattatatatatatttctatatatatatttggaatatatagatatttcatatatatattgaaataaatatgttaaatatatatttattgaaaaatatattaaatacatatatttaaaaataaatatattaaataaataaatatatttatatatttacttaatctttcttgttttttggtgaaaacaagtggcaatgtagtgtgaccttatacaaagatatctttcttggggaggtgtgaaattatgaggtggtatccaagtgtttggcttagaatgtctgtcatgactgtcaaagccattaatttataaagtgaaattagaaagtaatgtgtttctcccaaacacaccaatgtgcatgcatgtgatattcttacaatacattaattaacatcatcacttttttttataaactatcagtatatctagataatttataaggccctcttccagcttcaaatgttattttataaatttttgaatgtgttaagtttaagagtgtatttgattaaggcttagtgctaatggaaatcttattaaatgttattagaaaaaagatttctttaaaaagataaatatgttccaatactatactaattttagaaaaataaatttaatctttttatatcagttatctaatgtcatttaatcatatagataaaaggtctttaagttctaacagagttaatacaggatcgtcatctaattcaaatattaaaatttaattttccaaccatggaaactgtgctacatttatattaataatcactggaagtattctggaggttcttttgtgcttttttcttaggcatttaaggagactggtgaatagccatacttgccatggctatttttttgttcactctttctttagggaaaaaaatagacaagaaaaagcataaaagaataaaaagaaatgcatccttgctgtggtgtttcatgacatttctgcacttgaacatctggaaagcctagtgtgacagtgacaaccgaattgacaaagttgctgactgcatccactattacaaaaaaatatgggcactaaaagcgccactttaattctgaaaagctcaatacagtgtctcttcattttggccttgaagatagaaagagaaaccacatttattttgaagatgcattctgagcattgtgcatcgcacacattggaaaacaacagctccaaagaaaggaacatgcattataggaaaagagaagagagcagctgtggaactcggtctaattgcggaccctagatgggtttgataatcaaatgactattctgcataaactagaagtaaaatggcaaaacattaattactcctattattgcttttatatattgagatgtgggacaaaatgcataatacattttaagaacagaatctaaaggaaaagaaaaatttctacatggaaatatctgcagtgtcaaagaaaagatgccacaggaagaaagcagccctaaaataaaatgccgacaggcataaaacaaaagttatatatctataatatgctataatttaacgaagatacaaaatgaagaggagtaataatataaagataatgtattaagtctttaaatgaagacaaaatgtacattgaaatattttggttaactggcaggaactaaacaagacttttgatgttagggctgattatgctgaagtgttgttatttgtgtgccactaaattttatgatttacctccacaaattgcatgagcaatttatggaactatcatccagtgaacaaaagacaggataacaaaatgaattaatattacagtacatggtgttcaatactattattctagtgggaatactctcggtctgaactgatccagcagtttttgtgaaatgtaaacctcttcaatacaaatgggcattcattactgaaatctggccataagtaaaaactgaaacctaattattccctgttaagttctagagaaaaaacaatcaggtctgtgactactgtactctgtcacacttcaaaaatagcggccagctccaaaaatctaggagcagcaaaccaccaccaccaccacaaaatgatttgctgttctgctattaggtttttggaaatgtgtgttattaaggatattttaacataataggtatatgagccttaagaagcccaagtctagtctctgcctcatacctcaggaatcacctcttctactctggaaagttaaaaccatgctttgagttagagtaaatttatcactaaattcaacttaactcattggatgtgtcttgatttctagaaaagattttgatttgttcaggacttctctgttcataagcagcacaattggaaatggactccaggtatctctatgccaagtacagtcatcttccatttactcttctaattaaatttgaatgctttcttttaaaacttgagattgagcccatgcattgacacttatttgctccagtttatataataaaaacattgagagtgtacgactgcgtgtgaaaagaagaacaacgttttctataaattgcttcatcattacttacggatcaataaatatgtgctgataaattacacattaaggactcaaccatttatgaaaaataatagtaaatatctgcatttctctgagccattgactacatagctagggacggcctgcagtggtaagctctgctaattcgtgacttgatgcccattttccctgccctcattcttaatagagcccaatttgtttggggtatcaatgtgagcagcacaagcaatgaactgttatctagctcagttaatcttgacagtacttttcctcaatttcacagccttctttgtagctgtagatgtccatgtgctcccttcaagctgctccaagagtttcttgaagagtgtttgttttcattatgaatggggtcagttgtagccagcagtgtcctttctcctcccttgctcctcttgggccttgaacatacacgaaaaggtcaagaatccctgaaatctcagtcctgatatgtttgagttgctgaaccgctgatagcagccacctacctccatccagtcttctttggtgagaaaaacaaaactctatttgttcaagctactgctagctgaattttctgtcacttgcagtctaatgcattgctaaataagatttcatggcttagaattgaataagctcattttaaacactaggggaagagattttaaaaagggaagggcagatgccatgaaaacatacttaaaaagttattttgacttcttagaagtttatttgaacacttcatgtttcactgtgattgtctttacaattcttcagtcaagtggccagagatagaacaatttgcaattgccgtgaaaccagaactcatttgcaagggttatatatatatatatatatatatatatatatatatatatatatatatatatatatacacacacacacacacgcatattatacataatatataatatatatttatatataatatattatatatatttatatattatattttttatatattatatatttatatatttttatatattatatatatttatatagtttttatatattatatatatttttatatattatatatattttatatattatatataattttttccctatggcagactcagagaatggcctgcatttattgactattgcaatcctacttgatactaaaaatatgggagaaagagtccatctatagaatcatggaaagttagactggtaactgtcttaacctagccagactctgttgaatatattaggaattaagcagtatatgtttgtgaaggaacagtggacattgctatgcagaactcatccatatggtgggttagttcttaagcaacagtcattaatcttgcctagaatattcaaagagcatggtaaagtccagccctatctctcaggaaataaaattttggtgactaagataaggcaaagggaggttttaagaatcaggcaatgattctgggatgtcaggagacattatagctgtagttgattttcagaacagattacgagtcagactttagaagtataagtaaaaggatctagaaaatggaagcaagagtttgcaaggatctagacacaatgttaagactccaaccaagaggcttggggttctgaataagtctctaattttaatgaagtcatagagtgccaatcaggaaactgaactggagcccaaaaataaagatagttgcagagagtgcaggggtggcacttagcacacaggggctcagtgttcaatatacataccaagtgttagtctgcgcaggtaaactaatgccttaccccgcacactcttcaagttgagatttgtaacaccagtggacccatttacatatcctcataacccatttactctgggcagcacattccacaaaacagagatactaactagcaatacttatggtagtttctgcttaagctgctgactttcattcattgtaaaatgtgactcatggatagatacatatgtatgaccaccaatacataaattataaatgaagaaaaaatcatatggccagtagtttactgggaataatgcactctgatattttctatcatattcaattttttactattacttactgaaaacaaaaaaaaagttgtgattgacaaaactgatttttgacccattaataagtagatcagaacctacagtttgaaaatgctgccttagttcctatgaagatgaattcttcgttcccaattgtgctattccatctccagtttttcaagtcatgattcttccagccacactttttttttccagttattgcaagtgtgtgttgtcccagcggtgctctccataatgacagaattcttctaccaatgctaaactccttgaagattgttacttaatttttattcaaccatttgcaagaagaaacctggagccttcttaacataggcatgctgaaacccagtgataggcagtttctttgtgttttctggtagcaggtctagcctctatttgtcagtcatttatgggcccagagtgcttaattagtggcagaaagggacataatagtgagagaagcatacattaaaaaattacttgacccaggataaggatgtggaacactgttggctgagagtgctaggaatctgctgctcgtgagacaaaattccagtttagttggccaggctaaccaccattggctagaatcatacaaaaacacttaaagcacaaaaaaatcacgtaagctgtgctctgaatgccctacacttacatgtattttatgtgtgtgtttggtttgtgtgtgtgtgtgtgtgtgtgcctgtgtgtgtatatatatatatgtgtatgtgtatgtgtgtatatgtatatatatagatacacacacacacacacagtcatgcatcatttaatgacagggattgagaaatgtgttgtgacatgattttgtcattgtgtgaacatcatagagagtacttacacaaacctagatggtacagcctactacacatctagggcatatgatatagcattttgctcccaggctacaagcctgtatagcatgttactatattgtaggcacttgtaacacaaagataagtatgtatgtatcctgtatccaaacatatctaaacacagaaaagctacaggtaaaaatgtgatataaaagatttaaaatggtacatctgtatagagcatttgccatgaatggagcttgtaggactggacgttgctttgagtgagtgagtgagtcacggtgagtgaatgcgaaggcctaggacattactgtacactaagattttataaacactgtacacttaggctgcactaaatttatttaaaaaatttttcattcttcaataataaattaaccttagcttgctgtaatatttttactttataaaatttttcatttttaaacttttgattcttttgtaataaagtttagcttaaaatacacattgtacagctctacgaattttttatttctttatgtccttaatttataagcgttttgctattttaaaatttttattttattttttactttttaaacttttttggttaaaaacgaagacacaaacccacacattagcctaggcctctccagggtcaaggccaccaatagcactgtcctccacctttatatcttacaccactggaaggtcttcaggggcaataacatgtagagctgataacaagtctgccctgataacatttcgttccgggattcttcctgaaggactgcttgatgctgttttatacttaatattttttttttattagtggaaggggtacactctaaaattacaataaattatattataataattaggtaaaccagtcatatagtcatttattatcataatcaagtgttatatatactgtacataattgtatttgttgtatttttgtcccatggcagcacagatttgtataccgcagtgttaccacaaacacatgagtaatgcctctcaccgctatgttatgatggtgttgatagaaatttttcagccccattataatcttacgagatcaccatcatatatataagtcgttgacttaaacatcattttatggtgcacgactatgtatataaatatataaagaaggtacttcaaacacaaatattataatcagcacagcagcatcaagcaaaacaattcatctgccctgctgttacatgcatagcttccaggaatagcatttccaagaatctgttgctctgcttcggggttcagaaagaagcctggataaaagatgtatgagaaattccccatgattggcttttgtatctatggcgtcaattcttccctttcctgtcatactttaggcatgcacccataaattgttgctgtgtgccacctcttttttttaccaatcccttccctgcagattctatccttggacttcagcttcagtttgacttgactttatactctgtggttctgcaatccacccccaaagcatcagaaatagctgtaaaatagctagtatgtagcactctaaagatgcagcattattaaatagctagttgacttttgctaacatcatcattttatgtgtctaaaattagatcactttattttttacgtattgctgatgagtcctaagaacagttgtcccaatggtttcatagtctaaaatttgttactgaggagcacatgagaaattattttttcatttatgaaatggaatgaaaattgagcatattggaacagaatgttcatttacattttaagtcagcagaataggaataatcaaatgaatgactaatactaatagaataatacgtaatactgatatttaataattaaataaaagagttaaagagttaaagagttttcctgcttatagttgtagacattgaagaatttgtttaagagcatgataaaattaaaataaaccctttttaaaaaattgtccctggagtaaagttctgcattacactaatgaggtactgttggagattttatattcttaagttacattcattgatttttacttttgacgcaagactaaattttaccctggagctcagtattattttctgccatgtgttaatttcttgcatgaatgccttatttaccttcatttagactatgctgcaggtggaatgcgagcagtacttattgctgatatttttgttggccaaagctgaaggacatctcagggtcttgaatagctctagggtttcatgactatgaaggcgatttcaaggtttgacttgtcatcgtggaagactggcttcttaaacataatcctatgagccatgatttaaattaacaaaccttatcaatagcttcacaacagttggcatctgttttaaaggactcactttttatttaagattgcattgtaaccacaactcagttcatcctgtaggagtgctcattgatacaataattgagtcaagtactcttactaaacgattattaggttttagctgctgtgttataagctatattttctctcttaaagcagtcagtttatagcatattattcaatcccatgtgcattacaaaacttatggccataaaatttacagtgtggtttgttttaattcaaatgcatttacgttgatagttttaataattacacgtttctatcaagagtagttggaaaggaatacagttgataaactattataatagttaacagccactgggcttataaaagaacctatggttatctctgagctataattggtaagtgtgtacaatacaaccagatttttctaaggtgcttatcacctattaaatatgcctattattctttcctcaaatacttgaatattgggacagatatatacagcttgttttcaccctaaatagtaagttactgtttcaaaacattttcttgtgacttgtgttattatctgactcctttaggaaaactgtcattgcaaagatatgataaaatcatctttaagaatcctagtattctcctggaggtgattctttgtccccttgtggaaaggggacagtgctttggcataggcaatcttggattcagctcctgactatgcttcttaaaagcagcctcagtcagtcttccagtttttaaaatagaaataagtacccatgtcaatgggttgttggaaagattttaggagataacatatgaagtatctgactcatagtcattgcactgtactgctagtctttttctatgaaaagtcaccttgagcttaatagttatcaccacttcattgaaaatagactttaatgtatactcaacctccttgggtattccattgttctaggtattcagctgaactactggaagagcaaatttggagatattttataagggtcagaacactttagtttaataataccattttaatttgccaaatggttagtgatattgtaataatgttaaaaaccaagcaaacacaagcactttgttcacagagttgtgttattggtcctcactgaatttaagtatttaccaatcatatatccttgagtgaaattttagataaatattatttgcaggcattaattgattccaaagggagtctttgatgttctctctatagtcctagggaataactctggtttctttaaaagattgctggacctaaaggaaggaaaaaagacatgtcagtcctttgttcttcttcaatacttataccttcccctggtttttcacttctggagtgcctttcttagtttctgatgcaagcagcaaaactagatagccttgtcatcagccttcattccagttctgccatcccaacctggtaggaattaggataaaaatcacttcttcaaatggcagatcctgtggcttagactatgaagattatgagattcccactttaacccctaatcagacttcagacctagtctcactttctcaaaggaaaccctaacccagctttccccttgactccccacctttgtcttttagtaccctatccccacctcatgtgtagccttctattttggtcccacattcctcaactagttcaggaagtttcatggaatcatgtgctcgtgtttggaaatccttactgacaagccctccttgggctaaatatcatccagataattgtagccttattccacatcctgtgtttactgatgcctaaaaaaagaaacataatctcttcttggtgacaaacactttgataaggaaaaatataaaacttgagaaaaaacttgagaaactttagaaatatatctcttgtttaattagagagtttactttgggatcaagaaaaaggatgcagcaatgacttggactttttttttattcagtagcaacttccaagcattatttcccattcttttgaaaactctttcactgaacttcttaggttaaggtcatagctctcgatatggatagcatttcaccttaccctgtgggggattgatatcttatctaagggataagagcagtattgaatgtgttttagaaaccatcacgttacccacccccaacacacatgcacacacagacatatgtagattttatgtatggaaacttgcagatataggaatattttatatatttgcacaaagttataaagtcagggaaaaatagaggtagttcataaattgaagctattattaatgctgaagatgataaggcactcacattgaactctaatattttcttccctacttattaataatggtgtttatgacagtattttaaacctagcacagggtgcatctttttcatcaatgtcttcaagttcctgtttctgggtttaccaaagcctctaactggtcaagattagtccagctacttccaatgttgaggctctggtgcattagaaaatgaagaaatgtctaatattcttatgaaggatgtggtatattaagaattttaatatgaacactgctttcaatttgtcatgtcagtgtgtctgtgactgtgtggtaaaattcagatagagacaacattaaaatttaaatctaagggcctttaagaaggtgagatccaggctgcattgccctctaaagttcctcaaaattaggcctggcaccttcttcctcaatgactgagtgactatgaacatgtactctgtggtcccagcaggtgtttcttaaatctggcagtaatgctgaagtcagcttggcagcttcaccaggaccactgtcacttggcatgtcctgctttaatgtgtgaagctgacttactcccttctcctttttgtgttttagcaagcagaacttcatgacttgtgttgccatgagttacccttggaagtgtaccatttctacataacaattggatttctgagaaattcgtcaattgtgtcaaattgcaactttcaatcagatataattcaagtgagattaaactatatttagaacgtttaaccctgattcctgttgggtaagacataaagaaatccactatggatgactgagccttcagcacaatttcacccttaaattattagactgtaatttatggtaacatctgtttctgacactgtatcatttccttaaacttaacgttttccttatgtcaatatcaagttcattccatttttattatggcattggagaataatgtataattagtaacagttatttgaaaatctgtaaccacctgtatagtcttatttgcataataaaaagggagggttatcagctgcacaacaatgctgctctagtctgctaggttaatgaggaattcagttggtgagcagagtgaagtatttatcttaaaattaaaaagagccttacatttaagtaaatgattttcagaatgaacgtcttcaatttaggtggcacacatcattaatttctctgaaattgttttgtacatttgtttcttaaatgttgactatataaaatgccattaaatatatttatttgaagtaatatgctctagtaggcatgatgaggtaaatgtgatttaactgaaatttatacttggatttttaaatctaattttacatggagcttcaaaattctcactgtgttaatgaaattatcaccatggaaattttacaacatgtttcccttaaggaatttgaagtcttttcaccattttcagatgatttgctttttaaaaaaatcagctgtcagattatgttggatgattatatcattgattgtattacacaaaagaaaactggaattgaggaggcaaccctgctgatttgctgctacctctacagaacaagatctgatattgtaatactgtgatagagtaaaacctataaattctgtaagcctaattgtttagatttctagggttgattttccttctttccccctgcctttttattttggaaattgtaaaagtttaagacagctgcaccactgccctgggcatccaaaagagagttctctgccacatgggggcctgtggtgacagtggagcatcaccccatgaacagacatcaggcagaggcatcaatcaaagccattgattggcagtccctccctactgggaaacgatcattcaaggacaaaccttggaggttctaattgttgttatacccaggaaggaagacctttcctgctggagtctttattgagctcttgtatgtctgacttctccaagcttggcttcctacattcaggaacaggatgggagtcgtactgtggcggtcacctttcttctgtgggaaccacagtgcctttagggattagtgatacaattgatgtgaaaaaagataaatggctgcataatgcagttattctagccctttgtcttcagatcaggtctgtgttctgggaagcttgttatcactaatagatatcaaagtttacacaatacttggactttttctagatctgactatgaactcatacagcttaacctgaacatatgtttccttgtttttccacaaaaagccaggctatgtgaaaagaagttaaggagagagaaaatgccatttcaaatattatatttgtgtaaaattaacttgtattctttcatctcaaagcctctatgttgtttctttttcttcccttcactcccctatactgtataccaccagaatatatcctgtgttgcagaaagctttgatccaaagtcctgttagggccttaaaagcatgtgtctgaactgcctactttttttaagccatagccagagaaccacagacatgggctttaaaggctttgtgttttaaagtttttttattgatacaaatatttgtacctatttatggggtacaggtgatattttgttgcatgcatagactgtgcagtgattaagtcatgatattttgggtacctatcatctcgagcatttatcatttctatatgctgggaacatttcaagtcctctgttacagcttttttgaaatatacaatagattgttgttaactatagtcaccctactctgctatcaaacattaaaacctattccttctgtctaactgtgtatgtgtacccattaaccaaattctctataattctcacaagctctcaccatctacacacccttttcagcctctggtatctcttattgtctacctccatgaaatcaactttttttagattccatatatgagtgagaacatatggtatttgtctttctatgcctggcttatttcacttaacataatattttccagttttgtccatatttctgcaaaggacaacatgatttcattcttttcttatggctgaatagtgtttcattatgtatatgtagcacattttctttatccatttgtctattgatggacacttaggttgcttttatatatttgctattgtgaacagtgctgcaataaacatgggagtgcaggtatccatttgataaactgatttcttttccattggataaaaatgaagtagtgggatagctgaatcatatggtagttctatttttagctttttgagaaatttccatactcttttccataattgctgtactaatttacatttccaccaatggaaattagtggatttctcagcatcctctccagcatctcttattttgctgtctttttaataaaataattttaactagagtaagatgatatctcattgtggttttgatttgcatttccctgatgattagtgatgttgaacattttttcatatacctgttggctgtcatctgagaaatctctatacaaatcgtttccccatcttaaatgggattttttttttttttttttttttttttttttttgctgttgagttccttgtgtattctggatattagtcttttgttggaagagtagtttacagatattttctcccattgagcagattttctctttctctgttgattgtttgctctgctgtgcagaagctttttagtttaatatagtcctctttgactatttttgcttctgttgcctgtgcttttcaggtcttagcgataaaatgtttgcctagtacaatgtcctgaagtgtttcccttatgttttattttagtagttgtattgttttaggtctcacatttaagtctttaattcatcttgagttggttttcggatatagcaagagaaaggagtccagtttgttcttctgcatgtggatatccaattttctcagcaccatttattgaagagggtatcctttccacaatgtatgttcttgatgcctttatcaaaaatcagttggctataaacacattgatttatttctgtattttccattctgttccattggtctatatgcctgtttttatacaaataccatcctgttttggttactatagctttgcaatatattttcaaaaagaataaagatgcaggcatcatactacctgacttgagtaaggtagtagtgggaggcctccagctttgttctttttgctcaggatttctttggctatgcagggtctttttggtttcatatgaatagtagtagtattttttctatgtctgtgaaaaacggcattggtaatttaatagagatttcattgaatctgtagattgctttgggcaggatggtcattttaacaattttaatccttctgatccgtgagcatagtatggctttccatttgttcctgtcctcttcagtaactttcatgagtatcttatagttttccttatagaggtctttcacccactttgttgaatttattcctacgtatttggttcattttgtaactattgtaaatgagattgccttcttgattttttctcagctagttcattattgatgtataaaaatgctactgatttttatatgtttattttgtatcctgcaactttactgacttatttatcggtttaagatttttttggtgaaatctttaggcttttccagatacaagtttatatcatctgcaaggaaggacaaattgacttattcttcttcaattttgatgctttttctttctttctcttgcttgattgctccagccagaactttcagtactgtattgaataagagtggtgaaagtgggcatgcttattttgttccagatgttagaggaaagactttcagcttttccacattcaatatgttagctgtgggttgtcatatgtagtcttcactaagttgaggtatgttctttcattgcctagtttgtagagagtttttatcatgaagggatattgaattttatcaaatttttttgcatctattgagatatttgtggttttgttcctcatcctgttgatgtgatgcatcatgttgattgattttcatatgtagaaccatccttgcatcactgggataaatcccacttgatcatggtgtattatcgttttaatgtgctgttggatgtggtttgcttgtattttgttgagaatttttgcatctatgttcagcagggatattgacctgtagttttaatttgtgtgtgtgtgcgtgtgtgtgtgcttttctcgttttgataccacagtaaaactggcctcttcaaatgacttagagagaatttcctcctttccaattttttaaaacagtttgagaattggtgctagttcttctttgaaagtttggtagaatttggcattgaagcaatctggtcttagacttttatttgtgggaagtttattttttattactgacagtctaattactcatttctcattattgatctactcaggttttctatttctttctgaaatataaattcctctgtcaaagaatttatccactttctctaggttttctagtttgtcactgtgtagttgtttataatagtctcgatgatcttttgtatttgtatggtatcagttgtaatggctcctttttcatttctgattttgtttgagtcttcttttttccttggttcgactagctccaagtttttcaattttgtttatcttttcaaaaaaccagcttttcatttgattgttcctttgtgttgttttttagtccaatttcatttagttctgctctgatttttattattcttttgcttctactaatttggggtttggattgttctggcttttgtagttccttgaagggtatattagattatttatttggaatctttctacttttctgatgtaagtgtttattgttataaattttccttttagcactgcacttgtatctcatagatttttgtgtgttatgctttggtttttatttatgtcaagaaattttttcatccagtggtcatttaggagcatgttgtttaacttccatctatttatacaatttccaatgttcctcttattgatttctagttttattttattgtgttctgagaagatacttgttatgattttgattttttaaacatttgttaagaattgttctgtggcttaacatgattgatcatggagaatgtcttatgtgctaatgagaaaaatgtgtgttctgtggctgttgggtgaaatgttctgtaaatgtctgttaggttcacttggtctgatgtacagtttaaattcaatatttctttgttaattttccatgtaaatgatctatctaatactaagagtgaagtgttgatttcttcaattattattgtattagagtttctctttccttttacgtctagtaatgtttgctttatatatctaggttctccagtgtgggtgcataatatttagaatcattatatcctcttgctgaattgatccctttatcactatataatgaccctctttttcgctttttaccatttttgacttaaagtctgttttatgtaatgtaagtatagttactcctctttgcttttgattttggttgttcagtatcttcttccatccgtttactttcattcagtctatattttttttaacaggtgagatgagttttctttttttgtaggcagcatactacagttgggtcacttttttagtctattcagccaatatgtatcttttaagtggaaaatataacctattaatatttcttaagtataacctattaatattcattaatattgtttttaatatgtaaggttttattcctatacttttattaattgttgatttatggttattttatgtttctttccttccttttctttctttctttttttccttcccatttttctatctgtacagtctggcggttttctatagtggtaacatttgaaattttttcttctttgtttgtgtgtttgctctacctttggtttctatcttcttctgtgttttcatgatggtacatatcattcttttgcttcttcatgtaggacttcgttaagcatttcttgtaggtacagtctagtggtgatgaataatcttacgttttgcttgtctgggatagactatatttctccctcatttatgatgtatacatttgcagggcttaatcccctttgttaaaaaatttttctttcagcactttgaatatatcatctcattctctcctggcctgtagaatttctgctgagaaatcccctgttagtctgattggggtttctttataaatgactggatgtgtttctttttctgttattaggaatctctctttttctttgacttttgacagtttgtctatagtatgccacagagaaagttgcattgtatatttttggggatctctgagattcttatatgtctaagtctcttgctggatttggaaagtttacaacgattttattaaataggttttctaaccctttcagtttttctttgcctttggtgaaacctcaaatttgaatatattgttgttttatggtgtcacacatgtcacataggctttgttcattctttttaaaacattctttttaatttgtatctgcctgggttatatcaacaaaagcctgtattcaagttctgaaattatttcttctgcttgatttagtctattgttgttgaagcttttgaatatatttttattctatttactgaatttttcagtttcataatttctatttggttgtttcttatgatatctctttgggaaatttttaattcatatcctgaattgttcctatttttttgtattgttctctgatatctcactgagcttttaaaatatttctatttgaaattttttccaggatttcatgtatttctgtttgattagaaaccgttgttggagagtcactgtattactttggaggtaacatatttccctgctttttcctgttgcttgtatccttacattgatatctccataggtgataacaattacttctttcaatattctgaatttacttttgtagaagatgacattttgctgaagttatgtctatggtattggttgggtagggcactttggctttgattctgggtgcatgcagtagtgtagtgttcttatcattcctttggttgttatctgcaccagtcctgtctgtgacttcctcagtggcttaaggtgtggttgttagtggaggttgtggtgaagttatgctgcagatgggacacaggtgggcctgtccttgggctccagaagtagcagcagggggacaagtctgcttctccttaggccccagggtggcgtatgttggcactggtattagtgaattcaggcaggctgatttttgggcctccaggtggctcgctcagatttcagtagttcagccgtgggccaggcagtttggtgggttttcaggcccctgggcagtaggcaagtgaaggcaatggcagtaataatggtagaaataacttctgggtcccaagtggtccatggtggtgttgttagtggctgtgatgggctgggtggaccagtcctcggacctatagatggtttgtgcatatgtgtgcccactgtggtagtagcagcgggttgggtgggcccaacttcaggcccctggttggagtactcaggagccactgttggtagactgggctgggtggcccctagaaccccagtcagcatgtttggacacctttgagttggagccaggcctagtagaccttttgtcaggtcccatggtggtgcttgcaggcactggttatggtaggcagggatggatgatccccaagcccaaggcagaatgctcaggtaggagcagcagcgactgcactacattcttgctactgaggagggcaggtttgctttcaatggcagcaggagtatacaggtggctagggagtgtgcactttgcttgtgctttggccccaactgttgtagcccactgcagcagcaactacaggtgtgggagtttgcacttaaagtgcttgaatatgcataacagctttgctgcctggggcaactgggcctggcaaaggtgtcctatgtggaagtggcccatgctccaatgactcacgctttaaccttggaggcagcagccagctgcagcagttactgtaggcaaggcatgccagagggttccagatatgtggagatgcaagggctgttttgtgtcctgggcaggatgtagtctggtgagggccaggctttttcaatacggtgccttgctgtagctatttaggactcggggtgtgtgtgggatacagcgtgagctccctctctggagcagtgccttcctatggtcttcaggcagatccctgtatttgttttggggccatcagggcctaggggctttcccatggctaggatatagaagtccacagtaggatggtggactataggggttcactcttgtcctttccccacattggggagctccccccaaatcccagacaatcatgactgaagaggctgcttcactttcctctccttccttgtgttaggtgttttgtgtcacctctgcgtaggattccagtgttttctcttagatgattgtatttgaagtatgattacctactcactattttggtttttctttgtggaagggatgaataccagctgctgctagccagccatcttggagacccaaaggatttttaaggcataaagagtaactttatctacctccacctattctcttactctgtccctcagaaccttgagatgctgagtgaagggtctccagatcctttctctggcttgtttattgttgggtatcacactgccttctccctttgctgaccttcagctcaggttttgagtcttttggtacctagggggtcacctttctgactagagaacagagaaaggagagtgtgttaagacttttccagtgaaggaagctgtcagcagagaagaaatcagtgatttaggggaagcctgatccaggacatgtaatttgcagggtgtactgagctgggggtaaagcacagaaggggaggaggggagaaggggatgggtaggtaaaaagagagaaatagggataaaggagagagataactagatagaggtgattaaatataccaatatttattcttccagaaactttaagcaaatattcatttattgcatgagacatcagtggtcataggatagaagagtatataactgattctcaaggagatacagaaaaaccaaaaaaaaaaaaaaaagaaaaagaaaaaagaaagaagaaaagccaaagacttagtttggccatgacactatagaaccaattgtaggaattattgagaactgtttatcattaatggctgatcatgatgccacagactaataattatgaaaattgtgaatgtacattatttgattgttacagcacacggttagtatatagtcactctaatctttaactttcatgttcaattgcttagaatttaaatatttaggtaactttgcatgagacactattcattccacaaattctttgttactaaaacaattaggtacagagtactgaagaaaattgcaaaaaatcaaatgtgcagttgtgtcaccccttaacatttactgtggggctacatttaaacattttttattttattttattttattttattttattttattttattttattttttgagacagggtcttgctcagtcacccaagctggagtgcagtgtgatacaatcatagctcaatgcaacctcgaactcctggtctcaagccattctcacacctcattctcctgagtatctgggactgcaagcgtatgccatcacacctgaataacttaaattttatttggagagaaggggggtcttcctatgttttccagactggtctcaaattcctgacctccagcagtcctcctgccttggcctcccaaaatgccgggattataggagtgagctaccatgccgagctacatttaaacattaatatttaaaagcagtatttcattcttaaactttatgtaattacgtgtaaaatgctggatgcattattttaaaaatgcatggatgcttaacttgggagaatctgagctaccatgccgaactacatttaaacatcaatatttaaaagcagtatttcattcttaaactttacgtaattacatgtaaaatgctggatgcattattttaaaaatacatggatgcttgacttgggagaatagaaggaaaaaaggaaggaaaaaaggaaaaccggtatctatttcttatttcatgagtgataacatctgttctgaaagatctgcattatggactgaattgtatccgtgaaaattcatatgttgaagccctaacttccaatgtgactgtatttggaaacagaaccttaaaaatgtaattaagattaaataaggtcataagggtgggaccctaacccaataggactggagtccttatgagagaaggaagaaacaccagcgcacactctctctacgtgtgcacacatagaggaatggctgtgtaaggagtagcaagtagtcccctctgcaagctgaggagggaggtctcaccagcaaccaaccctgctggcaccttgaccttggacttccaacctccacaactttggaaaaataaatttctgcatttaagccaccccatctgtggtattttgttatggcagcctgagctgatgaataaaacaggtgagtatgtggggatatcccctccattgttgtgtcttcattccagttctgagtcaggagattctcggaatttcctgggagtaacagttccatccaagttacaagttgcgttaggagaaagaaaaggctacacctcagaaatgatatagcatttgttgcaagagctcaagctagcctctctgtgaatcagtgcaaagagaataaaagtaaattcaattaaagacttctgtgatcctattgccaagtttctgtacaaaatcaattattattatttattaacttttaagttcaggagtacacgggcagatttgttataaaggtaagctcatgtcatgggggtttatggtacagactatttcatgcctcagacgttaagcctagtacccattagttatttctcccgatcttctccatcatcatcctccaccatctggtaggccccagtgtctgttgttcacctgtatgtgtccatgtgttctcatcataaaatcaatcattttttatgcgtataaattggggtcagattaggctatgaaagcacagcatagtatacaaaaatattttcagcctatagaaaaatattgttagttaaaacacctcactgatacttaacttaaaaataagtaaatcatcattatactgaatcaccacctcttctttatcttttcaaaaatggtcacactaaagtgacttccttagcagatgtctgggtctttatttttgtatcatcagcatctagcacagcactagttacattataggaattaaataaaatatattcgttgaatacatgaatgcaattaaatggtgtatgtctagatttttcaatatatagggtattttcaattattgttaacagatctagatcaaacaaattaattttgaaaaagtctttacttgtaagaaatgattatatatctaattattttcaaggttcttcaactcaaccgccagctcttattttcctaacacaatctttgttttcaatttagatgtttacaaatatattaatccagcactggcttgttacacaataggaatgatctactttctgctataatttattcctagaagaggtgtgtctttattatgccttattaaattaatgtattacccaaaaaatctttgtttcttaaagtaattaataagaggataaaaaagaggttaaaatacaatttgaaaaattaaatttcttttttacattaaaccttagtgtttttattacatgatacattttactgaaattccagtcaatcacaatatttaatgtgggcatgctgctcttatggttaggttggattgactatgttttatggaaagaaaatataaagataatattactaattacattatgatactggtagtaattttagggggagaaggcatatttgctgctagtgtgtcttctgttaatcatatctattgtccacccaagctctggccctgaaaaggcagaaagaagagcagttttagggtctctgccctccaatagctaggacaccgaccagtgtaggaaggtatctttaggcccttttgagttctcctgtacgtgtgactttggaaactgaaagagaatttttgaaggaaaaaaaaaaattgcaaatcatcagaaatcatcaggaaaagaaacaggtttaccaaatctgaaaccatatactgtcccatgcattagccttatccccatgaaggcacctgtgaggcaggatgccccagggacagcagtgtctgctccgtcacctctgtgcacatggagccatctgttacacctggccaccagtgccttcatggagtagttaatgtttgagtctccctgaattttggattcatgtgtcctcacatggtggacaggcaaaggggcaaacaaattccctcaagcctcttttaaaaggacgctaatctcattcttgaggggtctggcctcatggccttgtcacctcccaaaggccccaccttttaatacttgcacattggtaattaaatttcaacatatgaattttggaaggacacaaacactcagaccgtaatagcaagcacttaccactggctattacatatttcctcatctatgtatttgtcttgatgtaagattcttgaaaggcggggcctaggctgaatcgctacgtcaacctcagagcttacaacagtaatcagtgcaccaataaacatttgtttaacagatgagtgaaagaatgaatgcttattctttatagaccaggaagaaaagaaaatgttactgttacaaatgagaaaacaaattccaaatggctaatagtttccttggcaattataggccattggtagcttacattattgaggacttttctttgaaaccaatcccagggaagctttcatccctaagtgggtgatttattcaagttatcagtgtgagtatttggcggctaaggaccgggagaagatgacagaggaaagagagtttgtgagaggggtttatatatgtggtaggtctgtgggtctagaaaatgagtcaggttttgccaggtgtctacttggtagaagaattagaggatagcattctccctttggaaccatttaatccgttgaagttgcaaggtgctgagtctgctgtggtctaaagagtgaatctgcttctataaatgcctctttaatatcatggagccatgtggagctctttgccctgtagcacacagtggatcagaaagcactgggccagtggtccatggcttcctgcattgtggcggcctactctgccaggagtccttcaggcaactaggcaagaaagaagtgagaaacatagatttaacactggcaaccactgtactcgctttacaatgcttatttttggaaagtggttgttgtaaaaacaattctttatgtgtccttgaacatgatacttcttcagtttccattgtgattgccaaaggggtatattcatacccttttgaaatgaagaaatggattctctattgggtttggcttttgtgtttcttaaacctgttagcatcatgcatagagcagaaatatattaattgaactctatgaaaatacttcctaactcatagtctaactcaggtttcaaatgactacagtggctagggaagttagaattttttttccctagaagacatgtctcatgatcttttcctctctctctctcatatatatatatgagggctgtatatgggggtggggggtacaattgcatttgttactttttttcggggattatcagcctaggcaacagtgcaagttcttccggagtcagagcagaaggaaatatgtcttccatatatgtgtgtgtgtgtgtgtgtgtgtgtgtgtgtgtgtgtgtgtgtgtgtaacaccattcacacttgaaagttgtgggaatttaggaaatgagaacttttgcctatctaaagaggtaaacactggaagttccagctgatttgtcatgtgggtttgctgtgatgcaagtttgtataattgttaaaataaagctgaaaatattatgtaaaaattctatattgaatattggcatctagttctactttctaaaaaaaattgccagccaacactgtgcagcatactgttcaaattaaagacacgtgtaagctgtgattggctaatggccatcaggttgcggtctctggttaaatgctaacgggcatccatctccacatttccaccattgcatttgtgcccagtaagcccttgctgttgtcatcacttgctttgtggagggacctcttctcctctagattttctctatgttctctccaggatgtactcagtgtctacaccaccaagcaggctttgaagctctgagtttctatccagagagcttctttttccatgtgctgtcagctggatctctcaaggacacatagtggctctgcctcaggtgtagacctccttgagccattcttgaaggaaagtcttcacatggtttcaactctgcagccctcctaagatggccttttcaatagctcttcacctccccactcccatctcttcatgtgccatagccttgcccctctgcttgagccacaggcactaacgtgtatttattaggtggaagcaggcccccagccttgcaaggcaaatgtttgtatgtggtagagggtctatattaggtgtagaccctctttctgtatgaacatgtcttagactctcttcctatatgaatgagaacgtaatgatggacctctgatacacggtgtagagtaagggagtgggggctacaattgcacttgttactttttttcggggattagcatcctaggcaacaatgcaagttcttctggagtcagagcagacggaaatatgtcttccattctgattcatgtttcaaaaatgaaaaaaaatatatgaatagactcccttcttttccaaaagaatactgccctggtattaaaggcaactactgtgacagatgcaaagcaggagatgcctatgtgtgtctttccccttgttcaattctatagtctgcaattgtaactgttgctctcagtgactagaattgcaggttggcaaccataaatctggaagtgacattctagtaaagaagacaaagcagaaaaaaaaaagtgccataaatgcattgagttctctcctgtgtctcattttctacaacaacaaaaaataagccctaaaactgtacctaaagcctttcttgctgtatactacgattattcctgattcattaaatacttttgcagctgtaatcaaacttgtttaaagctcacgtgttcatgggctagaaaaacactttagaaaaaatgtgaacaatcaaagcacaattgccagcatattattattggtatttttcagcataatgcagtttccgttctagtccactccactttttgaacattttatgtctgtaggcatatgcaaatacaaatccctaatagagttcttattgtgtcagtgcttgagttatatttacttgccagaatattcataatactaggtgcctgtgaaaaccattgaatttttgtggctaaggttgtattggagagataatggcttgaaccgaaaatgaccactgctactttgcatttgtgaaatgacataatctattttctctttttgataatagtgtagggcacatttttaacacctgggaatgaagcttttccccctttctgtaacttcttacgttgttaatgttaatttgagcaccattactcacaaacttttggtgactacagatttgaatattaagactatataatcagagattaaattataacatagtggaaatatcagagataaatttatagcatagtgggaacatgacagtaggtctttattgaaattactgctttagagagaggaaacggtaattaaaaagagaaagctattttattgcttcatcaaatagtttagatgttcatcttgttattttgtcactttctatactggatgttaatttttttaagatgaaattattttatatgcaatcgaaccatcttaaaattaatcttaagaaaactggaaaataaacatttatttctccaaatgaaaacctataacagtattataccaaacaaaaactttgcatgtattttcaaatcctatttactctggaagaatcctaggtttttcatttgggcattttgaaacatacgttggtctaatggcatatttcatatggagtcccaccagtcatcagcaatctagaatcagtgtctgaagaagattctcaaatggaggcattagtgaagtttggaagggcacattggactatcatcatttcaaagatggacacgattctatttccttatctgcttgcagagctatttaagaatcaatgtcttatttttcctgagtcctttataaccctattcatattttcaattgctgatgcctctttgagctacgagttctactttgtgcataacgttgaggaatttctacgtttactgtttctccttacttcactcatctccttcattaatggctggcaagtcaccgaatttcacttttctttacacaggtgtaaggaaaattgcactttagtcatgagtaggctgaggcagccttccagtgcagcatgactcagcggatttgcagcacaggtgcacaaccccacacattatgtaaccacgccacgtgaggcacattaggtgatcatccacgtgagcttgtgcttggctcagagccattattgcctgttaaaagttatgattaccctgctaacgctgtacgtacagcttgcgcctaggcttactcctgcccagagcgagagtaaagccatgtcaaaactgtctgcagttcctcaagtgtttttccagccacctgccactcacccaccaactccccttggacctcagtaagaacctgacaataggtcagctcactgttattttattattggtggttaaagcttgtggtggtgggtggtcctgacttcattcaggaagacattgtacaagagttgtagaagaggagaaaaactaataatttggctaatgttgtggaaacctcgaaactcatacagtcaccttatgtaacactaacctcatcagggcctaggatttgcatagcagactgagcagattgctagacccattctttaggctgcctttttatgattcagcattgttttctaggcaatttttaatgtttttggagtgatgaaataaaagagggaaaggtgaactagagaacaaaagataaaactcttcccttcattgcctcacgagaaaaattaaagtgtcttttttaaatgagtgatgattccacctctggacacagctcaaacgccattggaatgcttcccctattacagggaagtgttgagagaaaaagcaattgtccagagagttgatgtagtgtagtagtgtggatcctgtttttgaattctggctataactgtgtgaccttaggcaagttgcctaacatctctcaattataaaatgaacataaaaattgcaccaatattatggtattgttatgaagattaaatacattaatacttacacaatagttagaagagaaattgcaacatagtaaacattaggtatatcaaacatacatgtgaacagaaagcgtaaaagaaagcagatattcaaggagacttccagcatgccaattttcgagttcaaatactatctttccaaaacaatccgtctgaagtccgagaacacactcaatattgttgattaaatgtttaaataatatttattatagctagcatgttcatttttagacaggttaaatttatgaggcagcaaagttataatattatgtgtggtcgctacaatttatggtgcattttggtccctgtataatcaacatgcactgttcatgtatgcccattttataggactaggagtataatgatgatattttaaattattatagaggccaaacattgttctatctttgcctttatagcatattgttgatcatatctcaaattcatttgaaaaatgaatccttgttcaggaacacaacatccaattacaaaattactcctaggggaaaatacaagctgttttatggtgtgatttccaggaatgcattgtggtgtgaagtagaaattacctacatcaattttgttttctttatttatttcaagactatctctccctacaagttttacctgctttgttccagtagtttataatttggtaaataagtcagcatttcatttttcttatacagctccctgttcatcccctgatttctgtgttgcctttgcctgaacctcctctagtttcattaaatttaattagtatcaattgccagtgtcagcacgttgaattgctttataaggctgtataaatggcctctgatggcttcagtgtaaatcctagtcatctggatcaggtatataaaaacttcccttaaaagtggtctctgctatgcaaactaagttccttctcatctctatatcatctcatttctatatcatattatttcctcattttcctacagaaaggacttggggatatagaaagggcgtatgtaagagttctaaaaattattaaaggtttgagaaataatttttaagagaaaatgtcaaacggttttggagtgttgcccagccactttcctgtactcacattcacccagcatctatctagtcttcctaaccccatctggaagctcagctccactcctgttcctggaggaaggccagcctatgttcaaaactaaattagccttgcatccatttcttacctcatgattcgagctaagcatgtttcctggttccatcatctgggctctcattttattccttttgctcatgttctcaccttgtacctatcaccagttccctttttgccctctttaagtcctattttgccctatttaagcccttgcttaaattgattgcccaggtaaacatttttcctggattttattatttattttatgagatccctgttttctgccatcgatcttccttttacccagaatgtctgtgtctttagcttccatttcattcagtgttcagaatgtcttcatagcatgagtgccctttttttgagacatccatccaccccctggcactgaaactttctgatgggagatcctacccatgcccatccttgttagctctgtagttacggaacctagaagagtccacagataaccagaggtgccagaaatcaacgctggactctggtaactcaaatttacttattaaaaaatagagacaatttgtttgccagtaatatatgccttttaatttttggtgaaatgcaagattagaaatgttcttagagcatttagagatcaagtttgattaagggattagaatgggaaatttaggcttaggagtcatcacacttatcctatcatgttaatccccctctctccatggtcaaaaactgctgttgcctcccattgttgtcaacattacactcacagtccttattagagtggttaagaccctgtgatctgtattcattcctttaaacccacatatgcttgattctcctactcatatcctgcgatctaaccaaactagactactgctttatttccaaaaccccacacaatagccatcttggaccttttgtttattctgttgcctgtaggtggaattatccccttatccctatcagaatactatctagctttcaaggcagatttcaaatgccactttatccacgattaatttcctcttttctccaatcagatgggatcccttcctcctttgaattcacaacttaatttgttttggcatctcttattgaatctattcttaaattctgtcttgtattactggtatacaataaaacccagtctaattaattagagggactcaaaacatttttaaatgcttaaaatgttagcacacattattgggaggctgataaaataagcgtaggcaagtctgtgtagctagctggcctgtcgttcccaaggaaaggctggctgctaagatcaacccttctaaatcttggctatagtttggtgacacccactggacagggtccataaaaacttacatttcagtgggcatgattccgcctgctgtttttggctggaactgccaggacgatggtagcaatttcaggaatcttctctttggtgattcctcttttgtcagctggatccagggaatactggctgagagaagtttaggaatgcagggatactcttctgcttttccattttctaaaactcagttgcttgccatcttctgtcaaccttgccttccctcctgcatttactcaatcatcctcagaagatacgagctttaattctaatcatgtccttcccccagtattttgaggaaggagtctaggcagcacataagagccaattgccaattatttcatgccctaatttgctttactgccaaggcacctttttataggatttttgctatatatatgtattaaaggctttagcagggcaggggactatctttgtaatccatcacaatgcgtagatacactttgtgctcagtagttttagaaattagattgaagctgagactaaactttccaaggaaaagagcttacaaatggattttgttaagaagtggtaggaaaaaacagtgatgtcaaagaagcaagatgccacagttcatttgctggtgtagcaaaaacaccagacaaagttgagcaagtcatataactctgagctcaagattatcatctttaaaatgctgatattatgtctactgtatactactactgctgcaggctatttttcactcaacaaatactgttcacgtgtcagatgccaagtgctgggtgttaggaatacatcactgaaaatcacagacatggttccagctctcatgacatttccaatctaaagtagtgttgctattttatgctttaactatgaaactattaaggacatagttaacataaacattataaaaatctcccgagtcctaaagattaaaacaacctcctggggtttcagaaatgattaatttagagatatctatacttacagtccccttcattagatcccaaagataactagacacaggactgctctttaagtgtaaccggaataggcaacacttttgctatgtttctagaagcactgggcactttccttgtaatttcctcaaatacctgccttatcttcttggtctgttagctcaggctttatcagaaatacatttgtgggagtgggtgtgcacatgtgtatgttttaagccattgagactccgagagttttctttgaaattgcaaatactcttcaggggataaaacacattcagttatcatcagttgtcagtataattggtttttctgattcttttcttcatggcatctagccgagttcactgggaagccagctaataatgtgctgagtactgggccaagcaccatttctgtagttagacttacaacttgccccccttttgactctgctactctctattgtttgttatcttatcctaccaataattgcagcttttcatgtcctcatcatatttcccatacactgggccagaactggtgctagaagaatcttccctgtggttttccacccccaactgaaggttggtgtagagcacagaagtccaacaaagccaatgtaacatcacccaatgtgaactgacacattatgtgaaaaaaaagggggggagtgtgtgtatatatacacatactcacaactacatagatatagtatacatttgaagaaagtattggttcttacactttctccttttaagtatagagtgagggttcttttctccttctttgttcctccacttcgattatgtacaaactcccttaaggtattaaaggtgccctgaggagccagtgtgctcgctctctgtggtatctcaacacttaactaatcgtgcctataaagtgacgctctaagggctcacttaagaagaggagaagagggttcaggtgcctctcaggatgtaaaatgatgagttctggatgcatatttctaacagatggacacggcattaagaaagcagccacagaaggcagcaggtggagcaggcagctggaaagcgcagccacttgcaggagcacttgacattaattacacctgttggaattctcgcccaactttttgctttcaaatgtgttctcagtataatcactgtgaggcagggggaaaagaaaagcagctgagggctggaaacaggaaatggagcacttgcactgagagcaaagagaaagaggtgggccagggggacggcttttctggctcatgcccttcaattaatcacatgtccaaaataggagccacgggtgctattacttatagtggtccagatgattccatcttggggctgaagaggacaatttaaaaacaattaaacaaatgttcaaagcagtaaaagcaggagtatgcattcagtcctttagaaattaaacatgttgctctgtatctgaagagattaaatatatacatttaatgttttgtatcatctgagctcatttcaaaactttcttgggccatgtagtgattttccaaatctctgagattcttcatttatttctgcctgtacaatgggatcctagctttctctaagctgtgtcctagttatcagcacaacttgcatcttctgctactctatggctcacagtgtggctcctttcatgataaacttatatcattgcctgaagctgtgtggatgttctagtctgcttccgctattctttctctctggaatgcccctgttagccttacaaatttctgctcaccattaattgtgaactcaagggttaaatgtgtaataaagccttcagtgattgtcccaggcagacctgagccttcaccctcctcagagtcacaggacctttcccattcattttcaaagtgtggagcaccttgctgtgctgggctggcctggaccccctcctctgggccatgagctctgtgaggagagctccatttctactcttctgtagtttcctccttccccccagctcatagtcccccactttatagttctgactaaatgtgatttgaatataagttgcctttacctggaggtataggtcccaccactgaaaaataattttaacccaatctcagtatctcctgagaaaaaataagatgcggctttcaaaactatcaattgtcttcaggtttttgctcactttccagtgagacttaccctgactaccactgtattacaaaatggcaagcgccttaggtattaatgtgtgatgggatttttgctcattatggtatgaaatgatgtgaggtaaaacatatatttttataaggaataaggatggagttaaaaaggtctgttgaagtgaagtaaagaggaaatggaaataaacatgattgtgaagagatggctgcggtttaacaatgcatccagctgaagaataaatctacctctgctaataatagaggttgatttttctcaccaagatgactggcacacatttatgtagacctaaatgaagggaccgttgcactagctcagtaatgccggagccagaatctgtgtagtaagacttttttgtttttctctcatggtttcaagatgcctgccagagcttcaaatagcatgcctattttcaaaaggaatggagaagagagttgcacagagacctttaacacatttatcaggaaagcaaaagcttcaacagaatccactctggatacagttgccagtgtctagatgggcaatgccttgatgtcacttagcttcccctaggacagagtaaagaaaggaaggattttactttcccagcctctgtcctggagctgggagagaggaaaagggatttggaatgatctctgggttacccaaccagcagtgtctgccgcaaaaataactagtagataaaatgaattggccaaaataagtaaattgaaagaagacattcacttatagtggatatataagtaaaatgaataattcaatcaaaggataaaataatatgtcttaggacaaatgcataaactagatgtatgtatcaaatacataattttaaaaacaagatatgagagcagaattgtacaatattatactactcatgtcattaaaacacacaaaatactgattattaaatggatatatatatatatatgtataaatgtttaaaaacataaactggaagatacacatcaaattcagcctagtagttgccttctttgtggaagaagagggtaatagggaagaggaacaaaaggaacttcattttattttgcaaagtttcactcctgtcacaaaatcaaatggtaaggctggtatgtatatgagagtttggtgagaaaaacaactagaagaaatagtaagagtttaaatttagttctatcactgaaaataaatttaaaggagcataaaatgaaaacacagatgggattctaattgccacgaaagcctaagaaatagagacataatttaccacgggaaatagtactgaatgaggaagaagccccagaatcagcctttgactttggttctgaacttactcactttgaactttagctttctgacttgaaagatgaggatttttgtttttattttttcattgttctttagaaatatttatcgtttggctgggtgtggtggctcatgtctgtaatcctagcactttgggaggccaaggagggcagattgcctgagctcaggagtttgagaccagcctgggtaacacggtgaaaccccatttctactaaaaaaatacaaaaaattagccaggcatggtggtgcgtgcctgtaatcgcagctacttaggaggctgaggcaggagaattgcttgaacccaggaggcggaggttgctgtgagctgagatcgcgccactgcactccagcctggtcgacgaagtgaatctctgtctcaagaaaaaaaagaaaaaaagaaatatttattttttaagaatattaactattttgtaataaggcatgctttaaaacaatctttgcaatttaagtcataaactgtggtggtcctgtaaaacatcaaaattgttcatttatttgatttatatttattgaaagcttactatatgctggaagcctaggaaatagggcataaatcaatcaaaagttctagtgctaatgaaaatgatagtctgactggggccagagatagtaagtacatacttagtatataaggaagcccatgaagcaaaatgtagcaggatcagagagtactcagggccaggtgacagtggaactaatgctctagtagctagattaggtttctcttacaaggcactatttagcctagaaagaatgtaaaagtcaaatatctttcacaagtaacatttgctatgagtaatttaaattatatattatataaaatatattaatatagtaattataactgccttgtattttaatacggatttgtatgtgcttcaaggggttttgttctttctttttgcacacatactgctttttatcatagcactcccatccagacaagaagtatacattctctgctttgtagtcaatctctttgtgtcagtttggatggaaacctgactttgtgtcagtttggatggtttgattcctacacatctaatatcttgagcggatattcctggatgaataatggtaaagttatctcccttaggaaagcttgttgtccccatcatgtctgtgttacacagccattggatatacaacattggctggagtggggaaggtttgggggattttcttatcagctgtcttctgctcttagttagtgaaatctaacaagcacccagaccgataacatgtgagtttccatttgaaagtttggctcttgtttataaatattaatacggttgaaagttaatatattttgaaaaatgctttaagatgttttaaaaaaggcttttaaagtttcatattctgcaagagtctggacaagtaaaatacaattggcctttgaacaacatgggtttgaaccacacaagcttacttatgctcagatttcttctgcctctgccacccctgaaacagtaagaccaagctttccccttccccaaccattcaacatgaagatgacaaggatgaagagaggattccatttccacttaatgaatagtaaatatattttctctttcttatgcttctcttaacattgttttctctagcttactttatggtgagaatacagtacataatacatagaatacacaaaatatgtgttcatcaatggtttatgttatcagtatgacttcctgtcaacagtaggttattagtagttaagtttttggaaagccaaaagttactgtgtgaggggttggcacccataacctccatattgttcaagggtcaaccatacattatttagatttgatcaaactggatttttagtatgtttttgattttaggtcatcacagaactcaagggatttctgagacaaatagcctaatggaagattaaacgcaaactgaaaaagatcttaatttactgagaaaactggagataggaactaaggtttaaaatctgagtagctgagaagctgccacttattccagtgtctgaaacatggatatattgaaagattgaaagaaaatcttataattgaacagtgagcgtctttggatattgtgtaaaaagctctataaaagataagagcctgatgttagcttggagaaagtcccccttgccttattaatgttggtaaaactttgttactactcaaaaaatagccatcaactttaaaaccaacaaacattttcataagccactaatattgaccatgccatttagttctaccttatttattctttgacttccaggaatagattccctttcctcctctggagatcatgggattggaaattttggccaatggtagataaatacaaagttgttgtgaggtctgcatgtgtgctggaatatacatactgtggttagaaaagtgcctgatacatagtaaaaacaccatatccataaaattaatataatcaaataaaccagaaagttaatactatcaaaattaaagagtagtatattttgtaacttttatatttgctgccagattttctttgttccagttgccaaaacaaatattggctgatgaaaaacctaacttaaacattgacccaggaaaatttgggtttcatctctaagcaatcttctctgtgctgtagtgccaggcagagggctgttctctccctaatatatcattcctgctggaaaccaggaaagtctaatgtcaccattagaatttatttttttctgtcttggcttgcagattaaactatacatgtctctgaaagctaacagcttattattaacagttagagcagaggttaaagaaaacattcctaaaagaatgagaactagggtaggatttggagctatgaagtgaatttagtgagggaaagaaatggggaaagataacaggagaggaaagtgaagctcaaaggcgaggtggaaaggcatagaaccttttatagcttacatcttacttgtgtctggagcaggccctggcctgtctatatagaggagaaaaaaggttacctgttaaccaatggatgatttcagttgaagattcctagacttcacattcaagggtaaaaagcagaatgtatcaccataccaggactcgtagtttcctgctattcaaaactccaaattcatagtcctcattcctggaatactatttaggttggtgcaaaagtaactgtagttttgacattgaaagtaatggcaaaaactgcaattacttttgcaccaacctaaatcgtgtagttgtttcaccatgtatatgaatccagttattctgttagatttggggccaaaaaagatttgaagaattgctaaaggatagaacttttctgatatagctcaatgttgtgataaatacatgctctgaaaaatgaaggaaagctatttagaatagagaatttgttccaacgtaaaacaaatttaatggaaggagaattatcctaataatcgattatgaaagaaaaatactcctctggaattttgtatataatggctcaaagacacgaaacttttatattttaagaagaaagaaaagtgaaaataaaagtgctttcatataaatgatgaaaatgaatctgtaatacctgttcattcatctacagagaatgttattagatcagaatgagaacatcctaataaagaaaggaaattgaataggtaggttatgaagcattacaggatgcacaagaaacagtttgtaccctcgatagccacctgaggtgtgtgccattatactttccaaaattagtgaaattctaattcttttagaaaggatattttccattaaagattagaaaaatcaagaaataagttctttttgatgaaactttgaagttaggatagcagcaggctttatttcagttcctgccgtgtttctttttcctttagaattaaactatgtatgttccaggagaaatgattgtatcagttaaaataaaaattaccacggttcttctaagcatcctcttttagtgtatttgatagagaccatgaagttttcaagggagactgtagtctctgcacataggagtatcagattctgtgaataacaagagacaaaaacccaatgtcaaaatgtgagcctgctgtattggcacattggtttgagtgttctgcttgtgcgggcaaaaggttgaccattgaattgaagaatgtgcttttcagagtaataagttcttaccatagaaaggtcagctaacacagagggaagattatgcaactgagatcgagcgtgtcaacggggaccctcaaaagggaattgatattatggcagacattatcttctgttttctaagttctaacggaacattttaatggaactcagagaagactaaatttgttgtctgcacaactcttattaacattttgtcttgctccacagagagtgcgtcctgcagtaggtgagacatgataaagtatttccaacgcttacaataatgaaatgttagcatgcttgacctctgcagctatccatcattaaagaattaattttctggacctgaatccatttatttcctcattttagcgtatgtttggttattaaggggaagggagagtaaaactttatagatagaaggagaaaataaagttattaacctgtcttgccaacaacccattttatgtaataggggaaatgttgaactactcattagctattctttctctaaggttaaacaggtaaaataaaataacccactactaagagataacaaatgttgaataaactgggtttgaaagaaatattataattcgtttttaaagggaagaaaaatgctcaggaaattctcaatttttattttcctttttccacttgaatgtgaaaaaaattatagaattatctattttcaggtggataagaaactgcataattgaattatacaaaaactgaaggattttcatgcacaaggagaggattctgaagcactataacttaattacagatttaaaatcatttaaagaaattctttttagaaaagttacttgtctataaactatgtattggggttctccagagaaacagaactatcttaatccacttggactgctgtaacaaaatatcataaactgggtggcttataaacaacaaaaatgtattccttacatttctggagtctgggaagtccaagatcaaggcaatcgtagattgagtgtctggtgagggccaacttcctcataagtggcaccttcttgctgtgtcttcacatagcaaaagaagagagtctcttagccctttataaaggcaccaatcccattcatgagggctccacactcatgacataataacctcccaaaggccctacctcctttcaccgtaatatcaataatcaggtttcagcatgcatattttggtggggacatgatatggttaggctgtatccccacccaaatctcatcttgaattgtagctcacacaattcctacatgtcgcgggagggaccccgtgggaggtaattgaatcatgtggggatcatgggggcgggtcttttccatgctgttctgatgatggtgaataagtctcacaagatctgatggttttataagagggagttcccctgcacatgctttcttgtctgccaccatgtcccacgtgccttttgccttctaccatgattgtgaggcctccccagccacgtggaactgtgagttcattaaacctctttttctttataaattacccagtcttgggtatgtctttatcagcagcatgaaaatggattaatacaagacacaaacgtccagacaatagcaagaacatatatatatatatatgtttccatatatatgtttccatatatatgtttccatatatatgtttccatatatatatatgttcccatatatatatatgttcccatatatatatatatatatattcccatatatatatatatatatatatatatatatatatatatatatatggaaagagagagagaaagaagtatagtactggctcatgtgattgtggggactaaaaaattcaaaatcctcagcatgggctggcaggctggaaaccccagagaaccaatggtgcagtttgctagagaattccctcttgatttggaaggccagcatttttgttcaactgaaaggatgaggcccatccacataatggaggacagtctgctttatccagagttcactgatttaaatgataatctctttcaaacacaccctgcaagttaacatataaaattaactatcatgcatcatatatttacaaatggccaagaattaggatttactacctttatatgcaactgaattggaagcaaaatgttctacaaaaagaactagttaaaaataaagtgtatacagtgtacaaaattgtgaactttttactctttcatcatttcagtgtcattaccagtatatttccttctctgaagatttagaagaataggtaagaaagtggcacggataatagtaatgttcactgtccttaatgcacctgataattttatccaggtctaattttatccagttttgaacaatcaaaaaagaaatgtgggatattaatagtccgcttattgcctgggctggagtgcaatggcacaatcatggccttttgggctcaggtgatcctcccaactaagcctctggaatagctgggaccacaggcatgtgtgaccacacccagataattttcttttaattttttgtagagacagcgtctcactatgctacccaggctggtcttgaactccttaacattaacagtaatattgactttaaatcagtatactaagctctctgttagtgatttaaaaatttaaaaggtggtgtgtgcctgtatgcctagctacttgggaagctgaggcaagaggatcacttgaacacaggaatttgaggcttcagtgagctgtgatcatgctgctgcactccagcctgagcaacagagtgaaaccttgactttaaaaacaagcaaacaaaaagctacttagttcaggcttatgaggaaggtttgattaaaatgtaaagcttacattttaatcaaatggttatcaaatgattctctttgttgagaggagggctgtaactcagtagtagagttgtgagatatatctcatttaggaacaaatatgctaataggtgagaataatttccttattaattacttgtgtcttatccggagccctttctctggcagttaatttactgaatgccagagatccttgcttctgtagtcctgaacatgtttgcacttcagacattcttgggcagtcagaacaggactaataatggcttatgcagatatttttcataaatttagactgtacatcctttgcatagaataaaaattgcatcacttgtatttctctgtcttgattcatttgttctccttttatcttaactttcatggatgaaagcacgtattcatacaaaccctcaaattttacagatggacaacatgttgtagggagatttttaaagagtgtagctcatgtcttattgaggaggaagatacaaagctagatgagcatgaagaacaaatacaaaaatgtgtgcatcaagaattttgaatagtaaaattctgcttttaacttaatacttatcatgtttatgcacctttaagaaacactcctttccattactaaattttcactttattttaaaagcttaattttttggaattaaggcattttgtttgcattaaatgcttactgaataaaatcatagatttatttgtccagttgcagttggactctgttagttttctcatgttacattcagataaaaaaagtgagacgtctcagaggaatgctggactacaaagaatttgtctttcaaaggtaattaaagtataatttaaacttattgctgctgtgtgtaccactttcccttttgaattatgagtctataaagacatggaagtttgcaactttaaatcactctgcagttgtcaattaaatgtcatactttggggcagaatataaatggagtatagcctgttaacaattattaatatagtatcagtgcaaattcatacatcaaaagagtcagtgataatcctaaccacctgtgctgatacatagtgtgaaatgtacaactactctttctcgtagtctcctagtctcccagaaaaatgaatgcgttgttgaacagcttaattaaaaacaaaagaataaagtaacacaacacagagggttttaaaatttggttttaatttctgaatttcacaattgtgtgtgtgtgtgtatgggtgagtaaacacacacacacatattagacactcacatatatcttgttaaggcttattttcaactggttgacttgcttctaccatgcaaagtatattgtcaataaattcaagaattcaatatttatcaggcgaattagcttcatggttaaatagttatggactgactaccttcttaatcaaaggtgatgcttttcttttttaagtttatcacaaagcagatttatgcaactgattaggacattaccctgtagtttcggagatcattgcatttaagaaagggtttgaatgtgatctgaactgcaacccttcctaaagagatagccttagataaaacaaatataactatcatttcctagcataaattctgagcaattatgtttgtgactattgcctaatattatcaaataagaagttcatttacattcttcatctttttttgttttccaagacaaatcagaaatcaatctgatttgatctgggcaatgtgtaactcttaaaatagcttatataatttttaaagaaatattttaatgtcaatttaaaaccttggaattagaaaacaataattttaaattttgttttgtaggtcctagtaaggcagtaacattcgttattacatgattgtgctccttctcatagggcagtgggtgtgcacagcatgggtataaggatgtgcacaaacattgtgtatttctggcctatttatcttccctatttcaggactggttctaagagttcttggacatcaccagtatgctgagcaatttggacaatttcagttccattaggcattaaatgaagtcagggcccaaattccctgttaatgcaacagtttatgccatccagcatcccagagaagtatctctgtagccatttatttggttttcgatttaagaagacccgcacctgactggaacccaatacaactatcattaaaaaataaaatcccattgcccaggattgttttgttcttcatgtgtacttcatatcaagttattgtcctaattgcctcatgccttttagaaagttcagttaattcaaagagatgaattaaggaatgaagtttaagttctctgtgtctccttaaaacatttctgagctcaactctcatttgaataggtaatgaggacaagacaataaaatctgagtagagtctctagctcttgtttgtgtctaccttgtttttttctctctctctctccagttaaatgccatccaattatctcctgcaaatatctacagaattgttcgttagtcaacattatgatacaggttgattatgatattagatgattatgatattagacagtgattggtttaattagtttgtgaacatttgcatatatagagagctcttaataaattgggaatatatttgaatttgatcttcatatagacattttctaaccttggggatgcctttataattgctgttgttttctttgtgtttcattatagaagccagaattcttcttgctaataatgacatgtagataaataccttattagtgtagtaacacttccaagaggaaagcacattttctaagcatctcctgaaataaatgtcttttttgaagactggaggctctgaagctgctaatgagatatggaagggacattctgtaaaagtgacaagttattttaatcaaaaaggtcatgcatgtcagatagtattattgttttctgaagtggcttgactcagcccaagtcagtgagaattaagatttcaattatacattactaatggctgggacacagggttagtgaggtagaggtttaaaacctaagtgttgctgaaacgtcgtcttgatttactggtatcactgctaagtactctgtaaatgccagcagtttataccatgtcactaaagcccaagagtaatgtcactttagaattacaaaacagaaggcattctgtgattcaggcagcacagctaacttccaaacaagatttgaatactaaaatgaatgtcttatctttgagaagcaaaggcttttgaatgttcaagtcagatgtgtttaattatttaaaggatacttagtagatacttgttttctgtaagatttctgatcccttaactgactttcataatgttgaattgggatccaagaagaatggaataagagagagatcttgggattaagtgggggtgttctatgctttttttcacttatcctttttttttttttgagatggagtcttgctctgttgccaggctggagtgcagtggtgcgatctctgctcactgcaacctccacctcccaggttcaagctattcccctgcctcagcctcccgagtaggtaggactacaggcacgcaccaccatgcccggctattttttgtattttagtagagacggggtttcaccatgttggccaggatggtctcaatctcctgaccttgtgatttgcccacctcggcctctcaaaatgctgggattgcaggcgtgagccaccacgcccaggcctcagttatctttttggcttgcttattcttcttttcatatctctgtccatacaaggagtagttgctacatgaagagggtactgtctttgaaggtaaagaaagctttttcatgtgagtctgataataggtatgcatatactttaatttatgtaaatagtttaaccagtgctggaaaaaaaaagcatcatacctccaatggaatagttctgattattcagagaacctttcagacgaggaaaaacagaacattttccagggagttcttgtacatctgcatgccccacggtgctaaattttggctttgcatagatcccctgtgaatgcagaccttcccattagccactctctgtttccagtcgctttcattccatcacatatgaagatcaagcttaatgttctcaaagagggagagcaagaccaagcacaccctgcagaatggcctgtggagtttcagctcttgatagacttgtctgcgacaatttggtccatgctgcttcaaatggcaggaagagtaacatcacaggagggtaaaatattttccaaatctgatttaatgataagacactgagtgttgagagagcaccgaattcaatgaagaaggttaagtgcaaaacaccatgattttcttgagatgtgagtgtgttgagggagggggatggagagggagagcaggcaaagggagcagaagctggagaggggaggttgacgggatccagatcagcatatcttactaggttagtatttaatgaactggccagtatcagagtgatttggaggtgccaattaaaatgtgaggagcactgcaattttgtgtccagggttaagttaaaactatgtaatctttttataagcttgaaacattttctgtaggttaagtctagcaaaaatattaatgccatgtaacctaacttttttttcatagaaaaaatgtccagatttctttccaccaagaagcctgatatttgtagagttgttgttgttgactctgatctggatgctggagatgaaaagatacatgcgaggcagacccatgtcaaccttcagaggagccatattctagggatttcttgacagtgtgcttgtactaatattgtatttattgctttcaaactaaaatgaatactataatagacttaacacaattgtgaagacacgcaaagagggcaaggcttcttaattctgaaagtgtcaaagaaggatttattataaagaaaggtgactttaggttagatgttaaggagagatttaactgcatagggcttagatgaggaggaattggttatgatatttcagtttttgaacacagaatgaagaaaggtgacaaggatacccatttcattatattgtgcctttgtgtgattttagtgcatatgagagtaggaaaaggattgggtttgagcttccagaagatggaaacataaaaccgtaccaagtgtaggattttaagggcctaagttaaggagtttaaacaatatttataaataatgagaggcattaaatatattttttaattagaggtgactgttactgcaaaaaaaggatactctacaagaaatataaatttgatagcaagataacaattttgagatgagaatgaatagtgaacaggtggcaaaagacaagttaaaaggatattgcaataatctaataaacagaagtgtttgtccaagggttatcaatatgagatgcaaaagaaacaatgaagttgggcctcaattcaacctcacaattgaaagacactccctccttcccattttccccttctctctccattccctattccttccttctttcctccattctttccttaccacccccacccccgcccccaacctttttcctttacatgttattcagtgcctgctatgtgctaggctgtgggagtgaggaagagagtggatcaaaggtaatgccagaaggtctagcttggcagagtagtagggctattaactatgacagggaacattttaggaaaggagcagttttgcagcaaggaataaaatgactttgaatttggacaaattgatttggaaatacctgtgggactttcttattgagatgtccagcaaagagctgaaagagctctctgacattactgcagctgagtctggaacaaacaggctgcctggtgagcagtgtattcctatcactaggaggggataagactcggtcagatggccttgggtcagatgtgttagatggaactctgatgagggattattagcactcttgaaccaaacaggatacagtgcccttccagccatacaattctatgtctgcagacatctgtgcaagagaaacagagggagagagctagaaagagacttatgtttttcatctgtaaccacaactattaacataagcattaatatatctgttgacattttccatattaccatttttagcttcttaacctgtaaagtaaatgatgggtggactactaaggattgtctaatacccactatttccacactacccccccacctcttgtctgattatcaaatattcatggtatttgctgcaacttaaatattatttgatactttctgttctcaaccaagttatggtatatatatatattttttttttctagtaataatattaagtgtttagaatattctcttataaattaaactcaggaaattttatgcagttgttcttcatggttttattctatttttataaatttgctgctagtaagaaataaaggcaagctaatgttttatcacaaactctccattatttatttattttttttgagatggagatttcctcttgttgcccaggctagagtacaatggcacaatctcggctcactgcaacatccacctcccaggttcaagcggttctcctgcctcagcctcccgagtagctggggttacaggcatgtgccaccacacccggctaattttgtatttttagtagagacagagtttcaccatgttggtcagtctggtctcaaactcttgacctcaggtgatccgcccatctcagcctcccaaagttctgggattacaggcgtgagtcaccgcgcccggccagactctccattctttaaagtgaaggcttagttcaaattattattaaaattgctgttgttactattcttaattttttagttcctgattttttttattaatagcagtaagtatactcaatttttgcatatacttttatggatatccaaggctttgaaaaatgtgtgaaatggaaggctatttataacttcaacacatgtataagtacaacttacatatgattctaaaatgtagcactgaccaatactgtaatatcagtaatatcaaaacagtatattactgttttaccaatacagtaatatactgtaatatcaaaaagaaaaaagatatagaacctaccttcttattttcatttgtatgtgtacttctgaaactgcctcctacatatgaaaattgatcatacctcttgtgagctttttctctgtattaagttcatgataagcaatgtaaatcctcagaaaagatgttaccaccgtttagttatcttttatcaactcaatagatgagttaagatttaaaacatttgcctagggaagtattttgcactggtcaattctcacagttttgtgagatgaatcactttggtcattatcaaatgatacatagcagttgagacatgtattgattaaggtaaatataaatgactttttataataaataaaagaaatataagatttaacattcaataagcaaaattatgacataaaaattaaaataacacttcagatggaagcatacactggaaaataatttggagaaaatctggcaaaatgtgttaaatttataattttaaatcctctgatttagtgaccccatctgaaggactctaagcaaataaacgtacaggtgagcaatgatgtatgtacaaggttcttgattgagcataaattctactggtaaaaaattgtatcaggccaagagcggtggctcacccctgtaataccagcactttgggaggctgaggaggggtgggtcacctgaggtcaggagtttgagaccagctggccaacatgatgaaaccccgtttctactaaaaacacgtaaaattagttgggcgtggtggtgggtgcctgtaatcccagctactcgggaggctgaggcaggagaattgcttaaacctgggaggcagaggttgcagtgagccaagatcacaccattacactccagcctgggcaacaagagcaaaactttgtatcaaaataattgtttaatacagtagagtacaaacaaacaaacaaaaatcaattctataaagttaaggaacaagatgggtctacatgtactgtcctggaaagacacatgacatgctgttgagtgaagataaacacaatatatatgcaattctgtttataaatatatgcattcaaagtctgaaaagattcacagatacacaccactctattagcattctttcatccagtaagtactaagtgagtcccaattattcactaggcacacaacatagtggcaaagagacctatgaaacagctaaaatatattgtgacggcttatggtatgtttggtttcaattgagggtgcaagagttgcatatgggcaggaaaatcctagcctagacttcttggaagacatttctgagaaatcgatgttttcactgaaactagaaagagaaggaatacttaaccagggaaaaatgatttaatgtagaaaagcagagacaacagcatctaaaaaagcctagaagcaggaaagagatgtaatgtattcaagaactgaaaaagttaggtatgactggatagtgtgtaagaggggatattgttatctttgggactgggattatacttgcaaatttacttacaattttataaatttctctttttgttaatgaagatattcctattaacatgaaaataatttaaaaactagctaaaattctaacaaagaaaaaataaggaaacactttaaacatgctacagaaaaataataagaaaagacaaaaggggctagaattataaagttgaagtctaatacaacagagtagcattatatattgagccaaattgaaagagacaaatacagtgattttagaaaatgaagatacttcttttatataggctatttaaggagcattaaataaagcagtagtgcacatcttttaaaattagactgctatcgtagaagggcccacaggaatatttgtaccaatacagctgtaaaacacttatcagactttttcagctatttttcttttgcctcagttgcccaggtatatatactggggcaaaaagcaagatctggtaaatgactgttggtgtttttctttcctgtttattacagtgtagttaataatctttgcaattccttccaaaggtatgagccgactctgtatctgtggttctccaccttggctctatgttacactcaacttgggagattttttaaaaaatttatgctcaggccccacttcaggccaattagattattaccgctggcattaggacccaggcattaaatattttcatattcccaggtaattcccattcacatctaagactgaaaaacatcactgctctaggaaggtttagcctatttaacaccttcaatgtataagtcaagttgcctagcagaaaaatcaggtacggtttcactcaaatggatgactccaaagatttgagtcaagaactcagaatgagagatctcattcatggactggtttggtgttgaggttgcctgggtgtttgaagagtgttatgtgctgaatgaagatggaatccttggtgtgggtacactttagcgatatataggaggactataacgtgaatatcttaaacacattgaagttgaccttaaattcatacggctctcagttttctcatgagtgagatgagaatgtaactaccacattacgaagttgtgaaagttaaatgaggtgatatttatataagaaatgtgcacagtatacttcactcatagttcaaaagcttcaaaaataagaaatagagaagtaagagatgagtctctttcatatctaatttgagtattagacatttgagtattatagcttcagttttggtttccacattagttatttttttaaggtgggttttctttcacagtagaaagccaaaaatgttagatagaaaaagtatgtattgtcttgaaaaggtgaacagttggacattacgttttgaaggtattgaaatttttctaatgatctgtttttggaatgtgtatgtattggatttatcttgctgtatcataagctaccacaaatttagtgtcttcaaatacctgtttattaggttgcagttttgtaggtaagaagcttgggccgatgtgggaggtttttctgctcagtgtcttacaagtctgaaatcaaggcatttgctgagctacattattatctggaactcaagggcctcttctgagctcatgtgattgtagcagaattcagtgccttgcatttgtaagtctaaggttctcctttccttcctggctgttagttggagctgatgtcagcttttagaaacaacctgaattccttgccatgtggctcctccatcttcacagccagtgacagagaatttcccacactttgaatcaatctcccactctccccctcccccttcttctctcatattagataagcaccaccgaagataattctgttatcttttagagccagccatatcacagaacttaatcatgggagcactggcccatcatattcataggtgtctttcacgccaagtatggagatgattatacaaaggtgtgggtcattgggatgatcttagaattctgactactccagtatatgagacaggtgaatggactatatgtcagatgttactgggattttaaagcaaggaatgagaagactattactgcctcacgttttatatgcatttcttttcatttgatatgatgtttaaaattattgattggagatgggagatcagctgtgattgattccctacaggaaatatagaaaaaaagtatagaaagatatcaataaggaatgtaaaccttttgcatatgacttttgtgtctgggaaagacaatgtactcttattttctcccttttttattcttaataagtaaattttctcatacaatttaatttcattacaaatacatgccaaagacatgaacaaaaataagtcttcataaaggaaggacattccacaaataaaaattggcacacgtttattgtttttatggggattgggggaagttgtgttgttccacagaagaggccaacagcagcttgttggtactctcagatacggtgagtgcagtagtttccgtcagttccacagatttaccacggaacaaggaacgacccaggaataaggaatgccccagcttgcagcctcttaaagctgtaaaactactcagcacttgcttctggtagttgactgctatcttaataattccctgtacctcttaaagacatgatagtgttcatagccaggaaatgtttaggtttgatctacttttctatttgtcagaacccaatgaaggaaatcaatctatttgtttttcaagcataaatggatgaattcttggttgttgctaataatacagtgtcttatttggctaataccattttgtttagaaaataaaagaaatcataacattctttttaaggtcctttagtagtttgtagtaaaactgaattagttgctgtagatatttgaaccttaagagtgtgtgtgtgtgtgtgtgtgtgtgtgtgtgtatgtgagtgtgtatttgctgctgatgatcaatcagaagatccttaggagaagatcttttgtttaaaggtgtttaatttcgatctattctgtgctctgttatacttattactatacttttaggagaattgaacacatataaatgtaatataaaagggccattatgctactgtgtagtggattttaaactggagcgtgaatatccctggggttatgtgaggatgttccattggcatatgaactcagagctttgaggatacaataaaacaataatttgtttggctaattgacaaatcgaatggctctgataactgggtaacagatccattttcaaatcaggtggtttacaattctctactttaagcaaaatttcagagaggcctaattgagttgtcagccaatatatgattaaaataatttttgatggaaaatcattgacttttggcatataattgagaagtagttcaaggacttgagcgacattgttataatggaaagagtttcttccatttccatctatttatttgtgtgaacaaagaaccttaacagttatagcaataaaaacaataaacagaactcttgctgggtcttttctccttttaacagcaagtattagtcatccatagcatgtataaaataaatgggaaaaagccatttcattaagagattcatttctgatcattgcaatctttgtctaataattacttgtcacagttttaagtttttgctttgataattatgctcttttaataattttaatggtaactcaacccaaaagaaattttttttacacctagagttatatggtcacagggaattttttttaaaaccatctttagatacaattccttgttgcagagaaatatgatcaatacaaagactttcaagcataaaatttattatgtaggataaaaatcagtggggatagaaatatgagttcaaaaagaaatatgacttaagtaaaatttccagcaataaataagatcttgttcatggaatgtattagttcattctcacacagctatgaagaagtacttgagactgggtaatttttaaaggaaagagatttaattgactcacagttctgcatggctagggaggcctcaggaaacttacaatcatggagggaaggcaaataataagcaggtactttcttcacagaatggcaggatggagtgagtgcaagcaggataaatgccagacactatttataaaaccatcggatcttgtgagactcactcactatcatgagaacagcatgggggaaaccacccccgtgatccagttacctctacctggtcccaccctcgacacgtggggattataaggattatggggattacaattcaagatgagattttgggtggggacccagcaaaacgtgtagtttgtgctagtattttaattagtctggattctttaaaagaattatgtaccagttttattctaaaatatccatatttttagtatgctacaacttatattctttgctatttacacttaccaggaaaataaattgttgacctcaaaatgttttagaggtacatggttttataaaaccagattaggaggttacattacgttgtaagactagtgctgttgtggaaaggactatccacgaaaccactggcttttcctatgttgcaataaggggtttggtttaggggctaaggacccagctggctctgacactgacagtggttcaccttcctctgaacttctatggctctcattaatcatctgaaacatttgacactttgcatatgtctggtggtgctgttgatttggaatctaaaccataaccactacttagtagttgaaaagttaagaatttacccccattgttgatactctaattttcatgtaatcagaaatgttacctttgcgataaggagttcctgtactgctctctctgccccatattttctagtgtgaccagtttgtcaccaaaggttgggtcatatagatttttgccacaatttgagcaagctcctattacatcattaagagtatgtcacagttagtttcaatgaaataattagccaattggatttcaaatagtaaaataacacattttattatatgtaaataccttatcttccaaaggcataaatttaaggtaatgataattgatatccagaatgcttctgtgtacatacatgttatatgtttcaattactaagtcaaaatatgtggtagaaatagtaaggaacgcagagtttcttttcttcttaaggaaataaaaagattgacttgagccaatttttatctgaggaatgttaatttgttttatttaatgcagcttaaaactctacaattaccctttctatgaacagatacttaatgagtacataaacacttggttcctgtatttcctgaaatgttccacactttagagctggttctgctgatgaaagttgaagtcatgggcaggcatgagatggggtaggcaaagagtatactgtgaaaagagaaatgagggcctctgatattaaatattgcccagggagaggaaaaaaagtttggaaggatcctgagtaggacaattataaaagagaacctggagcttgcggggagttcaaagcaacagcaagagtctgtgccatgtaatacttagcaatttagtaaagtaaggaatcaaaaatgcccactggaattttaatataaaatatttttggctgggcacggtggctcatgcctgtaatcccagcactttgggaggcctaggtgggtggataacaaggtcaggagatggagaccatcctggctaacacggtgaaaccacatctcaactaaaaatacaaaaaattagccaggcatggtggtgggcgcctgtagtcccagctactcaggaggctgaggcaggtgaatggtgtgaacccaggaggcggagcttgcagtgagctgagatcgcaccactgcactccacagcctgggcgacatagcgagactctgtctcaaatgtgtgtgtgtgtatatatatacatatatatattttaaggacattaaaaaaatcaagggagaggaaaaagtctcattttcttctataggttggctaggttaaaaaaaaagtttcagggtggtcttttgtagtcagttttgttcttatatgtgatatttctagtgagaaagcaataacaaaaacaacaaagaaactaaatttttttgaatggtaactagtatgagcagtatctttctgggctggcagtggaggctgtagaggcatggaaggcaggatagtagggaaccatttgctttggtttccttctcgcttcaaccaggagagagaatgatgttcaagagagagaaaggaaaacatagcttccatggcaaaagaattacacttgcattcctttgataactggaggaaagaggaaggaatggataaaggtctaggcagtattgtgtggctggaagtttgctgtaatgtctaatgaagtaaaaggaaattttgctgaaaatgaaggtggtggtggtggtccatgatatcagaagttaaatacaatagagaattttgaaaaacaaacaaacaaacaaacgaaacggaatatttcagggttgctagaatgaatggatgaaagtattaaagtgtaaaattgagtcctcttgaaggcgaaggtaaagtaacataaaggaatatactaacatccaatcaaattagaataacaaatatttactgagttaagacattattgaatgtgatgaatttgaagggacaagatataaacctataaaaaggtacataacagaaatcacattaattgcttctataaagctggctgactaggaagtgtttaatgcaaactggaactggagaaaccaaagctgggatgatccaatcggagtaattcaatggccaactaaaatggcctttattagtgggagttaagtggagttacttccagatactttcactgtcccttgtttctgcgttgttcccttgtggtacccactaaaatccgtttacttttacctgcctctaaaaatagctatatgtcaaaactactaaaggcccataaacttagtcatattatcatagtttgaagcccaggtctaccacttaccagttctgagaacctggacaaattgtataaaccctctaaacctttttattcctatctggtaaaacaatgaaaatgataacctatgtcatgggtgttgtgaggattaaatagactaaactatataacaaccttagcatactctatggcatataaaaacctactcgatagttgtaccatgttattgttattaactttcttaatagaattcttaaggcaaaagggtattgacatatctctgtctacatcatttattgtcattgttataagtgctagttagtctaattcatttcattataattagtaagtggtaatatagctggagaatgaaactcattttgatccttataagggaatcaaaatgatatcagcttttcatttcagcagcctgattatcattagatgaacatcaatatcaatttataaaatttacaattttataaaacatgttatagttaattttttgtttgtttagatgttgaaaaggacactttcttttcaggtctcaagatacatatgggcataagccataaaatctatatttaattgacatcccatttccttctttaccatctttgaaataaaacatttaaaggttgactctggctgtgtacagtatcaataccgtggaatcagtgagagcccaatagttagttattttgacaatcagtgtttctagggtgatccatatccagtgtgcattctcctcagggttacattgcttataaattttatttatggttcatataaagttttatgttccagtatttttccaaagaacatcttttatgtccatgtgccttccctcagttatactgataactgtccattttgtattaagaatcacactggaagtagcttttatgatatttctgaattatgaaagaattccattccatttccaatagaaccatgctacaactaaaatatatcatggctgtgctgtaagctaattgtaataaaaaccataatttgggcgaccttctgtagcattgtaatggcttctgaaactcactttgtcttggtcaagtgaagatttcaggtatagagccagattgaccacagccatcactgcttcttccccagagagaactcagattattggaaagttttctactgagagtagaatactcttgtccttgggcaatagtagctcagaatttagttattctgcccacaggcctccctaaaatgaatctcagtttggagaaaagagagaaacaaagaaactaggatttttttttttttttttagattctgagatagcatccaccaacctgctacgcttactctggggaccttgaacggtgcatagaaaggctgttttgtttttgtttgttttataaatcaatttatttttgaacttcctcaaatatttacaactgtgggtggaaggaaataattttccctctcaattctgccttggagaggacacatttctgtgccctttccagcccaaaaggaagagtaggattagaaagtctgatgtagacaggatttaccactttatcataggtcatgtgcagctgctccgtaagcaaatagtaaggctctcaggactttttccctgggagttagaagtctctccccttcttcaagtgagaaaagcataatctagtagttacagtaactggtgcccttgcatatgcttctccaccccctccaataagcttcacccaagtcagctccaggtggctttcctcttcctcatagtatctgcctgtatttaaacagcaaggtttttttaattcattaaagtttgatttactgttaaacgtattaaatgtgatatccctccatacatattacaaatgcacgtcttttataaacctgtatgtgtttttatgtcgattgttattatatgaataatttaaaagcagtgaattgcagtagtcctctttggcatcataacaacatcccaggaaactttgtgctctgctgttaccttgtattatggcatatatgagggggagctcaatgttctgtccactttttgaggtgaaaatcaaacataatgaaagactaacttggtaaagcaacgttaaattctgagttttagctctctaaaggaaaagcataaggtgagggaagggaatttggttagttctattgacatttgatgactgtttaccatgggccaggctctgccagcagggttgggaactcacaggagagaaacacgagaattgcatcctcaggacattacaatatactgggggagatgaattcaaaagattttgataaatgacagatataggcattatagacatcaaggatgaggacgagccttgttggtgacaaaaggtgacaaggcagttctaggaaaaatataccaaaaacgagagagaatagtaacagaggacctggcctttacagacagatggaatccctttttcatggttgaaccatgagataaacttgcacatgctttaagtaaaagtaggaaaaagcaaagttaacatttcttgcttacctaagggatttctagtagaataatgtatataaggcaccaacctggttatgtggagttgctcaaaaaagagtaaattctctttcatccacttgcactggcctcttactagacaactcactattttaaagatgagacaatttaaatgtggtcagaaattaaggtgtagtcagatgaattggtctttttaaaatatgaagtcagctccatcaggtaaaagtccaaaataactttctttgctgtaaaataaaggtgttaaaacattggtaacatttttgtaaatttcagaaagattttgtttgtaaatctcttttgagaattttcttggctagatgctgtaatagttactaaatatttcacaagttcactatgaaagagaagttgaaagcctccaacagaacgaactgactgaaatattatgtctgtcattcattattattattactgtcattgttattattttaacaaagcattaataaaatttatggttagaggcaagtaccacccatactcaaataaatttattttgatttttcaacaaattggtttgcaatcttgatagatgggaatgtttcatttttattacaatcctcatgaatcacagtaaaatctaggtatgaagtctaaaagcttgtatcttgacaacatttaacacaaaggaagggtatttgagaaaggaaaacagtaatgttaatataaagatgctttttattaaaaagtcagttatttttaatccttccttgctttcttcttcctttccttttctcctacattgccttgtgtttctttttactgagtgatggaataaatgtcaggtctattaatgagggtaaatagtaaagcttttaaaagattatttattttagtaagggtctcacaatttgctcattaatgttgtctgcagcccaccattcccaaaacatttcaaatactataaataatatgtgattgtactcccaaataactaggttattgtccaatcaagaaaatagtttccttgatagttggaaattgaaagttagctaccaagcttgtgataagtcatattcatattaaaaactacaaaaaggagctcatgatggcaaattttacattctaacttcaatactgaaagtttgagaataacattttattaaagaatttcaaattaactagtaaaatagtatttaatacataatctttaccatatttcagtgataatgcctttgccttatttatattttggacatctgaacatactttattcttgttgacataatagattgtttctctttaaatctaaattccttgattatttgttgaaataagcacatgtggaaaatgttttttagaatgtgtatcttgaaactttttcttcttaaaagaagaaaacttactctaagggacactttgaattttgtttcagcatatgtctgcttaatttgacagataattttaccgtgctaaaatggtaaaatgcaattgaacattttttttgaatggaaaaataacattttagttgtgaatactttttgatatcatcatttgaaagagttgtttagaaaaatagacctgtatgttgttccaaattatagattttgtccttaaaataatattggcaatttgatataattgagctatgtatatcttatgtgtaacaactttcagcacacaacaactattttgtcaaccatgtcagtagatctagtacaacgtgtgatcagaagataaaggtgttaagaaatttgaatacatttctatttattttaggctgatatgtttttaataactctagcttcatagatatcttgcattaaatacaatctgtttcaagcaatttctcttgcaatattctggtgactgttctctataaacatggccaactagcctataaaacatgttttatttaattcattgctacccgtttatggctgcaccatgtggtaggaatccagaagcatcaggtctactgttcttataacgttcaagtggcctccaggtgataggcacagccagctgtcttggaccagtgccaactcacaatggtcttatcaaccagcaacacttaggaaatcactgagacagccaacagtcatttgtggaacaagaaaggacgtggcagtttggctattttttaaatttttccatctgaagcaggaattatcactaactggagtttattcttttttttttttttttttttttttgagacagagtctcgctctgttgcccaggctggagtgcagtggcgtgatcttggctcactgcaagctccgccttccaggttcacaccattctcctgcctcagcctcccgagtggctgggactacaggcgcctgccaccacgcccggctaattttttgtatttttagtagaggcagggtttcaccgtgttagccaggatggtctcgatcttctgacctcgtgatcctcccgcctcggcctcccaaagtgctgggattacaggtgtgagccaccgtgcctggccaagtttattgttatttgttaaaagaatgtttgctttttggtgtcttcaggtattttcaaatagaatgaataaaaccattgtgtgctggtctcctagtccttcatctcatttccctccatactccatgactcaattagtttctggggttgggattaagtgcaccttatgctaattagaactataggttttactccttaaataactcccattggcctagctttgattctttaatgtaacaaagatagatgtgggaaaaaagtgacctatcaaaatatataactcagaaagctttttgggataaacatatttaatacaggatttctcagttatatattctttttttacttagataaaacccccaagggaaaaataggtatctaatgatatatcctccattcaaaactgtgtattgctattgagaagttttatgtactattttaaataataattattaataaacatatacaagcaatgccaaataataaaaaatgtctgtctttttcctgtggagatactcagctcatgccaatttggttccctaaacaactagaactggagaaagctgtgctgtgacgtttgaaatcgaaaacctgaaaaatgtaagcttcttatcaacttccaaatttggggcaaatctggatcctaaaatcaagacatctttcgtaagattagtatccaacaagacaagaatattggctattgtgaagaatgctgctgtgaacaggggagtactactataatcttgtcttattatgattcacaatagtcaagatatggaaacaccctaactgtccattgacagataaatggataaagaaattgttgtttctctctctctctctgtgtgtgtgtgtgtgtgtgtgtgtgtgtgtgtggaaaatatatatatatagggtgatggtatatacatatatatatatatatatatggtgatggtatcaaaaagataaaatgactgctctacaattattctcattttgaatttcattttaatttacagttttcaaaactaaatgccacctgtcttttgacactgttttcattattgaaggttttatagctttaattttatattaataaaattaattatgtaaacatttgcttgcttttaggagcaaagcataggctactaaagtaaatagttcattaatttttatgtcagtcttggtgctatttacatgcatagaaatgaaactaaacgaccccagggaacttacagagggttggtttcaaatccatgaattaatgcaaatggtaaggttacatcatttgggtataaggtgtatgctttggagaatggaaaataagcaatcaaggtaaagtagccctagtgcctacattattcatgaaaatgagatcctgacattatattctaaggtgatgttgtagaagatagagctaactatttgtgcaggtacactataaggtcagtgtgtgtctggggtcagcttgccatgtgggcagaaaaactcttctgctgcatctttatttagaggaaatccacagagctttcacttggcctactgtattgctaatgtttattgccaccgtaactgaaattcctacaagttgagagcaattgtatttcatccattttaagctctcatcagttaaaatatgcattatatttattttacctctaagaaaagtacttctgatttaagtataacttttcacaaacttaagttttatcctgattttaataatgctaaaatgtgaaaaataaaaagccaccttaaagttgttgaaatatagtactgcttttattttattaagagtgctgctggcttggaggtaaagcttaaatattatttttggaaggctgtttcaggttgacacagacatttcctgcggggaatgagaggtcagagactatatccctcccattagcacattagagagagaaatgtcagaatattagacttaatttggcagggtccttgggatttctgcctctgtttctttgtcttcctatatttagttgctgtcaatgagttttggtatgtacaaatagatttaagaacatacatcagtgtctcatatattcattattattttgttaatatagtatttctttaattctaaatttatttaaattaagcagtgaatttgaaaccaaccccctataattcttgtagattgctgtactaaaatgtatttctagaaacctggttatcaaacaaaacaaccaaatactctgttcttaacatttcatcgtcttccaaaacgacactttcttagcaacttcaaagtggcaactgatggtttggtaacgatataataacaaggaataactcctatattcttaagagactcagaatttcaattcttaccacatatacatctattttcttaattaaaacaaaaagtcccagataaagtgtaatgcccagaacttgaattttaatgaatgcaaatgagcccaaagtgagaataatcagctgaagttctaggatggaatatttgtcttgtatttaccttggaagccactagcttttactcaactataaaagaagcctcaggagtgaatataaaaagaaaaaaaaattatagtaagagtttgagaactaaccaatatacttcattaatacattgaattttagtgtgaggaacaatataaatttcatgaagccggatgaaaaaagaagagatccttgttatctcttctgccttttattttaactctgtggataattttttccctatacgtctagaaacctgggttcttaaattatctccaaaaatatactctgtagggtttatagcctttaaatgtaagggtagctagagagcatgttactctcactaggtaatggggtacatctttttaacagaaacatccttgaattgctaacacatatcttccactctggtagactaaattctgttattttctgttgtttgttgagaagatagttcaaaatcacaccaaaaaaggcagtgccattattgtaagtgtcattggcatagatgtttttaatctcactgtagcgtgattctttggttaattgtctctctgctgcactagtctgtaaaagcagtacgtgtaaaagcttgttcaccattgacgtgaatggtagatcaccaacactcaccacaaagcttgacacatattacattatattaaaatattgaaatatcctgtgacttgacctcagtggaattggaatgtgaaaaaccatcttttcagaaagttgtagaaaaccaaatttggggtaccatccaatggtgctgagaaactgactttataatctgtttttatttttttgcttttggagtgactttagtttgtaaactttttttttttggctctttaaagggaatagcttttgaatgttagattagaaatcagactatgtacagagctattcagctctgaaaactgtgataacttgctaaagctatgtttacaaggagaaagtaaaaaacaacatgaatgattttatagtatatgtgggctggtaaggacaattatagaacatttcagttatccagaactataaagatttaacttctaattttcatataaataatttcaaaaatagcaaagaggaaaaagtaacattgtttaaaattgatatctgtctgcataacagagtatcatacaccacatttcatttacatagacctctggtttttaaaaaaatcataatgaatcatgtgtttcctaaaatactccattaatgttacaactaaataaataaatgtagacataggagtgactactattaggaagtgaaagaaaatttatttaggtgccaaattgacagttttttaaataattgttttgtttagaaaggtcacataacataaaaacaagtggattctataagaaatcaattactattcagtgtttatacaactttttaaatagaaaaagaagttctcttagttctaaatatatatatatatatatatatatatatatatgcaagcataaatgtgcattgcacaagagggttagttactcaaaggaggaacattatttgccatgcgttaattatcataattttgccatttccacattgaatcataatcattgttaatttaaatacaatggtatgtaacttattcattcaacaaacatttattcaatcccaggaatgcactagagtgctatacaacagtgatacagagacgaattcatatgctgaagcaaattctagttgaaaaaggaaatatcttcatatttggctttcaataaaaatgttaatatattaaaattataaccaagttctattgatatttctcctgcattccacctctgataataaataaactcatccttcgggcactctctgagttggatgctcccggtatatctaatgcctggatattatcagacattctcagataatacgtggttggggatagagggaaaacattaaaaatggtaataatataaggtagcatatgttaagagtgaaatgaatggttaatgaataaatagagaaaaccttattctgggtgctgaatcactgaggaaattacaaagaactaagtcctcatgctttttgctttttaaaatttgttttcctatctgtccctttttttttcccccttaccaatctcctacttcattttctttctgagttatttcaaatgtctccttgggtattatcctgaccagtaatccaccctgcatattatcaccaaatgagtcattcatagactgctttggccatagactatgatctccaccttctttactctatttaaggtagttggaaacctggcctggcgatggcactcattctcatttaacttgctccattcaaaagaaagtgctaactttcttttacgcctttattgcaaaaaagaatgagagaaaagagtaatcttgaaaaatataatttagtgagaaagagctgacaacccttgcagtattatactgtacttgaattcacaaacgctgagcatgtgctttgcatggtttataaatagactttggcaagctttgaactgcccacactgtgttctgagctttgagcaaagctctgctggcatgctgaaccaacttaagttctaatgtgagttataaaaacacaaggatgactggctccatttggagcattgtgttagccaagcaggtaaaataaattcatggttagacctcccctcccacggcatccctttcattcctcagaagataattctgatatctcttcttaaccagagcagacaatgcaactattcctctttacagatacgatgttttataagttaaaagaacaaaatgaacaaaaagaacacaacattcattttattgttagtcatctaccagaaagtggtaacattggggatggagataaaaatctggagtcacattttcatagacttacacattagtgacattgtttagacacttaccatgtgcattattttttctaaaaagcattcctggtaatgtgggaccatcttacatattttaatattaggtaccatactctttccatggctatatatgcatacagatcgttaaactcaacatgaaagaacccatatttcacctctgatggtaccatcatcttttaccatttcatgtcctcatctttggtaatgccaaacttgttcagaacttgttgatggaatgcaaattcttcaccaaatgcttttgaatggagtgcctaatatgtgtctggtactgttttaccaactggatgttttaattctgggggcattaataagacatggaattttgtacacataatacagagctggtatggcaaagtgagtgggagtgacctaaaatgtaacatataaggccaagccaatgaggttttgggggaacagagttgcctgtaaccactgcctgttgacatcagagctacagaggggaggaagacagtgaacaaagggcactgcattctcagggcagcaaaacagctgcaggggctcaagatggggcagcagggatctcaacaggtgaatggaggtctgcaatgggaaatacagagtacatgcttaaatatcagtggcgcaaggatcagtatcaggccagattgccagactttaaagacagaatgcagacactagactagaaattgacataggaaattataatactgactagagctaaaagtgcacaaagagaacatttggatttttgtgtgcatgttccataatttgtctggactaaaatatcgagctaattccaaagcaagtaatagcatgtgctaattattttcttagtcactaactttattgaatgaatgattttccaaacttggatatgaaccacttttaatatcttgggaaaaagtatctgaatgctattctgatctcaagtctggttttagggtttattgtagtagccatttagataaaatatctgtggtacggttcatttggattaagaacacatcagaatcagatcctttcattcaaaaatatttgtttacaggatagatcttcagtaaagagaatgcagcctgaatcattcaaatatatttatgagaaagaatataacttacctgagtaattcctggccagtcataaaatgctgaggagagaagttcagaagaaaagagggagggtggggaaggaagagggaagccagacaggaaaggggagaggaaatgaaataactgaaaccgatcaactgctttgtttcaaaggtgaacttaaagattaaaaaaattttcagtttgctgagaatgatggtttccagtttcatccaaccatcattctcagcaaactatcacaaagacagaaaaccaaacactgcatgttctccctcatagatgggaattgaacaatgagaacacttggacacagggtggggaacatcacacaccggggcctgtcaggtggtggggggatgggggaggtatagcattaggagaaatacctaaggtaaatgatgagttaatgggtgcaacaaaccaacatggcacatgtatacctatgtatcaaacctgcacgttgtgcacatgtaccctagaacttaaggtgtaattaaaaaaaaaaaagtaataataacaacaaaaaaagaaagtaaaaaaaaaaaaagaatcttcaggtaaaagaaaggaaaacctggctgggtgcagtgacacatgtctgtaatcccagtactttgggaggcagaggcaggtgactcacttgagttcaggagtttgagaccagcttggtcaagatagtgaaaccctgtctttactaaaaatacaaaaattagccacacgtggtggtgcacacctgtaatcccagctacttgggaggctgaggtgggagaatcacttgaatctgggaggtggaggttgcagtgagccgagatctcgccattgtactccagcctgagcaacagagtgagactccatctcaaaaaacaaaacaaaacgaaacaaaacagaaaggaaaaccctatcatttccaattcttatgtaattcaaacagatgaattcttccctacttttttgttaatattgttcctaaaaatgtttgcaatgactcttgcaaatatttgcatataccccaaacatactactgtaaattaatttttagaaccagttaatacatttctctctgtttaaatatatacttatatgtgtatcatataatatatatgtatgccatatgccatattatagtctcttattgtagtacatcccctaggtttgaaataataaatctgcatgttcatatctcaaatattattgccctttttatgtattattttatactaattcatgcaaagtgcctactttatttggcaataacaaagttattaacataataaaaataaagacacagatctgtatgtttctattgctaactccaaccatttgtttccttgaaggaaatttgtaatttagtgtccatcagcatatgaaattttagttttgacagtctggtatggttatatcagggtgacagtggtacaagattcagagctggtttttgctactatatcttttttaagccatctgaaccacttggtcaatctatcactaaccttgtcaattccccctgcttcttatatctattcattcttctcatttctactgtcactttttgagacaggcccttgtcatttcactgtaggattcctgtgacagacttctaactagtcctctgtctctgacttgccctgctcattcatccttacagcacaaaaaagttaatctgtacaaaatgctgttgttatgctatttgcgtagggtttgctttaaacagtacttatgtctatataccataaaagcctcaccgtgtttgaggaggaaattgaagttctcaggagaggagcgatggttgagaagacttgagaaatgagatgcactttctatagcgtctttagaaccagaatttacacaggaacatatatcctaaggaaaagcaacaagagcaaggtttcaacactcatggctttttcaagcaatggtgagcaaactgagattgaggtcccagcatttgtgagagataaaatagttgagtggcttcaatttatgttttactggaaaaaagctggtatgccaaattggaatttcattttataagcctcaggggttaggataagggcgagatgcattagttagcactctttcagtttctagtgatagaaacacacctcaaatctagcttatgcggtgcatgtgacataaatgtttcagggtattactgccattaggttatcctgaggcaaaatgactacatgagaacattagacatcaaactgtctttctccttttctctactcctcttttctctgtgacccagtagagttatgcccttagtgcctgcacttctagtgctcttgtctactaattgttctagcaatagttctggggttgcctctgattggaccaggcaggatgctgtactctggtggttgtttgcagaaacctgactctgggattggggtcagggacatctcaaccacatggactattaggggagcaactctggctccctgaaagaagaaaggtctattatcagaagagtggtgtggcctgttgaagtaaacaaaagtaatttcattttaggtttctcagctgaatgctgtgaatgaaatagcttttgtgactgacctaaggaaatttagccatttagtaatacagtcatacattacttaaggacaggagtacattctgagaaatgcatccttaagcaattttgtcattgtgcaaacatcatacagtgtacttacaaaaacctcaatggaattgcctactacacacctaggctatatggtatggcctagtgctaccaggctacagatctgtacagcatgttactgtgctgaatattgtaggaaattgtagcacaaatgtaagtatttgtgtatctaaacatatctaaacatagacaaggtgcaatacaaatacggtattatagtctatgggaccacctttatatatgaggtccctcattgaccaaaacatctttatgtggcacataactgtagttagattcttctgatacatttctctagcctccagtggtcagagataagtagattttatgtccccaactccacaatgttgagattgccaccaatgagtgtgtacagtgaaagcaacacccatcctaaattttgctaaagtatgaatatttttgtcaagtcatcacaaaattttcatgcagtctcttctcatagctcagggatggctaaactttctgctcacaggctagtgttttatattgaaaatttgctctgaaccaaatgcagcaacattcttaaggcaggattaagggaacttctagttgggtcaggtgtcaaagtcattgttgaagtagaaggatgtacagtggggtgctagacctcaaccctacactaatgttattacatgcggatctcccaaatcattttaaccaacgacttacattgaacaccactgatttcgccaataaaatatgatactttgcatcccttagactcactggtgcacattttaataatgatatttgaagtaattagtttattatcctaggatttattccttttcaggaatgtgtccatttcactgagccacactctatgctgccaattgcatgatctcatggttccttgagttttggggttacaggcaaaaaggcaaagaagtgagcaaggggataacagatcaaaagtgagttgtgcagctgataattcagcaaagaacaaagagacaatggcatgggaccgtgtcctgtttagagcctacagctactgtctcttgctggccttgctgacccagtgatgaccgaggaggagtcaggccagggcagagtacatggccagggtaaagaatactaggttttgttgtttgtttaaacctgagctctccgatcgcgctgctttggtcagatacttccagtggtgtcacaaagggaaatgtgatcttttgtcttgcctttcctcctctgcctgccagggaaaaatatatttacatatgttagtttttattttcctagcaacgaaagagtagaactattttacaaaccaaacacaatgtaaacacttttgttcaaggggaaccagataatcataggtcatgacttctttagtaaaaacagaactgtatattatgtacaactcattagtcatgagttccataagtatgtgcaagtgctatgcatcttttattccctaaagaactcagtcttacccagagcacccttggtaaaaggaaatggcatgtgtgaagcagttccagagaatcagaactaatgccattgtgaggcctccgagaagaccagccttgaggcagtaagttaaaattagcagggactttggcaacaggtgtttgtttagatgcgtgtttatgaaaatccttgctgatcttcttgcttctaaaggaaatgttcaatgactagaatatgggtcaagctttaaccctcctgtttgtcatcgtgataagtgactctgataaagggctgtcttggcgacaggcaacacaataaaactgacacttgaccagccatatcaagtaaacttgttaatgcagcctagatggacagtagcatagtttttccttctatagatgctttgagggcctaaaccaatatgtgtaactgctaacaaacagtagaattgtgtgttgccagtagctgtgactattattggagaaaaggtgataaacctctcatgagatttgggcatgtactttaagacggtattccataagtctttacattttatattacaattaaaaagaaatgaaatagatcactgggctctatttgatgtataaattaacactgatcaccataaatttacactgtacaactgtaatcctgaatgtaaagctttgttctttcccctcttgctgtaatttgaggagcctgttcctcatactctactttcattaggagggctgtctctctctctgtttggtctctctctgtctgtctctatctttctgttgcttgccttctctctgaagaggaaggctgcctgatgtagtcatttatctagccaccttgctgtgtcatattttcaattgatattgagaacttatgttttatgagcatgaacggtaagcagtcattagagctatcattgtattctaaagaagatgctaagtcttaggtagtctgctttattgcttgccctaccaagtatttagcattcccttcacaaatacgtgaaaataatgctgggtggcggcttacgatgtggcagctccttgcactgcataccctacaatgtcttgtccccctccctcagcattgagagctgctgagtgttcacgttccaaatgggtacttctgagtttcactgtttatacttctatacttgccttcatgcctctgaaaacagaaatcagtttctgggtacttctagtcactttatgtgcagactttcctaattctaaggcttattatcttattcttcataaaataaataggaacattgtgaatgaatctagacaatgcatggtgctgagtagactttaacaatgattcctaacggtttttagaaagtgtccattttgtcacctgcagtcaccccatatacatatgagatttatggacaaagactcccattttatatgcgtatgtatatgtgtataaaatgtgtatatatatttatgtgtacataatatatgtatgtatatatgtgtgtgtgtgtatgtatgtataaaatgggagccttcgttcataaatctttcactctgctttcctaacaagatgagtatttaaagtagcatgatcttggtttgaaatgaatatcttcagcctcttacagggccccaagtccaaaatctgttcctttaaaattttaaggaagagcaatgtctttggtgagagacagacattttcctctgatccagggtggaccactcccatttctaattgagaggttgctgtctgagaattgaagatatcaaagggaatttgtaataagacttcactttcccctgagcacagatcaaagtggcccctgggcattttttaactgataagggtctacactactcttgatactggtggtcaaagttatagaaagtgtgtaatagtaactgcgtgatcatcacttcactagttcatagctatggacttggtgaatttttaatctctttcttccatggatactttaacattgtagataacataataattttgtatgctttcattgcaaatttacaagaggatctcagggacaaatcattgagaaagttgagtgtgtcatactagattcctttagagtcatatttatgccctaatgtcatagctaggagtgtgacctgggctcaaacactggcttatcagctgtgggtaagtacttaacctttctttactgccattctctcacctgtaaaatagagataatagtagtttgtatgcagtgtgggcttttgaagattaaattgtgtgtgtgtgcatgtggaaggttagactgaaacataataagggctcagtcaaattagctactttggttattgctgtagtggtaacatttacacatttactatcttatgattcttcttatttttagaaactgtgtggtggtgatttttaaaaaggaaaatggcaaggactggggttttgttttctgttttctttctcacagttaatttcagcaatgatcaatacaatttttctctttacccttatatcatttttattgatttggctactgacaagttttgaagcggtagtctctaatcactatctccacttttttttctttaactctaattcactggttaaactcattttgaccagattctgctcataagattctatagaagatgcccttactctatgttttaatatccaactatttgcagaatccaaacaactttagttcatgaccatttgacttctttctggccactattagtaaactcttccttcttttgttctccttctgactctctgagtcctccttgttagtgctggaaggattctttttctccattcacacctcactctctatccttgatattttttacatgcccaactgtagtcatctttcatttctgttttacacattctacctgagtatcgtcatccattcttttattttgaactatcataaagtgcatattcccaagtcagcaattcctgttctttttttttttttagcctgagacgcatttccaactgttagtctctatctgaatatcatttatgcagtacatagtcaacttatccaaaacctaaatcattaccttccttcctaaaaattatttgataataatacttcttttatacctctgtcttggttaatggcatcatcatatattgagcctcccaaacttggttcatcttttatccatcactctccaaatgccttcacacgtaaaatgtcattgattcttatagaacaactttttatacgttatggctatatttcaaattggccttttcctctcttttttattggcccttagccagtaaaggcctaagcctttgtagcttaggcctacatcaaattttaattcaagaactgttgtgccttcctaactagtatattcctgccacgagacccttgccattcaagttcataatccatcctgtttgcttcaggggatagtcctccatgtttttgatcagttcactcccatgattatgaacatcaatgggcttttcatgataaataggacagaattcaaatctgcaataagtcataggtcaatctgaggtcttgtttacctgtccagcttcatcacctactcttccttgctcttcatgtaaacagtctattgtaaaaaattatggaggaataattgacatgaaataaaatgcatataattaaagtacaccatgttgatatattcttatgtatgtatatagcatgaaatcattaccataatcaagataaaaaatacccatcacccccaaatttatttatgcccctttgttttactgacctcacatctctccatccccacccccagataatgactgataatgcttctaccactatagattgattcccattctaggattttatataaatagaagcactctttattttgcatggcttctttcactctacatgatttttttttttttttttttgagacagagtcttgctctctcacccaggctggagttcaatggtgcgatctcggctcactgcaagctccgcctcccaggttcaagcaattctcctgcctcagcctcctaagtagctgggactacaggcgcctgccaccacgcctggctaatttttgtatttttagtagagacggggtttcaccatattggccagactggtctcgaactcctgaccttgtgatccgcccacctcggcctcccaaagtgctaggattataggcatactctacatgattttgagagctattcttcttacatgcattaaaaattcattgctttttctcgatgagttgtattccattttatggatgtaccacattttgtctatcctttcacctgttaatagacacttgggttgtttctagtttggagatgtttttacaaaattagctactgtaaatatttatgtgaaattctttctatggatgttgctttcctttctctaaattaaagacctagaagtggaagtgtagatcatttataaggtatatgttttgctttttaggaaactaccagactgtttttcaaaacagttgtttcattttacatttccaccagtagttcatgtgaattccaaatatcctacctccccgccaacatttgatatgctcagtctccttaattttagccatttaataggtattaataggtaccttattgtagtttaatttccatttccttaataactaacgatgatgaacatcttttatgtgttatttgctatatgactttcctggtaaattgtttgtacaaataatttgcccattttaaattggacattttgttttattattctagaattttgaattttttaaatatactggatacaatctttatcaaatatgtgtttgaaagtattatctctgtactttctttctctgagtagtgtttatgaagaacagaatcatttaatttgatgaagtaaattttatcaatctttatagagtgtgtttttgttgtactattgaagaaatctttgccgagcccaaagtcacaaaggtttatactaggttttcatctgtatgttttacaattttaaaatttacatagataggcatgtcatttctcaaatcactgttaagatatgagaaatataaggtgaggtgacataaggagttaatgaatgagttttctttgcaagtttcagttttatttgtaaagaccatatttataataggcagtcatgataatctgtgtggtaaatagaatactggtccgcaaaagatgtctacgacctaatccccaaaatctgtgcatatgttaccctttatggcaaaagagacttgcagatatgatcagggttgttaaacatgagggggaaagattatccaggtgggcccagtttaatcacacgtgtctgtaaatgcagaaactctttcccaactgaggtcagaaagcaatgcaatcacagaaaaagggttagagagatgtggcctttctggctttgaaaagggtagaaggttcacaagccaatgaatacaggtggcttttggaagcaggaaaaaataaggaaatggattcttccatagaatctccagaaaggaatgcaacggtaccagcacctaggttttagtctaggggtgattactgaacttctgatctatagaactataggataataaacttatgttctttaagccactaggtgtgtaataatttgctgtagcagcaacaggaaactaatgtataatatacgtatccccctttaaattcattgttccttccattaaacaagcaatgttttctttcatttgcattgtttcttgtcaatgagtaatagaaagcttttcaatgaatatttattgtatgaaaattgaataaaaaagataaaaacttaaacaatagattccatggatatactaccacctagggataatgtccacctacaaatatatacttgcatttggtttttgattttttaacaaaacaaaaataacagtatcttgactatacaatattgtaactggccattagtcttcagtatgttggcagcatctttctatgtcaatatatatatttctacaaagtaattttacaagttgttgtttttttcattttatatgtttatacaaatgtcctcaataagacctctagtcttggacattgacagtgtttccagtatgttcttgttctcaatatattatggtattataaaaatatctaaactcattgcttttactatctaggagtctatgcttttctgtttctgcctccctttctttcttcacagacttagtttttctttttacctaattaaaaatatttacttattaaaatactcttgaaaataaagataagtataaataataaaataatagttacctcatgctgttgttaatatcttgctgccaaacattttgggattttttgctttagtacttttatttacattaaaagttttagcatgattgtttaacaagctatcatcaatattcttaaaaatcatctttttgaaaggctacatattattcaccatgtgaacatttattacttgtttaacgtatctccctctaatggacacattttttccatttttgagattatatattcctgatatagttttatacatacactcttacacactgtctctgattagtttttatgatgacgtttttagggatggatgttctaatccaaagggatgtgtaatttgaaggacatattaccaaattgtcttcaaggaactttaattcagatcacaactagtagagtgtaaagggcatgtgctactgcctgtccaaataccatttctctcattttctttgcatatagaatgcatattatatttatatttcaacaagtcaaggaaagggatgctttctctttcttgggagtaaattctgattggtataagccaaccattattaatccctttctctttgtgagtgaatgtcttagagatgggaccataactgagttctcaccaaagcctcctaaaaattgtttctttgctcttaaaaagagatgcagtaaactcctcttttcctcaactaaatcatattgatttttctgatagtttctgtagggcttctgaattttaattcttcattctcttaagtctttagattgagctctggcttcttaaatcccatcatcatgaagtcacacagtatgcttcatgcttgaaagtattttattggatcatttgatagttcattaaagaaccacattttaaatagttcagctgagaacaaaaacaccgtgaggtgcttcaaagccgttctgtatgtttagcacagctactcaggcctctggttagccataaaatcattagctatgactgggtcattagtacttataacatctcctttgatacgtatgctcatcagtccaagaagttcagttagttttactttatacgctcatataagagtcagtatttgtgagctgttctaggatttccctctcctcctaagaaagtacaattccaggtaaacttaattatcgcagtaagcacactgaacagggtgtttccctatctgcagtgaccggcactgtggattgatgtgttactgaatttttctcctggaatacatctgccacccactctcccacatgtacagtcagtctgcattgctgtgccctgatctgtggattcaggaatcaatttatagaacaagatgaaacttttttttttaattcttcaaaagtatttagatcatttccaatttttatactatttaaacattataaggcaatagatttggggaatattacttaccattttataaatggagtaaaaagtgccaataccagacctctcttggcaaaagttacatgtgcaaagaaaacaaaatacacctttatatttattaatgaaagggcaaggaaccacaggcaggttttgtcataaaattttcaaaaagaaacctctcgaagaaatttggtaaagcctcaagcagttgtactgtcaaaaactagttaatcataaatataataatttaaattgccattttttataaaatgccttcatatacaatgtttgttgtgctttcattaacttggcaatttagtacctgctttctccaaaagcagtgatcagtcttttctcaaaatagattgaactgctgtatgaattcatgccaaagtccacaatgttagtttgaagaagctaaaattttatttttaagtcagctttgaaataaaatatattgctcagttttctcccctcaaggaatttcactttctctgagcctactactctggaccacaggcctcttttgcacataaattagccaccccaacagtaatagcagcaaccaccactcatctctagggacaactttttgaccatttattttgttccaagcatagttttaaatccttcataaatattttctctgaaagtccttataacagctgtgtgaggttgttttcaattttttttttctattttacaaattaaaaaaaaatccagagcttagagttgaattagtttgcccgcctaaggtatgtattggagctagcatttgaatccaggtctgcattgctgcaaatgcccaacacttgtggtagactaagatgacaaccccaggatgtcaagtgcctttaagttcaagcctatcaaaacctacctattctgtatgtaccctgtgtattagtctgttctcacatggctagtaaaaacatatctgagactaggcagtttataaaggaaagagatttaatagactcatgattccacatggctggggaggcctcacaatcatggcggaagacaaaggagaagcaaaagcctgtcttaacatggcagtaggcaagagggcttgtgcaggggaactcccctttataaaatcattagatctagtgagacttattcactgtcatgagaacagtatgggaaagacccgcccccgtgatttaattacttcccatagggtccctcccacgacatgtgggagctatgggagttacaattggagataagatttcggtggggacacagacgaactgtattattcctcttgtggccccacccaaatcttatgtgctcacatttcaaaaccagtcatgccttcccaacagtccctcaaagttttaactcatttcacattaactctaaagtacatagtacaaagtctcttctgagaaaaggcaagtcccttctgcctatgagcctgtgaaacaaaagcaagttagttacttcctagatacaatgggggtataggcattgggtaaacagccattccaaatgggagaaattggccaaaatgaagggggtataggcccctgcaagtctgaaatccagtggggcagtcaaatcttaaagctccaaaatgatgtcctttgattccatgtctcacatccaggtcatgctgatgcaagaggtgggctccctggccttctgcagctctacctctgtggctttacatagtacagcaccccccaccccgaccccccggctgttttcccagcctggcatttagtttctgtggcttttccaggtgcacagtgtgagcatttggtggatctaccatcctggggtctggaggacagtggccctcttctcacagctccactagtcagtgccccagtgggtactctgtgtgtgggctcacaccccacatttcccttctgcactgccctagcagaggttgttcataggggcttcacccctgcagcacacctctgcctggacatttaggcatttccatacctcctctgaaatctaggtggaggttcccaaacctcaattcttgatttctgtgcactcacaggctcaacatcacatggaagctgtcaaagcttggggcttccagcctctgaagccactgcctgagctgtaccttggccccatttagccatggttggagcagctgggacacaggactcaaagtccctaggctgcacaaagtagggggttactgagaccagcccaagaaaccattatttccttctacactctgggcctgtgataggagaggctgccacagaagtccctgacatgctctggagacattttccccattttcttggtgattaacatttgacttctagttacttatgcaactttctgcagctaccttgaatttctcttcagaaaatttctcctattgcatcctcaggctgtaaacttttcaaacttgtatgctctgcttcctattgaatgctttgcttcttcaaaatttctttctccagatactctaaatcatctatcttaagttcaaagttcaacagatctctagggtggggagaagaaattcccccagtctctttgctgaagcataacaagagtcacctttgcaccagttcccaacaagttcctcatctccatctgaggcacctcaacctggagttcattgtccatatgactatcagcattttcatcaaaattattcaacaactctctagaaagttccaaactttcccatattattttgtcttcttctgagccctccaaactgttccaacctctgcctgttacccagttccaaagttgcttcatatttttgggtgtttttacagcagtacccctttctaccagtaccaatttactgtattagtctgttctcatgcttctaacaaagacatacttgagactgggtaatttataaaggaaagaggtttaatggattcacagttccacatggctggggaggcctcacagtcatggcagaaggtaaaggagaagcaaaggcatgtcttccatggtggcaggcaagagggagtgtgaaggagaactcccctttataaaaccatcagatctcatgacacttattcactatcatgagaacagcatgggaaagacccacccacatgattcaattacctcccactgggtccctcccacaacacatgggaattatgggagctaaaattcaagatgagatttgggtggggacgaaaccaaactatatcaccttggtaccctttctagccataaaaagtaaacaataaggacttttatgttaatattcctgcatttatatgtagctcttataatattaaagtgagattaccttgattattttttccagagagtaattttctgcattcctcaacataggagtgaaaaaaaaactgttgaagtgagatttgttttggcatgtgaatcatataaatacaaaatttacttgctttaagggtctttgatctggcatttaatgtaaattaagtcatgcttgtaaacaagttttttctaaatctttatgagtctacttgccagagtagtaagctcttggtcatctttttctgccatttttttgcaagaaaaaatatatttcagtaaaaacataataaatattatggatcatcttctagaaaggataaatattttatatccctttcaatataagtgtgtatatttagagggaactgtgcatctcaattatggaaacttatttgtttttttcatcagcatacagataaattaatgcattagtattgtctgaaactgtaacaaattcttgacatgatccccatcctgccctcactggggataaccactattctccattataactaaacacttatttattatataagacatattatatcttgaaacttattctgataaaaacagtattcaatgaaagatattaaaatgtaacattttagtgactattcttgttaataaacttgaatagtctcaatgttgtagaagataggcattgtattgcctgtttattcattttgtttaataccattgttcactttagctggaaatattatcactttgagggatctctctttccttccttatgatatttgaacagagaaggcagctggaagcagaggcaccttttttctctgagactctgtgaagtgtacatctgtacctgtgccatctatgcttgttctttgtatttccaaaagccaatgtgaaaatgggtcattctgttcttagtaaaggagtaatattcttcctgccaaaattaatggatatcacatcattcacatcattgatcagtatccctttcatatttatattagaacagaacattgagacgtttattggatccattccctttgcctcatttcttcttatgcagtttatcctaaaatgaagatcagggacaacactgcttggtgttctgttctaacttctgtgtttgtaccttcagcatatgttttgattacagtagaagtcgcataaaatctgagttttctgcccaacttctacacatttcaggaaagaggttgttactgcaaccaacaaaaaagaaaaccaataaaaaacaaagatttaaagtagactacatcactaaagcatattgtgtttgatgctgaaatattttaaaaacatataaaatttaaaaactcatctctgataatctatttttgttttacagttctgaatactcattgtacctttcttaaggaagctgatacttgatatgaagaaactgaggcaccgaatttaggtttttgtgaactgtttataaattaaatcatttgcatcattagaacacaatacaaaattgaagaaaagattaataaaaaggcccctttcagtaaacttaaagaagacataaacagatgatcaagatatctcaatttgtttgctataaatgaagaaacagaaatagtttttcagagctgctattttattatttatgtttggtaggacattttttaaagagaaagagaaacaagactatggaatatataaccatcactcctcattcatttactctcacaaatatttactgaacactttactgtaagtaaaattgagtaaaagcacaattctttgcctttctacttgtactttttaaattgaatcatctgactcataacagtgaaattatagcccataggatttttcaacacagggaagcattatgttatgactaaacaagtacacatttaaaaagtttgattagtgggtgcacacacacgtacacacacgtaacaatatatagcatgtatatgtgtgtgtcaaacagtattatatatttttttacataagaacactgtttaatcttttgaaaggtggttacaaaccaacagaaagacatttctcttatattaactagtatgttaattaataaattaagattatttaatttctcctatcaagacttaaagtctagtaataattattacctatattaagtcctttcaatttgtgtaatatatttactgtattacatctcttcatattttagtattatattactctgaatactatcttctccaatcattggacattttcttttctaaaagtgactcaaaaagaaggcaacttttatattcttttaccttacatttttatatctcttggatcatataaagatttattttaaaaggaaaaggcaatttaaaatttttgccttataggcttataaatctctctttcccatctatatatatctatacatatagacatagatatatatagacatatctatatagatatgggcctttggggcaatttattaaaaaattctatcctctcccctgattgtactgcctttaattatattaactaggtttgcatgagatttctctgaaagttaattgaacccatgtaaaacctaggcatttggtaatcatactctttttttattattattatactttaaggtctagggtacaagtgcacaacgtgcaagttttttacatatgtatacatgtgctatgttggtgtgctgcacccattaactcatcatttacattaggtatatctcctaatgctatccctcccccctccccctaccccatgacaggccccagttagtgctgttccccatcctgtgtccaagtgttctcattgttcaattcccacctatgagtgagaacatgcggtgtttggttttctgtccttgagatagtttgctcagaatgatgatttccagcttcatccatgtccctacaaaggacatgaactcatccttttttatggctgcatagtattccatggtgtatatgtgccacattttcttaatccagtctatcattgatggacatttgggttggttccaagtcttcactattgtgaataatgccacaataaacatacctgtgcatgtgtctgtatagcagcatgatttataatcttttgggtatatacccagtaatgggattgctgggtcaaatggtatttctagttctagatccttgaggaattgccacactgtcttccacaatggttgaactagtttatagtcccaccaacagtgtaaaagtgttcctatttctctttgcctaggtggatataaaattgagttccaattctaatgtgtccagacaattttaaccatttagttttaaaatgtaataaaagataaataaacaataacttgctcagttttctttcaattacatcaatggttagaaaagccaaattcagtcagctcaagatgagttatttacaaatcagcctacttggaaacagattagcaatttaaatagctaagttaataagatccaattatagctaatttgcccatcctttctttcccttgccctcccacaggcttcagagtgtgactgctttgcatgaattcctgggagcaatggggaggcttgtggggcaggcgagtttgcaagaaaaacaaacacagtcatttttattattacacttgttgcagctgtactggactctgcagcctagcagtatgtgggggcaccagcatagcccaagtctctcacagttctaaacttttcggttaaagattatagacatatgtatactttatatatatatatgtatgtatgtatgtatgtataagtatatatatatatgtgtgtgtatgtatataaaaagtatatatttctttttatcagtaaagcttacaagcaacctctactagcataccagatgggataaggaaaggaaaggattgatacagaaaaaacatctgagattaaacacacacacacacgcacacacatacacacacaagagtatgtattatataatgtatgtgggtatattcatgtgtctacacatatgcaaaatgctattctgattccttgatttccttcctctcttatctggctcactttttctaatactccttcatttcacacttctcccactttgttttcatacagcctattctctgaaatttttcaaagctttccccctcttgtcgtttaattctgtaatccttttccatctttcaaatactaaatcctcctgctctgtgccttaaaatttttttgaaagcctacctttgttcatttttatgtcaacatctatgcctctacaatgttaactcattgatgtttataaacatctttgttttattatttaagaaatgtcagtgttatcagtaataatatattttaaatttatgagattttagaggacttttccttattgcaggacagattaactttacattgattttctcgttacctgtgctaaaatacatctgaattttatttattttgccaagcactgtgtttttcaagaaagatatttgtatattcatattacatttttgtaattgaaaagctacaggatgtgaaggcaaatagttgaggaatttggggatagacattactaagaaaattaacaaatatggcatctagagcttagaagcagcttctgctagtagtgtactatatgggataaggaaaagataggattgatatagaaaaatcgtctaagatttatgtttagggatgtgatagaacaaagcatccttaagaattgttaaatagttaaaatatctttcaaataataaaaaatagaaatagggggtgcaattggttaaaaaaatgggaaagatggtttgttagttaagaaactatattctgcacttgtacataccagatcacttctggtatgtacaagaaaaaagaaataatgtttcaagtttgatgattatttttacctttaatataacatttgtttcagacagattatattcccctgatccaggaaatgatgaacacatatacctatcaggttagccctcagaatgtttagtggacataatatttcatatacccagattactcatattttaacatcactgaatggcctttagaaaaggatttgtaatgaattagaatgcataacgtgaattttagaacaacacacctgctgaacgtcggcctctcccactgctaagttgcacagtcaaaacaagccctttcacgttggagaatacatttttaaaaaataaagaaaggggaaaaataacaaaatgaatatttaataagttcacataaggatatacaggaaataatatgtctttgtttaatggacacttaggctcattttttatacttaaattatcagttttagataaagcagatcttaagattatcagttatgttataatagccgtgattattagacagtagtcataaaaatgagaaatttacaactcagccacttcaagagtgcttttcctggccaggcgtggtggctcatgcctgtaatcccagcactttgggaggcggaagtgggtggatcagaaggtcacgagatcaagaccatcctggccaacatggtgaaaccctgtctctactaaaaatacaaaaattagccgagcatggtggcacatgcctgtaatctcagctgcttgggaggcttaggcaggagaatcgcttgaacttgggaggcagaggttgcagtgagccaggatggcgccactgctccagcctggcaacagagtgagattccgtctcaaaaaaaaaaaagtgcttttcctacttaaattactcaagtatgtttcagataattcattactactatgcatgcattgtataactagtccatgctaagtataagatgcctgggaactatgtgtatagaagatctagagtacagggaaattccttttgcttagattggctaatccaaggccaattatttgataaggttattgtacctaagtcactaatacatacctgtctatctctattctttgttgctaaagttaaggctttgaggtagccattgtttcttctagtactcaactcacaaatagtgtgtattgctggtctgagacatgcagtaggagatcggatgcatgatacatgtggttctgttcttctcccaatatacccccagctctagaggaatggtgatatcacaacagcacgaagaacacctcccaatttcctggcagcaaagcctagatgagaagcaatgaatggaaaggaaaaaaaaaaaatgaacaaacaaaatcagaaagagtgaatgtcctaaaggagtggaagtctattcttcctttcatggcccttccttccaatatgttgttaattggtcaaagggtacaaagttcccgttaggttgaataagttctgggtatctattgtgcatcatgatgactgtagttaataatagtgtattgtatacttgaaatttgctaagagcagatttaagtgttcttaccacaatagacgtaagtgtgtgaggtgatggatatgttaattagcttgatgtgcgaaaaagtcacattgtacactgtaaataaaaaacattaagaaaacaacaccttagcattgtggggattcagaacatcatgccccagaatatggccccttgacaacagagaaaagtacagagcaagttactctgaccttctcctgcctttctcccctgaaacaagttcataaaggaattctctgacctaccttgcctaaaagtgagtataacaccttcattcctgagagatcctgccctgtacctgggatggaaggaatattatactgagacacaggaaataatttgaacaaacaggccttgctgaagtttcttactgtttattaccattagatcccaccccttattgtccaatcatgtttctctacaactatccagttatttcatcagacttagcataaatgtacagtttgggggtttttgggtctttatttttgaaggttcctgtgttatgtaaaactttttaaaaatgaatttgccatgcttttctcttattgatctgtcttttgttacaggactttcagccaggaccctggcaatgagtaaggaacatatatttttctcttctacagtattcatattcatattttgccaatattctcttaaccaaattagtgaattgcagggctgtctatttccatagtagctcagttgattgttcctagtaactctttatgaatattaccttgttcttcaatgctcctttccttttatcatcagtaagctataatatttactagctagtatcctcaatatgcatctcatctgtgaataatcgtagccatgtgaagcaagcctataaagggatgacaaatctgggatatccatgacactactcccctctcctgcttttaagagacactcatcatcaatcattgctttctttttcctactgaactatgcaggcatcacagttgttcttgaccttgtgttcagacagccaccactgatcaatcagtgttagcacaaaataaaacttgctggatatcatttttctctatggtcccattctcatcttaaaacaaaaccgaaacctgaccccatgttgcatgttagctatcactccttgttctctcctttccttagctaagctctttgagtgtctacactagctggcccacttccacacttcactttcactattcaacacattgtggtctagtgtgtgtctcctgctccactgaagctgtgctgagaagctcaggttgtatggagcttgtagccactgtgtttctgcctcaaattttttcttccctggggctccctcctacttcctcttctgtttctcttcttgcctgtcttctgacaactcatgaagtgcctacggcttagcaattgttttccctgggatgtcctttgtcaatcactattactctcaggggtttaattatcactctttttttttttttttttaagacagatttttgcttttgttgcccaggctgaagtgcaatagcacgatctcagctcactgcaacctccgcctcccgggttcaagcgattctcctgcctaagcctcccaagtagctaggattacaggtgcctgccactacgcctggctaatttttggtatttttagtagagacagggtttcaccatgttggccacgttcatctctaactcctgacctcaggtgatctgcccgcctcagcctcccaaagtgctgggtgggattacaggcgtgagccaccgcgcccagccaattatcactcatattttgaagactctcaagtctatatcccctgccttagccctttctctgatgtttatttagtcttgtatatcaaaatatctagtgaccatgtcttctcagtaatccacaggaaacgcgtatgtatcatttacacatcctgtagtctccttcctacagtgatatcatcgtcagccagtcatgcctagtttgctggacacaggcattatccatcgcttttgatacatctctttcacctcaactgaatcaactgtcaagttccaaattaaatagttctttatttttttcttcttctctatttcttgtcaccactaccctgactcaaggcttataatcttttaactaatctcctactttctcattctactggtcttatatccattctttgcacttcagttaaagagaactaaatatattttaaataaacatccaaccatgccattcacttaatcaaaatgtgtggaggcctccctaataactatgcaataaaggcaagtctccttagcataaaataaatagccttccatgatccaaaccttcttaactctatctttgggtctaacactataatgatactggaagatatgttgctctttgcataaaccgtggtgttcctgactttatatcttcacccttagtgttacttaggatgccatttcattttttctttgttggtcttttatacataatttagaatgttctgtatatacttcatccgctctataaaaccttcacagaggtttcatctagctttaaatcctattctctgaatgccagtaacaatgttatttttcatgcagtgggttgcatcatattcacatttaacttaagttgctaattttagaatctaactctgaatgaggagtgaaatgcaacttgatccattgtgttcaatgttcaagaacagaagcatgatggctattaagtagggccacttgaggtggggggaggggggagggatagcattaggagatatacctaatgctaaatgacgagttaatgggtgcagcacaccagcatggcacatgtatgcatatgtaacaaacctgcccatgtaccctaaaacttaaagtataataataataaaataaattttaaaaaaaaggaaatggactatgggatcacaaatctcttagtggcaatataacgaaatgtaatattttagcaaaataaatacacattgtttggtctttggacttgcatcattcttttaggtcattctaaaagtttgtttatatacatgtatacacgtgtatatatacgtgtatatacgtgtatacacgtatatatgtgtatatatacaagtatataagtgtatatacatatatacgcatatacgtgtatatacgtatatatacgtatatgtgtatatatatacatatatatgtatatatgtgtgtgtctatatatacacatatatgtatatatatgtgtatatatatatatatacacatatatgtatatatatgtgtatatatatatatatagttttcaagatgatgctcttcagacttgttcaaagcaaccagaaataagcaatttattcctgtttctctgagattgcttttagaaatgatatataagtactagaattttttttatagtttgatactgataattgtgggctgttcttttttagataatttgaacgtaagtgctaaaattgtgtttggttttggttactttatatgttttaacttttattaattgcttattatttctactattgtttaacaattaaacatgtctgggatgtctgtctattgtgacggaaagtgctttgcatcctgtttatttcttagtgaaattcttgaattttcttttacttgcttgtcatatgttcttttaaaagtcaataatcatattcatacacttacaatccttctggatttctggactcgtaggaaaaaaataaaataaatatttaccgttcattttatttaaaaaaaaaaaaagtagggccgcagtaattgacagcatttgaaaagataaggaagcacataccccagttcttctctatacttttcaaagttgtaaatttgataaagaaagatttagataaaatccagcaaacatttattggtacctactgtgtgccagcctttaagtttattacttttaagcctaacgaaaacaaaatcaaccttggtttagtttagagaagtgaggtttagtattaaaatagaattaacatgcagaccagcagggattctttaagacagggatccccaacccccaggtcacagactaggaccagtccattgcctgttaggaaccaggcaacagcagcaggaggtgagtggtaggagaccgagcgaagctttatctgtatttacagccgctccccattgctttcattaatgtcttagctctgcttcctgttagatcagtggcagcattagattctcataggactgagaactctactgtgaactgtgcatgtgagagatctaggttgcgtgctccttataagaatctaatgccaggccaggtgcagtggttcacacctgtaatcccagcactttgggatgctgaggcaggcatttaagaccagcctggccaacatggtgaaaccccatctctacaaaaacaaacaaacaaacaaacaaaacaaaaacataaaaacaaaaaaacaatctaatgcctaatgacctgtcactgtctcccatcacccccatatgggactgtctagtgcaggaaaacatggtcagggctcccactgattctacattatggtgagttataattttttcattatatattacaatgtaataacagtagaaataaaattcacaatacatgtaatgcacttgaatcatcccaaaaccatcctcacacccccactgatccatggaaatattgttttccacgaaacccatccctggtgccaaaaaggttggggaccactgctttaagatgttccattgcctccatattcacttaatagtcttgtaactgtgaacagaaaagttggctatcccgtcatttccacaaaactttgcttttgattcttcctttattcttactcagtggttcttactatgtagaatgcaaaatcatcaggacaatgatggtgtacaagatgttatatattggatttccatggatgatttaaagtatttacagtcttttctctatatgccaaatgtgcttacttagactctgttatcacttaagatgggatgccagttaagaagtaactccatgatagctatcaacactagctttacagatgacttcacaattacataggacactcctggaaagcatgaacatactcttatgtatttctgtatcctctaagcctaagttagtgtctggaatgaattaagtgcccaataaatcttcgttaaactgaactaaactggaattcaacactgctagtacccaagatggagaggatctactgttctcttttttgattgttaaccactcatttattcttgtgctggagagtctcacctcttaagaggaacccactaggttctcttgtgtgtgtggatacagagatttcagaggcctggcatgagaagcagcagctttttaaaagtcattttcaggaagaaagcaaaaataaatgaaaagttgaagttgatatgtatataggggtgatgttactgggtttttaaaaaaataacaaagactgatggggtatgaatataatgctaaatatttagtatgctaaatgacaaattttattattttgatgtgtttatacttcagtgtaacaagacgtggccagcagtaaccattccactctgatcttcactaatctgcctttaaatagagtgctggtgatttcccctttatcattttttattacgtctatttgattcttctttcttttcttctttattagtcttgctagcggtctatccattttgttgatcttttcaaaaaaccagctccaggattcattgagtttttgaagggtttttctgtgtctctatctccttcagttctgctctgatcttagtcatttcttgccttctgttagcttttgaatgtgtttgctcttgcttctctagttcttttaattgtgatgttagggtgtcaattttagatctttcctgctttctcttgtggacatttagtgctataaatttccctctacacactgctttaaatgtgtcccagagattctggtatgttgtgtctttgttctcactggtttcaaagaacatctttattcctgccttcattttgttatgtacccagtagtcattcaggagcaggttgttcagtttccatgtagttgagcgattttgagtgagtttgttaatcctgagttctagtttgattgcactgtggtctgagagacagcttttgataatttctgttcttttacatttgctgaggagtgctttatttccaactatgtggtcaattttggaataagtgctattcctcaaggatctagaactagaaataccatttgacccagcaatcccattaccgggtatatacccaaaggcttataaatcatgctgctataaagacacatgcacacatatgtttactgcagcactattcacaatagcaaagacttggaaccaactcaaatgtccatcaatgatagactggattaaaaaaatgtggcacatatacaccatggaatactatgcagccatgaaagggatgagttcatgtcctttgtagggacacagatgaagctggaaaccatcattctgagcaaagtatcacaaggacagaaaaccaaaccacatgttctcactcataggtgggaattgaacaatgagaacacttggatacaggatggggaacatcacacactggggtctgtcgtggggtggggggaggggggagggatagcattaggagatagacctaatgtaaatgacgagttaatgggtgcagcacaccaacatggcacatgtatacatatgtaacaaacctgcatgttgttcacatgtaccctagaacttaaagtatattaaaaaaaacagagtgctgaacccatctttttaaacatctttaaaaaaatagttatgttgcctgtggagttttagaacttaatgtaatgaaagtactatctttctatgaaccttacagtttgtttttgttgtcatttttaccattatttgataaaggtaagtagacaaatagataacacattcatattggactattcattaagaggtctaagaagaaaggtactcttaaattcacaagtggggactacaaagcaatatgaaaatgatcaggatttccgttttaatgaaataatggaatcacatttaaaacattattttatttttttccaattaaaaaaattaaaaatagaaaactcaaaagcaagatttttattttctgaaatatatatgtattgatctgttccttcattgtattgccatggttgcaaaccaatgaaggccatataggaatagtattaacaatatttcctctctggtaatgtttgtttgcctaatgttctgtttttatatgtaatattttatgcgggattttgttctttaaaaaaaaatcaataaagtgccattgattaacaacaaccagactacatgttttagtaaactgaaccactttggctattactggtaggatagacactttttaatataaaatgctgagccagaggaaagcaaatagatttctctttcttttagccaaaatgtagagaaaagagaggcaaatgattcacaatataaaaagtttaaaaaaatcacacaatgaattcgctacttacaaatgtacaggagtaacatattgtctggttctcagggacttgttaaagggtgaagattagtgttctgttatgtagagttaattgtgttgcattaatgccttaaaataacttggatgattatgtaaaaagcagtttttaaatgtcggttagaaaatatctcagtaaaagatcattttgccctcttcttactaattataacacttaaaagatattatttaaaataattaatggtatacaagtagggggaagaaagctaactattgtgttttaagtggctgtttatttagagcccttggacatcaattatatctcacagttataaatgtactttctaagtagcattcagaacaaaataatgtgagaatttttttgacaaaagttaaatcacatttgggatactgaaatgaaaattgatgaccagattgttgatggacgatttcattctcactaagcgagcatcctcccactaaacgaaagaaaggtctttgcattattaaaagcccattctgcaacactgttgggaatttggttgggtcatgaatgctggcaggttgtcagggaaacaggaataatgcactgaatgcatggtcttcttataaaatgggcttaatattgctacttttgattttctaattgctgatctagaatttctaatagtaacattaaaggagaggaacatattttctagtttaattacatatacctctctgttggcttagtagtaataaaaatattttctgtaggtgtagaatatccttacagtccaaaaggagagtacatgttcacaattaaagtttgaaatttgtgctttgataacagcatgttttattcattcatttttataataatattactgagcctgtatcatatagtgatgaacttttcagctgttttgagggtttgtgttagccacattcacatttgtataacctgtgtttcttttttatttttctttattttcattttagatttagggggtacatgcgcaggtttgttacaagggtgcaccatgtaatgctggggcttcgacttctattgaattcatcactgggtaaacatagtacccaataggtattaacagtttttcaactcttgcccttctccctccctccctcttatggagtcctccatgtctattgtttccatgtgcacccattgtttagcttccacttataagtgagaacatgtggtatttgattttctgcttcagtgataattcacttaggataatgacctctgggtccatccatgttgctacaaaagacatgatttcattatttttatggctttgtaatattctatggtgtatatgaatcacatttttaaaattcagtctaccattaatgggcacataggttgattccatgtctttgctgttgtgaatagccctgcaatacactcacaaatgcagatgtctttttgatagaattacttcttttcctttgagtagatacccagtagtgagattgctaggtctaatggtagttctgtttttagttctttgagaagtatccatagtggtttccaaaggagttgaactaatttacattccctccaacagtgtaaaagtgccccatttttttcacatcctcaccaacacctgttatgttttgactttttaataatagacattctgactgctgtgagactttatctcattgtggttttaatttatatttctctgaagattagtgatgttgagcattttttcatgatttttggccacttgtctgtcttttgatagtttgttacccttttttctaaccacttgtttagaaggaggcttgggagagtccatttccaacttactttctctgagacaaactgactttcggatagcatgactggacctcatatagtaactacaagtacaagaaaaaatgtctaatatgcttcgattgcaaatatgtataattattttagtatacagaaatgcaagaaaatacagaaattgagcatccccttcaagagatgctaaggaatcctaaaatgggagaaggctataaaatgcttgttcataaattagtatttgagttttccaacataaaaccaataatctggccataaatagttgaatgcttaaattgtgctctaacatcattgcccataagctaataaaccttaactgtaaattagagcacattttatggatatgacaaatttatccagaagaatacctttttcctcagcctgcttaagcaagccttcaatgtctctttaattaaacttctaaaataaaagtattatcctcatctgatcctggaattcaggaccctgcattagtttcccccgaaatcattcccagctaatctcctgtagtttccaactgcttgctttcttcagataaacttatttcccagccactccacttgcttgctatgagtttctgtgcaagttctattatgtccctttattttatctatgacttggtctaaataaaagtgatgggcacacaaaagtgcttagtaacttctagccattgtttttatcatcattcccaactatgtgattaattcactctacttctgctcaaaatgtctcacatccctcttgccaccgttcaaaccctgccgtgtttcaaagtaatattaaaacatttttcttttacattgtttgtgtgcaagaaattaaagacactgtcactgtaccttagtactgcttatgagttgggaataaatgtgtggagttccccggtgatggcagaaagggcaggtcaagtgtcccaagaacctcaccaggcaggagtatttgataataatattcaagggaaaatgacaactgttttgaaaagcatgccattgtgataacataaactcagtttagaatcatttggtattaaaagaataagtaatggatattgtttcttccttaagattcacaccatgtgggtactgtataattaggaattctctgttatgcctcaacccacatgttatatccatattaccattgatttcatagccgcaaaacccacattgtgtctggcaggcaggacttttctccacgccagattttcaggtaaaaaatcttagagtatggttgtcgaggacatgaacttgccttttacctaatttactgtttacaaacttgtgtggcatttgagttatgtattttggtttgaaacacaaatattttcctttgttagattcagctaacagtatttttaacttgttttcatcccctaaccaccttgctgaaatttcagggagactgggttcttctggttgccatttccattgtaatttccttatggtctagtcaaaatatttttatactgtgtttatttaaaagtgaaaaagttcctttccatccagcctaaggggatagtatctttagaaccaagaatctttcatctcctctttcactctaaatataacggatacttatcttttattgagggaactaaacaaagagttcatcagctaatctctctcgtgtgtctattttaagttcctttacaaacaaaatattttacagtcccaacagccataaaagaaattcctgaccttgcccatttttgagagactgggaagtcaaactataccctataggaatcagtcctcaaaatcatttcttttctacttcagaagtgtgtatgtgtttttttaaaaactgctaatgaaagcattacaaagattagcttttgaagtggcaagcagctttcatttattttccttctggtattccctcagcctccagctaaaatttagaaccttaaaaatgttgctctttggtactaaattcagttgatattctatcaaagtgtatttggtttatcaaagcttcgttcttatcttgcaactcagtattcccgagagaacactagtcaggttagaactgacaagcctgtgtctagtcctttcaaactagaatgcactccctcacctactgcaggtctgcttacctgtgctggttaattctttctcccattgtcaggcagagaggcgagtgctcacaatgtggtaaaagaggaagtgatcacttccaagaaggaaaaccgatcagagagtcacacagaaattaatggcaggaagaaatacaacatgaaataagtagattcataaaatttagaagatttggaaatgttttttgccatactgtgttactacctaaagaaggaagctgtatctttggttcttttaatgacatctgacatggaaagacttggacactaattagataccagtgataattttatatcaataatctttctcttcttgaatgtcataaattagcaccagtgaaacttattttcatatttcccatatgtcatttttttctgtcagagtcttcagttattggttcctgaaaaacatgtgctatttgtagatttttaataagttgtctcattttaaaaaaattctaacaaattaaattcggtcatggaatcaaattggattaagtcagtattgtcttcccaatacatcaaagagcctcttgagacagatttggaaatgacataatctttcttggaggctttgttgacccttgggtgccatgttataataacatttgtccgaagactacagttacggaattccaaaggccagtcgctaatatttatctgaaggctacaatagctatggatccttgaaattctataattttctgagattatgatagaacaggtaaattccatagaatgatgggagcaacagtcaacttcaaagggttgaaagcggaaaggtagtataagaaatggaagtaccaggtgaaagcctatgttcaacaagtttgacgctgaaggaaaggcccatgattgggcaaaatttagaagttagcgacagcaagattgaatggataaacattaaagtagagctgctttgttaaagtaagggtcatatgaattccgtaagttgtctggtgagggctgagccttgggctagtgtatcccctgaagggacacaggcttgctggaatcgaggatagtaaaaatgagagatcccttctcagtataatattcaaatcaactaacatgaccacaaaattcacactaatttagaggaggctaaaatatggtgcgtgatttagtgatatggtctgcaattcaactgatgtgaaaagtttttttttttttgagtctcactctgtcacccaggctggatgctcactgcaacctctgcctccagggttcaagtgattctcctgcctcagcctcctgcgtatctgggattacagacacccaccaccaggcccggataatttctgtatttttagtagagacagggtttcaccatgttggtcaggctggtcttgaactcctgaccttgtcatccacctgcctcagcctcccaaagtgctgggattacaggcgtgagccactatgtccggcctatgtgaaaagttttattttcacttgattgttgattattgtgggctccagcatccacctggaactggacatttaaactgcatattattagaaaaaaatatgagacctaggaaagactgtatctaagttttggcacatataattacacaatcacctactccgaatttagcttatagtttctatatcataactggctcaaacaagaatagattcaaaaccaatttttgtaatatataactttaatgaaatatacccaagaagtttcattttaatatgtgtttacatcagaacttggcacctttgttagtactgtttccactgttatcaaaagcaatttcacagaacagttcaatattttataaattgctgtaccagaacgagggtgtttaaccagcagtgtcttctctccctcaggaatctctgataactctgacaattttaaatcaaagttctctttcagacaagttttcatggtcatgtttaattatcaggagccttttaattctcatatgtatgatgtttttctcatataaaaaggacattcttacataggatctttttaacatctgttttaaaaaaagttttatagtatttacctaattggcacatgcttattttacaaatacacacaaggttgctaaatattaatgttaccaataaaatttttaaaaataagaagaagaaataccaactctgagaaataacattatatataggtcaatacatattgaaggccaggatcacagttttattatatgagttaatatatgatagggcatgtagccctcagcaatcctcttttcaaatatcatggcttatttcaagtgtttttagaattacaaaataaacaatttctgtttgattactgcaaatgcgttatatatatttatatatatgtctatgtatttatgttgtatatatttataactttgaattttgtaattcagttattattttacatcttcatgtagactacagaaatttcttaattctacattattttgttttgagttgctatcattaattgacatgtattgtttttgcttatattcaatcgtttacttatttattcagtgaatatctattgactgcctttcaaaaattgggcatttaattttaacaataggcaattcatgtcttgtttagggaaatgaatgatttttatatattaattataaaatttgccctttgctggtattatgttagtctaaaaatatatttttattgtttatcttaggctttatttttacctaaacttcctacaaaaagataatttcatctttttcttttaattatctttacttagatttctctctattgactggttgcggtgactattggttccaaaataactgtaataattaatagtggacatctttactttaacaagaatgcttcttattcacaaagcatgcttctagcttttgttttaacatacacctacatgcacctccattcccaccctcaccaccctcaacacttaacacagaacaagtgtgtgctgataatctggattcagtaatcaatggctgttatttattacaagtggtttgtttctttttcttatccagacctagctagagttgacctattaaaacatgtcatttatttacagatttcctgaaggggagtgagccttaaattttcaaaatgagcttcacttagacatattttattattttcatacgttgtgcaattgtatttgctaatattttatttaggaattttataaatatttatgtaagattttgttatagttttcttaattctttattcccaggttttatcttgtgtctttcttctgttttcctgaggtttcattttgcagttctttttaaaattcccaagttgaatacattatatagttattttcattcttatttgtgtattaagtatgtctgaagctataaattttcttctgaatactgctttagtcatagcttataggtttttagattgtagtattctatttcctctttgtcataattacctcagatatgactattttgaagacattttaatttttgttgtttttattagttcctggtttgttattatttattattattagcaaccatttactaagtatttatcaaccatcaagttatgtgctaagcctttgcttgatgatattatggaatgaacaccagataactatgatataggtgttttcaggtaagaactctgggacttcctatatatgcatgtggctcttcttgcattcaaattcttaaagctgtgttaccacgaacaagttacttaacatctttgatctcagtcttcccatatataaaaagggaatgaaagtggtacttatttcagtgacatgaaaagtagtaagtcattaccacaggaagtattagtcataatgataatagttaaacctctgtcctagttcatagagttcaatgagtggcagaggtgaacagagcctcattccggttttcagggtcttacactctatgttgtacaactattgaaggactcattcccagtttgctatttttgtacatttttatttatttgtatagttcagaaattgggagagtaatttgtaattgtgctttaataagaccacattttaggaagtcatgtgaaaatacttatgattgagccataattgttatgagagcatcctctactttatggttattgcaatatctattgagctttctttagcctttggttcataaggggaagcatcactcctgtaaacattatcaactgaatggagcatgcttttaatgatcattatccgcacatcatctcatacaattgtgaggacattgctgccttataactgtagtaacagaagcagtaaaggagacttctgccttttaaaactgtgttggagaggcagaaattctgaaaacgtaaggccaaattgagtttgttcaaactaaatgcaaatacttacatttagttaatttaatgctattgatatttttatttgttattattcagttttttagcactgatttcctgctttgcattacaaacattattttaaatatattagtctcatgctagctaaaataaagtcagattttattacaatcagaggtcgaaaatccctgtatttgtggcttgagtttgtttattttactactgttttgctgtagttacactgaataacataaaataacatttttgttgctattaataaagtagaaatgttggcttttagatatgtggatagagcaaataaaaagggaaaaaaacagtttatgaatttgttcactttcataatattgtaaattggaatgaatacaaaatcactgaattgtaatgctgttaaaaattatttgatgaaactaagttcaattttaacctaatcaatagctactcattgataagattttcctgatgaaatttgttttctgaaaattggttctgaaatcttagttgcttaaatcatttgcaagaagaaacaaggtgtccatgcctttccttagggggacaaactgatatagtgtttcttgctacttctaaactctaaatataatggaataaatgaaattatttctttgttttcaccatctgaatgtctgagaatcccacaatgacattgaagagaatgattttgattacctcggacttaccacggaaagaaaagtctgacttcaaattgtgtcttaataatagtggaccaatgtttttgttaaatgaaactccacctgcccctcaaactattcttgtgcttcggcttatgtgcttgatagcacagtcacttctcacctaattgttgccatagtgtttgaagccagaacataaagaagcatcatgttcagaaaaacttaaaagtatggcccttgtcagtggtacttatacccctccagactgacaaatggttcctgaagctctagagcacatggcaacataaccatattaatgggtggtccagccagtagctgccaagggcttccaaatattattgcattatttagaagatcatttccttattctactccttacagaatttggcaaatataaattggcttcaatattcactttactcgtgggggaaaaaacccacaaactgcaagagtatatttactacctgcccatgcctgcaaattttgtggtgcaaatacagaccttaaacttattctaagacctgaaatcatgtatgaagctgaaactggcagttttgcccacagaaatcttgacaccaaatgaatgcatggtatagagctagttaacaggaataaatagtatgctcaatttcctatatttctaaaattttaagaaacttggagaatcagaataaagtttaaaagtgaaccgaaacacctagagtgtcccagtgaaagctagaaaatgatttttgtatttacgttcatgtaaattaggtttttcctttgtaacaggaatttttcatattaggatgaatgttaggacaaatggaaaaagcctgtgaatgaagttaatttcaaataaaataacttgcattgacatatttaatatgtgtaataatttgcttattttgatggagaactaaacaatattttaatagaaaatatctgtttttctcttattcctaataaatgttaggcagatttctcaggctgggggcaggttcacacatgtaatcccagcaatttgggaggccgaggtgggcggatcatttgaggtcaggagtttgagaccagcatggccaacatggcaaaaccttgtctctactaaaaatacaaaattagctaggcatggtggcgggtgcctttaatcctagactactcaggagtctaggaggcagaggttgcagtgagctgagatcgcaccattgcactccagactgtatgacagagtgaaactctgtctcaagaaaacataataataaaaataaataaatattagacaaatttcttaaggatatttatttacaggagtgctaaaacgttctcagattgtccaccatctaagtcctaccctatatgacagtggctaatctaaaagttttaccttttatagatatcaaagctgccttaaaaaggtaaaacaaatcaaactttgcatataaactcacaataaacaaggtgtcctatagcattttggcagacaatattcattttgagaatatttaaaataatacttcttaaaacagaacttgccaaaacacctgtcagaccaaacaaccagatggtagctaagatcatatgtttttagaatcatggcttttaaagattatggagtttgaagaggattttagcagattgtcttacattcctagaatgctcaactctcaaatctattttgaacatatctcatgtacagcacactgtggcaggcactgaggactaagaaggaatgaagtgttcttcacttgaatacactatgcatttgggatgttgcacaacaatggatcatacacattattaaacactgacttccctggtgaacggaaagtaagacaaaccatagtgtattgcaaaaggtaggaactatgtattagttatctgttcattatcatgtagacaagtattccagacctaaaacattgacttaggcgagtgagcagggtatgatggaaagagacagattggcagtcaagagaagctgctttagatcctttttcagctactgtaaactttagaaaattacttaatagtattttacattgcaaaggaagaggctaataatctctaggacttctccactcaccattattatgtagtaggattttataagatggtccaagtattttttaatggttaccattaataataaaattagttttaggaccaaaacaaaggtaattttccaccctaggcaaagttctaagccttctgcaaagacgggagtaaaatcctccatatataaaaactgtggaatgttttccacagactttgggttggtgttattctgaactagactctcatcgctctcccatctcagaaaatgtccagtttacttcaggatgatcagggactaccctatgaagtagttctcccctcagtaactactactactgagatatggacatttctttgcatatagaactgtggagggaccagtcccaaagactggaagtttcttctgaggactatagccattcatctcatggttgtgtctgatgcatagactgttgtgattcaatgtacactgttgagccccaggcccctgtagagccctttcagtgctctttcagcattccctctgtgttaaacaaggccattcgcctagacagagtttaaatggtatttttgaccttctgctttgcaggtcaattgctttggcagactactaacctttcttctgagtgcagatcagttatcagtgttttctgcaacatcctcaaattatcattgaaagatgttgagcttggaattttcttacttgcaatagagaaataaaatcagaaaacttctttttaatagtagagttaaagtttaggagacatagtcactataaggaaaataagtaagtcttttactttttagcacagtttgactcccacaggcacccaaaactgcgttttctgatattttggaagagtagaagctttgcctttgtgcttggaattattcagctgagataattttgtgagctcatttgaaacctatctcttccttaacaaagttctctttttcatggcattattcacctttatatagagttatttctttatacgtcaaaactatctggctaaaatatatatcaatatattctaatatatatatagaatgcatcaaaaccatgcatatatatatgaaactactggtctgcaagatttatatattctaatgtatgatgttgatgcatttttttcttcactgatctgttataatctcttttatgtcattggagctgaataaatactggttgaatggattagggaatgaatgaaagaatgcatgtcctcttgccatggaaaaatggaaaggtgttatgaaaattatatagtgcgatagaaagagataagaactggtctgttttacacttccaattaatattaaacacattcttagaggaaatattcacaaatgtggttgtaaatgcagtttgtcttctcttgtttagaaaacaatttgtgtctgcccttgtatgaaagatcagtgaaatcctcaaaattaagcacttaatgctcatcaaatagcaaacaaggtctgtagcctagtaacctttgtctgcattgaaagattagaaatgaaactaaatggtgattcatggagacggtgattatgtgtttcagtttattctaatgtataaatgacacttaaaccatgttctataatttgaaattgatacattatggctttaaaaggttactaacagtaatccgtatcaatctctggccctttcagtaaatatccaatgtttaacttaatagcttaataatcttttcatacattactagaggggcatgtttgagtttaaattgaaataattatgaaattcacaaacttgatttaagaattgggtctgtctagaaattaaaacttgtaagtcttttgtgagcctctggcttagccacgaagtacagaataaattaactaattagcaggcattctaataataactcccaagttcaaaagagggaagagaacaatgtattacacattatctttttttttccataggttttcaggaatttgaattcaatagtagctttaatgaaattggccattgtgggtttatatctgttggagtgaagttattatcttaaaaactactcagtctttttacatatatatgcagtatgctactatataaataatacctttctttttgaagtgatttaaaagaaaaatgatcctacctagtttaagtcaatccattttctgagtccttgggggaaatgatacaatttcacataccgtattcctggaacactagtgttccactaaaaaaggattccataattaaacaaattctgtaaatactaaataccattaccaattggagaatcacagtgcacattagttcctttaacattcaccgataaataaacttatttaactttgcttaacccagagtttcccaaactcttttgaaccacttgacccttcttgattctgtataagcctttttaacatttcttagtatagcaggtttcagtggaacagaatttgaattaagcaataaagagttgatcttacacacttgtttttgtatattgtttgttatagtttggtctgcaagtgtgacacaatgagagaagattctgctacctgagtatgagaatgcagacattgagttctagggtcttctccatctgatgagtgggctctacatctgatctctgacatgcttgctgaaaagctgccaaggagtacagtaggagttctatggtgtacatcatgatgaacaccatagaactggagaatgaaaatcacaaagaaatataacttttctaatctatgccagaatgcaatttctaaatccaggaaagtatattggaatgagaaaatggtctacaatttgactgaggacttgagtttttggtttttggtaagaggatatcttaagctatcaaaaatgccttcgctgttttgtagaaagctcattcagcatgtcagaccagagttcatgtgcccaatcttaggtttggggcaaaaggtcactatctgtactgcttccatttccttatgatatacttttttgttaaccctttacaatccaattactttactgtcctggaagactctcacataagtataatttgtgaggtggaaggtctttgggtttgccatatgacacagtttcaatgaactttgactgcattgtccaatctggagcctctcagatcttggccctttcctaaaaacaggttgtatttgccacaaataactatttaggtaatctgcaaatctcatgtattagtcttttgttgaaagtcagtacaagttgtatggttttcgtatgtctataaaatgcaaggacagtaaaatatagagtagaataaagtgagggaaatttactttctctctctctctctatatatatatagttaaatagcaaactgcatgatcttaatgaggtaagaatgttgtcatggaccctacactaacacacaaaggaaagcaacataggagatagatagggcttcctccccggctattaggctgtgccttttcagagcctgtgctgtaaattcaggcaatgcatttgtcatccacctccaaagactcagtgagtagtatcagctctggcacccaggatattttggatagtgacagataccttctttaagcagagggcaggagcagtgtgtgcaataccaggctaattcttggcactggatttaacagtgatgaagagagagtgaagacctttcatcaatccatctcttggcatccagcaatattcattttattgctgtataaataatcaaagcagtggcttgcctaggaaggtgtgttatttctcattttggcacacctgaaaaaatctcacccagctctcagggtcccaggcctatgaatcaaatactaactaggtccagctggactgaacattgtgcttcatatgtatttgaacactctcagatgtgaacatggatatcagttatcaattatattattttagtctttggcatgttttatatttctgtgggattaaacatcagactttccaacatgcttgccttgatggcttctggtgcctcttctgctcctcccatcctgctgagcccttgcacactgcccctcattggatgctttcctctggttgctcctgaagagggatatatcccaagatatgcaaataatattaagctacactctaaatgcaaggatcaagctattttggggcttttacaaagaattatacagaaaaggagaagagatctggatcagagttacagcactgaagtaatcattatatgggtggatagaagaacctattaatattagggtggctgagatggtttcatgaatataataaataagaagaaaggcaaggagagccctggagatcacatgctttgtgtgtgcacaattaagcaggattttatatcgctgatattaaaagaataagaaagatttaactatttcaggaagaattttctttaatgactactgttgaaatagtatcagtaaacattccttcctgactgatcaatcttttcttccaatagaggagaatatgccagcatctacacaagactgacagttactttgaaaatgtgcaagagactaaaatgccttccaggatttaaattcttggggatatttctgtgatgtttatcaattgattgaaagcaattttcattttgaaataaataattattggaaatttcacctgtcaacagaaaagtaaacaaagtaaaaaaagcaatattttcgggagatgcacagaaaaattgcttactgctgtcacagtaattttcttaagtgcatggctcagtcgtattaggtctttttgggtctctattgatcattaaaggctggaacatttaataaattaaacatggcttatgatatgagtttatcaaatgttcttaaagagagtacgtagaatcagtttgaaaacatactttctgtagtgcttattgtttagactctagatgtattatttataagatcacataagttttaaagctcagtttattatagtcaacattgatttctatgttgtcatatccttggcaatttttgcatcaattctctgtatttattttctcaaatgtggaaattccaatatttaaaattacaaggaaggaattttacacgtaggtttttttgagtcatatgttttttcacacatggcttagccttgtttctagcatatactaagtgataaaaataaatactaaatgattatgaaaagtaggactttatgcattctggactgaaaacaatgtatggaaacattcccaaatatatactctaagatgcaatgaagggtcctaaaagcttctgtgaccctgcctgtgtatatcatccagatctcttccagatgtttagagctcccccgggtttatgaagagaacctgaaggcaaagtcaacaaatgtagctactttgtctgtccatcaaagtacccatttatcactcggtccacgatgaattacagcagtcccctgttatgtgcagttttactttctgtgatttcagttacctgtagtcaaccacagtctgtaaatagtaaatggaacgttttaaaaataaacacttgatatgttttaaattgtgcctcattctaagtagcatgataaaatctcacaccattccactccatcccacctggaacatgaatcctccctttgtccagcatgtctacactgaagactcactacctgcccattagccacatagtcgctgctcaaggatcaactgtcatggcattggagtgcaggtgcaagtactcttgcacccaaataaaggtccatttgacttataatggccccagagtgcaagagtagtgataccagcagtttggacgtgccaaagacaagtcagaaagtgtttcctttaagtaaaaaggtcaaagttcttgacttaataagttaaaaaaaacatatgccgagttttctaagatctatggtaagaacaaacctatccatgaaattgtgaatagggataaagaaatttgcgtgtagtatatatggggtttgtattatttgagatttaaggcatccactgtgggtcttaaaacacatccctcttgcatatgggggagctactatcaatatagtggcaaataatgagccaattgggaactgaatagtgaaatgtttaccttgaccccatgaagtttatagttttatagggcactcacatgcattgaggcagtcattattaggatagtgagtctttggtagtattttactaatgaagtatacaataagggcatttcacttagtctgactggtcaaagcgttggaggtggtatctacagaagaagtaaaatatataatcttgccttcagtgagatgaaagagtagaacctgtgtcacatccttcagttgtataatacacaggttcattacctgcattgctcctcccaagtcttaatatattcactacattactgagaaagctgggtcagaagctcccttcagcctggcttggggctcagtggttttccttgtataactctattgtacaaaaagattggcaaatgaagttcatttggtgttatatatcccgacttaccccaatccatgtggtaactaagctacagtacggtcagtttgtgcacttgcccgcagcacaaaaaagaaaagctaaatttatttatttattgtgatcacctttattccttagtttaggtagggactgtttgtttacttcaatccaacaatgtaattcagttgaaagcattttatttttttctattttccaaaaacttgagtttttcaaatgacacaaactctaaaaattagaaccaggactgagtagaatcaatcgtacctattgaatcaatgagtgatttgggaatttggcagatgattaagatcttcaaatgcttattctttattccttttgtttttcaaagggaaagaaaaatacatgtgattcaaaactagcttgaatatcaaggatacacctttgaagtaatcttttaacaggttcaatttatagcatataacagttgtgaatagaaatccattttattttataaactatttaaattattttaagtgaattcctgtggctaaagccttgtgttttgtacttgcatttgaacagacaatattttaatgatagtcatggtgaactttatagacattttttgtgttcttaaacttccccttagagcctctctgcatgcattaggattaattagataatgtctcccaggtgcttagagctttttggagaaagggaacgaagcattgtgttaaaatgattattactgacttcaaagacagttacatgagagttcagaaagaacaattttttaataatagtgactcataaatgccattgagatatagcattttatgatgttaccagtggccatttatttttgtttttttaaattatactttaagttttagggtacatgtacacaacgtgcaggtttgttacatatgtataaatgtgccatgttggtgtgctgcacccattaactcgtcatttacattaggtatatctcctaatgctatccctccccgctcccccgaccccacaacaggccccggggtgtgatgttccccttccttttaacaagccaattaccttctttcttattccattaaattatcatagggaaggatgtagagtttgcagtgccaagttacaagatgagatgcaatgaatggagtcaaaataatttcattgaattggtgaagttcatcaaaggggcatagaatgatgttatccttggtctctctagaagcattgggttagtggtacccaataaaaggccaaaagcagataaaagtttatctaagaattttgcttcttatcggtttcaagaatagagggtagatggaagtggtgccactaaaggaggaaactcaaagtagtcaaaagtgccatgtgacaattaatcactagtacctcctacagactgcctgggaggggccaagaagcagactcctggactaggtggtaggttatagtccatttctctatagggtttattgaaaatgcagcaatatcaacaatacttttaataatggttattttggtataacactttaaattttacagaattttcacacacgtattatttgaccctcagaacaacactgtgaagtaggtgttactctgaccatgttatagatgaagaatctgaggctcaaataatttactgatgttttcagagatacgaaatttataaaagacgtaggaaggattggaaccaagcttttcttataccagtgagtgctcatttgtatacacaactatgggatggtagctcccccttgggtaagctagaacaagtagtaatgtgggtgtgtggaactctgtagttgatcttacgacatgttttatgtttattatccatttattttcactaacctcttcctgatgatattaaccaaacctcgaatttacaagaaagtcttcttttccaagtgtgtttcaactgcctttcattgtacctactcaatactactctgttgttgtataaaggaccacctgatagaaaagctacagaaatgaataaaatgaaaaaatgagtaaaacacttttgtccaaaagtacaacaatataagcttcacaacaaaagctataccaaaagaataaggtgtttgtatgaggaactatgggggatggcagaatatggcaaataccctcagttatcttaccaaaacaagtacttaaaggtattcaaagagtggtagaggtcattttcagttagcatctggatgaagaaagtcaggggacaaaaagtcttgtattagagggcatatgtgagacagatgtttatctgcagggtttaactcttttggttaatctctactccagtggtctgaatgtaggaaatagaaaaggataagcaagtgaagactcagaaattccaatggaggccaactgaaaagagagggagagtacgggatggagagaaggtgagggggcataaaatggaatgggtagagatgtggatgagggaggaagaagttaaatggctaaggtgtggtaagaagcaattataattaacttttaaattttattttattattatattttaacttatattttaatttcaggggtcaatgtgcaggattgttacataggcaaacttgcatcatgggagtttgttgcacagattatttcatcacccaggtattcagcctaatacccgttagttatttttcctgatcctctcttaaaatttaacatctggggtgggggcctacaatgtgtgcgacaatacaataagcaagtgaaaatgccaaactagaggagaaagctcacagctccagaggtgaggtggaaaacggttgaaaggaaaaaattgaatacattgttaatcacacatctcttctttgtctgtgacatcagcatttgctaagcattaaacaccacctgtcttaaacctcggcaacaggctgtttgctatacctccataggcataggtagaatcactacattattaagttcccaaagtccttgtcaaagacaatttatgattctggcagcccccaaggagaggcagttttcttatcttgtttaagcagtgctctctgcttaatcctttctgtgtttctaatgcacaagaagagctagtttcctaaggagtggatttggtccactcaatttttagataatttttccttctggaaacagtctcctttctgtggtaatgtttgaaatgggtgcaggaatgagaattttagattgtttctaaaaggcttgaggaggaaaaacatatatatccaagaatcattaagttttgaatctggattagtctgacagttacaaggttctaggactggtgagttcattgtgttacaattgttacccatacaaatttcaaggtccctgagactggtgagaacaacagtaagactgatgattaaaaatttaaaactattggaagatggtacagtctatgagtataaggaagggaagaaagtagttaataaattgattgcatgaatagaaacaatgaatatttctatctggtaaagcattttatatgtattatctatgtcatcttcacaacagtacttcaaagaaaagtcatagtgagagtcattggaatttggataaaatcaaattaggtgtaggtggggagataagtttcagtcccaggtcttctgatgcaaaggcttgtttttctttcattttacattacctctttagtaagttaccaagagaacaaaggtgggagatcaagtaatgagtttctgctgtgtcattgcactggcacactgatagagaaagcctgacagtgtaaaataggacagagtaggtgaaataagtggttggaaatggtaggatatatgcctaaggctataacagcagacatcaggacagcattgagaattggaccaagggcctaagcaaacacatttcattttacaagttttactcaggcagtacctattaaatattggtgagtgtattgcaagagtattcctggaatcttcttggactaataatattaaacatgtcaataatgttattcgaacaaatgatcaagctagggaaatagcacttccatggtattggccagcttcctctcttccccctcactctagccatagagtcagaatgggagatttatctcttagcatgactctgatttcctgatcagagatcagcaaaggaaggagtgggccccttagccattgtgggcaactcctagaaaaacacacacatacacccctaggcattcctttcaggttgccggagacaggatggaagatgtggggaaggagtccttgctacattcaggtccctagtttgagggatttggctttgttactgcccttcctctggcttggttagattaatcaacacttcccaaaggttctatcacttatgattaaaagtaccctgacttatataatgaccaaagaatttctggatggaatatttcaatataattcaaaggtaaatgatctttgttaatttcctattggatatgtgtttcagccagaatgaataatttacatatttgattaaattcaggtaaaatgtatttcaaatactatatcacctagattgtcttatatattgctcatattttaaatatctgcctcctgaacagaattttggggttttcatcatagggaagttagataaacaacttatattctaaattccacagattttggtaatcctttccccgtaaaataaataccactgcatttagttgctttcttatgaaattacaaaaggcagcataaaacgaatgcataattttaaatataatagctctatgagagtattgaataagtaatattttcttttcagatactagtaccctgggatcttttaaataagaaaaacaataatacttttatcatagactgaaaaactgttactcttaaagattgaaattaaaaatggtaaggtgatttgagagttagatggaagctatttagttccttgttttttctaattacacactgcttttttaaactcagcaagacagtttacctttagatgaactccattcttttgtcctcagagactagacatttatgaaaactaggaacaagggtccccttagttaagtcatggcagctctgggtggaattcctgattattgggtaattgtgcaactctagaataacacagaacagttcatcactgtgaccttcaagcccaggagaaaattatagcacaatgtggaacattttctcccatttagattgactttaaaaaatcactctcctagttgccagttgcagaaattaacaaaaatgtgcattatttgtatgtattttaggaaataaatgccagaaaatgggatattcaaaaaggtaaggcaataggaataggttcaagcaccttaaactacatgaccagatgtggtgagatttaactaaaatggttgaatttgtctttcatttggtattaatttgttttctagccaataccttttctcctatctccagagagcagaataactgtctaagtatagcatttgctatgttctgattttgcatgcctgctctcttaattccaggtgagctgatcgattgcccacatttctgcaagtaccaggacaaatcctatgcctaaacacaatcttgcagtagatttggctgagcaatgcagggtaataaaagtaatgaggccattgaaatccctttagctttgtgctgatgcctggaaactgtcatttattttgtagtgcctttaattgagagaggttttttttttttaattccacacagtaattggtactacatttttttctcatataaaaaataataaagctatatatcttgcttcctgactcttatcaagcattggtagtttttgatgtacaaaatattttatttttatttattttggtattcttgtcacaaaaaaaacttaaagatattctttgatatagccaaaaagaaaaaaaaagataaaggccagttcttgtgacatttatatgcatgaaaaattgcaaacctacctccttcaactcagaaatattccactctttgcagtgcataacacagactctctaaatataggtgaataataaatgtgcatcattaataattaataggattgtaacaaaatacagtatcagcataatcttctaagacattaatggctacacgttgccactttaaataatagcatgaaaggcaatggtgctctctgatatggatttgctatggtaaatgagtttgtgttactgtatatattttgttctacatactgagttatcaataatcatcttcatgcctctcaaacggtcgcacaagcaggaaaggaataattgctactcttcatggagccagcttattgatgaggtggacacaagtaatatttttagcctgctggctgtccatctgtaaggagtttcctggagctgtcacttctcctttctctggaaactgttatggctttgtctgcccaagggaaataatgagatccatctatcaagaaaaaaataaacaataaactctataccttccaattaatttgttttcacctatgtttacccaggtgcattcagttaaccatccatcatgttctatgcatgtaaagaagtgcatttttcaaaaggttgaatccattaacccatttgctaagtaaatatataggcaccctttatagctaaatcagggacttgtaaaaatcaatctttttggagagctcataaactctagctctgtcttccctagcatgcccagtgttgataaatctgcaagcttaatgtgaaccaaacaggttgttctcattcatccctccaactacatgtatgtttctttttaaatttgtctttgattttaatgccaccctaacattttcagaaattggttgaatgcacaacttaaatccgcagcttcaatttgattaagaatttgttaacaacaatttagtgggaaatggtagtgtatatcagcaatcaaatggcatctttttctccttctccattaaaaagtatatatttttcgaaatagaagacactaaaaaaatgactcaggcagtaatttgttcataggattttgctgacatttataaactatttgagctttactgctgccttgttgctggcaagaagcgtcagcagtggaagtgttcctggagttaaatgccctcctctttttttttttttaatccatctgtactatcaaaatagacagccactgttaaataaacacttgtcaaatgctttaaaaccatgaagaattgtggcagagtatgctcaaagtccccaatttaaaaacaaccagtgttccaggacttcatttgtaaagagagttgtttgaaatatagaacctaaaatcctcaaaatggtggtaaaatgcccagtttaatgcactaggagtatagagtatcagagatttaagattatggagtgacttacccagttcttgcttaactcaaccatttgttacagatataaggaaaaagaaaattaggtatttgctcacaagacaactgcaaagaaaacagcagttgtaatcgtgattgtttaaacaggaacacaatgagattagataatagttatatttctacctagaaagctagtacttagagagaaaacaggtttccttagagaaatatgaaggaaataattgtgtttaggaactctgaagaaaacttctagaaatgtttagtgactgtagaaattgaaagcattgtttattatgtgacatttaagttttgttttttttttttttttcggttttaggcatataactcagttataatttctatagagaatgagaaaaagcttatagaaaaagcaagagggagtcatgaggaaagaaagaaaggctaaaaatatacaataattagaaaaattatatgaagaaagaatgcccatcagaagcgtgagagtgaaagtatattgtgagattatttagcaatgagtctagcaaatttagccatctattagttcagagacattggacaagttcctgacactcttaagcttcttagagttccgtatgcctctgtttcttcattgcaaaacacatccaatattagtaggcacctcataggcttgttgtaaggatttctgggcacattgcttgccctcaataaatgttacttataatagtcaacatctaattcatggttaaatgggtggtcagaaaacaacaactggagagccacactcagtcacctgttttttgtatgacccttgagctaagaatggtttttatattttaaatgaatggaagaaagagaaaaataatattttgtgacacattaaaatgatatgaaagtctattttagtattcataaataagttatgtcagaacatagcctgctcactcatttgcatattgtctctggctgctttcttgctaccgtggcgaagtttgctgtctgtcctgcaaaatctaaaatatgtgctttctgttcctttacaggaaaagtttggcaccccctggtttaacaggacacatttgagggtgaatgagggtactattaataataagttaggacaacaggcataagctgagaatatattgggcaagccagtaggtttgatcaccctccatatattatgcacaagaagaaataaacatattagaatggaaagtggtaaaaaaaaaactgacaaagaaaagggagcattttgtgcaaatgactgcaactaggaaaatttgttaaagtgtaagtcttacgttttatctccttgtgttaaatccactatcaataccaagcacaagtagaataatatccagacccattctctacaagcttctatgtaatcccatccttacttatgtcttgggcaccttctcggacagctttctcctttgttcggttatgctatagtcacactcacttttctgttccaataagataccaagctggtcactatcttaggacctttgcaaggctccctacctgtaatgctcttaacagactttaaagtctgacccttcaccttatctaacccttacacctgtcaccatcctcccttccattatcccatcttattatctctttagaactgtcgctctcagaagcgtagaacctaagctccacaatagcagggatttttgtgtgcatagtgcctactacagttcctggcacagagtggatattcagcacatgtgaatgcatccgcctgactctgttgtattattgccactccttttgtgtcgagtgcttcagaggttccatccactgctcttcacatcctgagcttccatttggtctttggctctaggttggcagttcagcattcatacaaattttagtcttgatctctgctctaaatggactctctgggtacagaatgtgacatctctttgtttttttcctcccattttcacattttgctcctattatctttgcttatttgtgtctagagctaagcagcccttttctgtcatggtgttcattattttatattcttcatataatggagaagcagagtaccttgtgaaacaaatagtttccttgtagcttatgctgcattgttttcaatttttttgtctatgagtgtttccaaagttcgagtatgaactacttgtgggcagaggccatatcttttaaactgtatttctttgtacttagtacaacatcagagcaggcaaggatgtgctctcgagaaatatccctgaatgaggagtatggttaactccactgctgtgtgggctaatggaccaagcatcagaagagacaatcacaatcacatttggctttcagagacaccttgatcctgttatgcctagggcctatgccagtcacaggtgtattttattggcattttcgtaggtgcttgatttgcactctcagagcacgtgtaaaccagcctgaatcaaattagcctctatgcagttgttaacaattgattgcagagcctgagaaaagaggaaaagtttcttgtatataccacgtcctccacccagctaggattgaagctgcatagaaaagagaggagaagcataaaaaagcacaggttggggcagtgaagtctcatccagccttagcagatacaagcagaaagcctgtgttccattttgtacacatttagaagttcagcttaacttcacagtttccagaaacagaactggaacaccgttcgccaaaatgtaagttatgtctgccatgtttaacatatttgctataaatccattgccttgaatagtagagaatatttattgcatgaaaggataactttttccttgtttgcttactcatctagtaaagtttagcagactaggtacaacttaaatttcatcgtcagtgtttaattataaaactttaaggtacagctttaaaaaatataaaacaatagaaaaattggaaaatatgcaacacaatgttctttctgtgatattgtcaaatgctttggcataaaaatattcagccactaaaaataaaatgtcatccagcaatggaaaaatactacaatacgagaaaaaatgatggataaaaaaagagcattgctataatgattaatgataatatggctttttattttaagtacatgcagtttaggagaaagctttcagcatgtataacatgttgaaaataagtgttcatgtgatttgatcaaagggctccaatctctgagagacagtaaataatacagtatttaggaaattgctttaaatatttatttctctgattggctaagattgctcacaaattgcagcatgttttggatattgtaaaagcaagtctgaataacacatgcatcttgaagataaataggagtacaccaccatatatgtgctggagttggggaaaatattctcagtaataatgacattctcaaaggtgtttttaatgattgactcctaaacagtttacaatgttattatataatcttttttattaacccttacagctattttatgggaaaggtgggaagcaaggtatcttttcaaaactttctcaaaaagtcttcaatttttctctttctctatatttttatcaaaaattagacaatgcatgtgattctgtagggggattccatttgagatgtaatttaaatgatggaaactttcttacactatgagtgtcttatgaaaaggcaagaagtcttggtattcaaagagagtaaatgcagaactgttcaaatattccttccctctctacccttttgatcctgtcatgttttaacaatttttaaaggtgatttaaacattgggggatgcactacccctaagcactgtctgtttttagagtactcatactgcttagcaacctttgacaataagccataccaaagaagagatctagtatgaaaatctcagaagtgagtccacaaatacacatcaaaaatagtaatctccagagcttttaaaaaatactttttcacgtaagaaaacttagaaatgatatctgtaattaatccttgccctttaaaaaatgttcttcattgatttatcattcttaagatgagcaaagtagagctagagataagagaatggagaaaataacaaagaaaaagaatgtgtgttttaacacaaacgtggtgcagaaactgagatatctttagcaatgggaacatttttctaccaaccaaataaaaccaatgttatacttttaaaaccgtttctttcaatctgttgctcaagtaggcttgttcattacaatgatacgtaaatataaataaaaacttaagtataaacgtgaaatttgctaacctatttttttcaattaagtttatggcctacattgttttgtatatttaatatagtgtttaagattaagaacataatgttttagcataccttcttaatgatggaaataccatttattgttatataaacccccagtataggacattttgttgatattataaatattgtgacaatgagtagcttcatgtctgcgcatttgcttatgtctcaaaaatattttatatttccctagaatagagttccaggaatagctgatttcagtttttgttgttgttattgttgttgttattttgagacaggatctcactctgttgcccaggctggaatgcagtggcacgagcatggctcacttcagccttgacctcccaggctcaggtgatcctcccaccttagcttcctgggtagctgggatgacaggcatgcagcagcacgcctgactaatctttgtattttttgtagagacagggtattgccatgttgtccaggctgggctcaaacgatacacctgcctcagcctctcaaagtgttgggatacaggcgtgagccaccatatctggccagattattggtagtgaatcctctctatgacttttgactgataattccaatttctattccaaaataatttttatcattggcagtgtgtgatagtacatacttagtgggtttctctatggtaggcactcttgtgaatgaacttttatgtaaattagcacatttaattctcagaacaatttttaagatatttggtattatcaggctgggcgcggtggctcacgcctgtaatcccagcaatttggtaggccaaggagggtggatcacgaggtcaggagttcaagaccagcctggccatctctactaaaattactaaaattacaaaaattcgcccggcatgctgatgggttcctgtaatcccagctacttgggaggctgagacagagaattgcttgaacctgggaggcggaggttgcagtgagccgagatcatgccactgcactccagcctgggcaacacagtgagactccatctcaaaaaaaaaattatatatatatatctatctggtattattctcattatggaaaaaaattaaagacttgaatttcaagaaattgaactccagagatgagatgtaactggcccaaggacacacaattaataagtagtaatcaaagtactatgttttatgtcttccttaatattagacaaaataaagatcattttgtgaagttaacaggggaataatagctctatgttgtttaaatctcatttaattaaatgatttaatttagtcattgatcactgatgagactactagttctttcaatctttctttctttcaccttctcttttttctactggattaggtacttacctcatgaatttgttgtggggagtagaattaatatatgtaaaggattagcccagtggcaagcatggtcatttagctattcaatgaatgatagcttttaatactcttatttttagctagttactgagagggttcagacaaaaatccagaactatatatttggtttagtaattttttctgttatataaatctttttctcattataaaggaaatcaatcctaatttagtatatttatttgaatatataattgctcctagaagtagcacaaactgacataattaaatgtgatttcaggaatggaattgagcagtattataaactgtttaaatctttcatccctggcaataaaaatatattttagcacacaatgcaaatatatgtgtagttatttatactgtactaacatattttatacttataaaacatataattttttttttttttgagacggagtctcactctgtcgcccaggctggagtgcagtggtactatctcagttcaatgcatgctctgcctcccgggttcacaccattctcctgcctcagcctcccgagtagctgggactacaggtgcctgccaccatgcccggctaattttttatatttcttagtatagactgggtttcaccatgttagccaggatgttctcgatttcctgaccttgtcatccgcccacctcagcctcccaaagttaaaacatataatgttaacttacattatttacatatgattacagattattcacatatagagtaatattttaaatacttttcttatttgcaaatattacaaaaatatttgtgcttttgctaaaaaaatgtgaaattttgttttgggaataaccatattaaatgtgattagatagtcacaatttttaccttgtattctggctggcaagtcactcctaacctcccagtttctgtttcatttgctttacttatattactttcattctgtgggttttttttttccagaaacattttaggccatttttgagggtgagattagttaaaactagaaaacaaaatctccagatctatttctctaggcaacggtaaactgaaagatgtccagatatgctagactttaagaaatccactcttttctcaaggtatctgtatgtggtaacatttgacatctgggccaagtgaacaatgccaatttagatatgaataatatataattatagtgtcgtttttgttttaactattagccactaacagcttgcaacagtttccagtgttagcagcctaggaagaaaaatactcttttatcttgttttctgtttattgcattctctgctacctctctttcaggttttataagagggtatttatggctgttgcacctgtgactttggttgttcctgctgggttatctgcctggtttcaaccaattagttgtctatctctgggcttgaatctggaggtttatctatatcttcaatgtgtagtaggccctggtactgagttagctgttctctttcaatgaacagaagagtggaccatgaaaatcccacagattgacttttatgtgttcatattttctgtcgtcccacaagcactttttctcacaatgtaacacaaagtacagcctcttgtttccacaaaggtaaagattttcacagtatttcatttagctttctaatctaacgcacctgctttctcttttcttcatctatcagaaaattacacacacacacacacacacacacacaacactcaacaaactgaaaaggtccagtgattccacttgatttattaaaatatgcactcactagctgcctttccatatgtgacatgcacgcactgcagttcccgcttacccaggcctatgaaatgctaaccctgtgctacagtctgaatgtgtcccccaaaattcatatgttgaaacttattgatagtattagatggtggtgccttcaggaagttattcactcatgggacagagccctcatgaataggattagtacccttataaaagagatgtgagggagctattcgcctctctgccatgtgagaacacagtgttcctcccattttgccctatttctgccatgtgaggatgcaacaagaaagccctcaccagacaccaaaagttggtgccttgatcttgcacttcccagcctccagaacggtaagaaataaatttctattgtttatagattaccctgtctcaggtatttttaaaggagcacaaatggataagacaaactgtctcttccattgtatgtgcagtatttctctgtttcactgggatgttatttatacacagttgcatatttcttctttttaaattctcacacttataatattttaaataccaaacatgtaattaaaactgcttctgttgtctctattaacatgataaatatgtgtatccataatatatacacacgtagctatagatacataatctacagttatatacataactgcatttctcaagtgcatgaatgtctagatggggagattaaagagaaggaagtggggaacaacataagtcaagctagagatggcttaattttgtgccatttgcacctctgcacaatctcaactttttgaccactatctccaggtctcaggagagacctggctatctaaaatatatccaggagagacctggagagacccagatatataaaatatttacctcattgagaattatgtataagggttaacttcttagtctgttaacttcttagtctctccctttttagaatttttctttttccaaattatagatatattttgagcctactgataattacattcatatttctgtttcctgagccatgttatcaagcattgcacccattttgttctcctctgccatttgttgtgtctcttctccttttctggttgtggctcctgactgcactggcaggaatatgcacagctttagctaattaattgcttctgcagagcagtaaagtatacttacctagagtgcacttccagaaggcactatagagttattggaaaagagttatggatcttgattcatagctcatatatgcatatgcacattagaattagaatttagtctttaaaaatagcatgctaatgacctctcagcaataaataggtcctgagaccattataaatttgagaactagaaaaggcagggattaattgtaaaaataaaattataacatatgattcagccatatgtgtttttatgtaaaaagcttgttatttagaataggcttccttttgcttctgtaaccactctaataaacaggaatgcatataatccttttagtgcagagcatattctaaggatactatctcaaaacacattgatgcaatttgaaagtatatttcaatttgctgcgtttgtgtgtgtgtgtgtgtgtgtgtgtgtgtgtgtgtgttaaaagcagcaaatactcaaactcccagcttgagactatcttaaatgcagtatgtttttattcgtcaatctaacgcagctttcttaggccagaagagaatatcctctctttggctgacatgtgaaatgtgacagaggtatcttgtaatgggcattttccaagagcatcacatggtaggtttctccctagattttaaacctgttttcgtgtctgctactcagttccttttaggctcttccaagttcttctctctggagtctgaagcaggctacagaacaggtgggacattagtgtgacagctgggcacccttcctagaacagacccagcatggataacattatgtttgaatcacatatctctctcgtactcaaccctctctaagaaaaacactggtgtgggaagcatgatatctcatcactttgtggagacagttctcctacgtctgtctatatttatttcttttgttcctgcccttccttttcactccacagtatttcctttttttgaccacattccattatgagaaaccctgattctcatagcacctcacttggacggactcatatgacagcagaataaatgccagaaatagaagtctgaggaccagatatctaattaccacattacaataagaatctctcaaatgaaacagaacacaaaaacactttgtactgaaatgtatttgttgagcatttctcacaatgaagctctcaagttattgttttttgaatagcaaggccttaggttgtattcaatttctctgtgtggtatagtggtaaaacatcagtatgataatatactacccctggtttcaaatcttcattctgctactgactagatatgttttgtcttgaacgtacaaattccccagttataatccaagaatgatgacttcacagggcaaatgtgtggattaaattaaatccatccatttagcaaatatgtattgggcacctattttatggcaggcatgtgcatgtaagtgttagaggtagaaatgagaaacaaagcaaaatctagtgagggaaatgggcatataaggagagaatgacagtagtgtatacccagcactgttctaaaagcatcacatctactaactcatgtaatccataatataactttatgaaatcagtactactctgtttatttatggaagaactgaggtatgtagagttttaataacttaagtttatgtagttagtaagtggaagatctaggataaaaacctaagcagtctggttccactacccaacctcttaaccacactattaataataatgtactagaaacaaataaatgagaaagtaaaagaagtttgttttagtagctcttgagttagagaagatgatataatgtataatacactcactcattattcatttcaataaatgtttgttcctattttttggtgtcattgagatcacatgtaatattttacattttgatgaaagacataaaataatctaggcaactctatttcagccaatgattatatgacttttttttttgagacaaggtcttactctgtcacccaggctgaagtgtagtggcacaatcatggctcactgcagcctccaatttctggcctcaagtgagccttccaactcagcctcttgagtagctgggactacgggcatggttcatttgtacatttcattaacgtactccagacatgtgcatgttccatctttgcttgtattttgaggagctataggagagcctagccgtggctagcagagcaagtagttgggttggtggacatgggcagtgttgaataatctttttcagcctaagaaaaatgttctactgccctctgagcttctgaatttattttgaaggataatttaattataaaaacggggaagggaaccagcaaccaccgtaactacaccatatgtcttttgaagagcgatatgcctggaaatccagcgataagaaaagaagtcctttcccaagaaggggccttctgagagatgaggagtggatggtagactctcgagcacaggtcatctgtttgcatcagcctcagaatatcttagagtagaatccttagctgattggtcaggttttgctcttgcaggtactcctcaaaacattttagctcctgtcagacaaagatcacaattttttttgtttcctttttaaagtctattccgtacagggatcactacattttgaaaacctctttggttatctgttcattccaggaattctgagtaaccattctgtgaacagttgcccaacatatcatgtttctgtattttacttcatatggcatttcatctttatcactcaggttctattaaactttattacctctttttttaacattttctcttagaaattgttcacagtcaactcaattctatggagcagtcacctagcaagagttctgcatgtgagcatatcttcattagaattgtcagttaaaaatccctgatttcaggagaatgctgagtgagaggctgggctattggctgccttagttaggacgttcatccacttggggcagccggccagtgagtctggctagagtcattactctaatcaagagtacgcaaaatgaacctggagaccagtcattcaggaaagcagcctcattctgtttttataattgggtgtgaattttcaattgtgtagtccagaggagcacagggggaagacaggctggagcacagaagcagctcctggtgtctaattagacaggtgacctacagcaagtttcagattgggtttgttgcttccccagtcccagctttcctgtggagatatggctcaagtgtagatgaatgaatgagggccatgcatagaagtgatgttgctaattttactctttgagtcctgctagcaggtgccacctgcctcaaccaaggacatctcttgatggctactggagctcagcagccagcctggaggcatccttccccttctggaatttatgccaaattccagatggtctcttataaaggctgacctcagtttctatgccagggtaagctgtgacaagtcgtgattgtgcctgtcatttgtgacgttttatacttacactgaactttgtcaattctatggtacaaattgtcaccgagctctggtttaggaagcaggagagctatgaatgacttattttaaccttattaattagtctctacatacattgtaccttcggccacaccactgtcagcacctatctttcctttgcagttaaaagtttacatcttgtttgtatcttctcatctatagcagtcactgctatattcgctgcttttcttcagttaggccacttgtgagcttttgttctatttatcttatagacattttagaaaactaatgaatctgtttttgtccagagcatgacttccagactgtcgcctctattctggctatgcttaacctctgaccaagaggcacaggctgtgtgtataattctttacataatgcactgacttccaacctacctgaatcttgaacttgcttttactcctgctttatattcctcaaacccagttaaattcttccttctgcatctggttatacttggatagaaacattaccagccagtgtgaattgagtattcctcccacacctcatcctaaactggcactggcaataccaaaaacccttggcatttagctcatggctttctgtcctgagaggcagtcttggagtggattagacttggacaacattctggagccatattcctggggtttgatttccagctttgtccatttctccagtttattctgactatcacacctaagttcaaacgcctttgaatgacttctattgcccattagaagtttcatgcaatttctatcaaactaccaacatcatctttcacatgactagaaaaacgattccaaaattcatatggaaccaaaaagaaggctgaataaccaaagcaatcctaagcaaaaaggaccaagtcggaggcatcacattaccccacttcaaactatatcataaaactacactaaccaaacaccatggcactgttacaaaaacagcatggtactggcacataaacaggttggaagtgaatgcattgtataaagaattatacacactgcctttgcctcatggttaggggctgagcacagccagaatagaggttataggctggaagtcatgctctggacaaagacacatttattcattttctaaaacgtgtaaaagatcaatggaacaaaagctcacaactggcctagcggaagaaaggcaacaatggaacaaaagagagaacccagtaataaagccataatctacaggcctctgatctttgagaaagtcaacaaaaataagccatggggaaaggacttcctattcaataaattttaataaatggtgctgggaaaactggctagccatatgcaagagaataaaagtgaactcatgcttttcaccatatacaaaaattaattcaaaatggattaaagatttaaatgtaagacctcaaactataagaatcctagaagaaaacccaggaaacatcattctagacatcagactttggaaataatttattattactaagtcctcaaaagcaattgcaacaaaaacaaaaattgacaagtgggacctaattaaactaaagagcttctccacagcataagaaactatcaacagagtaaacagacagcctacagaatgggagaaaatattcacaaactatgcactcaacaaagatctaatatccagaatctgtaaggaacttaaacaatttaacaagtcaaaacaaaataacccctttaaaaatgggcaaaacacatgcacagacatttatcaaaagaagatatactagcggccaacaaatatatgaaaaaatgctcaacattactaaccattagagaaatattgatcaaaaccacaatgaaatactatctcacaccagtcaggattgttattattaaaaagtcaaaaagcagtcaatgttggttatgctgcagaggaaagaaaacacatatacattattggtgggaatgtaaattagttcagccacgttgaaagcagtttggagatttctcaaagaacttaaaacacaagtaccattccaagtagcaataccattattggatatatatccgaaagaaaataaatttttctaccaaaatgacacatgcactcctatgttcactgcagcacaatttacaatagcaaaaacatggaatcaacctaggtgcccatcaacagtgggttagataaagaaagtgtggcacatatatgccataaaatactatgcagccattaaaaaataatacaattatgtcctttgcagccacatggatgtagctggaagccattatccaaaacaaattaacataggaacagaaaacaaaatatggcatcttctcccttataagtgggagctagacactgggtgctcatggacataaagatggggactatagagttgagagagtaggaaatggggaaagactgaaaaactaactactgggtactattcccactacctgcataagagattatttgtatcccaaacctcagcatcacacaacatacctgtgtaacaaacctgcacgtgtaccccctgaatctaaaagagaagttgaaattattttaaaaaataacattaaaaaataaaaagaaaagaaatttcattttcccctgtcattctcaagcctccgcattaagccattattttccttccaagcgacacaaaccatttctttcctccatctgccccttatgccagacctctaggccactcactttgctctctacaacatttctattcgtaagctcctgcctgaatggcagactcactctataaaaatgctgcaagttccttgatttccaagaaatatttcaaaatccacttctttatgaaatattattttattcacccaagttttatttctttcttctttgacctgtgtacccctgttgttaactcacaataatataccttgcattttgttattcattcatttttttcattgatccttgctttcatggaatatatgtccttgatttatcttgatacccagttgaattcaaggttccttaaatgactgagactatgtctctatcatttttggaccatttatactgactatgtttggtcattttccttaggaaatagactctgaaatggagatttgcttgcaggtagatgatttagtcctgttggaaacccatggagggaagcagggttgtgaagaagtagaacaaagatgaactttctacaaaagttcagtgatgaacattgcagccaattccacaaggaactctgaagcttggatgggcggagttgtaacctcaaagaaaacaattccccgggagattcccaaggactcagccctttgctgtcagcagcccacacttccagcagcttgaggaatgaatgtttcagtcttgaagggaggccggcacagcgtgccatctcattcactacacaagcatagagccttatacgtggccaaagttcagtaaatatttgctaaagtatatttaaagtgattcgtgaatgtcttataacttctgataaagtatatttaaatatctaaattattgtataatttattaatgcacctaattagtgctaggaacaatttgctgagctatgactgtttcttggagtgactctatgtgagagttctacaaagagtcatagatttccctccccagctgagagccatgattgagactctgttaggctttaacctttccacaataggtatttggacacttatattttaaagttaaagtcattaatattacctacaacactttctacccttctaagttattttcaggttcctaacaaaatgttgactaaaaagacaaatccctctgaacctcatggccataggagccctgacactctgtgaagcatataacatacgattaaataaccctctagcaccatgggtcctccctgctcccccacccccaccgggcaggggaggattcagattttatggggctgaaaagctaaacaattgggggttcttagttttaaaatgtaatctaaaaccatttcccttttgaatattttatgaaacattgtatttggggtctctacgaactccaggtttgaggatatggctaggcagacataggattcagcatttaattgtactcacagtttcatggctatgatttattacagtgaaatgatgcaaggcaaaatcagaaaaggtaaaaggttcatggggcaaagaccagaggagaccaggcacaaactttcaagaatcatctcccagtggagtcacacaggacatgcctaattcctcaagattgtgacagggatgaaatgttgcccaccaggaaagctcaatagtgactcagcgttcagggttttttaaatttagagctggtcacccgacaccttctgcctggcatgtaccagaatttcaaactctcaggaggagagcaggtgttcagcatatattattttgttcgtaaaattattttgttcgtaaaaacaggcacagtgagccaatcttatcattttgggaatggtgggacctctcccaaaatccacgttctcagataaacaccaaaggccaaccttgcaatcaggctttttcaaggacagcactttcagacttgctaggttaactcctttctgtgtatatctgcacctttgcacccattactaggggtcctcccaggcagggccttggaagggctgtgcaagtgagggatccagatggtgagcctttatcagctccagggtaagtgcttctctggttccaaccatactgacacactttcaataccttaatgcacttgctttgcatgtgctagtcttttgtcttgagctattcttgctctttattctcttcttcaccaaaatcttaatccttgtttagctttcagagttacaccctcttggaagtccatggaactggtgtttctgttttatgttgctttctgctacgaacccatacggaatacgcatattccttatcatagcactttacatagtgcatggtaattactttagcattttcccccatttccccatgaaatctgagttccttgagaacaaaatctatttagtcttcacgttttattcatgagcctagcattatgcttgacatataacatacttacgttaatattagaataatgaaggatgaacgtacttactagttttgacaagtgttaccacagcactgcagttagtcctgtgatagatatttatttaaatatcttgggttaaattgaggcatgtgttaactatcagtgttaatagtatagtggtatcagagaaaaacttctgttattgtcgttaagtctataaacctattggaaaacttctcctaccagaacataattagttaaaacatgagtaaaaaacagtcaaagaggagttatgtgtcccagatagacttgccattgaaaagttgggtagattttcatgcaactatatatgctataaaaagacaactgcttcttatttggtaacattgattaatattatttttcaagtctgtgcatataagcatgatatcttaattgacattaactagagttaaattaattgtattgttttcagaaatctctgaaatctgttactgaagtaggcattattaactttgttgtcattattttaaaatgcatttcaagatctgcaatcacccaagccatcctactgtgaattctaaggctcaatgatatgtcatacattgcttctataaaactttaggaagtatgttactttatttatttatttatttatttagagacggagtcttgatgtgttggccagcctggaatgcagtggcgtaatctcagcacactgcaacctctgcctcccgggttcaagctcttctcctgcctcagcctcccaagtagctgggattacaggcacccaccaccatgtccggctaatttttgtatttttagtacagaccaagtttccccatgttggccaggctggtctggaactcctgacctcaagtgatctgcctgtctcagcctctcaaactgctgtgattacaggcatgagccactgcgcccagcatgtatggcactttaaaactgccactcttggcatatggaatacatgcacacacttttgtattctatattcattcatatatgcaaaagataaaagtggaaagaggaacaatctgtttattgtatatcacacaggcaggctctctgtgagattaacattttagctgcctaatgaagttgcaggtgactggtctctctgtaagtcccagcattggctatcagcaaaaattagaaaggaaaacatatttcttgaatctagtgctcatagttttggttagaaatagtctactctgaaagaatttacaactgaggagatgagaagagaatgaggattcagcagcaacagcaataaagtttcccaggagaatgagtattaaaaaagttgaggcaggatgtccactgtctgagctggaaatagtcttgcaattaaggagggtgaaaagaagcttggcttgagagaaacggaagagggagttgaggtgattgacgttccccaaggaccctcttcatttgtgtttgtttcaaggctttttctggtgacatagataattactggattgaaggtctctattttgctaggctgtttatgaggagattactaaacaaaagataagagaaagtcaagagctgatgaaggaaagtaatctagcctgtcttgctctctgctttagatggaacacgtgagggtgaaaaacagatcattgattccagttgatgtttataatatagaaatagcagagttatcctcctttacagaaatttcttaaatccattagtaccttacttaggtggacttgttcttgtttatgagattgttcacatgagtttgcggtcaagaaaggtgagccttctgcttttaggcttaatatttgcaaatccctgtgaaatttaagagcataaatctgtagtgcagagatctggagtcacgcccaggctctcctgtctgccagttctgtgagctcatataggttttacaatccctcatgcctggttttctccattgtaaatgggcaattataaacactgtctcagtttgtaacctgaggtatatgtatttaatgaagtaaatttaatgaagtagatgctgaataggcactttataactattttttagatgaatgtatataaagcacttactgcataatgcactttgtaaattcgaaataacagtagttaccatctgccatgttaaatgaaatatacttgagacatcttgaactttttcttgataaaccaaggccatcattctgagcatcagttactgttttgtgctgtagcacaatcaggagcctcctgtattgctggaatacattaggacaatttgtatgtaagcatgcacgtgaaccactcccacacatacccagtggcttttaaagtctttaaatctttttccattattattctaattttcatacatgtattttatttttgtcagtgtttttacatccgttttctcactcttctaataatttgctctgtatgagctgctgttagctctgaaaccatttgagagacttgatagaaatgtgaattagctcagaaggagcaacttcactggaagaaggtaaggtttcatgcacagtcctggcgacatctacttgattctccctgtggccttttaaaattactgatccctgggtttaaaaaattttatcaatgcagcagccaagtaaagtacaatttaaaagtttagtttttctcactggcaatgtgaattgccatatgccaaatttttaaattcttttttttttttggagacagagtctgcaaacatggcttactgcagacttgatctcctgggctcaaggaatcctctagcctcagcctgcctcccttgtgggaccatagatgctcaccaccacacccagctattttttttttattttttgtggagttgaaggcttcactttgttgccaaagccagtctcaaactcctgggttcaagtgatcctactgctttggcctcccaaagtgctgggattacaggcgtgaatgacagtgcctgacccaaatttttaaattcttaattcatttatatgcattatgaaaaactaaaagtttagggaattatttaaaataccttagcattgaggctgatttttcttttattttgcattctactccacatgacaatgaattgtatttttgcctcagtcctcataatttcattttcatttaggatatgtattgtgggaataaagtatagttcatttattgtcaggtttgtagcatggaactttctaaaatgggtctaagtacagattttgaaggtgtgaattaataaaatttttctagagaagcatttcatttccatatgtaatgtagtgtttctgcatgaatggactattctttgtatttttagattttacagttgttgcttttcatcaagatttggcctagctgaaaataatccctcaaagatttactgtgcagtagtggaagttaaatctatttttaaatcaacaagtgcttattaaaatgccaactttgtactaggcactgctgttaacattttacaaatattaacccattgactcttataaccctttgagatggatgctattattgagctcattttacagataaggaaattgcaatatagagaggttaagtaatatgaccaaagtcacacagctaataaagggcagaacagaatttgaatgcaggcagtgtaataccacagtctatgaacttaatcaaacctgagaattgtctgcatcaaatagcaaattgaagaactctttatctctacattttgtaatcctagtttaaagaagttctcttgattatatttaattactataacattaaatattttcaccagttttgaaaatagggtttttatgttacctaagacatattaagtgaacaagccaaaaatggctatgtcgtttttgtgtgtgtgtgtgtgtgtgtgtgtgtgtgtgtgtgtgtgttgcaattatatagcaagtaaaatggagattttgtttatttttaaatagtagattattggtttaaatcttatatttccaatatagttatttcattatttcttaagttattgaaaatgctggattatttttcttcttcctcttactatttgttcttatttccttattacctgtatgtgtctttactagtcattatcagtgggggcaaagaaaatagccaggcacagtggattatgcctgtaatcccagcactttgggagggcgaggcaggtggatcacttgaggtcaggagtttgagaccagcctggccaacatggtgaaaccccgtctctactaaaaatacaaaaattaggcgtgatggcacatgcctgtaatcccagctactcgggaggctgaggcatgagaattgcttgaacctgggaggcagaggttgtagtgacccgagatcatgccactacactccagcctgggcgacagaacgagactctgtctccaaaaaataaaaaagagaaaaaacagtcaaacttcaaattagtaaatttagacaaactatagcagaattggtgaaagattattcagtgtggggttgaaatcactaataaaaatatatttttttagatctattctgtcctccatatgaaaatataaatcatggtctcatttgtttctcctgggtatctgtgtgtttgtgtgagtttgagagagaaacaaggatacattataactttaaaagtatttatagcctttgataataaggtgatcaattgaagaaattaacagtattctagtatttcatttagctgaagcaagatatgctttaccgacttttagctatcctccttttttcctctttctgcttaggaattccactaagttggcatgtaaacagatcacaggctgtgtcagtttaaaacttcttgttctgggcatgccatttattttgctaagcctgtagcactagggagtattagcaaaagcataatttaccttatagtgacagtctcccgaaacacaggaaacctgcctttcttgtgtcactgagcgaacaaaggtaaagttaaaggtagtgggcagaaaggaaagaaagggtggggttggggggtggcatttggatggaaaaaaaaaaaagggaaaaaactttgtcctcagagagaaatggtgggtgggaggaagtagattgtagacctagatgggaaaggaagcttgggcatcaaaagattaaggatgtgtgaaatatagattaacgcccatgggagtctgactgataaaaaagctgggacaacaggtctcgctcagcagccctgagaatcaggcttccagggtggtttcctacactgggcgtcttgtctgagtttacctaggctaatatattttcccatctctccttgggactctacttctgtaaggggaagatacagtacaatttgccagaggtatttgctcagttattcaagatcttagacaaaaggctgtcttgttcctagaagctagaatgttagaattgagttagcctcttgcagtttcttctggatctatcagtctcaatatacgtgagttacagttttcattgttttcttacttaaatcattttgattgtcagagatatttttaaagatttgaatgtcacaggtctcacagtttcattttactaattcttgcttgtgtgtcttaaatattttttatcaattttccattttatatataatatacatatagactgttgctaatgttgtttgtaataatcccttgagtttatattagaccaaaaaacattgtaccaactacatttcccaattaaaaggaaaaggaaaaggaagaaaataaactgaggataattagcactttaactttatggccctccctgattgaatctagctctgcacacaaacacacacgactactagcaaaaacactccccccctccaagatctttatagaaggccttttatatcctcttccttctttcctgtatttctataaatgggaaaaatatgtttgaaacaaacatcctggtgttacaaatttctaacactttatctaataccatgtcatattaccagaaacttcagagaaatcaggagtccttgtagactaaattattgatgataaactaactcgcctgcataggtataaatcccaccatagtaataaaaattgatttcagggcagttagtttcaaacatttatttattcattggcatatgaaggtatagataacataaaaataaagttcctagtcttaaaaaagagtcgtttaatcctatattaaaagatttatattgcatattgactttcctctatgcagtttttacttggaacttttaaagatttttgtctgccacaggaattcttgatgactgaggagttttagttcttattttagttaatcctaattttagttattcatatgcataaatttcaaatcaatctattaatgtttgtcaaactgcagaaaatataaaacatggtatttctgtttagtaatgagaccaattttatttgtgtgtgattgttgaaatcaaataagacattttgaaataaggttatattactagtttaccagaatttttatgtttcattcacttaggttttacataaaatttgcattcatttttacataacatattctgtttctcctctttactagaattgaatggtattatctttagaatgtctaaataaagttcttatgtataatgcttggtaattactcataaatgctgttttctctaccagatacattttgcaaaagaatgttaagaggagaaaaacacttgcttattactttcagtaaaggatattaaagtttagttgaattttctagcagagtcatgaaatagagtaaatattaaaatatactatagtgcttattgaaaatattgggaatcaaaattctgacttttcaaggccaatttgcaatacaccatagacttattagtgccagaatttactttaggcaatccagttaaaacatgtcttattacaagatggagaaaaagaggccaaaagtattaagtttgtgagttggatcacatacaattacatattatgttaaatattcttagcaacaatcattaaattaaaagtctatcctcttcagtgtcttgctgagctttattaagattgcaggtattcaatagaacaaaggagtaaattcaatccacccctgcccttaaggtagagagagaaataaagccaatacagatagtgaataatgtgatgggaagggtattttaggaactgaaagaaacaggtaaataacccaagcctagaaacttggcgcatgggtggcatgatggaaaccatagcatggtggtgggcaacaggaagggaagggagacctgagctgagttttggactataaattattggcaaggactgcatctgatgttagtagtctttccactgtattcttatgctaaacatcaatgaaaatcaaagtgttatatgagttatttactacgtccttttttatccaattgcttaatgctataggctcttaatgtaagcttaatattaattaggcttaatattaatgcaattttctttaattctgaagtcattcaagtgtagacaggcatgtgagaaatttatgcaaaagatatgagaattggttcctaatatgtacttcaatactatttaaattgatgaacccatggtcttttgattgttttgttttccctatggactccatttattattcattcattgagaaatagaaatgtagacttaaaatttttaaaaaaacatttagaacaatagaataatttatatgcctgcttcaaatgtttgtttatgacacatggccaatataaaaaaaaaagatctttaatagagttctgagtttaaaggatcagtgtcacaaatttttagaaactaaatgtcaaatgaattctttctataagtcatcctttttattagattttctgtatgatatttgtatccaaataggattttacaaaatagaaatcaatccatttgcattgggaattgagaaatttacacacacagaaaatcaaacgcaccaaatatacaatttatacagtccatattaacaagcagtgtagtaggtatttaggcaagtgatattacctaggattaatatttagcatctattattttaataggtgatcattatgcctttcatacgtaacaactattatatctaaaagacagctcttttcaatatttaaaaatctagaaaacatagactgctttttattttgatttcttgtaaattcacatcctcatatgcctttttatgagactttatacgtataccaaaggaactatatgtttgtatacaaaatatttatacttttgaataattttaaattataattcaaataaaattcagatttttttattactagctgtgaaactttggacttaacatcactgaagattagtatactcatctgtaaaatgggatatttacaggattaatttataggcccatttcaagaataaaactaaatccatgcataacatctaatagagtgcctgatacacaataatgcctaattaatgttagctgacctttgtcattgttattattgtcatcattacttttttaaacataaaaaagtatcagtaagtattatatggcaattgtttttcttttgttgcaggataataatggctgttttagttttctctgtgttctaaatttttctaattttttataatataaaatttatatttagcaatggctgtttcatcaatatatactcttttactacttctttataaaaattttagttgatccacctatacataaatttcaaatcaacctattaatgttttcaaagtctttgactccttcctgttctatgtgaaattcagattagaaccagttctcaattatctgtagcaattggtcttggtctgtacagttaaagtacatgcaaaaaagacacaaatgctttctcacatgtgtctttcagtctaagaggaactgcaacaatactaggtccctgcaattttcatttgtgtactggccttttttaaagacactatggttacagagagcatgattttttcatggaattgcaaattccagcatggatagatcccaggatgaaaagcaggaaactaaagaggggacagattaaaaatgactcacaatatataacaagggttttgatcttgattgtaagagaaacaggtaccaataaagctataacagaaggtagagacttgctagctaggtagcatagttatatctagggtgaaggggaggtagtgattttagattatcccagatttctagcttgagtaacttggtgagcatttccccatacaagagagggaaaataaggaacagattggagtggattatggaaatgaattccctaagtttaggacattatatctcttgtatctcaggccagaacagtttattctcatgtattgccatctaccacataacgatttttcggtcaatgatggactgcagatataatggtggtcccctaagattataatactgtaattttattgtactttttctgtgtttagatatggcttgccattgtgtgacaattgccatacaggtttgtagcttaggagcaataggctacagaacatggcctagacgtatagtagattataccatctaggttcatgtaagtacaccttgtatgttcatgtatgttcacatgagaatgaaatcacctaaccatgtatttctcagattgtatctctgttgtttatcaacacaggaattgaaatttttttgtgtagcactaatcttatatttctgtagagcctgatacttttccaaagtgctttcccatgtgctacctcactttatccaggaaagtccgggaaaaaagggaaaacacgctccatctacttgtagaaaacaagtcttagagatcaaatgcatatgaattggcatgtctagaactgaagtcaagatcattgtgctttaatcactcaagaatctttttgggtaaagatgaaagcttatttgaagagaacatagcaggatttatgaagatcttttcccgtcctcatagaaaaagaaaaaaaaaatctctatgcttaaaaatttgctaatcttgctgagaaacccaaagagcattttctgctgaaaagtagtgcacagcaggtaaatgctgtaatgatatttactcaaagagcttaaaatttgttaaaaggagattcataccaggatcttagaagtcaacttctgcatgcattttataagtgaataacaaatgctgtaaatagtgtattttgtagggagaaagtgacatagtgtcatccttaatgatgtgaaagcaaactcaggaaaaggttttgtctttttaaaatagattttgattacatctcagcaaattattttatgctcatcagttggaattcacatttatgtggcaatggagatattttaatgcaactactgaattgaaataccataaatttttcagtggtttatttctgaaagaatgttgagaactataattttggcttaaaaaatgaaataaccctgaatttggcattaaaaaatacactgaatggccagtcaagaaccactgtagcaaataatataacagtatatatacttgcagagtatctatgtatttcagaactgggttgaggggcagaaaagttggaggataggtaggcagtggccctttgtgtttgtcaaagttagacttcggctcaaatcccaaatctggagatgcctgtcttggtggtcttggtgagtggaacacttttcttggcccctgtttcttcatgtgtacactggggatagtaatactttatgtggttttaagaggactaaatgcaataaatatttgttcatgcagaaatatgtaccaagggacaattatgtgcctgacactattttagatgcttctgatacataagtgaataagcaagtattcctgccctcctggagatcttatatgtgaagagctctgcaatgtgtctggcatcaatgggtaataaattgtagttgtgaatgagattatgacggcttggtaaatctatatttacttaaatggaggaaaacagtaattttagaaatctcttctacctcccatatcttctacttaatttttttcttagatgtaagtacaaaacaaaaggcataatattttccctactaggtaatgggctttcatactaaacagtatcagtatccttgctttttaaaggtaaaataactttcagatccctcagttttcatataaaagaaggatttgcattattataggtcactagtgttatattgatcaaatcactacttcagatttaaagaaattttcattctccaaaggctcaacatagtttcaataattcattatcataggtatcttcacatctgctccaagtgttgccttacccctctccagctcccaactcatataaaccttttataatgaaatgattatgaggatgattgagcttttgtgtttgaaatatgactggttagtaaactttggagtttgacaaactatataaatttcagtaaaggttcagttgacattttctgaatctatattcatggactggctctctgatttttttgagaaaccagtaatatcaggtatgattgtaagttgctggtgaaagcccaatgacgtaaaattgtattgtaagcagtattccttttggtattgatatttgtctcctctttttgttttgcctcatgtgaatattgtaggcatttttcttgcttgttgtttgtagacagtaactattaccaagtgtgtaacacagtttaaactcaaaataaatttaagaagtctagttaaaacacaattgctgggcatcactatagatctcatggacattaaaaggataataaagtaatactgtgaacaattctctactcagaaatttgataattatgatgaaatgagccaaatgcatgaaagacacaatctgacaaaactcacacaagaagaaatagacaatgaaaaatagtcttatattaatcaataattaataacctttcaaaacagaaagcaccaggccatgatgggtggtttctacaaaacatttaaggaagaaattacactaactctctatgatgtcttccagaaggtagaagcagagagaatacttctcaagtcattctttcagaacagcattatcttaaaaccaaaaccagaccaagacatatgagaaaagaaaccataggctaatatctcccttgaacatagatacaaaaatcctctacaaaatattagcaaattgaatccaataatatattttaaaaatgtagatggcacaactaaataggatttatctcagttatgcaatgctggttcaacatgtaaaaatcaattaatgtaaacctttatatcaacagattaaatgaagaaatatcatttgatcatataaatagatacatgaaaagtatttgacaaaatctaacacacatccataataaaactctcagcaaagtaggaattgaggggaacttcctcaacttgataaaagacatttacaaaaatcctacagctaacaacatacttaatgttgagaaacgagaagctttttcactaatatcagaaaaaaggcaaggatgtcctctctcaccatctcttttcaatacagtactggaagtcctagcttattcagtaagagaagaaaagggaaaaaaaatgtatatacattggaaaggaagaaatgaaacttcacagatgacataattgtctgtgtagaaaatctaaaagaattgacaaaaaacttcctggaactaattaatgattatagcaagttggtatgaccatataatggtagatatacatgtgtgtagagggtgtatctgtggctattgggaactctggtttttgttcagttttgctgttaatctaaaactgccttaaaaatagtctattaaaaaggagaaaattcaattgcgtatgtaatagtagggaaaaagtaccacataaacatgttgtatactgaatttgccttgaatgtcttaaattagcatgccttattagcagcggtagacatggatagttggcatacttcctttgggggaaaatgtgttagctatactctgataacatacacagctgacaatgccagttaacattccgaaaattttattatagtggaatatactcaattgttgtatcacagtggaatccaaaaatgtgtagcttaaggatttactacaactattagagagtgttaatactacgttgcattcgcatttttgcttttaggatttctttcagaataagcagtgcacgttagagtctcacaaccttaacagtagttgtaacaaagcagctgagtaacataaagttgccaaagatctgtatggcacaaaaatgtttgcagtagacagtcttcaaatgcccttgctacaaaaaatggtaatttaaaacattagctcacttgatgccaggagtttcagaccagcctgggtaacacagtaagattccatctctacaaaataataataataaaattagccagatgtggtggtgtatgcctgtatcccagctactcgggaggctgagacaaaaggataatttgagcccagaagtttgggctcaatcatgccactgcactccagcccaaccaacagagtgagaccatgtctcaaaaataaaataaaaaataaaccactggcaaggagctcaatgtggagaaatacaaaattgacatttatcttagaggtgtctttatcagtcacttgttaaccacttgccagcttacttactgaaaagtttttcattgttcctaaaagaattatttagtttttacctgctgaagacagtaatctctagtactgttgctttctgtggcaagtaatggaacctggtcaaaacttaaatccagaaaatactcactggatttaatgatttaagcagagtctatagaaagaaaaccatatttgatgtactgattgattacacaagatgttgagttgatttgcatatggtacattatttatcaacattgttttgttttacaaaagcatctagtaggatttgtgtgctaaaataaattctgaactctcatgtattatacacttaggtttacaaattcatatataagtgcctgaatacattatttgtctattttatatgttggcatagaaaactatattttcacatgacttatcttagcacaatagtgggaagtgttgtagatattacctacagttcctttttgcaaatactttatccttttaaataatatcctctgcttcctccagaaatgttgtgcaaaacatggccaacatggttgaagttaactaatatataaaattttcattggatctaagataaagtcaatcaccattgacaacttgaggggagagacactcttgcttacagagtatattccgtatataacaagctatataacaagttagatggtgtggttttcttgttttgctggatagttctattaagcaggcatttattgagcatttaatttgaacaagccataattctaccaggcacattagtgtgagtaccgtgattcggcctgaaagtcatggtctttcttctaaagttgtttagcatctagttgctaagttgacatctgagaattcctgctggcagctattgttctcttctttcttttggtttgttcagcatttctataatctgtctcttaccactgctttgattttgtaaaccttgctattttaacctagaaccctatgatctgccatattgaaacaccaatacttcaccagtagagcatacattttcactttactatgtctgtgtttatgtgactttctctttgtataattcatttctgcttccttctctatacaaccaaatcaaagcacaagactattgcaggcaaactctgcaaagagttccctgaacccgggtgcctacctctctcccttagaaagaagggattgttcatttgtctggattttattcatacacaattagcatattccatgaaaataagcaaaacatattatctagtgactgactgtcaggcactagcgttatcttggctaattctcaatatcaccttgtgcagtaaatactcttatcctcattttatggatgaagattctgaaatatacagtttatgtaagttgcccagtgttagtactaagtggcagaccaatcattcaaactcaaggattcacttccagagtcatctctcttagccagtttgctatagtacatgtacatactccattatgaatagttgcatatgtacacaccagtatccttgttttcccccaaaccttaatattaattttcttaagttcagcaatcatgtttatgtgtttcatattcaatactaactagcatttaatatatgctttgtaaatacttgcagaatgtttgtcgaatggataagttaaaaggatgtcatgttttagaagagtgttttagtaatcctgttttgaggcatttatgaaaatgttacttttgccttcagctcttctgtacataacctattttagattctttaactgaagtcaaagttttggtcaattgacagaaaaagaagtcagattatctccaatatgaatgaaaactgctaaagaatattaaattctagctgcaaaaagttgacatgtgggttggcggtggggagtaaactttctgactgcagtcattttggtataataggataatggtcataggaacttataacacctcttatctaaattagtaatgaagctttaccatattctgggtagtgagaaaattgtccatctagaggcataagtcagatgagatgataataggtgtcgtgtttaacagcaaggcttgcaagtcagcagacatcttctaaaacctaacctttgttgtatattcagaaagacacttaacttctctgagccaggaactgccacttattaactaaacaaattactttacttttcttcacctcagtgaaaccaagataaagatacagcccatgtcaggttttaatgaagattaagtcataggacactcataaagtgctgagcatattgcctgcacatgtcagtacatgctgaacttttataatcgttcagtgcatttaactatgaaacattttaaaatacaatatcaatcccatggagttatttgaagaaccaaatgagataacagtatgctatgctgggcccataggaagctatatataaatcatagctgtgaaccattctattatcagataaacatttttaagtttttccaattgcacacccctttaaatctgtcataacaacttaataatgtattacattttaagtacatttttgaattggacattagtatagcacattactatgattatttacatagtccatgtaaccaaaactcaaagtaaaaaggctaaaaaattgaatgtgaaataaacattaaattgattttaagtgagacctaagtaaagcattgtaagatctaaggaagctttatgtcccataaaccagtgaagctatataccaccagaccaaagaactaacctatggctataaattaagaaaatcattacagcaggcacatgaaaacactatgtcagaactggaaagagtaacatatgatggcaagaatcttcttttaattatagatcctagtcaatacacatatttatatgtttatatcaaaaatatgaatgtttcagtaaaagagatgagatttgagaaaaatacaaattattaataggactacctttgttgcataataagaaaactgaatttcatacagacagagtctctaaacattgattttccatcaaagaccagggaatctgaaaataatacatacatttttgtacacattggctgaatgtgtggaataaaatattatcaaattctaaattactgactgcaagccagttaccttctctcttactgaggagcacctggtcaaagcattattttttttttccccccagctccatagtcttccacactttgcctcatttcagtaatgtatttaatgtcaggttgctaccatctacaaacaacatacacatcgtgttgtttaccttcggtagtcctctttatcatgtgcattgaagtccaccttttctacctggtctatgaaatcttctgcacattcatcctctgactctttcccgcatcatatgcagatcttcacttattcttacctgggactttcggcttcagtcaacaatctcacctgcaaactcagggcgtcttacttcttttcacctaacactattctcatctttgccttttagttttgccaacacttatgtactttgctaaccttaagtttcattaccttttgctttttacatagtttaatgttctccatgttagtatgccatatgccctttcacctcaagtaagttataggcttcctaaagataaaaataattgctttctattttgttttcctatcatacacagcaccaagtgcatccaatgcactgtcaatcaatgcctgagaaaatatttcggcgtttttttgtcaggggttgaagtggcatttaaaaacttaaaattctaattgcccatattttattatttatgtctcacccagagtgtgagaaattgagaacacatttctgtgcttggttttatctctaaatctaatgagaaccagcagagatcatcagaggtttagaaaatatataaggaacaattttctataaaagtattttagtgattcttatgatttcccatcttttataacctccttcctgttgatttttaaaaggatgtaaaggaaatattaaaaactttttttctgtaattctttcctttgtggggcactagatgttagatttttgtatttcactctagactctaccacttcataactattttattcaaactcacattaatcaacttcagagtgacctcaagtaagcttaattaacctcttttggtttcagttttttttcttgatggggtaagatgatatctaaatttctttctagctctcatatgtttagcctatttatgtaaaattctttccacatgtagagttcatttcagtcctacaagtctacatattcttggcttaccagagtaaattatcaagaactagatagaactgaaaaacatcacctgaatagggctgatctcagtagatataaaactattaaccatttccaaatcatcaacctctattgtcttcagcactttggcttgattaaagattttctcccccactgatttttctctctatttaatccacttaaatttgcatcattttgttttcttttatcatcactgcttgaggcttcctgccagtatgaattttaaagtcttacagtccctaattctcatctgcttaaatgttataaatgttgtacatatcttagctgcatgatttcctctgggcatttttgaagcttacttaaaactatggaaccccctcctcaaatatcctgaaattcaagtttgatttggtgtatatatctatggggaagacaaccatggctaaacatgagagtagaaaaatacacctgcattccaggtcaagagaaatgtgactcctctgcagttacggagaatcagtttattgttgtaatcatgctgccaagataattggggtaaacctaatagtgtaagtgtagaagctccaaagccgcactacctagtttcacatccaggatctactactttctagcggtgtgacattgagcaagatgctcactctctaacccataggattgttacatgcattaaataaagtgacatatgaaaagcaaatgaaacagcacctagtacataaccttcaacaaatgttaattgttgttattattattaacatgttcaaagacagtttggagtaatcctgtaaatagcaggggaatctcacattcttatttcactaagatttagaaatatgtatagtttggtaaacctgtttaacctatgtttaaataaacaaattttcatatgaagtctatggtcctagcaacatttacgacaggaaaattgattgtattatttcccttgtctataagcacactaaagaatagggacttacaaaactatctaagggagcccgctatagcagttaagatgagaacacctgcagcctgatttccaccacactacctagggcatctcatggagcacatcaagaggaaagccagagaaactaaaggttgttgttagcatcatccattttcttcagatttttcttgtctaaaaggaaggaaccaaaatacagaaatcaatgtttatgtgcttttaagggcctgattttaactggcaggcaaggcatttgatatatgcaactggatttttgtctttctcacacttcactgtggcgtctgaacagagctatagatgatctcagtccgctgtaaacaaaacaaaacaaaaataatgcaagtctgccatgtaacacccattaacaatgcagctttaagatacagatatcttctcctcttgtgaatatttacaatactttttatctctcctaatgcactgtgacctataacactctactggagaattagagatttgttctctagttgttgcatgaacttatgattcatttcctcatatagaaaaaatgattatttgagtatcagagccttatcttatatctccttgaaacctcccatatttcttactctaattctgaaatattttgaagttaatatttaatgtaaaatatgacctagtaactatttctcagttgtttcttactcctcagaaattgtgtctttgcatttgttcctagggagattgagaaataaagatctacaggaatccacatgttaggtgcttttctttgttctttattaagactaagaatgaggtaagaagagtaaagaagatcagagatcagtaatttgttagaatttcagctttaattggtcaggaacacctagagcttgtttccactcacatagttaaatgccttatgtttttcgttgctctgtccttcagtttttcaggtgcggatccaaagtttgctgatgtcaccaaagcagtatatatcaacattttttacatagtgaggcagttaagggcgcaatttctaacaacagacctagatcaaattctaatactttcttacactcttcactaaaggaactgactcatttctctattatctgataattatttcataacttataaaattatgaccaatatctttattatgtgaaagtttaagattcacttttcattatatatagctagaatcattgagttgtagacttctctccacttacaatccatgtaactacgaacagagtacttaacttttttaaatgttattttatttctctgtaaaattgagacattaaaaaatatgtaataacatggttgtaaaaatgtggtgaagaatttagaaattcttcttcaaaagtagtctctgatgattagcatagttgaaaaactgctgacctatatgatgttcatgtcaacccaacagttccatgaaaaactgagtcataagagagtaaatgaaacttcttagctagatgattttaggctttttaatctgtttggataatattcccactgactattcaattaatttaatctaatttcataaatactggatgttttccttgtttcaagcatatacttgtgaaaaagacctacacaggttacagttgaccccaagtcctaaataaaatcttgtgatgcattctgaatctgaataaggcttgctgttgtcacttaaaattttgtgcattacgtacatgtatttatttttaactaaatgttagtacaattattataaaaacctatatatacaacctttcaaaagtgtctgtgtagagaattatttaagcagaatatggattttgctcctttatgcagcctaattttaacatgatgtgtacttaagttatactcaaatgtatattttctattctgcataattttgatgaaaataccaggtttagaattttcctaataatgtattccacttaccttagtaagtatacagcctcctatgagatcaactctatcaataaacactaaatatctccctaaggactcttttttatgttatcactttataatataatacgaagtgatcatgtttttctgtaagctgatttgcattcaacatcaagcttacctattcccctgagtacttttaaaagtactgttataacagctgggctaatagttgaagaatcaaatcaaagtttcaatctttgtatctatgcatgcatgtgatagtgtacatgtgtatatccctgggcccagagatctctttgttgtaatgtcttatttatctaggaaaattaggcacattgtttctctataaacaagaagcaaagactagaaaacaaaactgtaggaaaattttagaacaaggaaagcattggtctaatgaagtgaataatagtttttcacatgaataaataattgcagcatctacttgctgctctgtttgattgcaagaactgaggtgaactattataactacaagattttcattgtattgcatgcaatgtgatggtctccaaaatgtcatacaggatgatccaacattatcaactcagtgtaattgttaaagaatagccatttcattcttttctttgttgagatctatcttgccatcccatggcctacttgaaaaaaattatctctcaaatatctccaggatacatacatggacatcccaatactctgatgttttaatgatcaggtccaggaatggctttaccaacccctgttatgggattctcactctttacacttaggctttcctaattgtttttagttacagctcaacagctttgaccatgttatttctgaaaatccttcttatcgttttctgaaaaattcttattcatcttttaaggctttctccatgttcatcttccccaggaattcttcactgaactccaggtggggctatagataccttttttctttacactgggcttgtgttattaaaggagatcgagaccatcttggctaacacggtgaaaccccatctctactaaaaatacaaaaaaaaaattagccgggcgtggtggcggatgcctgtagtcccagctactctggaggctgaggcaggggaatggcgtgaacctgggaggcggagcttgcagtgagccaagatcgcgccactgcactccagcctgggcgacagagcaagactccgtctccaaaaaaaaaaaaaaaaaaaattatctgttatgtgttttcttcattcgactcttcactccaacacctagggttctttctcatatttacacttcaaaatgtttattgaactgagaatgatttaagaacgtagatgaagtccttgacaacacacctgaataagaaagcacattttgttttgctgctggtacttgattatacttgaaatgatagaagccttcaaaatcaaggaaaacacaggaattttcagtagaattagtttttatttttcttctgaaatttggtggctcacacctgtaatcccagcactttgggaggctgaggcgggcagatcacgaggtcgagaccatcatggctaacacggtaaaatcccgtctctactaaacatacaaaaattagccgggcatggtggcgggcgcctgtagtcccagctactcgagaggctgaatgaagcgggagaatcgcttgaacctggggttggaggttgcattgagccgacatcgcgccactgcactctggcctggcaacagagcaagacttcgtcttaaaaaaaaaaaaaaaaaaagtaattaacttagaggcaagctgaaatcaatataaatttcatcttagatggcacaaaaaagatatttccaaattagataggcatagtacataaaagagtagcctgtcattttgctatttgctagagtttgggtttattcgcaaatgacctgatttctcagttatttgttagctacatgcaattggcaagtatagctccttaaaccagaattgtggaaagtcgtgctataatagatgaggtcagcagcctggctaaacttcaaaacaaatgagaagttcataattctaaacctgggaatgttgacgcataaattggctgttatgaatttatgaaagcatcatgatattatattttctatatgggaagtgtatgcaggaaaactgtagagtgaaaagggcttactgtagagtggaaagggcttactgtagaaggaaccaactagtctgattggcaaaagctgggaagagttttctgcagagccaacatttacgctgaaacctgatatcttggatattatttagcagtatctccatctggctaagagatggactatactcattatttttcccaagttagtcacctggaggtgatgaatgattttttttggttgatgagctactggggaagaggagaccaaggagattctggagcctgttaggtatgtaaggctagtaaaaggagggatgcaatattttggcaaagtaagaagattatgcatccttaaaaagataactaaatggtctttattgttcctactctggttaattattttctgacaattaatatgtatcatccttattagactttaattataatgcaaattaagaattgcaaagcatgattttccacatgacttaatatgtaacacctgtaagctctttgaggacagggatcatgcattatttgaatgtctcacacgaggaatgcctcaacagatttaacttcaagcaaaatgtatacaaaatgaagtatgactttgtgacttctattagggcataatactgagtaattaaataatacactgtttctagttaatatcaacaatatacatttcattggtttcacaactgcttaggaggaatgggttttgagatggttttgtaacaaatagtagtccaattaattctttagtacagttaaaaaggttttgtcaatagaaaaatgagtgggccgggcatggcaactcacacctgtaatcccagcactttgggaggacaaggcgggtggatcatgaggtcaggaatttgagaccagcctggccaatatggtgaaacctcatctctactaaaatatacaaaaatgagccaggagtggtggcacgtgtctgtagtcccagctacacgggaggctgaggcaggagaattgtttgaatccaggaagtggaggttgcagtgagccgagatcacgccactgcactccagcctgggcaacagagtgagactctgtttcaagaaaaataataataataataataattaaataacaaagtgtgttttcccccttgagcattatatttaaaaaataaggccagattcttatagataaaagataaaataagagataaagttaggttatcctattttcctgttctgtcataaagacaaactgaaatacatttaaatttcactttttagatacaggatggtccaaatgatatagtcctagtttaattattgaaaagctagaggcataaatatgctatgttgaagaaaatatacataatacatataatggataatatttgtattcttttatggttataggaataagataattggttgattatctaatatatggcatgccctttagagatgttatcccatttaattcctgtaataatatgaagaagagatattatctgcctttttaatatgatgattagaagtatcaggaatttaagtaacataaattcacaattacacagcttctagatgttaaaaatgtaatttgaatttaggttgcctgacctgaaagtacagacattgctttaatcacaaaattgctgtctatctagatggtaagaaacctaaataacatttgtgacactggatatgacatgttgcttaattatatataccaatgtaaagacattgttccgcctttgcactttttatttttgaaaacattaaaagtcaaattcttcttgctcaataaatggctgtattaaagaaatgccattgaaaagccagctggaagagaatgaggttaaagctgtggttctcaggaggaggtgggggaatgttgcattccaggagacttttgactattgactgttacaatgtatgtagcggtgggatgggtagggagaggtgctcctggcatccagtgaatagagcccagacatgctgctaaacatcttacaatgcacaggatagaccacagcaacaaagaattatccaacccaaaatatcaatagtgctgaggctgaaagagagggttaaagcctttgtatggagcctacacaaaaagaagtaggggactctttttgtctgtttattttggtttggatttctgttggatttaaagatcggttgctaccagcattacttccttgtaggatactggttgtcttctaacaaagacatcttcatttttaaagaccttcattcttgtgattggaattttaaatcctgtgcaagttaaggaaatgttctcttacatgttaaaattgaacacagtttattctttactgcagaaatttcttcctcattcagtacctgacaaagccacttattgtttcttataagatttcctgatccttgagacacaaagcgatgcttgagtgcatcttttgaattagcagattttggggagtgtatgcaagacgagtaatgaagttagaaagtaatttaaatctaaaaagaactcaatggagtttatttagaaagaaaatggtttagaagatactattcttttaaaaaaattggttttatcatgtctgaagagtatacacagatatgatttttctttcagacacatgtgtaattcctatcatggtaatatgttgaatttaacatttatttaatgcttagtgtttacaaggagccaagagacacatttgtcaacatctgcaaatggcaagatattccacagcaaatagaattgtttgtgtgaatgttaatgtaaacctgtaaaggacacaactctttttgagatgcgattgtatcaatattaatgtaagaggttttctatcatacatttacctcatgtgctctacctaaaaacaaacatctcttgctgcaatatggatattgatgtcacaacctgacaatttaaattagatagttctgctttgttacgagaaactatcaaactcggatgcaggcttctaatagatgtggggcccctagaattgttgtccatttcttgtcctatagaaccttccctctattatctggcatattaatagcaatttctccttgctgctcagtatcacaaacttgcccagaggcaaggaagcaaaaagaggctgtcttcttggaatttgagggtggggacaaaatatatgaagacaattttatgtctgagtgaattatcttgccacaggtgctatatttactggtacagtagaattgctcaaattttatattagctggtggatatattttccattgtcacaaggcctattctggatgccatacaattgttcaatacccaacaatgcatggtaaagccatatgtatgtatttcaaaaagcaatagtacactgtacaaaagtgtgagaggactggtctattaagatcagtttaaagttggcattttaggccctctaagatggacattaaagtatgcagaactgatccagccatctggagggctgaaaaaaaaatgattattatccctgaaagttgttaatctctgaaaatctgccaaacacctgaagaaaactgctaggagattctaccctcaaacacagacccaaataggctgtattggtcaccattccatttttgaaagctagccggctaaaggaaagatatcatttaggaataatggctccaagagtaaattctccaggaaatcagacatctaattagctagatcatttgctgggcacagaatgtcaggagtatcagtttcttttttatttttttaggagtatcatttctattaatttattgttataaatttattcttgacaaagcagggttttttttgtttgtttgtttttgctgtttttttctatccactccattgggactaagaaccaacctatgtttcagttacttgtgatacacctaaagtatgtatgagatgagagcgcttggaatgtgacataaactaaggtgtaattcagtatttcaggacaataacttcctgagggatgccacgctgggctcatgaaccaagagtacatgactgacttaggtgagtcaagcagatgcggatgtgagccctcaagcacagaaacctgctcagtgaggcagggagaggaatgaaggaaaatgatgtggccacagagcctagatataaccagcaggcagtttaggcacaggctttgtagggcaaaacttcctgggatcccaattccaaaagctgtctgtaccaagatactggagcaggcagggagaatatccaaatgatggcccaacactcacgcaggtggcaagacctctaccaagagacaattttggtaccagatcgaacttcaaggaactggcatgggccaggtaaagtcacctgagaggagggtagtggtggaatacagaatgtaacagtctcttagtacataggaaatggagctgctgaagcacaggaaaaggacaacatgatgtggtgcggggaccactgccccttcactggtatggaccatctgggtcaccttagcatcagcttccttgatctgatggccgtaaaaatgcctgggcctaaactaggtgctcactattgggtttgccattctgacttcattccaggcttcagctcccatcagaaatgaaggggcaggagtttggacacaaaggctttcagcaagtgttaacttatcttggaaaacgaatagtctcatctaaaaggtgaatttatgtgaggtacaaaggaagatagagtctggaggtggggtgacattctgagtaagtcgttcgatgccccaagagagaaggttgcgataacagtacaaggcattttcttatgtttgttggtgggcttatgtttctgttttagattcatctgtattgatctatagtgatgctcaaatgaagtatgtggctctgtgcacaggacaattccctgaagtgtgtcctcttttgtgaatgtattgtgcttcttcgaagagccctttatgacttttccacatcacattgattttttcctttttaaaaattttgtaatgcagctagaaaaatgtaattgagtgtttaaacaatccttgcttcatagtctctaaatgtttcaaatatgtaattcttgtttttttaaaacacttgtaaggggggcaatctgttgcttttttcttctaggaggcctaacagtgtttggctagacatgtgatcaaaacatcttgttttttgatcgatcgattatctgcttgaatcaaaaatctgtcattgactggaaacacgtattaattgtgtgacattgtactcagaaaacagtagactgaaaatcgatgactaagagttctaatcctaattccatataagtttttttgtgacctgaacaaatgatgatttttaggttacttatctgtaaaataaaaatgtggtaaagggtttacagttagaattaattatatatgaaagcaaactttcagatatttagacagactgaaatgagaggaaactagatcttgctactggtcccattttgagtaatgttgttaaaaataatctacaaagcaatttgataccctgaaaaatagagcgtgaatcgaaaagaactttccttaatattatcaacgtggggatttacttggaagcatttccccatgttcacattaaattttctagaaaaccaatgaaaaagtgaactatatagcagtcctgtgcaatttgaaaaactacatctgcatcttctagagtctgttactataatacttcacagcattttacaatcagtatctttagtgctataacctaatgagaactatctggtgagtgtgattagaggtaaagaatgtctgaccttgtaatcatggaattatttttctaataatgccttcaaatgtatttgaatggaagttattattactaaatgaaataatcttagaatcacagaaatcattataccactttttaagcaagcattcactgactaggaagcattaaaaggtttttttgtaatttgtaaagtgatgaatattagtataataaagaaagtagaagtagcctaagctgatgtctccttttttagttatatgatagtcatttaaaaattctgaacctggggccgggtgcggtggctcatgcctgtaatcccagcactttgagaggccgaggtgggcggatcatgagatcaggagatcgagaccatcctggctaacacggtgaaaccccgtctctactaaaaatacaaaaaattagctaggcatggtggcaggagcctatagtcccagtactcaggaggctgaggcgggacaatggtgtgaacctgggaggtggagcttgcagtgagcttgagattgcgccactgcactccagcctgagcgacagagcgagactccatctcaaaaaataaataaataacataaaaacagaagaaaaaattctgaacctggttctttacctgtttaccccttcgctcccctatttctccagacatagcaatatgaaacggtgaagaaatgcttctcatccaaatttataaccttttttgtcttgctaagtttcagattcagtatcttcatggaaaaactttgaattaagcttgaactctgatatggccatgtcatgtggctttatgtttttacagaagaggtatgtttgtgttgctgaggtggtagttgatgatgatgatgatattttggtggtgtaaaacttgaaacgcttatctgaatttttttctcatcaagaatggtatatttttatgttatagcaagtgaagaatatctttttcaatgattatgggttaggggattatggactttttaattttcatcttttgcacttatatgtattctccaaattcccttattttatatatgtacacatgaatgcaatatacacacacacatattgctctaatgctaggaaaaggaaaatttattttggtgttttaaaagcatctaaaataaagggaaggaaacataatgttggagattcatgaatgcatatagtgctcatactaatgatcattctgagaaattaattttgttctaaatgagattacttctttttatctctactcagttctatagttactgcacagcattaatctataatagccacgggaggtcactggcattttttctatgcagcaggatatcccactggtccaatgctatgacacaggtagctagtgtgtaggtttagacaatacttcctcctcaaaacccatctggatgggctgatttatgtggaggctgagacatctctggcagtggaaaagacaagacttctgtcaatgttggactttgaataggtacaacatatctaattggatgcggttgtgaggtactgtgaaaaaagcaagattataggcagggctgaactcgtcataaagaatgaagtctgtcatagtcagcaggatgatatagccgtgtgtggcaacaggtaaagtgaaccaggcaggtataaatatttgaacaggaaaaatctcatgtttcctgggtatgggtccaagtataaaacttctaaatcacagcacagcagcaagtgtttgcctttcagaggagcttttgtggacaggatgggctgacagcaatctttgactgacctaatctttggagatctgcacgtcagtgggttcaggggctgaaatgatcccctggggccagtggtagagtccgggtgtagttataagaggagagcgccagcctcagtttttgtattaatggtggtggcagccctgcaggaacaagggcctgtgcatcagtggttctctggcattgtgtctgggagagaatgatcaacaagactgtagttgagactacagtgtgaccaaataaattgggcagagagagacacatgtaagagacttccatctctgatctctggagaagcacagagacttttgtattccaatatagattgatttttataaaaagatggatttaaggggctcatagccagtcatctccagtgttgtaaatggcaaccaaatatttagtagaaatataaatccaattacatcaagcattatttaacttacacagtcacagaattcatcagtgtttcattattctgacattttttaaggccaagtcatcaggttgtaagagggaattcataaggacagaaaaacataatcgtgctacttcctttgctattacatataagtaacaatgatagcaaacatttataccctttagatttgttatctcactgaattatctctgtaaccttatgaggaaggtgcttttttaaatcactattttatacatgggaaaattaaggcagatggaatttgagtaattttcccaggatcctacagtttacaaatggtagaaaagggatttgaactcaagtagcatgtgattacccactatgttatgcccaatactgggagaaatatgctatgctagaacatgctatataaccaataaatggaatatttatttgaactttatggtactttttgactgtgtttaaatgatttatttaaatcaagattccatctgagtttccctactacatagtgcttgtgaagagttacagtgacactagttaacatgactgagtagttggtggcttctattagcagtaaattgatgacgtgacaacctggaatgagaagaagggtagaaaacacagaaaatgtttgttctttaagagtttatgatttttttgttattactgttagggaaaacactattattgtagtatgttttaattaaagatgaaataagatagaggtttgtatctatgatatcatattgagattaattcacttaatggtagcagtgcagcaatcgataaatgctttgactttgtactaagatgaaagtcttacttggataaaaacttacagagctgattttgttaccttaggaaaggcggaatgatttaagcttggcaaatgcatctaaaataagtgttcattattctatttaggtaaagctggagggatttatctggtgatgtgctttatgactgtccttggctctgtctacctcaacaatttaataaataacagaatgaggacattggttgcagagtgatcatatttatgctctatccattcacttacacagaaattcatatttacagagtacctcctatgtgtgccaggcactatcttaggacatgaaatgcagcagtgaacaaaacacaaaaaatgtattgccttcatagatttttacattaaaatgtggaaagagagtcactcacacacaaaaaggacaaacaaaacatataccatattagagataggcactgtataccatattggtgataggcactattaataaaacgaatgaagtgggtagaaagtgccaagggttcacaatttttaatagggtagtcaggtaaggcctcgggagttgttgacatgtgactaagacttcacagatgagggagtacattatttagatatatgggggaagagcagagggaacaagtgcaaaggcctgaggcaagaaacatcaagtgtgactggagctaagtaagccagatgtgatgtcagagaggaacagagtgaggccgtacccgcagagctttgcaaatcatgaaaagatgttggctttacttgtgagttagtcaatgaagtattcagaacaaaggtgttacatgactttacttgttttttagatggtgtgattctagttgatagggtagaaaaccaattgtaggaaaaataaatgatggaagtaaggagagctactacagtaatgcatccaaaaggtgatgataacagtaattattgaggtggtagctcaatttctggatatttgttcattattgaggtaaaatttacattattcatactgtgtaccaggcactgttttttatgatatattatggtttaaaaaagacttaacatgaggtctacaatcttagcaaatatttcagtgtacagtacagtgttgttaactataggcacaacgttgcatgcagatctctaggacgtattcatcttacataactgaaattttacactcattgaacagcaatctcttatttccccacctctctttcagcctccagcaaccaccattctaccctctgcttctaggagttttactattttagattcctcatataagtatctgcccttttctgcctggcttatttcaccctgcgtaaggtgttcagagttcattcatgttgtcacatggataggatttccttcttttttaagtctacataatattccattgtatgtatatcacatgtttttcctactcatccatcaatggacctttaagctgttttcacatcttggctattataagtaatgttgcaatggacatgtgaggtcaaatatctctttgagatccctattttaattcttttggataaatgcctagaaatgggatatttggattgtttggtacttataatttttcaaggaacccccacactgtttgccatagaagatgcactgttttacattcccatccacagtgtacaagagttccaatatctccacctctttatcaatacttgttattatttgtttcttggtaatagacatcctaataggtacaaggtaatatatgaataggttttaatttacctttcctgatgattagtgatattgagcatcttttcatatacacggtgttcatgtgtatatcgtctctgaagaaacatctattgaaatcctttgcccatattttacttgggtgaaatatggcaagaggtgtggctatttatttgtagtgattccttatatattttagatgttaaacttttattggatatatagtttgtaaaaattttctctcattcaagacatttccatacagtagatttctttcactttgttgattatttcctctgttctgcagaagcttcttagtttgatatagtcttacttgtctcttttagtgtttaatgtctgtgtttttggtgtcatatccaataactcattgcctagaccaaatatcaaggagcttcctccctatgttttcttctaagggttttacagtttcaggtattccatttaagctattaattcattttaagttgatttttgtctatcatataagatagggtttaatttcaatcttttgcatgtggatactagttttcctaccaccatttgtttaagaggctattctttcctgattagatacactggcaatcttgtcaaagatcagttgaccacatatggatgagtttatttctggactctctgttttgtaatattggtttatatgtctatctttatgccagtaccatactattttgattattttaacattgtcatgtattttggaatcagtaagtactgtattttgaagtctgaggcctcaaaatttatttttctttctcaggattgattttggcttttcatggcctgttgtgggtttctagtgaattttaggattatatttcctatttctgtaaattatgccattggaattttgatagggattgcattgattctgcatattgatttgggtggttggacattttaacaatattaagtcttccagtctttggacttttgatgtctatttgctgtgttttttaaaatttctctcatcaatgcagtgtttttttgtaaacaagtctttcacctccttagtttattcttacatattttattctttgtggtgcacctgtaaatgacactgtttgcctaattaccttttcagatagttttttgctagtatacagaaatgaaactgatttttgctggttgattttgtatcctgcaactttactaaatgaatttatttgttctaacagtgctttttctggagtctctaatgttgtctaagatcatttgtctatgtgtctatagactttagtgttgtctatgtataagattatgtgtatatatgaatacatatatacgatcatgtaagatggagtcggaatattttagttctttctgtttttgatgtcatcagtttctttttctggcacagttgctctggagagaacttctagtaatattctgaaagaagtggtgagagtggcattcttgcctcattcctgattgtagagacaagctttctgttcttgttaagtctgatattagttgtggacttttcatatatcactcttgttatattcaggtaatttcctttacttctcattttcgagggtttttatcataagaaggtgttgaattttgccaaattctttttgtgcatatgttgagatgatcctgtgatttttatcctttattctgttgatttgctgtatcacgttaactgatttgggcatgttgaacatccttgcatcacaggaataaatgccgcataatcatcatctatgatccctttaatgggctgtgggattccatttgctagtattttttgaaaatttttgcatctatatccatcatagatattggtgtgtagttttcttgtggtttctttgcctggctttgatatcaggataattaccagcctcaagaattgagtttgtaaatgttccctcattttcttttttttttttttccaacagcacattgaaacaatattttactattatcgagtgcagtttatcccagggatgtaaagataatttgacacaggcacatcaataaatgtgatgcatcacattaacagaaaggacaaaaaccctctgatcatttcaaaagacacataaaaagtatttgacaaaattcagcatatactcataataaggaaaaattgtgtacttgattaaatggtttctgctgcttttttctcttttctttttaaaaataatttcaacttttattttagtttcagggagtgcatgtacggattttttgcatgggtatattttatgatgctgaggtttgaggtacagatgaccctgtgtgatgagcataataaccagtaggtagtttttcaccccacatctccttcttccctcctttagtagtccctagtgtctgttgtttgcatatttatatccaagtgtactcaacatttagctcccacgtatcagtaagaacatgtaatttttggttttctgttcttgcattaatttgcttaggataatggcctccatctgcatccgtgttgctgcaaaagacatgatttcattctttttcatggctgcataatattccatggtgtttatgtaccacattttctttatccaacccaccatgagtgggcacctagattgagtccgtgtctttgctattgtgaatagcgctgagatggacatgcaagtgtatgtgtatttttggtacaatcatttattttcctttgggtatatatccagttccctcattttctatttcatattttaaatatttggtagaatttagtagtgaagtcatcttatcctgggcttttattttttgagaggtgtttgattactgattctatttctttatgatgtagttttgatatgtgtgtttctagcaatttgttcatttattctggattatgtaatttgttagggtataatttttcatactagtctcttatgtgatctaacatatgaaatactctggagaaagatgcatgtctgagaagagtgtgtattctgctcctgtttggtagaatgctctttaaatgtcaggtccattttttctttaatgttattcagattatctgttttcttatcgatctgtctggatgttgtgtccattattgaaaatgaggtgtgaagtctcctgctattattgtattgtggtctatttctcctttcagttctgtcaatgtttgctttatatatcgaggtgctctgatgttgagtgcatatatatgtttatcatggccctatcttcttgacgcattgacccttttatcattataaaagctttttctttgtctctgaaatagtttttgacttaatggtcatttgtctgatgtacccctactctcttttggttatgatttataatatatgggatatcattttctatcccttcactttcagccaatgtgtgtccttaaatctaaagtttcttttttttaatctgttcagtcactctatgtcttttgattagagagtttaatccatttaaagtaattattgataggaaaggatttgctattgacattttgttagttgtttcttattattcttacagtacttttgtatgtcttcctctcttgttttccattgggttttgttggggttttttttggtattgttatgcctcaattagttttttgttcttgttgttttgtgtaaattttacagatttgtatgtgtgtgtgtgtggttaccttgctacttacataaaatatcttacaactgtctactttatgctaataagttgaattgcatacaaaaacttacaatttaacttcctccccagaacatactttatgttattattttcaaaatctattcatattatttatcttttaataattgtgtttgtatctttatagttttcaaaataattttttcttttaacttttatgctagaattaaatgtgttttacccaccaccattacaataatacaatattttatatttgtgtatatatttacttttctcaaccagttttatactttcttatgctgtcatgttgctgtttaatgccttttcattttgaattgaagaacaccacttaacatttcttgtaaggcaggtccggtgttgatgatctccctcaatttattttgtttggaaaagtctttatctctctttcatttttaaaggacagtttttgccaggtggagtattatttgatgacagttttatttttctttttccttcagcactttgaatatatcacctcatcttctgccctacatggtttctgttgataaatttactcatagtctcatggatatttccttgtatgggactggtcacattttcttgatgaattcaaaattctcgtttgtctttgacttttgataatttgattataatgtgcctcagtgtgtatttctttgaatttgtcttattgatgttctttggatttgtggatatggatgttcattaacttccccagatttgtgaagccttcaacaattatttctttgaataagttttctggttgtttttctctattatcattaagagacttccataatttgtatattggtctgcttgctggtattccataaatttcttaagctttctttaaatttttttctattctttttttctctttttactcctccgagttatttccagtgacttctattccagttcgctgatactttcttctgcttgatctagtctgctgctgaacccctttagtgcatttttcaggtcacttgtgttcttcagcttcatgattttggtttagtactttgtaatattttctctttctttgttgaaattcttactttcattgggctctcaaccttatgaaagttatttttaattcattgtcaggttaaccatttcattagggttgatttctggaagtttatcttgttcctttttttggagcatcttagtcggattcttcatttttcttgactctctctgttggtatctgcacattagacaaagcagacacctctatcagtctttactgacttgacttgtacagaaggctcccaccaatcaacctacccagggattctggtggcctctatcaactcttttcctcccacaggaagggaaggcttttgtcagcttactctgtgataaactgaagctatggtgtctataacccactgtttctatttttcctcaggtggctagattgtgccatctccatcagagcttcaggactcacaaggcagaagctagttgtttaggaagccctagagatattgtagcattggatacacagatcaactctttcctttccaagaagaaagctgaaaaaaaattgggattttttttgtttgttcgtttgctcactctgtgctgagcagtggggagtatcaatggcctgtaccagcccaagatgttgcctgcattcttcctcaggtgtctagactgtgctgggcccatcagagcttcaaggctagcaaggcaaaggccagttctctgtgtccccccgccccgactccccaccctgcttccttggaaatgcaagggaactgaacatgggatccaagcccttacctcccctgggtgaaaccaggagcttgggcatctctttctgatcttagggaaccacactgagacaagggtgtctggtgagagggtgtttcatatctctctgtcagcttcagtgagtctggttttgcattctcccaggatgcaggaacctttcaattagtttctgatttcccacacagggaattcttccatcaattgtggctgaatcgatatgcttgtatgaagaaggagagtctaggatttcctgttctgccatcttgctgacatcactctgctacattcttgtatgattagttttgtaggcatatgtttttatgtctcttgggtaaatactaggaatacaattgttggcatacagagtaggcatgtatttaacactgtaaggtatcttccagtttttcaaaatgtttgattttcagtctgactagcaatatatgagatgtcaagttgctctgcattctagctaacgtgttgtgttgtcagcctttttaatgtcagcagtagtgctatgtgtgaagtaaaattttaatgaggtcttaattagcattttctggatttattttttatggacattgagtaggtttatgatgattggatattgtttcaagggaaagagtggtaaaaaggatggcacaagggacatttggccttatcaattaaaaagtagtattgtccattaacagaaatggggatgactgaaatatatgcaggtgggggcaggaaaaggaatataaaaaattcagtattaggtgtgttaattttatattcctattagataagttcaagtagagatgtcaagtaggaggttggctatatgagtttaagttcagggaaatatctatttgaaaatcatcagcatatagatgttaataaagccatgagatttggtgagatcactaagggaggaattttaagtagaaaagagctgagaactaagccctggactcctccataattggacccattaaaagaaaccagaaaaagattttgagattaagtagccagagaggacagaagaaacgagagaatgtgacactcagaagcccaataaaggagagttttcaatagagaagtagtgattaattgtgcctgatattgcccaaagggaggattctgctacattcttagggaacaaaaggttgtggtcagagggtgggatgcttgaagctataattatattcagttctagttattagtaatgtaaaggtctggagaatgatgattgagacagtggctctattaggctgaaggacaagatcacaggaagaaaggaatttaagagacaggtcagtttgttggaagcatgttggaacaagtgatatgcaattggaaaagctttttaaaaatgtgtgtgtgtatgtatttgacaagcaagaataataggctaaatctgtcaatatgtcatttactaagattaaaaaaggaagttttgtattgaggtgtaatatattaaatgcatcagggaaataattatttaacgttaggctatatatatggaatttaatggatttagttgactgtgaacttagtaaagctttgccattagattcttaatgatttccaataaattttttcaaaaaggacttacaaaaaacatggttagtccttatctgtattaaataatttcagcaaccaaagtaagaaaggctgctcctctttacaagcataggtcagccacaccttaaatgtcatgtgccttcacatattctatattgagcatatcaaaggaagagagactaggattatgagcgaagttcaagccttatcacatgactatagtgttatcagacagacaatttcatatatttcccttgagaaaaaaaaattaaggaaaagtaaatgagtggcattttatattcctccttgagcagtagtgacaggagaatgtagagatacccctgcttggcagtattaagaatttttatattttagtgattgatagcactgcttaatcagcaatgtaatccttaaaaaattttgaaaatcagtaaacgagttaactttatggtgaagacatcacattttctggattctaagacaccatcagttacaccatataccattattttatgtagcaaactgccattataattatgatatgccttcatttttaaaactcattctgatttcagaaatattaaaatgtgaaaaaagggttttggtatgtatagtgatatgtagcaattaaaaactgtagctcctcaactttttgttttgaataatgttggtgtcttagtgtgctatgtatctttcacataatccaaatctacaaaaatatatttttgaaaacacatactttttactaaatatcaaatgcttttttatataaaatattatattttattatagttagaagatagctaatgccttctctgaataacttttcaaagcacgttcagctcttagagatcagtaacaaaattcttattgggttaatatcagtttttcagataaaacgttattcttcatttgcttcactgatgccatgtcttttgactattagtaacaaaattaagtctacataaagaatatgttagagataccatgtatcctaattactccacctggggttccttcagcagtttgctctaagttgctcttttggctgtgttgtaaagtagttcacacacttgtaccttctggtttatgggtgaattttgtcagtgcattctatctttatttgtaagagttcttccttgaagtcagattaggctatcgcgggaacagcatgcttctaagatgtttgtgtaatgttgattaatgtgacattgtattgtaactttatggtaataattctttatcatttaaaagcatcttgaattcaagatgtttttactttaatgcagattttcttatgaaggatcctaaaaacttggatgcaataatactgctgaaaaaaacattgtttttgtttttgtttttgtttttttgtgtgaatatgcaccagaaagctggactttaaccttaagtaaatttagtggagagcaaagaagtggcacttcacgaaagtgctatgaagcagctatttctaacatcaaaacatccggtaacttgtaagcttcatagttttctaattactgaatgccggctacatgtaaccatagccattatataatcatgtttaaagatgagagtaaaggaagtggtaaagatctagataatatgtaatcttatttagttaatgtttatgaatgatgcagaaaaaataatttaagaaaaacactaagccatagatatactctttcacagatagccaagtagtgaaggcattaggtacagatcattttggaagtatgtacaggagaatacgggatggatataaaattctgcttatttcttaaagtaattagctataaaatgcttttttactttgaattattaacctttctaattatttgccttcccaccaagaaaggcatgagaggtaaaggtgggatgaatcaatttcatatttttcaatagcaaatttgaagtgaattcaattttggttaaggtagaaaaacttatttcatagaaaaattctgtggggaggtccaggagaaaaattaatattgtatttgcatgccataggtaggatcacagatgaatttcagtggtacccaattacctatatctaagcaaaaggtaaagccatccttcctaaatgatctgtttgattgatagcatctttctcaatatttttgattgtacaggaagaacgcagcaaggcaaaatggtcagcacaggcaatgaatgagacagaaagctgacctgagcatctgcctgtgttctactctgttgtaattttagttgcatcggtataattccatattggcatcatgccgtctttcactttattttgcattgtcatataaagctaccattaaggcatatactctgtcctaaatctcatttgatctctaagtaaaaggtcttaacatatgtaacaaacctgcacgttgtgcacatgtaccctaaaacttaaagtataataataataataaaaaaagaaaatatgtagatgtaattggttattacattcaaattaagttcacattatttcattatgatttatgatttaacttgtgttatgcagtgattcaatagcttttcttattttgtgcctagattcattatattattttttataatcatataatatttattcaattttataaaatctgtcattataacatcacattgagtaaactcccatgtgcagacattaaaacagttaaagcagaaaaaaaaaaaaagctatcaggaaagatggcataccttaggaggtttgctaactaaactaaggaaatctggttctctttctcctcaagatacagccctgtagatagctgcagatttttttcaactgaggtctttgtgacatcagagtattagagtattttctttccttcttgtattctggaggtttaaacagagccctggggataaggcatgatgctatcataggaatagattcttgtcacaagggcagaaggttcatatgtcttttctttcaggtctttttctttagaactgatactctcatttatttatatccaaccttaatttaaaaagaggaggtatggctaaaaatatgcacacattgcaataacataaaatgaattaaaaaatcggaataaaaaggaaacaacactaggaaactcaaatgaagccgagattaaatttagaaagtagaaagggatgctctgcaatgtaaattggaatattgcaagtattgtctttaaataattttttcacttctaaatgaagagaaaacaaatgattataagatttgaagtggtcatgctattaatactaatacctcgggagaaaacaaaaacaatttttgcattccagttctcgtagggagcactgtggtgaggttaacggcatcctcaatgataccctctccagtgagtacaataaaaattattgtaggcattcttcttattgtctacatgtaatataagcccaggagtgacagcaacatgaaaactcagtaaaaagcacgtttataaaacagtgatcatctgaaaacagcaatctctgaggacagaggtctataattgtgtcattttgttactgggataaaaacttagaatatatagaggagtaaattggcaaagtcatcctgtacaggccggagtaaatattttggttttggaggtcatatgttctccatctctacctctcaattctgcctttgtagcatgaaagaaaccataggtaatgtgtaaatgaatgggtgtaccaataaaactttaagcagttagatggtgagccagatttggttcatggactgtcgtttgccaaatctgatctagagaaataggattttattcacattagagattcatctagtctgtaacttctcagagcaaatttttaataaatatttgaaaacaaagattagaaattcaagtacatctttgaaattaaagacctgaaagacattctattaccatgtaagggtactatatgatatagctccccaaccagaaagtggttgatatcttcatttaaaaagtaaaaaatttaaccagagttacctcacctctgaataaggaaggatgaatgagtgtaattaatcggggaacatttcccccttgccccaaattctgcattctccagaacaaatgtatgttcctatgtgactcatggaaagtacaataataaatcatgtgcacctgggaatgatcacccacctaccagatctgtgaacatgagcaagtttttctcacctatttttaactaaatctccttatcaggaagttgggcataataatttattcctcacagggttgctataaggcaaaatgtttagccattggatgaatgattgatatgaatcgatagatcatagtttgggccctaaagaacatgccagaactcccaaactcttgcatatgggactgtatctaactcacagacgtatttgctttgtcctgtgaaacatggactgtataagcatctgtgatgcaaatgagaaaaaaaatggtaactttacatgaaaaaatacattttagggaaaagaaaaacaagtagatctgactgccctgggcctgctgcattgaattaaaacagtccatgtgagcaaggcatgtggcctccagtgtgcacagctgctaccagacacctgtcaccctggagctcagactgggctctgctaccattcacagcccagcttgtcctgctgtgttgctttagtagtgtccataagaaacaaatccttcttggtcccatgtatatatcttttctttttcttttgtatacctggcctgctttgttttttttctattatgttgttcttgttaggatcccagagtaacgtaaagtcagggggttattagtagctctgtgataaatgaattctctagttaagtaagcttaggtatgcttaaggaagcaaagaaaacaggtgtcttctgtgggcctctcattatcgtttaatatattaatgaacagtttcagtttccaagataagagtacaccatacagcaatctcaaactcattttgacaaatacatttttaaaaattttattttaatgccctatatgtcatgaccacttaactactgaccacatttttcccatggaatgtggtttggaaacaatgctctttaaatcctcacagatcttgtaattttaaaataaacatcccagatatatttgttgcaaatggtatccaccaattacctgataattgaacctactttataacattagtggataataatagtatcaagagtaatatacttaagatttattgaaaacttataggcaacaggtaagcacttagctaggttattttatttaatctgcacaaaaattctgtaaagtggattgtcttatccctcttccataaatgataaaaatgaggtagagtgaagctaaataacttgctggcaagtaagacaactaaagtcttttacccttactcttagctgctggatttcactgccttgacttcatgcagtaagagttggaaacatatgctctaaattatatctaaattagattgatcttggaccgtgtttcttcctgtagtaatgatatataaatatcaactgcctgttgaaaatcacttgagcttttaaatgtaaaaccttaatacaagtagaaaagtatacgttagatttattttgtatttgctggaacatatggctggctaattcagtagattcaccaatttataagatttacaaagaagaggtcatgaaacttgatgcttttcagttttaaaaccgtatactatttgatgaaagtttttctaaagaaactgatactcatggttctattaaggcacagatttcttttaccagtccctgagggtactgattagtcctaaactgttctatatttaaggacagtgaaggctaaataaagatcaataaaagctaaaccgaatgttcctgaaatcttttctgcaaacggatagaaatttaaccgtggttagtagagaagtagatatgcctaaactccctttgaactcatgtaatcactcctcaccttgccctgccatcttgtgtataatgttgcccaagaggtacaaacttttaatttattaaggggaaaaaatatgacagagtgttgagacgattttcagtgaggtccagcaatgatctgtaagttgtaagaagccatttgttttccagtaggttgatggagaagaaatacacaaaataattataaaatatcaccacccataattgatgattatactatgtaagtatatatatttatagtatatagtacataggtatatctatacataactaaatatatgtatacatacatgttgtatttcactgataccaagatactattaattataataatacacatcattgatgcaatcagagtttttcagaaagaagataagcatatcaaacaggccaatttttggaagacacgttcagatttcaggaactatcagaattgaaatgtgtcttatgattaagtctgtctggattgctcactattcagatgtaggggttgatacaatgaaagaaaaagataagtttttctaggtagctaggtaaagggcaagggttggtagatctgggaagcaaattaatattttagcatgctgtgaagtttattttagaagctctaaattatgcgggtcaagttccaagccttgttgaattagttggggttgcctttaaatgggtcaccctctaatcatgccttatttgtccctctggtatatttacaggtactgaagatggatggggatcattaggtttctcttattatattgtcccacaaatatcttaaccgtgagtttttcagagtaatatttttccatttgtgtctacagggtaatatatatttgaagaactcatgaccatacatcagtgttcatgtttcactaagattgtttcattttcatccagaaaaaagttttattttatgtaaataatatgtatttttctggctctgaaaatgatgcatggtattgaagacaacttggaaaatgttggtacaaaatagattacttaaagtcacccataatagcccatttacctataatgacataatttgaactgtccattcgtctgctttacatgttttttgatataaagttgagatcacgtagtatatatatatttttaattatttccatttaaaatgaacattgtgaacatgttatctttaaaacaagatgtttagtctgggtagataagcaagcatatgttcaatagttttattcagtgaaataattgctgcttttatacaagttagactcaaattatccatgttattagactgacttcagagaggagagttttataggctatcgttttaaaggaaatttattgtcatataaagctcaacaaggggaaagtagaactaattatcatatttgtaacttgtcactgcattttgtgatactgtattaccatgagctcaggtggtcctagatgcttggaaattttaacaaaggaaattgtacaaattccaatggataatagcaacctcaaatttcatagtatttctgaaaacagcagaaagactccccataattttaaatcattgtcacaagtttacattttcttgagagtctctggtccttaaagtttaataagatagtccaaattgataaaactctttgcccctggttgaagaagtttccatagcatgatggtttattattctcttcccccaaagtatctggtgtctacattcatgttaaaaaacaacaacaacaacaacaaaacagaaaggaaataaatataagagaattgcatagaatttttagaaattaatttaatacacttgcttgtagccaaaaggccaataagtgattagaaattaatttagttaaaattatctgtagtataaatcatttttcctgtgattttaatctctattgtgataagtgttaggcatcacatttcaaaataaggttccttttttagctctgttatttagaattatatctagtataaatgtaagctgttactggattgccgaggtacctggaaattcactgcctttagccattggattaatgtgttaaaggtcaccttaaaaattcctggtgctgtgcaaataataggtgctcagtgaatgcttgactgactctctgatggaagacagctctaataggctcctgaaaggaggatggaaatctagagcattggaggggagaaggaggcaggagcttaggacaacatgattacgtgggtgagagagaaagccactgagaccaaaaaaagaaccaaaaataaattccaaaatgtaaagagtagctaattcttgtttttcccagagacagtattcttttttcatactattttttggtgattttcctttttctgatattatatcctagatagtttatgaaccttaagaggtttttgcatagatgtgcatttgttgcgcattcatagcaatatctaagactgtcatttcagagatttgtatcagtcatctagtgattgataaaaaaatgacatggaacctacttttgagattggatgatgacataataaagtagcttctcattttaattctcataatgactttgtggtcttagttatgttataagtaaatattgacctcctgaatcatatactaccaaatggcaggaactgggctctttagcctgttttatcctttcctctatatagttggatgactcagaaacactcaaaactgcaaggagataccactgcattttaaaacaaagttgattgcctaatcaatgttaagagacattgagagagagagagaaatctaagactcgactttggttaattggattgtccagttgttatcataatgcaggatactgattcatcaatatcactggccttttaggatgagtgatcacagtcttccatgtgcattactttattactgcctttcacactagacgatgcagctatgatgctgtcatacttgcttggtctgaaaatgttgacaagtattgattttctacaaaataatggtacctattaatctcatgttttattaatttctaattttaaaaagcatgggttcagttgaaacattacactggaaaagatgttttatttttgtttataattgtgaaagagaagattttatagcacctgcaactgtctatcacaatatgcagcttcattgtcttttcttgatttccagtagctacctcaataaatcacttatttttaatgtcattcatgaagagtatataaattattgctcttccagttaaacacagcattaatgggaaattgttaatgggaacttgaatcatataaagtatctagaatttcaaaatgacaaatctattatttgttatgaataatagtcctgcagattaatatagctacttcttttttccttttacaaaatgttaatcattcagcctaattctttgcacaatagaagaggagacaaatgttaaacaagacaaaactgtgaattttgaaagatgtctcctactcatttctacatataggatcatttctcactttgtgaaccatagcagaatagaattaaaaataaataattattagtattacgcctgtctttgtattgttttttcttctttgtgtctcttatgcatcactgcatgatttagtaaatattgttctcctgaatcaagatatgcagatgatatttgctttggaagtattacagaggtagaggttgatggatctgaactgttcatcattgtgtgcagttggctattcttttcagtgtggccactatcgccttttcctctatgtacttgtaactagagctaatattgtagagtccatttctgcacttattcaaataacaggtcataggtaaatatgaacttgaataagtgcacaaatttcattgtgtcactgaaaaattattttcaatttgattgacatttgcaaataggaggccgtacttatttgaacatcacctatagatgagtcttgttctacctgctgggttgccaagtctaaatatttttaaataacagtggctatacaggatatagataaaagtcctttccataaataaacaaatgtatacaagagtatgtttgattattttatgaggattttacaatagcttttcaggattcagtttcaagtcagttctctctttctgtctctgggggcttgcatgtataaacatacatgcacacgagtgcacactgtggatgtggattatttcattttacctgcatgaaacattgtctgtagtggccattactctgttcctctttattctcttctataaatctcaaattactctttaatatgtgtttatgagacatcaatttttatctgctccatattttaagaaggcaaacacagttaagtcaaaatgactaatgggatggtagggaaaagtatgggctgataaaaattaaatagggcacaaatgattcccctccagagccatccttttaatatggccaattattatgaataaaaaacagcattctaaaacatttcttttaattaaatgttgtaataaagatatatacccctctgctttccaagccacatgttatctgtactatgcttcagcaggcactaacaattcaagagcagttttaagctctagaaccttttacagaagcataggagtcttatttcacaggtttttaaagtgttatgcataatttttgccagaacacaaaagataatcattggaaaaaatctactgtgttttcatcctcttctgtgaacattatttcacctcactactctcccctgacaacactgcattctcaggagcattcacaagccacttgtcatccttcctttgttcccttccaggtcacactcccctagagttcttgaagtgtttcgctcttggctcatcatcaccctcttcaccactactcttgttttaattactgatgatttcaacattgtggtagattatctttctaattatctggcttctcgggtgggtctccctgacccactgcccttcaattttctgtccttcatcctaactcaggcacccagcccatgatcatttcctgcaaccactctgtattctcaatttcaaattgcctaatttccacccacaatactgtctgtctatctttctccctctaatactctagctccaaaaatatttcagtcacacctggaatctaatcctatcatgttttcgcttcctcttgtcctcaccttgtagcaaatatgccacagttccctagtccattgtatttcctacttatacagtagacatttttttcttgactattcaaatctctgccatctcttccttcattctccctcttacttggctaacttggttcttgcctcactgagaaaattgaaggtattctaaaactttcacaaactttcatcatcacatttaaacatctatctgcaacttaactctatctactattgatgaattgtccatggtcttattgaaagccacctcttccaaatgtcaatgagaaccaatcatccctactggaggacactgatttagccgttcagtattgcccaatccttcattacagagagacaaatagctgggcactgtagctcacacctgtaatcccagcattttgggaggccaaggtgagaggatcacttgagcccagtctgggcaacacagtgacatggcaacatggtgaaaattcaatgcaagcctgggcaacatggcaaaaccctgtctctacaaaaaatacaaaaattagctgggtgtggtagcatgtgcctgtagtcccagctactctggggactaaagcgagaagactgcttgagaccaggaagttgaggctgcagtgagccatgccactgcactccagcctgggtgacagaatgagaccctgtctcaaaaaacaacacaatagacgtgctcctgagttatttttaaaaatcaagatcagtttcacagctatgaaggatgatatgatatgatatgtttctgaattagaataatacatatatatatagagagagagagaagaaaatgttatataagtaagttctgaattatgtgttatagacttaacatttgggcatcagtgatgtaagaactattcagaaatgacttccaggtaagacttgagctgtgcattcatggatggagagattctgatatgtggaaagaaaaagcagctgtcccaggcaagagaacacaacacgagcatgtgtgcagacgtacaaatgagctggtatagtcacggttcagaggggaagactgactacctagtataaaggcttcacaagattgttcggaaagagaggtcatagagaaggattcttagaacctgcttcatgatggccttgactttgaggcctaatattagagatgacagtagaatagtcacatggaaatatttactagttaattttgtattttcagaactgagattggataatagaatacactgagtttcatgtcttctttgtttttatacttagaatcttccaaactgagttcacatgccatattttaggatggaggaaaaagacatattgagggctttgaggctgatggtttggtgagcagaggggaaaagcctgggcacatccaaacttctactcactcattaagtgagatgcaggagggacaggcctggtcagcaaaggaggctgtccctgtgagcaggctcacactcaggttcagtttacatttccgccaacctgggcttcaaggtatcaggaggagacagaaggccccatcaggagagtgaggaggtcgatggttgctattcccgttttttttttagatggagtattgctcttgttgcccaggctggagtgcagtgcgcgatcttggctcactgcaccctccgtcttcttagttcaagtgattctcctacctcacactcccaagtagctgggattataggcaagtgccaccatgcccaactaatttttttgtattttttgtagagatggggcttcaccatgttggccaggctggtctcaaactcctgacctcaggtgatccgcccaccttggcctcccaaagtgctgggattacaggcgtgagccaccgtgcctggcccatggttgctattttatgtgttggcagttgggagacctgacagtcatttttctcctaacaaaccaggtcttcacctcacctaaggacatctgatgctgttgttagcatagaaatctcatacctgcattatggtgcagttgaaattttctgatgatggaaatgttctataatatagatagctattgagcacttacaatttcgctagtccaactgagaagcgaagcatttcattttattttaatttatttgaatttaaatctaaatagtcacatgtagttatgggctactaaatttgatagggcaactatagagctaacctctatttaatatttattgggtgtgtcatgtgcctggcctaatctaagaactttatatgtacccttaatattaactatttgaatttccataataatcacaaggattaagcattcaaattttccccattatagtaatgagtgaactggagtagagagaggtttagcataggaaggaaatagcaaggttgggatttaaacctagttagtatatttacagagcttacacaactgtgtctccccatctttaagttctaagttaatcttgctcttctttcttgctgacattcatacatttattcctgtatgttattactatgttcatttatctataaaatatgtcaatctttcttcttgaggtgttatatttttctcccttaccactgccactaaaagagtgcagattcacttaacgtgtgaatgtctgaatacgtttctgatcatcatcctaccacccctctaaacaagtgccagtgaaactttggtgtgcacagaatcacatggaatacagcgtggttgtttctgatacacgaggctcagggtgaggcctgagaatttgaatatctaataagtctccaggtgacagtaatactgcttgcctgtctggagccaccctttgcgaccctgtactctgccttgcaagtctactgccaggctaattgactttaagatagaattgtcagtacgttttggattctttcactgaaagacataacttttcatcattatttgtgtttttgtatgttgtagaaatattaaattatctttttgtcaagagttgaaaatccaactaaaaataatacaggaaagaaggaggagaaagggaagaaggaagggaaagaagcaagaaaaaaaggaaaattggtttatgtaactgaaagcccagatgtagatcaccctctaagatttatgctgagaatgccatcaggtgcccatcaggacagatgtgcctacaaagctatggagaccacaataatatttgaaaacattaaatgcaaatggctattattggaatgtcttcattttttcacaaaggacatcaatgtttcacatgtattgttttacacatttatatcacccccctcagttgaagatttagagtttgctactccagaattaggacaacagcaaatggcattaaggttttgtcactcgtttcttttctccttctgaacagcaatcttttttttttgagacgaagtttcccttttgttgcccaagctgaagtgcaatggcgcaatctcagttcactgcaccctctgcctcctgggttcaagagattctcctgcctcagcctgccaagtagctgggattacaggtgcacgccaccatgcccagctaagtttttgtatttttagtagaaaagggatttcaccatgttagccaggctggtcttgaactcctgacctcaggtaatctgcctgcctcgcctcccaaagtgctgggattataggcgtgagccaccccacctggcactgaagagcaattttttaaacttttttataatgtacttatctcatgtacaatatggtagtgatgatagttttctcagcttcagacttacatgatttagtttctgcaatctaagtgaaaagagcattgctgttttccaatatagtaaaatttcatgattaattctagtgggctcagctttagtctcatgcttacccctctaaagtagctgcggttaggataagggagtatttcctagagggaaactgtgagaaaggtggctacccaaggtagaatttggatcccattacccaggcaaagggggtggtattttggacaacaaaagcaccagagatctgctccacagggtatgaaccaaaatcatgttttgaactgcaactttgataatgttcttttcatctgaaacacagtggccttatgattacctcatcagaaagggctatcaataattcctgttgcgtctcaaaaacctcatccatgaaaactgtaacaacatctgcccctaattaatgtttttcattttaactactgtgacattttattaaaatatttctcatctgtactagataataaaataattgtaaatatgtatatttgctctttttctcttgtatttgcatgcatttgtagataggaattattttaatgcattactatatcatataggtatggtaagtgaatttaatgtttgcccttattttttttttttttggtagaatgttaatctttagtgtgtaaatccaatacttaagatcgatcttcatgctcgttttcactttgtttgaattagtttttgacggaagtaatcacctatcttttaggatgatttttttaaagaaaataattgtgtttatgtaaaaatgaataaagtaattacctggagagtagaaaacaatttatctgttccaggtcatgatggatagaaagtggatataggggatcccatctgggatgtaaagtcaggaaaattcccatggtagcaaaacacaaaaccaaactgctcattcaggtagcaacaagggacgtgtgcactccaacactgcgcagtcctgtcttggcctggtgtctgttgaggtcctattaaattttgctgaagacagtcaatactaacaaagacacacaaagaactgctagctattactttccatgatgtttagaatatcctaaagttataaatcagaattactttaccctccacgagaaacttctgagttgagttttgttgttgttgttgtttgtttgtttttttgatacagtcttcctctgtcacccaggctggagtgcaatgacatgatcttggctcactgcaacctctgcctctggggttcaagtgatcctcctgcctcagcctcctcagtagctaagactataggtgcatgccgccacgtctggctattttttgtattgagttgggttttaaaatagtatctggctttaccaggagaagatggtgaataggaggcaggattaacatgcatctcccacttggccagacagaacagtgtatagaaattcacactgtgaactttgttccgagaaccaccacaggaatgtaccaggaaaaccaaaagaattcagatcctttgaaagaaatgccatgctactgcaaaatcagcgagacaggcaaaaaactgtgagttcccaaagtgtgagaagggaaaaacctgcctccaaacacacatctccactggggaatctgaaaatccagatcacagaaggatttaaccttacctagagctggaatggatttagggagctgtgtgaaatataaaagtagtagcagcagtggaaagagccttgtaggcactcctagtctccagcttgagcccagggaaggcatccctgactatgtctcacagggttccttggggtaggcaaccagaggaattagggagggcttgcagggtaaaagaagcttccaggtgaattttatgatcacttctactaggcacacacttccttgagcagaaactgggggatgaatgggaactgctgcaaacctgagcaaaggagccactgccattgtgagcagatggggagggaggagaggtgtggcctgaaagccatgcttgctttctcagaagggaagcttatggcctggggcaggtttgagttctgcctgcaggctgcctgaatcaaaactcagcactgttaatggggcactgcaggagcaagattgaccttgccaactgaatgagagctgggtgaggcctttcactaccagctatcccccacttctttggtgaactatactgcacagcagaggcagccataatcccctttggaacataaacccattggcctgagaaccatacccctgtcccccacagtggctacaacaagctctctccaaggagagtctgagctcagacccacctgaccctgcccaaattaatggtatttctctacctgccccagtagctgaacacaaaagacataaattcttgagagctttatggccctgcccatcacctgataaaccagaatacttcccctgggtaacttagggcaacctcaaatcccactgctaataccacagctggtgctctcttgaaagaaccacctcatggctggaagccaaccaactcaggccattacagcaactcatgacagaataacactggtcccgggaaagagaaaacaacagttaataccactgcctacaacatcctggctaaccggaggtcctgagtctgtccatgtgaaaacttcactgctggcataaccaacatttgggaaggccaacacaataaacctagctacaaccaaagattctcacagaatctacatcacccccagccacctccaccagggcaggtgttaatatccacagctaggagacctgaggactggtcacatcacaggactctttgcagatgtttcctggcaccaacacagagcctggtagccccactgggtgactaggcctggaagagcaataataatcactacagtctggctctcagggagccccatctctaggggaagggggagagcacaccacatcaaggtatcacaccatgggacaaaagaatctgaacagtgggcctcaagttccatgtcttttggctggtgagtcatttctcgcaacagggacacaattgcagtactgggcgcaggagggaaagtctgcacctctaccccaatagaccagcttctgtgatcatgaagggccttggagaaggggtacttattccctccaggtactccactaaagacacagttggggcttgccccacaggaaagcagcatggaggtacctatagtcaaccttcctagaacaattcagggtgactggaggtacaccttccagattcaggcctgcatgagaggcagagtcaccgttcctccctacttgggacatgaacagtcctatagatgaaaagaggtgcctgtctgatctgaatacctgaaacactaggacagaagtgaggctgtgaggtaaatggctttcctgctgacctggcaaggggagctgaagtagctcccactcttcactctgatagaacctcagcacatctaattgagagctcccccagccaccctgctcaagactgggacctcggcccactgttagatattacatctacccacctgccttagccacaactagtgcctacccagggatatattccctattggcttgaagcccagatcatcaactcaataaataaacaccagaaaaaaaattaaataaataaagtatacaccacaagagaacaagataagcttctagagatccccatcattacaactccataggagacagtgaacttacccacacttcaagaatataactgctacaagtagcatcaggcaaaatcagcacagaagactctataactaaggaactcatagagtcttcacccctagagcactaataatcaaattaggctaaaataaacattaaagtctgatccttacgaggggaaaaaagaaatttaaattaaaaaaaatacagtccaattaaaaataaattcaagaacagtttgaagaaatagcctactcaaatgagaaggaaccaaaaaagtagttttggcaatatgacaaaacagagttctataacacccccgaaagatcacactatctccccagcaactgatctaaacgaagaagaaatccctgaattaccagataaagaattcagaaggctgactattaagctacttgagataccaagaaaaaggtgaaaaccaactaaaagaaattaaaaaaaaaaaaattaaggatgttggtgaaaattttccagagaaacagatatcattgcttttcctaaagacaaaacagtcacaacttctggaaagaaaagacacacttagggaaatacaaaatgcagtgaaaagattcaacagtagactagaacaagtggaagaaagaacttcagagcttgaagacaaggctttcaactaaccccatcagacaaagaacaaagcctcaaagaaatttgggattatgttaaatggccaaacctaagaataattggtgttcttaagggcacggtggctcatacttataattccagcactttgggaggccaaggcgggtggatcacatgctcaggagttcaaggctagcatggcaaatatggtgaaaccctgtctctactaaaaatacaaaaattagctgggcatggtggtacatgcctgcagtctcagctacttggtaggctgaggcagaagagttgcttgaacccagtaggcggaggctgcagtgagccagaattacaccactgcactccagcctgggcaacagagcgagactccatctcaaaacaaatacaaacaaaaagtttggtaaacttatttgagggaataattgaggaaaacttccctggctttgctagtgatctagatatccaaatacaagaagctcagagaactcctgggaaattagttgtgaaaagattatcacctaggcatatagacatcaggttatctaaagtcaagatgaaggaaaaaaatcttaagagctgtgaggcaaaagtatcaggtaacctataaaggaaaccctatcagattaaccgcagatttctaggcagaagtcctaaagtccagagggattggggtcctatctttagactcctcaaacaaaacaattggcagccagtcagccaagaattttgtatccggcaaaagagagagaaggtcacaaacaaatgctgagagaattcgccactaccaagccagcctaacaagaaatgccaaagggagttctaaatcttgaaacaaaacctcaaaatacaccaaaatgaacctccttgaaccgtaaatctcacagagtctataaaacaattacacaatgaaaaaaaaaaactgtttaggcaacaactagcatgatgaatagaacagtacctcaaatctcaatactaatatttaatgtaaatggcctaaatgctccacttaaaagatacagaacggcagatggaaaaaattccaccaaccaagtatctgctatcttcaagagactcacctaacacataaggactcacataaacttaaggtaaaggggtggaaaaagatattccacgcaaatgaaaaccaaaatcaagcaggagtagctattcttatatcacacaaaacagactttaaagcaacgatagtaaaaaaaaaaaaaaaaaaaaagaagacattatataatgataaaagtattattccaacaagaaaataccacaattctaaatatatatgcacctaatactggagttcccaaattcataaaacaattattatcagaaatttaagaaaattgaaatcatatcaagtgtcatctcagaccaaagtggaataaaaccgtaaattaactccaaaaggaaccctcaaacctatataaatatatgaaaattaaataaactgctgttgaatgatccttgagtcaacagtgaaatcaagatggaaatttaaaaattatttgcacagaacagtaatagtgacacaacttaccaaaacctctgggatacagcaaaaacgttgctaagaagaaaggccatagcattaaatgcctacatcaaaaagtctgaaagagcacaaatagacaacctaatgtcacacctcaaggaaatagagaaacaagagcaaaccaaagccaaacccagcagaaaaaaagcaataacaaagatcagagcagaaaaaaatgaaatggaaacaaaaaaacacaaaagataaatgaaacgaaaagatgtttatttgaaaagataaatacgattgataaaccattagcaagatttaccaagaaaagagaagatacaaataagctcaatagtaaacaaaatgggagatattacaaccaataccacagaaatacaaaatatcattcaaggctactatgaatacctttacatgcacaatcttgaggagatggataagttcctggaaatatacaaccctcccagattaaatcaggaataaatagcaactctgaacagaccgagaacaagtagtgaattgaaactgattaaaaagttgccaacaaaaaagtccaggatcagatggattcacagctgaattctatcagacatttaaagaactggtaccaattctactgaaactattccaaaagatggggatagaagaaatcctccctaaatcactctatgaagccagtattatcgttaataccaaaaccaggaaaggaaataacaaaaaagaaaactacagaccaatatccctgatgaaattaggtgtgaaaatcctcaataaaatactggctaacgaaacccaacagcgtctcacaaagataatatgtcgtgattaagtgggttttataccagggatgcagggacggtttaacatatgcaagtcaataaatgtgatacatcacataaacagaattaaaaacaaaaatcatgtggtcatctcaatagatgtagagaaagtatttgacaaaatccagcatctctttatgataaaaccctcagcaaaattggcatagaagggacagggacatacttcaaagtaataaaagccatatatgacagacccacatctaatatcatactgaatgggaaaattgaaagtattcccccctgagaattagaatgtgacaagaatggccactttcagcacttctattcaacatagtactgtaagtcctagccagagcaatcagacaagagaaagaaacaaagggcatctaaattggaaaaacagaagtcaaactgtcactgtttgctgatattattgtatacttaaaaaatcctaaagactcatccaaaaggcttctagatctgataagtgaattcaataaaatttcatggtacaaagtcaatgtagacaaattagtagcagtgctatacaccaacaacaaccaaactgagaattacattaagaactcaatctttttttcaacgactggaaaaaagtataaattacttagaaatatacttaaccaagaaggtgaaatctgtctactaggaaaactacaaaacactactaaaagaaatcatagatgtccacaacaaatgggaacacatcccatgatcatggacaggtagaatcaatattgtgacaatgaccatgctgccaaaagcattctacaaattcagtacaattcctatcaaaataccatcattattcttcacagaactaggaaaaaaaactattctaaaattcatatggcaccaaaacagagcccacatagccaaagcattactaagcaaaaagaacaaatctggaggcatcactttacctgatttcttgctatattaccagactatagctaccaaaacagcatgttaccaataaaaagataggtatatagactaacggaatataatagaaaacacagaaataaatccaaatatttaaagacaactgatctttgacaaagcatacaaaaacacataaagtcggaaaaggacacccaattcaacaaatggtgctgggaaaactggcaagccatatgtagaagaatgaaacttgatcttcattgctcatcttatacaaaaatcaactcaagatcgatcagtggcctaaatctagaactgaaaccataaaaattctagaagataacattggtaaaactcttgtaagcattgtcttaggcagagaattaatgacccagagcccaaaagcaaatgcaacaaaaacaaaaataaataaatggaacctacttaaactaaaaagcaaagaaataatctgcagaataaatagacaacccacagagtaggagaaaatatctgcaaactatgcatccaacaaatgactaacatccagaatctaaaaggaactcaaacaaataaccttatcaaaaaaggggggcaaaggatgtgaatagacagttctcaaaagaagatatacaaatggccaacaaacatgaaaaaatgttgaaaatcactaattatcagggaaatgaaaattagaactacaatgagaaaccaccttactccttcaagaaaggccataattttaaaaatcaaaaaataagagatgttggcatggatgtggtgaaaagtgtggaacacttctacactgctggtgggaatgtaagctcatacaaacactatggaaaacagtatggaaattttttaaagaactaaaagtagaactaccattcgatccggcaatcccactagtgggtatctatccagaggaaaagaagtcattatatgaaaaagacatttgcatgtctatgtttatagcagcacaatttgtaattgcaaaatatgaaactaacctaaaagcccatcaaccaatgagtggataaagaatatataataataataggataattattattaataattatgttatattattaattatgttatataagtggatatataatatatattatatatatcacattatatattatatatgtatatgatggaacagtgttcagccaaacagaaaataatggcatttgcagcaacttggatggagttagagaccattaatctaagtaactcaggaatggaaatccaaatattttatgttctcattttaagtgggagctaagttatgaggatgcaaaggcataagaatgatataatggactttgaagacttggggggaatggtgaagagggatgagggataaaagactacatattgggtacaatgtatactgcttgagtgacaggtgcaacaaaatctcagaaatcaccactaaagaacttattcatgtagccaaaactacctgttccccaaaaacttttttaaataaaaattttttttttttttttttttgagacggagtctcgctctgtcgcccaggccggactgcggactgcagtggcgcaatctcggctcactgcaagctccgcttcccgggttcacgccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctaaataaaaattttaagtaaagtaagataaaataaaattggatcctctgccaaactgtaagctgttaaaagtaggagctatgtgagaaaaacatctttctaaaagctagtttatattattcagtattctttctgtaaagattcatgtgacaaattacttttagaaattaacagtagaaaaagagtttcacttaaactagtacacatatttaatctggaaaataaaacattcccattatagtgataaaagctcaaaatcaaattaatgcatagaagaattatgataaaatttatattaaaatattctcctataagatttaaaggtcttaatatatttttttcctgaaaattactttaaatcattttcatgtcattcttccttaaataggctgaagaatacaagcaaacagtggagaacactagtgtttgggagaagaaggatatttatttctctttccttttcttggaaaatacaagttggtttcccaagtattaaaataaaaatcttacaaccaaaaaatgtggctaaattttaggatctatgatgcataagctgacacttatgcacagatgttattaatttctatttttattttcttcactggaaacctgaatctgggaaaatatcagctgtgagcttcagcgaacacaagtaaaattcatatgagaagtgcaaacttcataaggaaactggcagtactgaaactctttaaactgaaactggttctaatagaatattagaatgatgaaacacagcatagcatcacatgttcccattaggcatcaatctttgcccctgagaccttccttttgcataatataaaatgttgctatggtttcacatatagtatccttattatggcattaagaattatgcaaaatatgtaatatgtagattgcaaagttaatgacagctctgtgaatgactgaaaagcataaatttataatacgcatcatgtttattcattttaaaagttgttgacatttctcttggtgtgagacaatttgctatccattctcagatagaggtaaaaacattagaaagacatgatctatgcagtggattttatgagctcagttacatatgttaccttcctttctaagaataattgaaaatacgtgccattttttttactgtactagttcctccctagaatgagttaatgcacagaacatttgagaatgactggtaacttgttcactgactagagggcatgtagggctaggacatcagaatcttaattcactgacttctcaaataaggtatctgcaccagttgactgttcaattcctatccagctatttttttaaaaaaagtgtttgtgtctgtattttacatattatccaaataatacacattcattgtagaaaaaaattttaattactaaaaacagaactgtagaaagagcagaggatcttttgtttcattctgcaacatacaatgttttgattctattattatccttctaactcgaccccaatcatcatgcattcccagaatgaattcatctctacaaaccagactcaaaaatagctgataatatttttactaatatagagataaaactatggagttcaacttgagaccttcagctattagaatcttacagagaataatacttctccaataaggacaaaacttgtaatgattactaccatatgagattgctgtcaatgttgcattgagtcaattaagccagggatcacaggaaattaggccactagaagaactggccctccccaaccatttgtcgttcaaagatagtggaagcaattgtgcgtattgagtcagaaatgggaaaaaataatcaagatttatgactttagtttcctgggagcaatgaaaattccctgtgcttatttcagggggattcacaaagaaaaaaaatactttttactttagacttcttggaccgttagctaaaaatgtttccaccagtctagcccaagcaaaacaaacaatagttataaaagtttattttatttctgtagtggatttgaattttacacagttatagaaaattcaagtataacaaacataaaatatgaagtgtggggaagctcaatttagcttataggtctgcgtttttcctctgtggaggaaagtgtaatcttgccattgatggtaatctagttgcttctggcttaaaattcaatcaatttaggattaacacggtcagttcatattctattttcttgctcatttttttttctccctctcctatgaaacttctgggttcaggagttttgctgggcattttaagtgtgggaactggatttgcaattgattcttggtaatcttctctcattgctggcttctgctgaggtgtgactcatcctatcagatcaatattggttcccttgttcctgatgcatttactgctgaggtgcacattcccactccagtccccaatttcaggttcacaattaccatgtcttcttgaacccaacctcagtgcttctgtagatgatcttgaattgcaaccagttcacaactctaatgacatctcaaaattttcagcttttctccctgttgttcattggtttgtataagatataatgaggctgtgttcagaactggtctaggcactttgctcagaaaataatttcccatcccatagatgccatgttagttgcaagttatctgtgagacttgtaacatcccaggcagtatcttggacaacttttctcctctgacattattccacaatttactgggatgtatactagggttgcagtagtcctacctcactgacacattgggattctacttgggaggggccctgaaatccactagcagaaatcatctttgttccttaaacatcaatcacctcttagtctcttttttctacccactgctgaaattcttatatctttttgatgagaaaaactctacatattcatgaattcctttcgactccacatttttgtttttgatgtgattaccatattttaagtcctaaaggattcagaaataaaaacaaaacattttttatctcaagttcttttattataattgaaaaccaaagcattcaagaatatttgttacttctactaaatacttttcccaagtcatttagagtgaaaaagcccacagtgtgattattgttttcactttgacatctcttcctgaatgcagtgtatttattgacagaggatgggagaattaaccagaaaaaacacgcagttggatagcaaaatattatggtgccacagttaaatttacatatttcaataatgcgagtatctttgtgttttatttgataaagaatttagattttacggtccatattttcaagaacaatgcccaattatgtctaaatgaagtagaaaaaattaataggtcataaattaggggattactatattctagttatagcagatcttatttctaaagcattcattttatctcaagtactatttttgtgttagatatgcattatcattataatcatataaagtgataaaatttattttatcaatgacaaattttgtaaaaaagaagtaaagcagttggctaagatgcagcaaccggtaaaagggaaaataaggatctaaatccagatctcttcactctaaaatccacgtacttaaccattatatgagttttaagaaaatgactcaacctatttaattttatctcatttgaactgtttatgcttctgaagagccaagaacatcttttatctttaaaatcttcacagcatttatcaaaaccctaagcacatatttaaacacaaacatatgtttgcttccagaatgcagtgtttttaaagttaaaaaaatgtatcactgggagcagcagctcatgcctaatatcccagcaatttgagaggctggggtggaggactgcttgaagccatgagaatgagactagcctgggcaacacagtgagaattcacgtctacagaaaaattttaacaagtggcaaggcatagtgtgcacacacctgtggtcccagctacttgggaggctgagacaggaggatcatttgagcccagagtttgaggctgcagtgagttatgactgtgctactgtactccaccctgggtggcagagtgagagagaccttgtctctaaaaaagaagaaaaaagtatcaacaacaactgctcctaattaaaatgatttctaagcaaacaaggaatagaataaaaatttcttatcctgataaatagtgtctacctaaaatctacagttactaatcagacctaattggaatatgtcaagatgactaaatcaggaacaaggcagattgccaccacacccatgtattcatgaatttttgcaaattctgtccagaacaagacaacataatgtaatgaattatatgtagattggaaagtaggaaataaaactgatttttttaatctagtagaattatttataaaaaattcataaaatgtatatacctatcattagaatatgttagacaactaagcaagtttttatgataaaggttaagtataaaactgttaatggttttcttattatcctaccccatgctatgatttaggcttgtatataactataactaaagttagaaaatgcaatataaaagaaaaattacatcttcacaaagcgtacagtgtctagccctagatctgatgtaatgtgcaagtagctgtgttgaaaatttacatatcattattaaaataaattgaagacaatttaatgaagagatgtgccatttaatattataaagatgttaattatccacagattgatctacaaatttattgtaattctaattgaaatctgaaaagaatttttatgaagtttggtaagctcttcttgaatttatatatgaaaacaaatggcccaaatattctagaaattcctaaagaagaagggagattttgtcctatcatatgagggtacttactgtgtagtgttgctgcaagagagagactaacaagtcggacttcagagaccaaatccagacccagtcattagtggtaatgtcatccatgaaagaggtgacattgcgtttcagtgagaaattgtgggctattaagtaatggtattgcagccaactggttatacttacagaagaaaaataatggaacagaatagatccaagaaatagactcagataaatattctctactagtttttggtaagaaagacacaaaaacaattaaatgtagggagaacagcctttttaataaatggtgctggaacatccacaattaaaaaaaataaagaatcttgatctaggtctaataacggtcattaaaagttaactcaaaatgaatcatggacttaaaagtgaaatgtaaaactgtaaataatttaacataaagtatagaagaaaatgctcacaatctaggggcaggcataaagatttaggcttggcactaaaagcataatctatgaaataaatatggataaattgggcctaattaaaaaaagtttgctctgcaaaagttatgtgaagaagataaaaagacaagctatggactaggaggaaatatctgtagaccacaaagaggtctacaaagagaaaaagctagtatctagaatatgtaagaaattttcaaacaacaataacatacagtccagttagaaaacaggcaaaagacatggtcagacatttcaccagagacaatattccgatgtcagagaagcacatgaaaagatgtttaacatcattaactatgaaggaaatacaaattaatactataatcagatatcactacacatatatcacaatggccaaaataaaaatactaacaataccaaattctggtgaggatgcacagaactggacctgacatacatttctggtggaaatgaaaaatgttagacaaactggaaaacattttggcagttccttataaaactaaacatacaactaccacacaacccaacaattatcctcttagacatttattccacaacatttatttccagaaaaccatgcacaaaaaatgttcagaacagctttatttgtaatagccaaaaactgaaatcagccaagatgttctttaacaggtgaatggtttaataaactgtggtatactatttagcaatgcaaaagagaaagctactgatatatgaaacaacctggatgcatctccagggaattaaactgacaaactttttttgtttttgtttttgtttttgtttttgttttgagacagagtctcactctgtcacccaggctggagtgcaatggcgccatctctgctcactgcaagctccacctcccgggttcacgccattctcctgcctcagcctcccgagtagcttggactacaggtgcccgccaccatgcccagctaattttttgtatttttagtagagaaggggttttactgtgttagccagggtggtctcgatctcatgacctcgtgatccacccccctcagcctcccaaagtgctgggattaccggcgtggaccaccaagcctggcctgacaaacttttagtcatagaggacacattactggaactagtagttaagaatatggtgggagtctcaggaaaaaggcagatatggttatgaaaggaaacatgagggatccttgtggtgatagaatagctcatgatcttgactgtgggagtaggtacatgaaactatacatataattgtgtgcaaatacacataaatgaattcaagtaaaactgggaatttgaataagattaggaaatcacattaacattgatatcctagttatgatacactccagttttataaaatgttacctttaagataaagattacatgagactctctgtattatttactacaactgcttgttaatcaacattatctcaataaaaatgccaatttataaagaaattgttagaacacatttgcaagatttacattaaacaaataattagcaaaggtcaattagaaaaaatacaatcgtgggcaaaaaaaatgtacagttttcttttcagaactacaattagaaaaaataatttactaacttagtcattaagtaaattttaattaaattactttatcattttgtactctacagattgtcaagcattaaaaataaattatcaatttgcagagttgacagggatttgaattggaattcatgtaccattgggaggagtgcgagttgaaacaattactttagaaaacaatttggtgcctaccagaagacacagcaattgtactcccaggtttataccctagagtaacacctggttatagaaggatacatatacacaaatgtttgtagaacattgctcatgatagcaaataaaatcagttcacattagcatgaataacctgtgttatattcacactgtagaatattattattcattagaaatgaataaacacactcatatctacatggatgaatcccacaagctaaatattgaccacaaacacaaatcacaaaaaatacattatgattccccttgtaaaaatattaaatctggcaaaactaaatgcatactgtttaggaatacatatgtaagtgaaagaaaactattgaggaaagcaagggaaattataaaattcaggaatatgtttcagagaaaagaaagtaatgctattggggaggaggcgtggaggcttcaaaggcatgttagtgtttcatctcctaaactgggtgatagttacaacagggttattaaactttaaactcttaatatattacatctgttttttgaatgatgtattttacaatgaaaagtaacattgtcatccaattatgtgttttctctggtaatacttgtgcttgcactgattttagtacatgtgcactgcactattttacctcctttattatgataacacattaccacagcatggggcatgctgcggacttttagaaaatattctgatttttcccagcacactgtgtattcattcaggatacactggaaagcgtgacattctgatccatcattatgagtgttcaggtcatccctcactaaccttagaagagtaaacaacactgattgcacacatgggtgctgcagttttgctcttgacccgtggttgttaaggatcatttctagagaacagtctccaccatacatgagcaagttgcaaatatggaactggaagaaaaaaaaatccacacagaatagaaataagatccaatttctgcctagaacaaaagagataaaaagactaaaataaatgctcagatgaaaggttcatttttccaatacgattctcagagaaccttgagagttgattaaacagccttatatgttttgcaatttaattaggtaatgtcttcaacaaaaaaaaagcccacgaaaaaacaaaaacaaaaaaactgaatttgtcaaagaaaaatgctatcaaagtgacttttttattaactctgatagttttgaaacatctccagctgatacgtgtttgctgtggaagcttgttcgttttgcctccacaagctacttcttttaatctttctgtttaattggccattgcttgcactagtaaagctatcagtaggaggatattttgaagtaatggaatgcttaaatctcagctttgtttcttttttatataaagggccaggaccatggatatttagagtataaaaacttcccctcccatcttaaaaacgcgtagtcctcatccctggtcatggcttttcttctctctttagtttccactgcagtccctctatatattagttaatacattatttgatataggtattctataatcattcatttctttaattcctttctgcaaatgagtttccttctgcccatatatatttgagtaaagattttcattatttcatttattttttttaaacattcaggaaacctctattagacatatttttcttgttcaagaaattatgagatgtagcattagagagtttgcacttttgtgattactattttaacattttaaataatagctttatttgaaaaaatgcgaataataaaatcaattctttttaacttatagaatttggtggtttttttagtatatttacaaagttgtgcaaccattatcacagtccaaatgtagaacatttcatcaaaaagaaactccatctccattaacattccttccttatctcccccccgaccaacccctggcaactactgatttacagttctgtctctttacatttgcctatctggacatttcatatgaatgtaaacatacaataagtggtctttagtttttgttttttgactattttttcttcttaaaaaaactgacctctagtcctgcagatcaatatgtggtgtttgggactggcttcttacatttagcatgacattttgaaaattcctgttatagcatgcctcattactttatttcttttcattatagaacaatatttccttgtatgaatgtgccatagtttgtttttgcattcatcagttgatgaacatttgagttttcccaatttttggccatcatgaataatttttctaggaatattatgtataactttttgcatgtgtttttatttagttttggatttataactaggatgagattgctatggcaactgtgtttaacaatttgagaagctgctaagctgttttctgaagtgactgcattatattgcatttccaccaacagcattgagagtaagggttcagtttctctataccctcaccaacacttgttattgtcttttatttttattatagccaaactagtaggtgtgaaatggtatctcatcattttgttttgcatttccctgacaattcaagatattgatcattctttaacattcttgtaagccatttggttatctcctttggagaaacgtctatttaaatccttttcccacttaaaaaaaaaaggttacttttattttcattattgaattgtaagggtgttttatatattctgaatataaagcctttggcagataggtgatttgcaaatagtttcattctgtatgttggctttttactttcttgatggtaccaattgcagcacaaaattttatccatttttttcttttgtcacatgtacttttagtgctgtaattaagaaaccattgcctaaaccaagatcacaaagatttgctcccatgcatttttctaagagattatagttttagctcttacatttaggactatgatccattttgagttaatgttttgtttatggtgagaggtcctggtctaactgcatttatttgcatatagatacccagctgttcgagaaccatttgttaaaaagactgttctgtccccattggattatagtatgcttgttgaaaatcagttaaccataaatgtaagggtttatttctgaactcttgatttaattccattaatatctatatctagccttgtaccagtaccacatgattgtaatgactgtaatgattgtaatggctttgcagaaatttggaaatcaggaaatgtacataccccgattttgttcttttttgccgggtctgtcctgcagaccctggctgatggacgaaatgagtactcagacacaggtatgcagtgtaagagcagttaggtgactgcctggctctagtggccagacagcagcccctagaagctggacctgcttgcttttattcagtgcaggcacaatgccaaaaacctggagccaacacaacctgtaggtaattaaaatttattgttcccctttcggtgaaggtcaggggcatggatgatcaaaggtcagttcctggtcaatataagtaaacaagcctgtttaaaataaattcccccaccctcccttgtacctattccttgcgctctgcctcagggttatagaataggtgtcttcagctattctcccccctgggctctgcagaaccttccgacctttcagaaggtttgcatcctttccctatagtttttccaaccactgtgacagatcccccacactttttcaaaattgttttggctattatcggtttcttgtcagaaatattttttaatcaagtttccagttatatttgtttttgtgaaagtttttggttaaaaaaatgctatcaaaactaatgtattgaaaagaaagtctccttcccactccaaaacctcagacatatctgttcactaagaactgctgaaaaacaatatgtcattcaataaattatacatgcatgtattattttataaatattttattttacaaacatttctatagtttgccttatacattaatgatattacctggtgctcatgccacatcctattcattaatctgtctaaatgattgaatagaattccattgtaatgatgaattacaatttatttaaccagttccctaatgattaatatttaggttaattatgattttttgctattatactcaattctgtatgaaaatcttttctgcatttatttttatatttttgaaagcatatctgtaatgtcggtccctagaaattgaattcctatgtcaaatataaggggattttacatttttaagcacacagacaaactacactccgggaggccttcaagaacttacaaacttagaacaatttttctacatctttattaaccctgtgtgttatcaaattgtgttgataattgtgaattggtagatgtaaaaacattatatttgtctgaatatatgtataatagtgaatgaaaattgagcatttaaaatgtttgtaagtaacatttgtaattgtttttctgtaaaatccttattcttctttgttcatatttctatttgaataatggcattattgaattgaaactatttgttcatattgaaataaaccctttgtcatgtttcttttacttaatcagcataactcctctgatgggatcttcatatcattcctaatagaagattgattacccatgtatatttgactagggttggctgggagcaaagggaagaaaacttttatcatctagtataacaaaacaaaagatatacaattcatacatattatttcaatatgaatttaattcattttacatgacttttattttattgaaggtataaattacatataatgatgaacacaaatcagaagtatacaacagatcaatttaaataattgtaaatgcccaaataacaacgtcccatatcaagattcacagttattttagatcctcctttctcccttccatgtatatggactcttggatgcatatgtggtttttttccagtgtgagtgtatgataaataacactgctacaaacacttacgtgtctgtcttttggtggacatatgaactaatttcttatggttgtctatgtataacaagtgtaattgctaggtcacagagagtgcatatttttttgtgagtagaaaatgccaacaaatttctgaaagtacaccccacaagcaatgtgtgagatttctggttgtcagcatttgttattgtctacccttttcattttagcaatctaactagtatatcacagtatcacaatacagttttaacttgccttttcccaatgacttacgatgtaagtgctttttaatatgcttattatgcatcttgatattatctttcatgaagtacttgtacaaaatttactaactttttaaataaggttgactacatattaatttataggaatttaaaaatgtatttatatatgctagatacaactctttatattttttctatactgcctttttcgtacactatctcttgaataatagatatatttacttttaatgaagtccaactgatcctcctttttatgatattttacttattctgtttataaaatccttgctttctcaatgccatggagatagtttcctatattttaccctagaaaacttattaccttatttttcacatttaaatttatgatctatctcaaattatttgtgtatgcatgtgtggtgtgagatagggttttgtattcccatacagatgtccagttgatccaaaatattatattgaaaaaacccctcttttgccactgaattgttgtgacacatttgtcgtaatcacagttaataataattgtaaaagtcaaattctagtttctctattctgtttcattagtctaattgtgaatttttgcaccagtatgcatgatctaattaatacagtttcacaataagtcttgaaacctggtagtgtatgtcttgcagctatatttttctctttaaagattgccatggggaaatgcaaatcaaaacaataaataataatgagatatcatttcactccagttagaataactactatcaaaaggacagaaaataacaagtgttgatgaggatacaaaataaagggaaatacttgtacatgtttggtaggaatatagagtagtacagccactatgggaaacaatatggaggttcttcaaaaaactggaaatagaattaccgtatgatccaccaatccaactgctaggtatatatccacaagaacgaaaatcaatatattgaagagatcactgcactcttgtgtttgagtacttcacagtgggcaagataggggctcaacctaagtatctgtcagtggatgaatggaaatagaaaatttggcatatatgcacaataaaatagtgtttggccattcagaaatgaaattttgccacttgtaacatggatggaactggaggatgttttgttaagtgaaataaactaagcagagaaagatgaatattatatgttctcacatgtaaatgggagctaaaaaaaagtacatctcttgcagttagcataatggtggttgactgaggctgggaagggaagaagagagggaagatggggagaagtttgttaatgcatacaaaaatacagttagatagaaggaataagtactagtattcaacagtatagtaggaaaatgacagttaacaataatttttgtatatttcaaaatagctagaggagaagaaaatgcacacaacaccaaaaaagataaatgttgaggtgatggatattccgattaccctgattttattattacaaattctatctatgtatcaaaatatcacatgcaaccccagaatgcatcaactatcatatatcaattaaaaaatataaaaagcagatctctatggatattgtagattctttgagtttctacatcaattttagaattctatgtttgatttctataataacaaaaactgcaactacaatagcaacaatataactgatattttggttggaatagcattgaatttatagataacttgagggataattaacttttaacattatctagtattcaattcatgaaaatatcatatacttctacttattaaatcttctttcagtccttccaggaagcattttgtaattttcagtgttgtagtcttgcacatattccattaccctttttccccaaatatgtgacattttggtctctttcatctcgatatttttctttaatttctcaataatttgtttctagaatatgaatatgctgtgtatttttgtttattgaccttgttttcagtgacttcattaaattcatttaattataattgtttataggtccctttgcaaataaaattagttttcccttttatattaaatttttatgctttatatttatttttcttaaattattgcactgattaaaacctgcaacataatgttacataaatataatgagagtgggtacttgttttctttccaacttcagatggaaagcattcatatgttatctattccttttttttttgtagttatttcttatcatactgaagaagttcccttccatttctgatattctaagagtctttagcatgattgggtgttgaattttatcaaataatttttctacaacaactgaaataattatgatttttttcttgtactctggtgattttgtaaattgtattgacacggtgaattatattgattgatttttcaaatgttaaacaaattttacagttgaggactaaatacctcttgattatgatctagcaccatttttccaagtaagttatacgaagtataaaatgtttactttgatgataaatatgaatacttaatttgaatgatatcactggatatgtatcaaagaaatgtttctcaagtcatgagactgtaaaacttctctgtcactcagttctgttcatagccatgcttacttcctttcataagcaatgtaaggttttttccttgacagacattatttgtctgtttgagacatttcagatattcacatacttgaaagagaagtcacctgatattaagttaagtagataacttagcttcttactgatgctacgaagacttttctattttccctttcctaagaaaattatactgccactttgtgactcttttttatgtacgtattctagcccaccttaactctaactctttctttaaatgaaaatcgtatatatttaaagtgtaagctaggtgattattttgctcctttttaaggcttaaagtgagtattaattaccactgacaaatgtttcttgagtatacggagcaccactgaattgtgttcttcttatttaatgccaaattctaggaccttcttggaaatcatattcttaactgaaaagaaaacctgacagtaataatatttgtcagataacaatatacaaaaacaaaaatattccaagtaaatacaaaaataaatattccaaatgatttatgacaaggtggtagacataaaagtattaattgagagatatatatgaaaatgtgatttttaatcagagttataaattatcaatgtacaataccttgccacatggcaggaaaagaattgttttagatatgaataggtgaaactgcatgatgggctatgagttatggcatttcaaaattgctgattgacctagattagaagctatttgaatttaagccactaggatgggcgatatttttgggaatgagttttctttttttattaattctagttatcccaacatcaagcatggtatctggatgattgctttaaaaatgttgttaaaagatacaaaattatatctagatgggaagaataaaactttggccttccatagcactgtaagatgactctagttaacattaatatatagcttcaaacagctagaaggaggatactgaatgttcccaacacaaagaaatgataagtgttcaagatggatatgctaattgccctgatctgatcgctgtacatcatatgtatcaaaacattactgtgtaccccataaatatgtataattattatatgtcaattaaaaagaaaaaaatttaaatgttgaatgaggtaaagaatgaacaggccaatgaaggaagagcttggaatttaggggaaatcaggaaatggaaaaaatgagagtcttatttaggatagatgatgaaaacatatgtgtgtaatatatgctatctttttttttttttgctattctgtgtgttccagagaggcaattttgatatgatttaacaattccatgatatggagataaatggaaaaaaaatctgaaggaaaataagaagcagattatgctgctgaattctgaatttggggaactgacacatgatggtaatagataattgacgtatagtgaatggaagaatattaaagctgatgttttcaagggtacaaggaaatgggcataaatgaaaagataaatggtgtgatctcatttcatattgtttccttggttttaaattgcaccttaaggtcctttgaatagggctatagtaacaacgggaagcccagagatgcaaatgctgggaagacagagaatggaaaaaaaaaaaaaaagggatactaggccccattatacctccaccttacatcaagtttggtgggtaagtgcagtgaagggaggtagagttgcttttgaataggagtaaaggttatttttgaaaagatgtgcattctgagctaggggtgacttctaattgggagaaatgtttgattttagacacttaagggggccaggatggagatgagggaacagaaagcaggtcactagatacttatggatgactaaggtttaagggagagcagtaagtggaatggactatatgtttcttttaatttatgcagtttttaccagagtagaggaggtgggctttaaaattggtttcgatgattcacgcatgtgtagatatttattgagcaccttccctagatacagctatcctacataccaggatttcagcagtgaggaaggcagacaagttaagggctactgtaggaagggtgctcaagggagtcacatctgaagcaggaggagtcagtcatatagccatctggggaaagagtgtgtcaggaaaggaaacaccaagttcaagagcactaaggtattgtttagaaatgaaaagaagttcagtgtatctgaaacatagagtgggaggatcatcacacggcacaagtttgcagagctgagcaaggcacagacagactggaaagagttgaaaatctacttaaaaccaaggagaaaattgttggaagtctctaatcaagaaagtgaaaaaatctcgctttatatttttaaacatcacccaactgccttgtggagaatggactataagaaagcagaaatcaaagcaggaatttaggtaattacaggagtacacatgagaaaaaatgatgacctgtggctgggcacagtggctcacccctgtaatcccagcactttgggaggccaggcaggtggaacacttgaggtcaggagttccagaccagcctggccaacatggtaaaaccccgtctttactaaaaatacaaaaattaacgtggtgtggtggtgcacatctgtagttccagctacttgggaggctaagccaggagaattgcttgaacccgggaggcagaggttgcagtgagccgagatcgagccactgcactccggcctgggtggcagagtgagactctgtctcaaaaaaaaaaaaaaaaaaaaaaaaaaggtgacctaaccaaagcagtaacagaaaacatggagacacagagatattcttgggatacatactggagaaataccctgaaattaattatgtatgggacacggtgggaggtgtgtcataatggacacacacacacacacatacacacacacacacacacacagcatgcttcttcctatgttcttatttactgtatactgatagtttggttatatattaaggttttttatgctgcttaccaattattttactttccttctttattttctgtgtgtagtaaatttattgtctgacattgttcacaaatttaaaaagtaatcctataagaggtagcgctattgctttattttgaaacatggtgaagttgttttcacattgacctgggagccattgttgaaattaaaaaacctcaacctctcataaccgacatctctgtgaagggccaaggatcactgacacatgattgcatatgttgtcaactgttctcccttgagtatcttatttactctatttttgatcatgtacgtatgctttttaaactttcccattaagtggctctaacactcagccttttgagatttaatttgttttattttcaacaagctaaaaggattgtcattctcttagattgtttatgttaatctcattaatgtaaatgaaagttaaactaatggggaggattgtttctttttttaaagctatgatttccttctggtagttactattgtatgttaatgcatacacctgcttatctttttaaagtgagactaagcactgacaacaaatttaattaaagatgaaagtgatctatttgtgtccacatttactcaacctgcttacatttgcagttttgtgcaaaagtctaaatatcaaaatttctattactgaaaccaatatgaagaatttattgtatattttttctgcttatattagtttgttaggactgccataataaaatactataggttgagtggcttaaacaacaacaatttattttctcacagttcaaatgtcaaagtgccagcagggcagttttcttctgaggcctctctgcttggcttgcagactgctgcctttttcctttgttctttctcttcttatgcatccctggtgtcgctgtgtgtcctaatcacctcttcttataaggatgctagttatataggattaggacccaccttagtgtcctcattttaacttaattacttctgtgaaggccctgtctctgaacatagtcactctgtcataccaggggttagagtttccacatgtggattttgtggggatgtaattcagaccataataacactgaaaagtggaacgaagcaaattaaaagtatgacagtatgccagaaaattgtgtggaatcagactagactgatcagtgccagaatgctattttattgtatgttactaaaatctgtaaagttctgcaatgaggtggaagaagtttggcactcatcttcaaatgatgacattcactatttatcccctgcctatcccaacacacagagcaccttggaatttaactgcaatccccagcttggtacttaaatccccttgactaatgaagaccctgcaatgaggagtgataagagacatccagttagacaaaacaaaacttaatttcactctgcatttatagtccagaacccttttctatttgccaagttgtcacattatgtagatctagcccatcagatacaattgtaggagcttttcttatagtaagtatccaacacatggcctgtgtttgaaaaacgtttgctttcggagtcacagagacctgattatctcccagccgtgccacgtaatgttagacatcagcttgctcatcgatgacaccctcataggattttggtggagattaatcactatgacatagatgtaatgctgacacacatattcatacttcatagattttagggcaattagaatgcaaggatatggtagactgtcttttactcaattagtcactcacttccatatttgtttctctatacatttccatatttgtttctccatcaaccttacaataatatgaaagagcctcacatttttctagagatatgggttcagtgttccagaggtcttcagaattttattttttagttttgtcctaatgccagtatatgcaaacactgatggattaacatctttatgttttaatcatttattgctattactaaaggaaaattattttgattgcgatggggtatggtaaaaccactcagggactctcaaacctgaaacaactagtatttgtactggtggcttgtattgtgcattttttgtctgttattctcagaaatgactgccctcagaatgtaacatgtacttgaaattaaaaacctcaccctctgccttcttagatgtaaaatttctctgtatgtattgattaggaattggagcatttttactcaaagttttaacttacactaaacgtgatgtctttgaaaggactgttgaaagttaaaccttatattagcccattcttgcattactataaagacaaagaaaactaaattatatccgagtgcaatagtgaactgacctgttggtgtcagaatagtggaatcatcaaaaaggaggaactaggaaacaaaggatttgaagtggcctcagaaacccaagcgcaagaggctacttttgcatgccaaatgccagttatgtagatacagccaataccaaagtgtgcatatggaagaaaaatataaataaacctgaccatgaaatacagacagccatattctgagctgcaaactaaatgaaggccttggtgatgggagaaaaatattcgatgttctacagccagccagtgtttgccctcccttttttcttactactcctttcttgtttttgaaggcatcatgtgtgttgggaattggcaaaaaagcttattctgagtaaagcaatgccagttgtttggcagatggaagatgtgggataaaccctagcttacagatcctcccagagtacaatcgggaaaagagctttccttccagataatatacctagtgagaaatctgttcaattgggtgaggcgatctacagtgaaaaagggacagagctagagggtaggaaaattttcccctcgctttatctatacagcagacttttctttttctcactaagcactaacagcagcaaactattctcaatgccactctcatccccaagctaagatccaatagcttgcaagtgcactttctgtattgcaggctgtcaagagggtccaagagtaattctatcagtaaaaacgtattcaggttttccttgaaagagctgtatgtgggaacaactgtattttctacattaaatttatgcaccattatatgctacatactgtatgtatatatagatgtatatgaaaatggacttgcaaaaatatttctaaattcatgtgcaagttaaatatttaacatatgttttgcatatattcagctactaaaatgatctaaatttaattaagtaaaacactaatttttcatgaaaggttggtttaacagaaaatgataaaatgaataatctgtcaaaaggatagcaaattttattattatgatcctaaactaccaaacctagaaatttcatattcaagagaggggtgatttatgaaggtgtaaatatgcatgtattaaaaatgttttaatttttttagaatatctgaaatcccaaatttataatcaaactacaatgaaattttagttatatgtgtgagatgtctgcttttccataggagtttcccatgaacacatgaaaactcctttgttttaaatttcaagatccaaatattctgtggtaaaagttgctcagtgatgccttcttagatataaaatttctatatatatagattgtgaactggagcatttttattcaaagttttaacttacactaaatgtgactgtctttgaaaggactgttgaaagttagaccttatattagtccacttttgcattgctataaataaatacttgagactgggtaatttataagaaaagaggtttaatgactcacgttctgcctgctgtacaggaagcaatgtggcttctgcttctgaggaggcctcaggaagcttacaatcatggtggaaggcaaaggagaaacaggcatgtcttacatggcaggagcaggactaagagagtgataaggggaggtgctacacacttttgaacaaccagagctcatgagaactcactgtcacaagaacagcaccaaggtataaatctgcccccatgattcaaacacctcacactaggccccacctccagcactggggattaaaatttgacatgagatttggtcaaggacacagatccaaaccatatcaggcatatattgttattatcatatcaataaaacatgaatctgaaggcaagctgattttatcttttaaaattacattaacactatttagtaacaatactcatcagaaatagcaatgacaccacaattcctcctttataagttgacacctaaagtttatgttcattgaaatgctgaaaaatgagcatgcataagacattataagggtgcagaaactttcaaaacatgactttgtgttttagattttaaaattatttgataccacatgttctcacttataagtgggagctaaacattgagtacttgtagacataaagatggcaacaatatacattgaggactactggagaggggaaggagggaggcggaaaggattgaaaaactgttgagtactatgctcactacctgggtgacgggatcattcataccccaaacctcagcatcacaccatatactcatgtaacaaacctccatgtacccctgaatctgaaataacagttgaaattctaaaaaataaataaaataaaataatgaaaaataaaataagattatttgaagtttaacagggattgtaagtttgttcgaatagctttagaaaataaattatttctaagttttcttttatttctggggaaagtcagagagacctgatgttaaatctagttgtatcactcatttgatttcaggcaggtcaggtagttcttaagcatcagtgcccttggtggtgaaagagagatatgagtgtatacctgcaggattatgtaagaatcagttgacatgacatacacctaagtaccaacacacatagtatgcgctccataggaataaggactattagactggtatgatggaagacttcttctactcaagttattatccacttttcatccagttttccctagatctttctatttttgtgacagttaacagacaatcattgaatgagatggtattaaatataaatggagttttgttggtattttttaccctactgattagaaaaattggcacagatatggtacagcatagaggggatgaactatgcatgtgtatagcagagaatggatcagaaattatgctggatgacagctgtaaataatttctgcacaactgctgaggctttatagttccagaatgtttatggaatttggaatggtagacttcatttcaaaaggagaatcggtggtgaatgttgatcacaaactcaaactgccataagacaggtcacataaaagagagaaggagtcctagtgaaagaagccatcaaagtggtagccagacagtgtgagagccagacattgcctgtgacctgctaacttacaccctttggaatagcatttaaaggtattactgctgtgatacctttatgtttcttatgtgtaaacagataatgtgttcatcctttcccatacatgaagtcttcttaggcaaagttctaatgcatgtggatttactttttaaacaggaatgttcttaatttagtgtaaataaattttactatccgattctgtgtggaagttgtatattatttagtttataatgttcttattttctgattctacccttattacacaattgcttccagaaaagtttatcatatttatacatcaaattatgattttttcatcttcatactgtgaatattggaacactaggtaatgtttcagtatcacatagttgatattcagtatgtattaatctatgtgaattagagtaagttagaaattcagcttctaaatataaaggaaaaacagacaggtgatttttttttcatctgaggaaataaatatactgtagttaaaaaacaaactaaaagttgctggtaaacatgcttgaattataaggaacagtcctactttgtgtgtgtgtgtttgtgaatctaaaagatgcccataagaaatggaatgaaaccattaaggccaattttgcaaaaggccaacaagaatgtctcattgatatttttttgtttcctatacaatatttttattatagatgtggaaatgcaggcattttccacaactttcctcctagtcttgagttctctaaaaatttcctcaaatgatgtttctaaacagcaaagtatcccatcattagaatttttcagatttagaacctatgtaaaatggtaagacatttcattggcttgcaaaagtctctgatgtccgcattcttacttaatcgcatagagctgtgttctataattggagtattttatctagtgttttctctttgaggatttattgcattgaaaaaatttggtgatattgaaagaaatccaaagaacagaaacagagataattaaaggaatgaaaagtggaaactgtgagggaagattaaagacagctgtgatcatttagtttggaaagaggtaaaaatgatcttcagttataggaaagatttaatatggaaaagaacagttagtctccattgatacaaacgatggattaagataatacgaactgaaacttgcagaaagacgaatagagagcaggctgttatagacaaccctgaagtcatttgaagtgaactgagtccttagtcttatttccttgactgctcagtcaccaatggatagtccatatttggtttgctttttaaaaaaaatttccatcaatatttacaaagtaaggtatatgaagaagtcttataaactaaataagttttgtgaaaactcaaaagttagaattgtaaacaagattttagcaaatattttggtacatttatttaagtacttcaaatgaacttttcaaataaactcttaatatactttcattttttgccacggaaaatagagagcctagagtaaaacagcatatacccacgtttcccaaactgtgtattaaagcgccccaggaaaccatattaactcaaataggcaccatggattattttaaattttaaggaaaatagtgatactcaacatctgttaaacatcacacagagtacttcctccaagtagttcacagatttaacattagaacacaatagtttcttttgatgatatcacatcgttgagaagcagagttttcagtgcttcctgtggtaaaaagcaagtaccatggggaaatcagcgtggaataggatatataggtggtggtgtctaattcgattccaagttttaagaagttgcacaacatccaatagacacatgttattagtaatgttgattacgtaagagtaaatctttttttctttcaatttatgtgcattatttttttcaaattgctactcgggtagaccataagtatgttttaagtagtgtgggcttaactattaaactggcggtcgtattacaaaaaatattcatggagtgctgtgaaaaattataaggcaagtggatcgccacaaaaccagaaaattgagagtattctttgttaatttgtttcttattttaaagtaacaatgtgcatcttatgtgcttcacaatatgcttacattggtacaagtaggggttagaacaaatcatggtacatttgtgacagaatattaggtttagagccataacttgattgttcatttaaatgactttcatggtcagaggttctttttctagacaatcttgtagggttttagaaatatttcttattaattataactaatatcttgtaaaatgaagattactttattacttctttaaggcccaaaatttcttaagtgctaaagaatactttagtggtaatctgtgtctgtggctcttatatttttggtattggtgaaaagcatttattgtgactataaaaattttaaacattttgaaatatgtgaatatgccttgaaatatattaagaagctttctttaataatagttttcccaaattagaagtgcactgtcccttgaggaaaaattggaatcactaattatgggcttaataaaatgttgctaataggcaggaatggtcagccctgaattaaaacttctactagtgagaaaatatgaatgaatgtaattctacattttattcaatttccttttttgctatattttcccaatataccagtttgtttgaaaatgatgtgttagtaaaatatgtcctccaactctaacaatcagtttatgtatttttttattttattttattattattatactttaagttttagggtacatgtgcacaatgtgcaggttaattacatatatatacatgtgccatgctggtgtgctgcacccattaactcgtcatttagcattaggtatatctcctaatgctatccctcccccctccccctaccccaccacagtccccagagtgtgatgttcccctccctgtgtccatgtgttctcattgttcaattcccacctatgagtgagaacatgtggtgtttggttttttgtccttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagttgacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatggtgagcattttttcatgtgttttttggctgcataaatgtcttcttttgagaagtgtctgttcatttccttcgcccacttgttgatggggttgtttgtttttttcttgtaaattggttggagttcattgtagattctagatattagccctttgtcagatgagtaggttgcaaaaattttctccaattttgtaggttgcctgttcactctgatggtagtttcttttgctgtgcagaagctctttagtttcattagatcccatttgtcaattttgtcttttgttgccattgcttttggtgttttagacatgaagtccttgcccatgcctatgtcctgaatggtaatgcctaggttttcttctagggtttttatggttttaggtctaaggtttaagtctttaatccatcttgaattaatttttgtataaggtgtaaggaagggatccagtttcagctttctccatatggctagccagttttcccagcaccatttattaaatagggaatcctttccccattgcttgtttttgtcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagcgtgatgcctccagctttgttcttttggcttaggattgacttggggatgcgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcatgtcccttgtaagttggattcctaggtattttattctctttgaagcaattgtgaatgggagttcactcatgatttggctctctgtttgtctgttattggtgtataagaatgcttgtgatttttgtacattgattttgtatcctgagacattgctgaagttgcttatcagcttaaggagattttgggctgagacaatggggttttttagatatacaatgatgtcatctgcaaacagggacaatttgacttcctcttttcctaattgaataccctttatttccttctcctgcctgaatgccctggccagaacttccaacactatgttgaataggagtggcgagagagggcatccctgtcttgtgccagttttcaaagggaatgcttccagtttttgcccattcagtatgatattggctgtggttttgtcatagatagctcttattattttgagatatgtcccatcagtacctaatttattgagagtttttagcatgaagggttgttgaattttgtcaaaggccttttctgcatctattgagataatcatgtggtttttgtctttggttctgtttgtatgctggattacatttattgatttgtgtatattgacttcagtgatgcattatagattcagtgatttttatgtacttaggtagcctcttgaattgagctcctgaaactttgcaatgtaatgtttatcaaagtacatgtgaccatagagatatatttctaaccatttccttctcttttgagaatccaaaacccatgtggtacccacataaaaaaccaagcatttattctgcctcaatgccacattatttgtcattacatttgaatcataggtgaagagtttgaagcaaaatcaaattagtatctgtcctggtttatcatctctttgcaaattggacatttaatttttttataatagtgcacaagttcatattacatcattgtcagtttgtattagtattgctatatatgctggccataagtctgtaaaatttgacaagttaactgaaggactaatcacctgaaatgcatctgaccagtaaagataccatcagaatgatcatactttaagtttccaaaaatgatttggtgtttctgggaattttagctacaacagaatttaatgatggttcagaattatatgatattgtagtatggatactcttgtacatacactgaatttgaaagagacattcttgtctatacatggaatattgaaatattaaaatgacagttatccatgggttataattttttcttttgtgaaaaatgctaaatattaatataacaaaagttaaagcctgttaattttgtgtgtgtgtgtgtgtgtggtctacacactaagaatgacatatctaacataaaacattctttgagtaatatgaattttagaaccattgcctgtgtgttggccagttcacacttaataaatatttaggtattgtgaaattagctctaataccaacatattatcttgaaaggagaatcagtcatcttaatgatagtaacagcctcttgtaaattttattaagtatattaagaacaattcctttggttgaggcaaagtttaacttccaaaatgatgtaaggtgaatgatacttcagagtactattcttttgcactatttacaggttacagtgtcaaacagaattattggcatattttcattttaacaatcggaatatttggaggcccatggttctttgtcaaatatttgcgtatattttagtaaagctagttaaaaaattcacaaaacaagtaaaatgctcttcttgtatacttttgacatcagtatttctcatgttcaatatgtgctttaatattgaatgttcagaattggatgtgtgtgtatatgtgcacagacacatatatgtacatttaaattttgatgtttattatccagtatagcactgtgcacccaaagatatataacattacttaatgataaatttctgtgtttttttctagtattatcttgctgataataaatatacatagtctcaaaaatttatttctcttagatctaaataatattctttacattctgagaaatttgcatttgataaaatttggatattgaaagaggctaattctgctcttttcacaagtttatctttttgcaatcaaagtagataaagattattgctcattaagtattaaaaatgccaagcagtgggatttgctacagtttcacattgatggctgatctagaattgctacattttacaatccatggcacatattttaatatctcttagttcctaaatatagtttctcaaattaaattaatttaggcaaaaagataagttcactgacttacagaagttaacttaaggaaataattaagcacctcaccaagcaaccaggcttaaattctactgagaccctctcattggcctgccttgctcctttcctttctgagccatgctgattcttagtgcgtatgttttttttctccatgcactttgaatggaaaatcttatctccatgcacttaggatggaaatcttcttaggtggaaaatcttacctctgtttgcttcctggttttacattctgcatcctcaccattggggtggaacggactttcaccccagactcacttattcagaaatcgcagagaaagagcctctttggtccattttgggtcaaatgctcagccttaaaatggtcagcttgggccgaggcctaagtactgtaattaaatagatttagttagggaactttggggtttttattaagagtgtttccttcccaacagtagccacatcatttaggggctgaagtgaggaaggacttcctagaagaatggggatgcaaaccattttctgagttcagccttcttttcttcttgctgaatctctattcctgtaaatcctcaccagggatgcttccttatttcatgcagatctcagctcaaatatcacctttccctgcattattgtctaatattttgtactcctctttgcactctctctttttccactgctttattgttccttcacaacattgcttggtgttatttaagtgttcccttgtttatttttctactacactgggaacagtgtactgaacagtgaacttggcatattgtacgtattccagagatatttgttgaatgaatataagggaacactatgccatttccatagatatttttttctatttaccctaacctgaatttctctctgctaaatagaaagtatgcagggagaagtatctctgatgtatggcaaaagaatgtcaagacaaaatcattaaatgtaatggctagagttggacaatgaaagtgtgctgtaactcattagagaacatttctctgtatcatttcttccccatatagtaactgattttttcttaaataaagagatagtggcttcttggattccacaaaatcctttgatattttctataaatacagtgaatttggcctcaatgaagccactttttatgtccaatatatgcatttagaatacgaaagtataaatagcaaagatagtaatatgtgttttagttccgtggatgttcctaataaacattcaggtgatacctagggtgtttatatttagctaaactgactagataatccagtcatatctgtggtctctttcggtaaactgataattttctgacaaaatttatcacatttgactcattagttctttataagttttttccccaattcaaagcttaccttttcactctggtaaaatgctccttaaagaaaatttaccgtgatttctttagaatttttgtcactatctttaaaaaacaaattttcataattgtgaaggtttttttttagaaaatttcatttgagatgtgtgggaaagaggttaaaacaaataaagtgaagactaacactcaactctcacttttccactaaatgtaaattttatcacagtttctataccctcatccttgtcattaggtattatgcttttttgcagccatattcttaaggaactttttttgttttgttttgttttgggagctaaattctgttggcagaaagacaaaattttcccgtgttctgctctctagcatatctttctaattttaaaattttaggacctagagattttcatctcttcattttgaccatggtaatttgaagtgaaacagcaagatttgacataagaataaaagatataagttagaaaattcatttctgcagtttattcggatccattctggaataatttttcctcctatgatagattcttaaagcaattagaaaaccaagattttgtgatattactaatcataaaacaatgttaagttttcgtaagagagggccgatttgattttttttttttttttttttttgagacagagtcttgctctgttgcccaggctggagtgcagtggtaccatctcggctcactgcaacgtctgcctcccggttcaagcaattctcctgcctcagcctcccaagtaactgggactacaggcacatgctgccacgcccggctaatttttttgtattttagtagagatggggtttcaccgtgttgcccaggctggtctcgaactcctgagctcaggcaatccgcctgccttggcctcccaaagtgctaggattacaggcgtgagccaccgcggccgactcttttttttttttgagagagagtctcgctctgtcgcccaggatggagtacaatggcatgatctccactcacttgcctcagcctcccaagcaactggtactacaggcacatgctgccacgcccagctaattttttgtatttttagtagagacggggtttcaccgtgttagccagggtgatctccatctggtgacctcgtgatccgtccgcctcggcctcccaaagtgctgggattacaggcgtgagccactgtgcccagcccccaatttttttaatgatagtgaagttgaacaagttttttgcatttttggaaacagatttgaatattttaactttttaattcttctttgaataatttgcatgtttttaaaaaactctttcatggaatacatgactggcttttgaagtaaatttgttatatcaaaaccagtattttctcaggtgaagtggaatggaatgaaatagaattgaatagaacactgggatagagtaagtagaatgtcctggttgcaatatattccatgaattttgaattctaattctaactactgctgtttggtgggagttctcctacgtaagtttcattttattatggagtgtatgtaccatcttgctcatatcaaatattcctttaaattctataaacctcaaaatttccctctgtttaatacagaatattgactgcaatgatatcagattttaaaaatctgtatatcattcttgtggaaggaagtatatattcttgtggaaggaagtaaaaaagtatatattcttgtggaaggaagtaaaaaagttccaaagcctgttagaatctgtataaacttatggaatcattacttctttttgttttactacattaaattcaccttaaattcagtccaggtttttactttgagatatttcatatctgaaatggctacagcattctgttgcactcatctgctggagctcaagcaacttataaacatctttacattaatattcagaaatcagtttctatcatttaatatgtagtgtgggaatagttcacatatagagtttggctgtatctttgattccttatcctgtaccacatgagcaagatttcttcttctacacatgcctttggaattgcctcatatacactcaaagctttccatttaagcaatttagtgacaattgcattaattcaaatcatagctgattttacaactgaagtagaatatgattggggattatctgaagtctcctctaaaactctctcagtttaaattgatggtaatctactcctgaataatgaaatatttcaaattgtctaattgcatgatataaaatgcatatacaattgtattaagaataatgataaaatgagaatctctcttgctcttataaaagcaccatgactagtttttacatatgaattcaaaatgattcggttgattcttaacatttcataacaccaacctgttctacacattcattttagcatatattacttttagtacgtgattgggagttttactggaaatgtttctgtcttccagtctctaacagctttaagcttatattctaatttcagtaatgaagtgagatacctattcctacctcaaaaacttccctttcacaaagactaaatttcctcaaagattgagccttaaagaagcaacaagaaagtgcataaaaaatgcaaagctgattctttgcataatattaataggccctttgaagaaactgtagagtgaaaaagggatggtggtattatatcttgctaaagctgctccaaatcaaattatttctaaaattatacttaaaaactaaatttgatactgactttatgatacctatatcaaatattattttatcttgttttctcttgaaagtaaggagaaattgaaataatttgaatatccctcttctttgttatataatcatcatttttgaaagttttttcaggtttgtgcaatagagtagagcaagcaatattagattgatacttagtggatggttcttattccttatttcttcaaacttctcttcagagtaaagttttgataattgataattttaatcattgatttctagggtgatagctattattttggaaaataaaggattaaaattttcatgccgaaggatactgtttacattcatgtatagcatgcaatagggattttgtttatctggccattttgaggcaagaagggatattatgttgaagtattcatttcttatttttaaaatctgatatcattgcagtcaatattctgtattaaacagagggaaattgtgaggtttatagaatttaaaggaatatttgatatgagcgaggtggtacatacactccataataaaatgaaacttacttaagagaactcccaccaaacagcagtagttagaattcaaaattcatggaatgccacagaatcctgaatttggaagaaaattcagaagttgttcattcaaacttcacactaaaagcacctttcaactttacctgttaatcattctaaaccaaacttcctcaagtgtctccttaaataaaaggcacacttctggatttaaggaaaacaaagataaaaaggtcacaatctctaccttgcagaaattagttagggcagcctaagtacaatgaagaaaaactcataattttagtaatttagcacaataaaagcttatttcttgttaaatagatacaggggtagtactctgttctacagagttgttctgggattcagcctccttaccctgtccaactccacccttttctaattcctagcactcctattcattcaactattctttcaactagggaatggtcaaagagagtgagggcaggattgcatcaagagattattaagggtcaggcctaaaagaaggcaccacttctactcatatttcattggccagaatgtagtcatatgaccaaaccaactaatgaaagaaaagcagggaaatgtaggcaaccttggtgtccaggaggaaggaaaaaatagtttagtgacacattggtcagtccctttgaaaaggtctttgcagttgacttatatatctctgaaagattgtccctctagctcctttttgaccacttaaatgtcaccactttagtaaaatgtatatgtaaatttgaaattatctgaggactttaataaaaattttaattcacagaatgattctccttttactttgtgaatacctgtatctaccttattaaaataaggccattttcagttgtaataataaatagaaagtgtgtttttaagcaccattgtaacttgggttatcaaaaggtgggtgctgaatgttattaatactattgattttctttgcactttacttctgttaagaagcaggaatcatgtggctctcattgcatagacagcgtgaagtgcttgtagaaacttgcagttcaccctgagtgacagatctacactcacacagactgcatactaggctgcacatctgtatgaaggcattactatttgtagggaaaaaaagaacaatattatgcttcaggccaggaaagtcaaatagctgaagtcaatattaagatagttaggataatatttcagaaaagatttgcctgcttcacttggcgtaaatttaaatagtcaaacttcctaaacatttaaaagttaaaacaagggcttaaaatatatgatgtgagtttcacataatgtctacactgcctctgcctgtacctaatgggaaaatgaaaatcacttacatgttaaagtctgattggtttacaaatttcaatgactacccacttagtagatacatctattgtttttatatcattatttttatacaatgggaagttactaatataatttttcccatatcccaaccttttactcttccccttctgtttacaggatgaaccccaaagtctttagtttatcaattcagattttttttaaatgtagcctcactgggttttcaacattattttccaatctacgatttgctaaataaacttgttgctccaccaaaactgttctctccaaagtttgtgaatgtacatctctctcttgccctttatttctctctttctcactctttatttcatcacatgtgtagatttatgttattgtaatctgctttttacatttttttaagtactgacactactgttccatgctgcctctcatgagaaattttctagtttatgcagacttacctcagagatattgtagtttaggctccagactatcacaataaagggaatattgcaatgaagtgagtcacacaaatcttttggttttccagtacatataagggttatactatactgtagtctattaattatgcaatagcattatgtctaaaaaagtgcatactttaaaatactttattgtaaaaaagatgctgacagagacacaaagtgagcacatgctgttggaaaatggctctgataagctttctcaactcatggttactacagaccttcgatttgtaaaaaaatgcattatctgtgaagtatgatttaaaaaagtatgcccatagtttggttccaggactagctagtctctaataactagctctactggttatattttgaattctttgggattttctatatacaagatcatgtcttctaataaaagagattgttttattttgcctttccaaattgctttctcttgcccaattgctttggctaaaacttccagtacgatgttgaatgacagtggtgaaaatagacatccattatgatcctaatcttaggggataaacatgtaatgtttataaacagtgttgttaactgaagcattttttcttccttattctagatttattaaaaataaatagtagatttatagaaggcaaggataaacatacagattcctgccatgttaatatgtaatttaacaacaaaattatatgtctgtgctgctagatatgatagaataaaaatgatattgcattactaatttaactggaatctattttattattagtgaggttgaatatcttttatgtttcttgtgtgtattcttttgttaacatctcatacattttcctatttttattttcatgtttgtcttttaatatgcaagtttttatattgactattaacttttacccatcttatgtcttgcaaaagtctttcctagtatgacttttttaaaaatgcctttccatatagttttaaaattctgtggcataaaattttttatctttcattttattctttcagactacgtgtcctactttaaaagtcctatgtgggtataataaaaaatgagtaatattaggttaatctaccaaatattttttgaaaatttgacaaacccttgaaatccaaaatgcaaaagtattttatatcaattaccagttttaaattaggagtcacatttattgtaaaaataaacaatttttgatacttggagaaaacaaaaaagcattcgatacaagtagtccaaacaattagaaattttatttcacatgcacagtttagatattactttataaggggaaaacagatacttgagtatgacatggagaattgtgactttggagggtggcagcttcttagcatgatttcttttaaacttctggtataatcctgtgacatttctgtaaatgactaccactggaatccttttttgtggcccaggtattgactttcagaacccctcattaaaacatagttatggcatcagtctattaccagtccataacattattacacttatcctgggaaaataggaaatacaaaaaaattaatccctatttagaaatctctgcatagcagatatgattgtgttttacgtacattgttatggttgaaagtttttttttccccaaaatctatatgttgaaatcctaacctccaaggagctggggccatttgggaagtgattaggtcataaaggaggaagctctcaaaatgggattaaagcctttataaaagaggcgcaacggagtttctgttcatccattttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaatctgttcatccattttaccatgtgaagatgcagcaaaaaggtgccatgtaagaaacaggaagaagagggcttcaatagactccaaattttctggtacttttatcttacactttccagcctccagaactgtgagaaatacatttctgttgtttatcagaccccccagtttctagtattttgttacagcagccaaatggatttagacgtacattaacttttttttttttttttgagacagagtctcgctctgttgcccaggctggagcgcagtggcatgatctaggctcactgcaagctccgcctcctgggttcacgccattctcctgcctcagcttcccgagtagctgggactacaggcgcccgccaccatgcccggctaattttttgtatttttagtagagatggggtttcaccgtgttagccaggatggtctcaatctcctgatcttgtgatccacccacctcggcctcccaaagtgctgggattacaggcatgagccaccacacctggccgacatacattaacttttaatgatcacataatcctaattaagatatgcagataatattaaatagccacatgtgatgcatgaggaaactaaggatagtgtggtttaaataattttctcaaggtgacagagctattcttttagaaagtcagtattcatacctgggcaatttggctctaggctctatgcttcccacttgactggccagttttgattcaggaaatattctgagcacaatgtgctcaaaaaagaagagactcaactctgattagaatagaaacagtgaattcagactttgaaagatagtgtaaaatcaaggcctctaaatgtgttccagatgtggtactatccttaatgagagaatgtgtaattgtttcagatgttggtcatggagcacagtgaatttggtaattattgacccaacacaggtgctgtacaatacaggtactacaactcgattaaaattagcaaagactttaaaattgttagcttgcaaatataaagataatcaaggaatttgaaaccaataagaggaattaagatactaacctgtagggatatatatgtttcctaccaaataattagatcttagtagaaaatgtattagctctatgttcatctcagtgaagacctatggctcacagagctggaggcatcagaaggtgactggggaagagtttgtcaatacaggctttgcagacctttactgtctcatttaacactagacatgttcttcagctattctgtgtgtaggtagtgaaggatttgcaatcagaaggaagtgatctcaaatgcaatgactttgcacaagtctgttaatgtcttaaagtgttatatagcacttgttttatgttgtaggatcaaataatgtaaacaattgatagaaatgtaaagctctatgcatttctaattactttggtaattaaagtttaaatcaagaaccagagaagttacaaaattacagttgagaggaaaaggaggggagaggaagcagaaaggcagtgagcagacagcagagggactgctgggagagcagtaggcactcaaggcgcatctgctccatttcacccattacccatgggtaggcgctggatattgggccttttatccacagaattactttctgaggggaaatgtaactgtgactgttatgttggtttcttttcctgtgaagcaatgtgcaaacatcaaagaaggtttctattagaatcaaagtactccttgattgcaaaccttcttaaataatggatgacacttgaagatgttggttgtcatttttaataattaactatgtctaattttggcagtaactgaagctttattttctgtaagagcttgacagattacttgatttagaggagcaagagatttagatattgcatagtgctgagagccacaaattctgaataaatttcccactctctgtatgacattttcttttcaggtgaagttttctcctttcatgggtaaatagattacaggtagataggtaggcatgtaagcaaatagatatctactgtgtgtgtgtgtgtgtgtatgtatccagatagatagatagatagatagagctaagatacagatataaatacctaattgtattctcatgctgccaataaagacttacctgagactgggtaatttaacaaggaaagaggtttaattgacttacaatcccacatggctgggaagactcataatcatggtgaaaggcaggcaaaggaggagcaaagtcatgtcttacatggcagcagacaagagagtgtgtgtaggggaactccccttcataaaacaatcagctctcctgagacttattcactaccatgagaacagcatgggaaaaaacccacccctatgattcaattacctcccaccagttccctcccatgacacctgagaattatgggagctacaattcaagatgagatttgggtggggacacagccaaaccatatcattccacccctggcccctctcaaatctcatgtcctcacatttcaaaaccaatcatgccttcccagcagtccccaaagtcttaactcatttcagcattaaatcagaagtcaagagtccaaagtctcatctgagacaaggcaagtcctttctacctatgagcctgtaaaatcaaaagcaagttagttacttccaagaggtgggctcccatggcctttgaaagctctgcccctgtggcttcgctgggtacagcctccctcctggctgctttcatgggctggcattgaatgcctgtggcttttccaggtgcatggtacaaacagttggtggatctactatcgtggggtctggaggatggtggccctcttttcacagctccactaggcagtgtctcagtggggactctgtgagggggctttgactctgcaatttcagtctacactgccctagcagaggttctccatgaaggttctgccgctgcagcacacctcagcctggacatccaagcatttccatacatcctctgaaatctaggcagaggttcccaaacctcaattcttgacttctgtgtacctgcaggctcaacaccatatggaagctgccaaggtttggggcttgcatcctctgaaaccatggccccagctgcaccttggggcctttttagcaatggctgggatgcagggcatcaagttccaagactgcacaaagcagcaaggccctgggtgtggcccaggaaatcatttttttcctcctaggcctctgggtctataatgggaggggattccatgaagacctatgacatgccttggagacattttccttattgtcttggtgattaacatttggcccctcattttgcaaatttctgcagctggcttaaatttctcctcagaaaatgggtttttgttttctaccacatcatcaagctgcaaattttctgaacttttatgctctgcttgccttttaaacataagttccaattccaaaccatatctctgtgaataaataaaatggaatacttctaacagaatgaaagtcacctcttgaatgctttgctgcttagaaatttcttccaccagataccctaaatcatctttctcaagttcaaagttccataaatctctaggacatgggcaaaatgttgccggtctttttgctaaaccatagaaagtgtgacctttgctccggctcccaacaggtttctcatctccttctgagaccacctcagcctggactttactgtccatatcactatcagcattttggtcaaagccattcaacaagtctctaagaagctccaagctttcccacatctttgtgtcttcttctgagcccttcaaactgttccaacctcttcctgttacccagttccaaagtcacttccacattttcagttatctttagagcagcaccgcaccctaccagtaccaatttactgtattagtctgttctctaataaagacatacatgagagtgggtaatttataaaggaaagaggtttaattgtctcacaggctagggagacctcacgatcatggtggaaggcaaaggaggagcaaaggcatgtcttacttggcagcaggcaagagagcatgtgcaggggaactctcctttataaaaccatcgtatctcatgagactcattcactatcatgagaacagcatgagaaaaacctgttcccatgattcagttacctcccactgagtctctcccatgacatgtgggaattatgggagctacaactcaagatgagatttgggtggggatacagccaaacaatatcactaattaagcattataataatgaatagcttgataattacaaatatttttaaaaacaagtcattatgagttacttggaataatccataattgttactatattgtaccatagacaaagactttgtcttattcaactctgtattctttgaaattattagtaaaatattttaaacacaacaagtcctcactaatttggtgtgttggattgattttttaatgctgttatccaagtgattaatgaaattaaattttacttatatttttatttgggaaaattcaattcagtaccaggtggttttatttgaaaagaagccaataaactaccctgaacattttgagagtagacctgtctatatccatatattaatgtttgacctgaaactaatacacctgattgagaaaataattaaggtgtcagatggtaagtgtattttatttaataaacattggtattggacatccatgtgaggtattgttgtaacttaaaatattgggaaaatgtagctcagacagatatatatataggcaaacatacagatgagaagtctgaaaatatgccctatgttcctactgttttcaaactatagttattagtagattttgtgccatgtattagaactagccctaaagcctaagtattactgaaatcagaatgttaaatatgtgaaagatgtatttttgtgagatgaggaattaattattattttattttagtgctaggctacttatccatgagctttatctacttttaaaaatgtaatttgagaattatggctgtttatggatgtgtgaaagtaggaatattcatattgcattggggttaagcaatcagagaccccatttttgcaggtctcaacataaaagaggctgaatataataattgaaggagaaaataaagatattggaagttgcagttataagcaaggcataaatttagaagtaaataggcattacacatgtatataaataatgttggttgttactaagtgcttgtctattttgtttatattacacttctattactaataaaagtatagcaatataaattataatttatgatgaacaagcttcaaaatcatgatcagtctgtgagtaaattattagatagagtatagtctctgtattgagcatgttaattacatttgaaaacttaatccttgagtatatgtttcctacatgacatagcctcattattttctcaagatatatgtttatatttagtaatgatggataatcagtaatttccatgttaatgtttattggaatatttttctaaaagagaaaaaaacactcttttttcttcaacaactattactgatgtaacatcctttgatagttttcaagggtacattttatatccctcctaataaactgaaatgctgggtttcatctaggaaatctcatgccctgcaagttttttcatataactataaaatatcagaatgtggtagattttttatgtgctgatttcatgaatctcattagaaaatcctgttacttttttgagattgaaattttacactgctacctttgttacagaagatgattttttaaaatgcgtttttgattatcatgtagaactacagaaatagtgatgaatagagacatctgccagcacacatacagattgataatgactttatttgtactttggcctaatgtgtatcctgacagatcatcaaaacaagaaaagaaagagctcagcagacagtaagaaatggccagatgctcacagaatgatgaaaagtcattgtctcttatcttttaatgttcaaattatgcaaagaagacacttttattataaattttaaaaggaatctaacttatcaaacttaactgctacttcagggatatgccaaacattctggtctcgaaatgtttggttctcttcatcttctgtgttcatcctctcctttttcactatcagcctttctgcaaactagatgttatctctacctgggaaccttgaagatctcaagggctcccagaccattttgtaactgtttccctacatttaccttagtcttaaaaacctctctaatacattcattatttctggatccctccttatgttttagcctgtctaactccttctagcaacaaaatgtaatgtttatgtcattctgggcctcataagtcatttggcactgtactcaccaccacccgaagagtcccttaatatcttggtgaagatatagctggtatcttggtacagcactgagtatccctcactatctgtactctctgactgccctcccagggaacagagaaaagtaataagactaagctaatggattcactataaaatcactcattttcataattgattgatttaattctgggggaagaaacaacaggtctgtgttttaactttcaagactaaagagatgttctcctaattttgaaaaacatcccagatcaacaaaatatctttatttagtcccagaatcaaagggaatggacaaatctaaaccaaatccttgttaaatacagacttacatgatcatcttgcattttttttcagcaactgttaaccatggattttagtggatggaacagtagactggtgacaagggaattaattagtagaaaattgaattaattattacataatatacatctatttctatcattagttggaagaacaaatggaaacattttcttcatattcaaatttatgacatactaattttcctgccttgaagtacatcatttactctatttttatgttcattagcttccaatataatgatttaaatgtaaaacatatctatgtatgtactatttctagacactttggctttagacaatgaaagtcatagcaattctactatatttgatgtcttcaacttgaactggactctttcatattatgaaactttcagatatattattatcgtacagtagttttgtgcaagtaacttattcatttcattataactgtattaaaaacaaaacattttcaattttcacctaatgcggtttaaaattatgagttctgattctttggtgaattctacaaattagagaagtcacagaagtactgtgtgtcagctacaaagccctagggacttaaacagaaaaccatctcccaccaaaccataaaaataaatgctgatacaaagaatgttttgtatgctcaaagaaagatgaacttatataatgaacaataaaagactgtgtctactgtctttctctttctacactaattgcttttataacaaatcaaaatgtctaatatatatgattatttaataagaacaattcctttgaagttattcctgaaaatccaagaaagtagaagtcctctcccttcaaatacttcatgaaatagcattttgtgtgtacaaatatactttttatttattcacactaagtgaaagctcttaatgatagcccagtttcacagcttcttctttttatggttaaacacatctgtttgtttattgactctcctttttggaattaggttatgggagttcttagtatgacagttttagatatgatacagaaataataccaacatcaaataatttaggggaaacatgtggaaatggaaatgactaacatttcccctttgaatataattttgttagaagacaaaataaagcttagtatattattatataaagcatttgcttgttacccaaaataggaaccgtagaagctcggaaaaaagaaaactgggggctcctacctgtaattccagtgctttgggaggccaagtcagaaggattacttgaggccaggagttagagaccagcctaggcaacatagtaagaccctgtctttacaaaaaataaaaaaaagaaaagaaaggaaggaaggaagggagggagggagggagggaaagaaagaaaggaaggaaggaaggaaagaaggaaagaaggaaggaaggaaggaaagagagagaaaggaaagaaagaaaagaaaaaagaaaagaaaaggagaaagaaagagagagagagaatagctgggcatggtggtgtatgccagtagtcctagctaccagggaggctgaggtgggaggaccacttgagcacaggagttccaggtgcattgagctgtgattatgtaactgcactccagcctgagcaacagagcaagccccgtctttaagaggagaaaattggaaagttttccacagtgaaccttgagagaatatcaggagacacaatgaaggaggtcaagggaaatgtgagggagcttatgacccttaaggaaattcgatgaaactatgcaggtttatgacagtccttgccaatcaagtgaagcatttgaaagtatgcacctgtgtctaggaaatctatcagataccaatatatgtgttttctaccctaaccaatactattgctttcaacttactatgccaaaaactttatttagtattaaattaatatgcctactgtggaaaatgtccatgtattcattttaaattagctaaaaagcataaggagactttaagaaatgtttacctctctgtgaaaacaatataaaatatataagcattagagccaccatgtcagttgctatgcatttcagaattattctcttaaatatttcattattggggctgatttttataatccttctaggataccttaaaacagagaattttttctgacaagaaaagtactgatgattttttttaaaaatttttacttaaactgaactctatatttgctggtggcatgatgctttttagagcagtctgtgggatttatctattctatacctttccacatagctttgttacaacagagatgactataaaaattttaaggatttattttctttgtttccttttttctcagttcagtggagtctttaatacttttcttaatgtagccctagctttacctaatgctatgataatgctcactaacctgatatggatggattagagatgacttcataacctaacctaccttggcattttatttgactttatgcctactagtcattcaaagacgactcagaaaaaccaacatgatttgaaaacatgttctttttattctgactctcaaatgtcatgctagtttaaattttggcatagataaaaccattatgtcacatcattaagggctttctttattctatagctcttttgtttattgcagccacccatagtccaattgggtagacagggcagtttcggataagatcaaaaagcatatttttggtcttatcctaaagtatgggccctactttaggcgtattgaagcagaatttccgaaggtagggcacaagaaactgcatttttaacaccattctcaactgaagtttgatgactttttgataaacatgcttattttcatttcaaacttagttaaaattctctgtctaccgtccattgcctgaccctcatcctttttaacaacatagtacatgcattggaagtcacttatgtccacgcaactctctattttcaagttcagttttcctctgccataccttctttttcctcttgaccctcctaagtacttttactaagctgttttgaattcttgctctgtcaaggactatctatacatccttaactatcttctagattgttttagtcatttcctcttcttaaccaagatgttattccataagaatgatgctgtttgatctgaaacactctcaaaatgaaattgtgtatttttgcctgtccattgtgtcatggaagcaatagatggtcattgctttccttatctttccaccgtagatccagtagccttattattccacattacttgaagtaacatacaaataatacataagcttttcagaagatgaaaatgcgccacagttctagagctcaggagaaaaaattttaaacctagtgattctacactttgcctgaatttggtccaatagcatcatatcatgattcaatcagagaagtaaattcagtaggaaatatatattaagagattggttgcaaagaattggctcatctgattatggggactagctgggcaagtttgaaaactatagggcaggctatcagaaggggcaaacttgaactctcagccactggctgaagcttctatccattgggagaatttcttaaagaggtgtcagccttgcctttcaattgattaaattaagctcatccagattatgtaaaataatctcttttactcaaagttaactgcttatggactttaatcacatttataaaatgccttcatggtaacgcctagcttagtgtttgattgaataactggcctaggcaagttaacatgtcaaaaagatcatcacatgcaaattatttcatgtgaatttgtatgtatttgacatagttctttctgtgttggtacttgcagaaaattgtttcctaaatagcagtttttatgcatttgagatactcactaaagtcaatcctttttctgaaacccgttcccctagggaattctataaagctctgatatgctgtggagcctattggtcaatagtttgatagaatttatagctgtgtttcagccttttaatggctctctggaagtcatcaaaatccatacttaaatgccatgttcaatataattaaatatttaatagttacagaaaatctcttaagctttattctgattcctcccataacagcttgattaggggaaacatagctgtttacaaacagttctgagcaaatttgaaaaataatcatctctgaagaatttataataatttggagaaacattttagttaaacaccagattttctaatacatcactgatttaaatgacagccacatcatcattttgttgccaattgaaatcatgcacacctagaaatttttttgcattaaggtgctcacatgaaggaaaaaaaacgtatttcttgctatcagaaataacccaagcaacaaaccatgagattattcagataaatataataaaccactaatacatgagacatgattgtgctgtgaaaagtaagaatggcctttaaagggattgagctcttaaccagcacaatttaaaatattattaaaaaagaaacccatagaaatgaaaccctatattggactaagattctattagatctttagtattacaaaaacaactgctaactgtgtgatgtggttattcatgtttaaaaaaaatgcaagccaggtgcggtgactcacccctgtaatcccagcactttgggaggccgaggtgggcagatcacgaggtcaggagttcgagactatcctgctaacatggtgaaactctgtctctacgaaaaatacaaaaaagttagcctggtgtggtggcacgcacctgtagtcccagctactcaggaggctaaggcaggaggcggagcttgaagtgagccgagattgtgccattgaactccagcctgggcgacagagcaagactccatctcaaaaaataaaaataaaaaataaaaagcaaaacacttggtacaaaaatgtcctgggacaaattaataatggcacaatgccagaaactagcacatctttcctccttagtggtaattagtgcctttttacatgttgcacacacggagggaagaaagctcttcatcattgttctcccaactcagacatagaaaaacagaatgtcaggaacacaatgagccttcattttatagacatttggtactttgatgtctgtattatcttttggaaattattccttttagtgaaaacaatgaaggtcagagggcagatttcctaaaagcagcaattaatgtgaagtgttttaactattgcctccttgttccaaaactacctgcacatggccacaaacatatgaaagtgaatctttggtggccatagtaaacaattcagaccttggcccatagacagggttacacgtatggtggccctgtcttcatagaggccacctctaatgttaagttggaattgccagacccacttattctttctaagccttggtttctttacttgtagagtaggtttaattattagatattacagggttatcctgaggctcaaatgaggtaaagcactttgtaaattataaagcacagtgcaaatgttagcaattaccttaaatgattttaaccattcaaatgaaaagtgagaaattccaaccttggcatcatgtagacaaaccatttgaatgactgactcaatttctcagtcttctggagacttattatcatgtagctatttaaaacatgctggaatttttatcagatagtaaccagtctggcaggttcttttgtgaagacgtttgttggaaggatgtgttcttttacagtggctctataattggcatttaaacattttctcttgcattaaatatctttagtggtgcaatgttttgttggagttgcaaattcttaataagcgtatacccagatttttaataagcatatacggtagtaagtgattcagtgtaaaattcaaccagaaaatatccatcttctaagatgacagggtgttagacaaattacatgtaagattaagacattaatagagagttcatttctgtcaccccctaccatgccaactccaccccactctttgttagataatatgtggtctattttttgaattctttagaaaatagactctcttttttagagcagttttaggttcatagcaaaaattgagaagaaggcacagagatttcccatatactctttttccctctctataacatcctcccccaccatcaatattctacaacagagtggtacatctactacaattgatgagctgatattgatgcctcatcactcaaagtccgtggtttatgtgaggttcacgcttgctgttgtacattctattggctttgacaaatgtaaaataacatgtagcgaacattacagtatcatacaaaatagttatactgccctgagtgaatcagcttgctgatttacaaaaacgtttgtagaatttctaactggaattgcacaaaatatatagatccaaatttaatcttccatttcatgaatttggtacaaatctgatttattcttgtcttttaaacatttctatcagtaatgttttgtagtttctgtgtataggtcttgcacatcttttttttgtttttgaatgtattcataagtatggttttgctgctatgataaaaaatattatttattaatttaatttaaaaagtttatatttccagtttatagaaatataactatttttccatattagtcacatattctgaaaccttataattttatttattaattctatttgttatccttttagtcctaaactttacaaagatgatcaagtcacctcacaacagtgagctgtatgtcttcctttccagtatttatgccttttgcccatttgccttactactctggcggctaggacttccactacaatgtaaatagatataatgagagcagacatctgtgtctggatcccagaaatgcattcattcttttatcattaagtataaggttagcccttggttttccagatggctttacaaagttgaagtgtgtcctatctactcattcctagttcactaagaattttttcatgcatggttttgaattttattaaatgtttcttcagtatctatcaagatgattatattactttacattttataatccttcattttttctaagtgttcaaatttattggtctaaagatgttggtaatatcttatccttttcatatctgtaaatggtattccaaaatttcttctgatactgtaatttttgtttttacttttttcttaattagtcttcttaggagtttatcaaatttattaatatttttgaagactccacgtttgctttgatttttttcctatggttttcctgttttctatttcatttatttctgctgttgaatcatttctttttgcctactcactctgggctacattgctcttctttacttttcttcttacagtttcaaattaggtcactgctttaaattttttctccttttctgatatagacatttacaaccataaaggtccctccaagcactattttcacagtatcccactatttttgatatgtgtgtttttgtgatcatttcatttgaaagagtttctaatttctcattgtgattacttctttgatttatagattatttagtggcatgttatttacaaataatatgaggtttttctaaatactttactgatagtgatttctaattaaatcctgttttgatcaaagaacatattgtataagacatcaatcttttgaattttattgctaattattttatgaccaggcatatggtctattttggtgaatattctctgtacacttgagaagaatgtacatcccactgttgttatgtgtagtgttcaataaaagttaattaggtcaagggaatcaatagagttgtttagatctaatatatccttacagattttttttgttggttacatgttctgtaatgttctgagaggattttaatactaccaattgtggtgttgtctatttctctccttagttccatccgttttttttttttttttttttttttttgagacagagtctcgctctgtcgcccaggctggagtgcagtggcacgatctcggctcactgcaagctccgcctcccgggttcacgccattctcctgcctcagcctcccgagtagctgggactacaggcgcccgccaccgcgcgcagctacttttttgtatttttagtagagacggggtttcaccgtgttagccaggatggtctcgacctcctgacctcgtgatccgctcgccttggcctcctaaagtgctgggattacaggcgtgagctaccgcgcccagccagttctatccattttaactaatgcattttgaagctctgttattgggtgcatacacatttagaattgttatgtcttctagattatgttatggcatacttcaggtgttgcttttctggctggaaacttgtggccagtggtgcctctgcccgagttttgcgagggccccttgggcccatttggcccggcaaacagggctcagttcgcactaccagccgggatctcatgcctgccaagggcaagcagggcagcaaggggtgtgtgagtgagcgagcatgtggtctggccactgcccatagccaggtatgctggctgcagcagggcaggcagctccaggcgccaacatgagtgctagctccctgcaagtgtgcagctgcaccaggcataccataagcagtttccatgacagacaccagggaatgtggctgggcccagaaacttggagacaccaggaaccgcagagccctaaggaaggagtcaaagccctggctctgggagctcctatgtctggctcccagaagggccgcagctcttctctccttgtcacccgcaacattgtgagcaagggacgtatttcagccctgtttgttttacagctcttttagccctgccattcagtaggtcccgagttcttgttctgtgaccaggaagaacgaggtatgcagacaagtggagggtgcgcaaggagaagaggagctttactgagggtagagcagcacaaaggagacccacagcgggtagcttctttctgctgccagggtgtcctgaggagtgttcaggtcctagcagaggggaaaccctagagtgggtagctcctcttggcaggcaaatcattccattgagtgttcagctcctagcagagaggagaccctggagtgagtagctaatctccacagctggttgtgtcatcatctgtttagccctcagcagagagaagaccctggagccggtagatactcttgcaggcaagtcgtcccattgtctcttagtctgaatgagtctggggcttttatgggtctcagtggggaggacgtgcactccgattgttccatgggtggccatgggtgggcccagaaaaagcaccacaagttcccactctggtcagcaagaccagcagcccagcccccaggcttcagccactgcccctaacctgcttgaaggtggggcttccacccaagatctagtctgcctcctgcccagactgcccaccactgccatcaatctcctaacatcttttgccttattttactttaatttaatgtagccataccatttttttgtgtttaccattttcatattacatgttttctttttatcttcctttcaacatatctgtttctgttatttaatgagcatctttcattgacggcatacatttgtgtttttcttttatatctactctggcaatattttttaattggaatgttgatacatttatatttaattaatggaatttgatttaaatctaccatcttattacttgattttcgtacattccttctgtttttttcttctcttgcctactttctgtcttctttggggttaatcaatatttattcacatgttattttatgatttttttatattctaggtcatagatggcttaggtatttattgagatttccatagtacacgatgctatattatgtctttttatttctgcatatagtattactagatcaacttacaaaatataactaagaggacttctagtttactacatataatggaagggaagagagccaataagaactactttcaaatttttggtaagctgtcatgccatggactggaatagggtgcactaaaggataaaaggcaagaattcttggatttaattttgtacatttttaattagatgcctgtaagtcattgagaagtcgagggacatccttggtaccagctttaaatgaagaggtgaaagtttcaaattatttgtcatattattggcttttttttttttttagttttaaagtataaagaatataaaatgcaatttttttattttttgtgttctattctgaaataatattaaacattataaatttaattcttaatgtttaatcataataagtatttttatacttattatattcctttgaatagccttttttattgtcaaggaagttttttaagataaattagtctctacaaataatgtgctccatattccatgaccttagagtaaatcagttctacattagttgtgagatctcattaaaactacatcaatttccatagaatgtatttattttaaaaattactttgtcaggtttaaaattattttcttaaaactagttaactcaatgaagtggattcaagtttggatctcttcacaataggaaacaaattcaatgttagctaactatcccctgctgttcagtctcttgccagaaagctacagctttctgcccacacttacttgctagacatttgatttaataactgcacattcatatatattttttgaaaggaatgctgaaaacttctcatttgtgtatgagtaaactgaatcccaaagagttgagagatttgtccaaaggcagtgaagtcactgatacaagtgagaaacttggataaagcacaatctcctcacctttcctcattttttatttttaatttcatttcataacaattcctcaatggaaaagtaaatcattccatgatctcaaaaagctgtgatggatctatgagctactgagtttataagttaattgctcctttgttaaataactttaaatggctatttttttgttgttgcggtgttttttaaatattcatctcccatttccttcactctcagccatcattttggctactatcccagtgttgcctcaagtacccctttttcctttcttcaaatttgctccttctagtgtacttgggaaacactgatattagcccaattttctctaatacatacatttaaaaaaatttgtactaaatattataaatttgttcactctttaattgaagatatgcaaatatctaccactaaaaacaattatgggtttaagaaaagctatttctttccaacaaactagtgattatacctcattatctgatttgagattccagtcttaatattttcatatattttttaagtactagctcattcacattcatcattaactatttaagacaaagcattgtcttgaaaagtaaatacttatccgggtaactataactcaaaacacaatacctgattgttttgtgtgtgttcacaaaatattaaagattatatgacaataacaaagaacatacattgactgctttccaggtggcatgtactgtgcttattcttcacaataactctacagacaagaaggttccactatattccccatattatatatttggaaagtgatgtttacagagattttaaaaattgccaaagtaaatcatatagtaaattatagtcatcatttaaacagatttggttttaattgtgagcctgagacttcaattatcatgctctaatgcctattaacactgaaacaggtttcaatttgtatgtttatatacccaacctttgcatcttggatacacaattttattatttgctttgcactaacactcttacacattcaatttttcataattttaaattaaagattttcacagtccatcctcacaatgcattcagtgttacattttgatcttaattatatttgcaaatttaattgaactattaatattgaagatcaatcagtgtctaatataaaacataatatatttgtatcatggtgattttaatttattttataaaagtttattcgtgcttgctttattaatatgttttcattttcaaactgagctaaaatttgtggattttccctaataaagattaataaggaagaacctcattgtcatgagatatagacatgcacaagaacatattcaagaattcctagtttcattaaggaaaggtattaagaaggttgtagtctatatcattagagaaagaaaaaatgtttactaaatctggaatagtatgcttattggtatcatagtcaatgttctttaaaattttctttatatatatttatatagtttttctttaaatatatttaaattgtagaaaataatattttgaaattatagtctttgtctgctatttccatcttttattttaaaatactgcatttatttttctctatgctaaattcataagtgttttgtccccagttcataaatgttactatgtttctttctaatctttcttctttttttttctcttccttctatggcctctctttcactctgttttcctcccactttccaccccaccagccttatatggctttgtattgttcgacagtcaatacagtttgtgtccccttggaggagctcacttctctttggaattcaggttatttggttgtattatgactacaactttccaatgaattcaagaaaagttatcgttttatagattatttggtctattttcattgtttagttggctgggacactaatagaagctttctataccctaagtagaagtggaaatcctgctcttcatatcgtatttgcttttaaagtcaaatttattacattaccattttgtacagtaaaattcacccttttacatgaactattttactcatttggacaatgaatacaggaatataaacatcactgcagtcaagattttaaaaatcttaccattgcccagaaaggtccttcatgccccttggtaatcaatctcctctcttactaccctttaataccactgatcagttttctgcctctgggatttttcctttttcagagtataacctgtgtctggttttttttttttttttttttcatgattttgttgcatttatgagtgcttccttcctttttattaccaacagcattccattattatatagctccagaaactcagtaccaactgagatatttacatctgagaagggccagctttcgaaatctgccaggttactagtttgtggggattgagtgactctgttcagaaattaactgggtttgggatttttcattgctgtatgtacttgttgtacatcacgagtttaaataactctagatatgggctacctttgcccataactccaataactctagatataggctgtttttgccatgtaccacgtgaaggctaggataatggagagttttcttagtatgaatccgctggccccgcttttagccattcctataggtatgtgctatacctataggagaactgttagtgcttacgtccttatttagcagtagactgcagttgtttagtacttcatgctccgcccgtgttgtggggatagcagttctctgttgttttggcccagccacagttctgggaaacccatggagcctggactctgggtggagaattctcagtatgcctttcactcttctgcttgacagtcaaactctctgccttgtatttgttgtagatcttgaccttgagtgagagtttctcttcttctctattgataggaagctttgagtgggtataggattgcagttccaagagtttcccacccttcttataatcacaataactctgagttttttccttttctttcctttcctcagccgtggtatatctttactgcttctctcctgtggcttaagaccttttgctctgcatgagagaagagtccaaggaattgcacagtattttgtgtgtgttccccacagctgctcattctgctcctgcctgtctgctctcccaaggggcatttttatggtggtccacgttctttggcagttgagacagtttgtgtgtcctgtatctccttgtagggactcacgcttctttgtaattcaggtcatttggttgcattatgactataactttccagtgaattccagaaaatttattttgtaggttatctggcctatttttattgtttggttgtgtgggacactttgcgcctttcaacatcttcagtgggggtggaaatcctcttctttacgttattttataatctgctttttgaacttacaaatatatttgaagcaacattcctttataatattaaaatgatgtgtcccacaatttattttaccaatatgctatttttagatttactttgcggtatctcctttgaaaaattgtagttagacgacaggattttgcttggcacaaacactggcgtgacaacagatctcctaaaaagtgtctggatacaaacattctggtcttttaaaaaagatttttaagaaggaagtagaagaaaaatccatcacattagttgtaagtttccttctaaatgaattgatacggtgtaatcttttaaagaatcatgaaaggtgaatgcgagatctggctgcagtcccatgtccttgccctctgcagtagatttctcctctggaatgcacattcagttttctgcttcaaggatgaccagtgttcagggctcacattcattctcactcctaaattatgtgatgcttcctttctttgtttgacatcttcaaagtgaaaagtgtcattgccagggaagcatgaagatatagtcagtcccaaaaggctgtctggaaaaattacagaaagctcggttcttattggatcaaaaaataaatgtagggagaaaatatgaatatgcatttctacacaaagaattggattttcttaactgtttaaagatcacattgtgtaacattttacagtatggggtgccacaatctggatgtatcattttgaatgcgataactagaaaataggtaacaagaaaattaacttgatgttttcagtataatcaaagcaaaggattattttgactaaattgccaaacccttatgtaagcacagtgcaccaaaatgtatttcttaatagtagtgaagattcaacctaaacttggagaaacaaaacaaatatatcatcgagaaaaagtatagtgttgaactaatgacctttcagaagcatataaatgttattgtttgacattctaaaatcctcttttaagtaattttaaaaatgtaagtaaggatagaaggtatgaggaaaattagctaaaaataatcagtgaagaagataccttgttctccatgaacccagatttaaattttgcatgttttatatcagctctgtcaggctttgattatccacagccagatgacaatgaaataaagtaagttatgaagcatttgccaatgaacactcactgcctccttattcgctttcacttgcctaaggcagcctatagctcaggagaaagcttctgaaaccatatgtatagtctttccttaaactcaggaatatttgttataacagcataaatatttaaacttctcatagacatgcatcagtttgagggtaatcctgtctatatgggataaggagtaaagcgcaggaaatgtactgctctaggcaaggggtccttgctgtgttttgttcgctgtgagtccttcagagtaaagcctctggattttgaagtgctgtgagttcatcatcattagatacttatattcaaacaaaaccctaaaaatgcatttctgaaacaagtatatattgcatttctccacttttcatttaaaatatgctaatatttaaatcacctaccacttcatgagtatcttagataaatttcacatatgtattgtcttttccaagaattaagaattatattataagaacagcacaataaattgtgcctcgtcttttctcaatgaagcttgtccaattatttgagtgcactgtactttgaagttcataatcattaccttcttttttcttttaactttctaaagtgaagacctgattactgccatatgacttgtgcaaatattccactttgcaatatgtgctgcatataaatgtgcggtttgtatagtagggggtaaaatgggcagctttcctgccatctgcgtgctaattaaccagtgtagaacacagtcttgtcataggaaaaagccgtcttcatttctacagggtgcaaattatgttgccaggatcacaaggacagggtcaaagttggctgtcagcaatggttgtgggtttagtttgtgctttgaaaagacctaggaattttaaattaatacatagacttatacttccatatctaatgtatacatctacataaacaagctgtaaacataaaacaaaaaataactggccttttacatactaatacatatttgttctggatcattttctgttggcatctgattttctctaagacttacacaccatgctgttacctctccatggcatgtggtgggggggcgatggtgattaaagtatgacattaagtgtacatagaaacataattaaaataaatatgcattaatggttctctttaaatatagtgacccatgaattaactttttggtatgattaagaatgaaagttttaaaggcatcctttagcattaaaattcaagtcagcaccaatgattctaattagtgggaattctagcggggaaagtagttaagggaaattagttacctattgttttgaactataattttaaaatgtagttatgtttggaaatggattgttagcaaacatggatgtatgcacatctgtaacttgtgctctagactgccaaaaaaatcaataattgaaaatgaaataacacaatattttgcatgttatgtcaacgtaattactctcgtaattaaaacctcaaggagtgagaaggatagtacgtcagtcctgtggccatacatagagatacaatattcgttttcacgtcctttcaaacatgtgctgcaaagatggtagaaaatgaaagaaaagttatcaaatggtagctaaatgatctgcctatattcttaggtgattatgaaaatgttctcactttggaattaaaagtgtattgttttatccttcatcaaagtgagagaataacttcaaataggataagatttattttctatatacctattttctttttgtattttctgcacagatttctattaacgtttgagctttcaaaagcatatttcatgtttggttgtgtattatcaacaaacgtggttagctataattctcagactacctgtaaaagatatctaaggctatttttccttgtgggcagagtggcagtggtatgactacaggagtattgaaagatgtgtatgtctgaaaaatatgaccttttaactagcagggccattatttaagttaaggggatctagaatgtccctgaaaaaaagtaaggagctaatatttcctaagattacacattaagcatttaagccagttgcacctgtaaatatattactttattctgtaagtcccacttaacatatcagctctgctgtgaagttttcccttcttctcaacaccaatttaggtgctcctcagtgttctcacaattggcttcgattccttagcgaggcagaaaccaagtctaattatgttttttatgcactggagttaggtgagcatattaagtacacaaaatctttgtggactgagtgaataaaagaatatacattcattcaactgttgttctaacatacagcaagtccttgagggaattgcatttcagtaagctttgggggagaggccacatcctgaggggaaaatgtccagactttggaattggacagaactgatggaatcctgatactattacttattgcctattaaaaattaaaaaagtcatttaacacctttgaatgttaggattttttttattctaaggaatggtgacaaacatggtatcttgcaaaattgttgggacagctggacacgttacccctaaaatgcctgatgatgccttttcacccacaatagatgtgctacaagtaatagctcttttttaatgaatgagaaagacttccagaagcttatgagggagttatatgtaggattcttggccaagtcatagaaagaaataaaagaaataaataatagatggcagtgattgtggcacctacaagaggcataaagttgtaatattgtgtactcactaatttagcacaacattataggcatgtaacaaatttgttggttcatagtttcattaatttttgtcatgtagtatagctctgtcatataatgtgctgtctgtttaaatgttaagaacagactgtaaaagtagagtttaatttaaaatttgctcaatctgtctgttttgtaccttaagagtcattgaaatattttcccctatagaatgtgaatgttgtcattagaattgtatagatttttaaaatagtttgttgagggggatcacacatggtgctagaacattatttgtcattctagtccttccacccactagattatcagtgatatccaatggctgattttagagtagagaataactgaagagaaaacaattacatattgcctaatggaatgtcactgagatagctgtattaaaactatgggtatttttgttttacttttgcaatttcatgggtatttttatcacaggctcaaaaatactgcctgtgcttagttgtgttctctagtggctcactctcaagtgaaattcaaactattaattattaaaatattctaatttttaaaatttttttccagagaattttaaggcaaattctggctttcacagtaatgataggtaaatctaaataagcatgctgagagagaaagggcattagagtgtacaggtggttggagtggttgaaggagacattcagttccagtgattcatctggaaatttcctgttacagtgaacctccaagttaggcctgctgacagcacgggagcaagtatcttgaaaagatcatagtgagaattagagagaggatatggtgtgaaatctgggcaaattatatctacccacaatattacacattcttttttttaaacggtatgagtttactaggtttaagtgtcacgaaagatgaaatatgcaaaaagtaataaattgagcccacttttaagatggtaataagatcatttaatacatgtgtaaaactgctaaatgatttcgcagaaggattgcttcacctctgagtgaatcataaactcataaacaagcattcaacaggagatcaatgctgttttgtagtgcacacactattgcagcatctgctccaatacaaagataaatccagtgcaaaccatgtgttttactttttgggccagcatccttatcctgctgctcttattacacctaaactatagccttcaacaatctcatttctgattaagtagaaatcagttgcaggtacacatactactaatgtttgtatcaagataaatgagacataagactaaaacacaagctccaaaataagagacattttacattttgcaaaagttgactgtagtaaattattgaaatttggtataggaataaattagacaaagatgaataacttcatattaagacatgaaataagccatttacctatgggaccagtaaattacagattttttaggttttaaatcagatagacacttttgatgactcactttaaaagcataactgacaaaaaaatatgaaaaaataaatgagaggactttctatttgaaatcgtaggcccagagagattattgcttcttttgattaccacattaagtataagacataattctttcttttatttttgatttatttggacggttaagtggtcatgttagcaatgtgacaactataccaataatagcaagttgtaaactgtcaaagggcaactattcatcaagaagtatattttaatataagaccaggcgtctaatatgactttgaaattgttcatgattagattgctagcatattctaggtacccaaatgacatttctcttggacatggatgaactgaaaatcatgaaattcaaagccaggttatatgcagcacttattaatttagctaatttgatgtgtttcttaatctttcagtgagtacagtttcttagcatattactataatacagtctgcttcctaaataactttaggaaataatattaaagagattttttatgtcattatatttattcatatcaagaacatcaagcacttatcctctgcatctaaaaaaaagcaaaaaaaaaagcctatatatcaaattttaaactttattattattatgacattgatacattatagacaacaaaaacaaacaaaaagaaagaaatgtcccaggtaactgtttcacaattacacactgcattttgttagttcatttgaatatttcccaaatggtttattgaaaatagtccataggccaaatattatgctagatgaagatggctatgaaggttaatgagacatggacaattccgtgaggaagggcgcagcatctctcagtatattcagttagatgcttctacacgaattttccaaattatataagctaattttaaaatgttggacagcaattctagaatactctgggttactctgcattttcttaggtgctaaaaaaaaatctcttaatttgtcatcttattggaaaagtcttatataatgtgtcttatctttacctgtcttcctcatgcatttctgaatacttttactctactggtacctgaacacatgtttatctctccaagaagtatcccaattgtttgtttgtttttttcactaagtcgttcatatccttttacccagtcatcaaaatagattattcttctcaattttagagtctgcatataaacaaaacttctattttcattcatatttagggctactagattaacttgtgactcttctaaagatattcacatttacagaggatactttgtgatatcatatctgaactcaagggcatggatctacacataagaaagtaaagaaggaaagtcattaggaagatatcttagggctgaaatttgtgacaatcgcttcagagcagtccatgtttgttccacaaatttgtttaagtaattataaatacctgctctgaataacaaaatgtctttagtttcccatattttccattcttaaacaacaggtttactgttatccgtaatataccttagtatgtatctgtggaagcattctacaaagaacacaaatatgtgagcaagagcaaaatattcactcatctcctgattttgatgggagaaatggtcatagttgagaaccccttctgaaaacacatgtgaatgcacaagtgaacttacaattatttcccaaccacagtaatcaacaagacattcccaagtgtgtttgagttcttccagagctcctacttgtgagtgtcaagtgtagccatcaagtgtaattttctattactttttcctatttaagcacgagcctaaagaattaaccacgtgttgtgctagttgtttcttggtatttttttctttttcttttttagcaatcactgaattttgtcaattttatctcactgttgtgaagaacaaaatatatatagcaaaataaagattaagcgcataaaacaagcctgagagtgattccctacttgcttaagggaacacagatatttctataaatcagaaagtttgttagattgtaatataccaagtctcaagaatgtcaaatttaagagattgttttttagtagaatcagtcctgcctacctacagaattgttgtgttttgggcttccaatgaatttgaaaatgcatttaaatactactgagtattctaatatttttaattgtatttttgttactccattttccccctgaacttgaatcatcatccacagtatcagaatattattctatcagttatctttttctcttcagagtcatattgctgcccgtgttcacaatttatagtttttcttattttaatatctttcttttctttcacactcttttaaagatgattttaaaggacctaggttacttagttcgtatttcttttgatgggaaatacaaacaatctgtaaacatgggattagcacaaagactaacaagtcaaggtcagtttagcttccagcctcaaaacttggatctctagatgatatagtgataatatttcctctaggtccaaaatacgggattaacatctcatatctcctctctccattaaaaagtttatgaattttggacaaacaatggattggtcaactatatgtggtcaagaaacacagtttcagctaagctaaatacattaaattatgtatataattatatattatataattatgcatataacctgtcagtgcccagtaagtgttttctgaataaatggataagcaaatattgtttcaacataataaggaactttgccaggtgctaaggctcacacctgctttcccagctacttggggggctgaggtgggaggataacttgagcccagtagtttgatgctacagtgaaacatgttcataccactgtactccagcctgggcaacagagaaagatcctgagtcaaaaaagaaatgatgatgataataataatcgggaacttaattccaaatctatttaaggcactctattaaggggctcttatcttaatctctttataattttaaggatactttctaaattttgtttgttccatagggagaataaagtatatgtttctaaataattttccatactagatagttacatccttctctgtgttgccatatgatttttacagttttactatagcatttctttaattctgcttattttctcaattgcacttcctgggcaggtctttttgtttaaatgttatgtttacctgccatgtactaagcttggcacataactgctcaacaaatgttttaggaaagaatgagtaaatgaactttaaaaatactgattttttgttcaaactgaataatttaccgtatttctgtttttaaaagacagtagtgaggactatctgttttgaactgcataaaataaaccctattttgttttgatttcagtaaagtcaataaatattcatttgctatcaaggcaaaaatctaagcaacataaagtacaaataatttacatgttgctaaatttgagatgcagacaattaaatattaattttgctaaataatacaaaaattgtgttacatgcactagaattctagacttgtattctgcaggatgagtcttactggctgctgaatattatatttgtctggctacttgcttttgaagaatgtactttaattattgttaaaatactagaaaaagcattttaaggtttttgtcttggtggctgttcttgtgttagctgtggagagtacaacatggacaaaagtaactcaagctgtaggctacaatagacttgattcaaattctggctctattagcaggctgctttgtgatcttggctaatttatttagcatctcagcctcaatttcttgatatataaaatttgaataatgataataatacttcaaagagtagttgtgtgggtccaagatttagtatagcccctggattgtcctaagttctcagtgtaatttagctagtagtgcagtatttattgttaatgttgttcacatattaagctgtattatcaaacatataaacccaacatttttcggtagaaagctagattttccatatgatgaccactgatggcatcataactgaacaataaaatatatgtttctaactagtgtgctagaaaaataattgttaggtgttcttttcatatactgatataaatatatgtaaaagttaaaaatttaagcaattccagttaatagataattatatttaacaatcccagatatattatatttaccttaggctatgttatgctgtatgtttatataaaatatactatattatattttatcctacataaactgtaatcaaaatatatctttattgtatttttctggttttctaaataattatatttgacaggaaattcctgtatatattattccctcaatgcatgcagaaaaatatttatttatttaattattttgtttttctatgctttatttatttaaaacttttattgttaattattatggatgcataatagttgtagatatttatggggtatatatgatattttgatgcaggtatagaatgtgcaatgatcaaatcaaagtacttggggtatccatcatctcaaatatttatcatttatttgtattacaaacatttcacttccactcttttaattattttaaaatatgccatacattattgttaaatatagtcaccttattttggtactgaatactagatcataaccattctccctaactgtattcttacatccaagaatcatccccactttatacccgcctcgccgctactcttcagagcctctggtaaccatcactctactctctatctccatgtattcaattttatttttagctcccacatgtgagtgagaaaatgtgatacgtacctttctctgcctgtcttatttcacttaacataatgtcccccagttccatccatgttgttgcaaatgacaggagttcattcctttttatggctgaataatatttcattgtatatacttaccacattttttatgcattcatggacacttaaattgattcctattgtgaatagtgctgcaatacatatgggagtgcagatatctctttaatatattaagttcctttctttgggatatatactcagcattgggatttctggatcgtatgttagttctattttcagttttttggggaacctccacagtgttctccatagtgactatactaataatagtttacattccaccaatagtatacaagggttaccctttctccacatcctcaccaccatctgttattgtttggcttttggacaaaacctattttaacaatggtaagatgatctcacattgtagttgtgatttttgattctctggttattaatgaggttgagcatttttttcatatacctgttggacatttgtatgtcttatattgagaaatgtctattcagatcttgtatctattttaatcagattatttttacctattgaatagtttgagctccttatatattgtggttattattaccttgtcagatgggtagttgcaaatattttctccccttctgtgggttgtcttatcacttttttgattgcttcctttgctgtacagaagctttttagcttaatgtgatcccatttgttcatttttcctttggttgcctgtgcttttgaagtcttacacaaatcttcatcaatacttacattctaaagtgtttccctgatgtttttttttcagtggtttcatagtttgagttcttacatttaagtctttcatccattttgattcgatttttatatatggcaggagatagagatctagtttcattcttctgcataaggatatccagttttcctagcaccatttggactgaagagattatcctttccccaatgtatgttctcggcactttttcaaaaatgagttgactgtaatttatgggttgtctattctgttccattggtttatgtgtctgtttttatgccagcaccatgctgtttcgattactataactatgtagtatagttaaaagtcaggtaatgtgatcctgtctagttttgttctttttgctcaggatggctttggctagtctaggtcttttgtggttccatataattttttttctatttctgtgaagaatgtcatcagcatttggatggggactgcactgaattgtagattgctttgggtagtatggacatttaaaaaatattggctcttttaacccatgaacgtggaacatctttcattcttttgtgtcctcttcaatttccttcatcaatattttacagttttcattataggcatcttttactactttggttaagtttatttctaggtaacttatttgtagctattgtaaatgagattagtttcttgattttttttgtttgtttgttttttgttttttttcagattgaccactgctggcatatagaaatgctactgatttttgaatgttgatattgtgttctacaactttactgaacttatcagttcaattagttttttggtggtgtctttaggtttgtctaaatataagattatattatctgcaaacaaggttaatttgacttcctcctttccaatttagatactctttatttacttatcttctctaattgccctggcaaggatatccagtactatgtcaaataagtgttgaaagtgggcattcttgttttattccagattttagaagaaaggctttcaatttttcatggagaaaatcatgtagaatatgatcagaaggtgacattggcaaaaatgactggaacaatgtatatattgtgagctgataaatacttattaaattttccttgtctctcctccaaagaaacagagccactttagtaagaatcccaaaatctgccaataaaattacttggattttttccttcctcatgagcaatataattttaaaaagattatatttaaaaaagactaatatcctccctcatgagcaatatatttaaaaaagattttaaacatagtgggtattcagaaggtgttacataactgaaatagactttatcattcaggtcattaaactatctcctaccacattgctgtttttctgaccctaaacagctctgttttgggaatagtgcaaatggttgacactttaggacacttgttatttgttagatactttcacaaaattgagtttgacagtagagagaagaagagattatttaaaagtaattaaatgtaaatgtttggtggtatgatctgttagatcttggaaatgtctaagagttctttgccacctacctatattactaagggcttctttgaggattttgtgatgtgtaatagctgttgtccataggattattcaccagcaaatagtttaagatttgaatgtagatatataatctgatacttaatcagtgaaaataggcaatggctattaatatttaaagctataattgatttttagatttttttgtctgtacagtgacaaactatttgaacagaaaaagttaaaagtcgaaaattgtgagctttgtttaaatagtgccaattatacaaacttttcaccatttccaaataatgattggatatattcacttttctttgtgtgattggcattgtttgagttccagtggtagtcatgcttaaaactgcttgacataatgggctttcttctattggaatattttgtattagtttaaccttgctttgtgggatttacagtttattgaataagaacagaatatgattatttctttttaataaaatatgaaaaataaacatgggaatacattgcttttaagaagtaaatgtaaaatcaaatgactttaaacctagtacagttctctagtgacatttgtaataacttgcctaaggcattaattctaatcactttgtcattatttgcagttttattttaagcaagttttatattaattccccttactgttttagttttaaaagtaatatatgattctcttttaaattatttttatgctgcgacttcaatcttccaataaaacaaaaaaagggttgccttaagatgtagtgaaactgaagccttaattagcgacaggcattatagacaatgcttagaataatttgggcaatcttgaaacagatcttaataatattagttaatagagtgttagagagtttacagtattctcacctaggaattggtccaatggcagctactaggaggacagcagcccagtgaggccctgtatggacctgttcagtatcaatgaaacaaggacaggatcagtaaggagatactcatacactttcatagtcattgctatatatttccacaattctaaatcagaaaactttgtcatatttttaaacttcaaatttccacatttttgaaaggatttagtatgaattttctaattttagcattcgttgttcttctaaatctcatttttatgcaaagagaggcattggtccatatagtaaaattgtccttgcattactgttatatttaatattttgattgattcttttgttgagtattcatgtgatttagttattagactcaaaatgatgcaactttaaaaacccaggaataacattcatgtatgatcaaggaatgaagagcacaaaaatcagtttattaatagctctcctgtggaaacactcatgatgtaaattggactattgaatgtttatttcgttagatatacttgcatatttctttgcttttacttagcttcaagcaatgtcttctacctgtaggtcttctctctctgtatctaagtccttcgtatcttttcaaatccagattttacgtgcgaatatcctataggagatgtttagtgatccccccagctgataaaagttaccttctctgagtttcttatgacacagaatttgtatattttatgccatgtatcagttttctaccttgtatcatagtaatttacatatcttcatcctttctctactttgaatttattgaggacagattctgtgttttacaaatctgcattgggtactcaataaatatttgtcaaataactaaataaatgagctgtgttaaaattaaattggttcccggagtcttagtaaaatatagctgcaaacaaatatttttatttctgtttgtgctttcaaaactgcactaaaattatactaaataaataagaaccctaatattagcactatacccaccagaaaaaaagaataaataaaaaaatacagccagaggagtgagataaacatagaccaagggaagagtttagataagttataacagattgtcagagggagaaatcttcaaattaagttcctgaattgctggtaaatatttgacaactcactctctaaaaaatgtatgcatgtatttaagtttgttatcaacatagtttataaataataaaaatataaaatgtgtaatgataaataataaaatgtacaatatctttattgtaaaatccatatagtgatttaattctcacagaatgtttttcttgctttttacaaaatactggtatctatagtcaatctgtggttgcataggatgaacaagtgtattcccaacatgtatgtttaaacaaacaaatagatgaaagtggtacaaggaatatccacatgaaactcggcattttcaacaataatgtgagaaaatttttagctaatttggataatagctttcaaatagccaaagaatatttcttaaatttgttgtactattcacaatataatgattacagatgtgccaacaatttactttcatcttcattgttaacatttcctccattgtatacttcaatgtagacaatagacaaaacaataaatcaagttctcatttgtagtatttgccaattcacatattgtaaatattctcatcataactagtttcgacataccaatagtatgttactgaatgtggacttcgaaagagattaagaaatagcacaccatcattaacattctctaccacatagatgtaaagatgtaaagaatcttgtgagtattaatagtagtaaaattcttaagaatttatgagtttaaaatataatgttttgtcttgaatccatatacttgcattttaataaaatttatttggaaggaattatgtatactttgatttgtaataatagctgtgtttaacaatgaacttgcaaaattcctgaaaacttacaagggtcaaaacttgtggcgggtgtggtggctcacacctgtaatcccagcactttgggaagccaaggagggcagatcacttgaggtcaagagttcaagaccagcctggccaacataatgaaaccctgtctctactaaaaatacaaaaactagccagacatgctcacttgaacccaggaggtggagattgccatgagccaggatcatgccactgcattccatcctgggcaagaatgagactctgtctcaaaaaaacaaaacaacaaacaaacaaaccttgtacacgtctatttctacagcaaatgggcttcagggtggggaatacattttaaaaatcatttgaaagtcttttcaaagaatgatcttatcttttccccatctgagcaatcagacatttatccagactattcctgcaggaagaagccattgcctgtatacaaagactccaataagctttctggagcttctctcagaagtattatagggagtcaatcaaaagagatgatttttgagaaaagctgccgatatatgagacagaaacaaaaataccaagcaaacaaagaagaaacaaactcacagaaaagagaaataaatcagaactgaggaaaaagatctatggaaatattttcatgacaaaagataatgatattaaaaaaacaataatcatggaacataagcaatcaacactttaattgtgaagaaaagagcactttagaactcaaatatttggccatttatattttaaaaatcaatagaacacttgaaaaataaaccaaaataaatctctcaggaaatgtagccaaactaggtgaaaataggagataaaagattttaaaattagaaggtcatttaggcgatccaacatctcacttacaagatttttataataatcaaatataataaagagattttcacacaaataatacaaaaaagaattacagatttgaaaaggactctccaatatgatgggcccaatccttatgtgctgtatattataagttctaaaataacatgatacattatgtggaaactttagagccactgaatattaaaaatgcccatagggaaaagcaggaataaaattaaaaacaaaactaaatgtgactggaatagcatttgtttttcaactaactgctagaagtcaaactttttttcacttttaaacttctaaagaaaaattattctcaatctagaattttatacctaactgtcataagagtaagagtgtgataaaggtgccctcacatatgtaagatctgaacatgttttcctgcagtgttctttcttaggaatccatcagaggatcttctcaacaaaatcagctaagaatacatgagatccagaaactagaggaacacctctagaagactgttaaagatagtcctggccggatgcagtggctgacgcctgtaatcccagcactttgggagactgaggcgggtggatcacctgaggtcaggagtttcagaccagcctggccaacatggtgaaaccccatctctactaaaaatacaaaaattagccgggcctggtgacaagcgcctgtaatcccagctacttgggaggctgaggcaggagaattacttgaacccgggaggcagaggttgcagtgagccgagatcgcaccactgtactccagcctgggtgacagagcaaaactctgtctcaaaaaaaaaaaaaaaaaaatagtccacagaccacacactcagtctaaataggagcatgagtatgggagaatgggagtatttagaaatatgtgcgaggatttcaaaaaattaaggtttgaaaaccaaaggaaaaatgcagttaactccaggtagagaaaagttgcctaagaggaattataactgcagtcaaattacagtcaatttttattgtttgctaattgtgtatttgtaaatttgcctaaaatttacaccaaaacttatttgttatcccccagtcaatattcacggcacttttgcaggcattcacagacatgtgaaaagcagccaaaaatttgagatactcaacacgcatatgcccaactgaggtcaagccaagcaacactctgccttcttctttctgctctcaaactatatacaagtgtctttttgctgtctgtttagtgtcacattattttacattttcgttataatttcactgttttaaacggcctgcaaatgtagtgtgtagtttctcagtgcaagaaggctatgatgagcctcatggagaaaatgtgggcactaaataagtttcattcaggtatctgttattgcaccggttggccatgacttgaatgttaataattcaataatctatattaaataaggagttttgtatttattggcaaatacataaatatattgacaaataggttgtgatcagaggctcacagaaacctaaccctatattttcacctcaaaacaatggttcattattggataattcaatcataaagcaatggttcatgtggataattcaatgtttgcagccaatgtgtagaacataactattataaataacaagaattgactgtatattacaccatttggcctgacaacaagcaatttctaataataaatataaaatacataaagtagatgttaatatgaccaaagtttgccacatagccatactgggaaaatggtgagaggatggcaaaataggaaataataggcaaagctaaaattaatatcctaaagtataaacatattgtatataattttgaagttaaataagtaggaaaaacaactcagtacttgaaagtggtggcctacagaagcatcctgggagagggggaagagtgaggtaggaaagtgttgcttttcatataaattgtgatattacatgtggttataaatcaggattaaatgtttacttgagagaaattagtattttacaaataaaaataaagttttgataatatagttaattttaaagctcatctacatggttaagtcaactttaaattttaaggtaatgtcttttaatccatggtagagaaaaaaaaaagtctttcagggggtgttttggtgagatttggaaataaattatactaaaaacgatctgtacaatggaaaatgattgtattttatgtcattgatacaaagcacacatttctttatgtctatttttgttttgttgatttgtttacctaaaggtattttaaacatttggtaatgtgaaagcctgactaatcagaccactttctcatcctggaattccaattgacattctcgactgcatgaataaatgattctactgaatttagtcttccattttgtcacatattacaaagcagtgttgcatcttggcaaaaattctgctggtagatatatgtatatatatatatgtacacacacacacatatacacacacacacatatctatatatagagagagatatagatatatacacacacaaagctcaaatattaactaagatgttcttcttgtcaatagtttctaagatagacctaaaactaaatcagttgtgtttcatataatagcagtaacactattggcaatttgtatgcggtcgtttgcagtaagaatggagaataacttggtggaaacttctgaaagctacagttccagagtaacaaaaggaaaaagaggaattcgtctagtaaaaggccgtatggcaaagtgtatgttaaaaaaaaaaaaagtggaaaaggcattattgacttgcagaatgttctaaaaatacctcattcaataagtacatcttgctagttgacacacaattatgttaatgtagtaagagttgaagagtaatttaaatataattagggcttaaaagatacatggcatagagcatggaacttgttttggcgcgtgcgtggagtatttttaatgaaaataaaaaataaaagtaatctgtaaattaaaacctttgtgtattttcaatttcatttgaggttattctcacatgactgataaagatgatgaaacaaatgagtttcatcatgaatttattctcatataaatgacacttttcaacatcctgttttggaaaaaagaatgaaaaacatttcttgattcttaataggacacctatttcatgaacattcatttccatgccaggtcccaagctgcatctataaaacaacaaaataatttattaaataaggggaaaatcagtctaccaactactaatagcaaaacaacaatattttaaaaataacattggctgatacttattttcagtgagtttactcattgttttttagagagttgatttgttctgacataattctaatcaattatagtaagttgtagatagatttagtgtgctctgtaaaaaaatcatctaatctgacctacttttaaataccagttactagtagaccaagtgtaactcctggtgacagctataaattgagtattgtattagttcattttcacactgctataaagagatacccaagactgggtaatttatgaaggaaagaggtttaattgactcacagttccacacagcaggggaggcctcaggaaagttacaaccatggcagaaggtgaaagagaagcaaggcaccttcttcacaaggcagcaggagagagaatagtgaagaaggaacttccaaacgcttactggggagaccacctccatgatgcaatcacctccctccctcaacacgtgggaataacaggttgctccctcaagaggattacaatttaaggtgagatttgggtggggacacagagccaaaccatatcaagtatgaaaactgatccttttctagaagtcccttccaattttaaaaaattatattaggacaatttatttattaactcattgagcaaacacttatttttatttttattttcttttttctttttttcttttttttttttgagacagagtcttgctctgtcgcccaggctggactgcagtggtgcgatctcggctcactgcaacctccgcctcctgggtttaagtgattctcctgcctcagcctcctgagcagctgggactacaggtgtgtgccaccacatccgactaatttttgtatttttagttgacatggggtttcaccatgttggccagggtgttctcaaactcctgacatcaaatgatgccgctgcctaagcctcccaaagtgctgggattacaactgtgagccaccacgcccggccaacacttattgaatacgagttacgattcaagaatctgttaagtgtagaagatataagcaacaggtaaattttaaaaattcataagaaatactatgttaatcttactatgatgaagtattatgagaacctataggaagaaggtatttcctgagtcctaaaggttggctctcaagtagaatagattttgatattttagaacaacatcagtgaaatggttgaaagctggtttattcctatatccttatatacagtctaaatggaaggataagagatatactaacaaattaaaaatcttaacaaaatgccaggaaataaacaacaaatttagatacgaaagataaaggaatgcaaaaaaatactatatgctattctttgtttcatttagcattgtttcataagcatctttccatgaccttaaatataaagcatgaaatttaatggctttctacttgatatgattaggctttgtgtccccacccaaatctcatcttgaattgtaattcccaggtgttgagggagagacctggagggaggttattagatcatgggggtggctttccccaagctcttctcataatagtgagtgagttctcacagaaactgctggttttataaggggctcttctccttctctttctcactatctctccttctctttctcactatctctcctgccaccttgtgaagaaggtgcctcctggttccccttccaccatgattgttcatttcctgaagcctccccagccatgccaaactgtgaatcaattaaacctcctttgtttttaaattacctagtcttgggcactatctttatagcagtgtgagaacagactaatacactactataacatcttattgatgtatgcactctccttttttttccctttttttggggccatttaagttatttataaagttgtactaagataaatagtattgtgatgaataaacatacatatgtatatatatatatattgcatatctttgtgtacatcttaaatttttttcttagaagaaatttataggatgccaattatatcacctaagaatatgagaaaatttaagcctcttcatatgtattgataaattgttttctaataattttgccccaaattatatataaattatactaatatatatgtttgtttgttaattgtctatctttcccagctgaatgtaagtcctgtgagagtgggaacctttagttttatttaaagaggcctagaataattcctgggatatactaggagctccataaatatttatttagttgaatgaatgaaatttcaaaaggaataattttaagccaaactcttcacgtatttagattcaaaatctggctgctctatataaaagaaataattttaaacattgagaaactaaagcagttaacacagatttttttcaagaaaattataacttggtgtgaatccaacaaagtgctaaggtgagaaactttactgaggagaaaatcagctttgaaatacccaaaggactgtaaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaaggatgagttcatgtactttgtagggacatggatgaaattggaaatcatcattctcagtaaactatcacaagaacaaaaaaccaaacaccacatattctcactcataggtgggaattgaacaatgagaacacatggacacagggaggggaacatcacactctggggactgttgtggggtgaggggaggggggagggatagcattgggagatatacctaatgctagatgacaagttagtgggtgcagcgcaccagcgtggcacatgtatacatatgtaactaacctgcacaatgtgcacatgtgccctaaaacttaaagtataataataagagagagaaaaaaaagaaataaaacgataattaaggtagaatgttaccagtaagagttgttgttacccagcaaagcagactagaataaagggccagaaatgatgctaaagatggagctcagaatttcatgaaccccaattccatacatgtagaggccataaccatctggaatcatgcttccaaccttatccttgctctgttctggtaaaacatgcatgaggaagaatttgttttgaaaaaaagatgtattagaaaaatgccactatacttatttaaaattcactagattttcagagttaggaagaatgagtgttcgctctagtttgcatggatcaactgaggttacttgtctgttgaatattatctttctatcacaaaatggcttttcattgagaaattaatatcttcttgagcaacatttgttctttttcactctgataagtctggaaggaagactagatcttgccttctagattaccattaaatattttcaccttctacctatcccgtaaaggatgatctggataggcagctggtgatagataatgtgaatccaggaatctggagtaaacctgatagaaaatctgtgttatgatgtaacaggaaaaagcaaagacaactggatgttaaggggtgaatttcttaccaagaaacatcagttgtgtcagtcaagaaaaggaaagaaatgttgttgccctcacagagattacactgaggtttgggaaaaataataaatgaacaaactaaaatgtattaaatcactggctgaagaactaaccaaattaaatacagaagtaaataaatttacataaagatataaataatagagagtgtgtcatgtggtaattaatgctaaagaaaagtaaaacagtacagggttgggagcattggtaggttggatgcaatttaaaatagagtagtcaggaaatgcctaatggagaaggagagatttttggaaaactctaaaagaagaaagggaatgaggcaagtaaacacctaagagaaaagtgtttataggcaaaggaaacaataagaccatatgcccaaacctggcagtcaggtgatatcacccagaacagaactctggtcactcccaagttgataaggtagaaccagcagaaaagactgaggaggagaggccagtgaggtggaaagaggccacataagtaaggaatactgaaagccaggtgaaaaatgtgttgcatggcggagaatcaatgcgtctcttgctgctaagtcatgtagaacatggaccaagtattaatcatttggctatgtggcatcattgaagacaaggacaagaacacttgtgaaatcctaattcatactgtaagttcagatgatattagaaagaacagaactggagagagtgagtgagacaattttgagaaattttgctttaaagagaaagagaccccaaggcaggcagatcacaaggtcaggagttcaagaccagcctggccaacatggtgaaaccctgtctctactgaaaatacaaaaaattagccgggcatggtggcgggcacctgtaatcccagctacttgggaggctgaggcaggagaatcatttcgacccgggaggtggaggttgcaatgagtggagattgcgccactgtactccagcctgggcgacagtgtgagactccatctcaaaaaaaaaaaaaaaaaaaaaaaaaagtggaagagaccaatgaagctgtaactgaagacggagacagaggcaagaataaacttttttttttccttttgggaagagaaataaggcatgtttgtatgctaatggaaagatccaatgaataggaaaataattgatgatgccgggaagaggggaagaattctgaagcagagtcccagaataagggaaaggcaatcaaatctagggtacctagggtttctaccattgggtgtcttttcctcacccttcctggactctgtttttgttctagtatttatacaagacactgctattgtagaggcattgcaagaattccattaagcatctttctgtgatttaatcccacttaagcccttgatagtcactgataaagagacttaaaatctccatttttgccagtttgaagattctatacaagatgtaaagttaacttcattttcttgatttgtttattttgtcaacttgtgttggaataattgaactcaatcctactttattttctatgttccatttagacattcttccctattgagagttagttagaacatttgcttccagtgagtcatctgcctacttgagatagttaccacctattgctacatgacaaagacaatgaaaatatagagatctgcatagtaatacaaaatgagagaatttactgcctgtgtgtaatcatatccagaaaagaatgcagagtgaaaatgtttaaaatgagatggtgcatggacagggtgtagtttgttagtctaatttggatattaatctacaacttaaggaatgtgggatttcgaagtttgtttttaattgatattacaatctctcagagtcaagaacaagatgacaactgatacttctgtgtatgggggggatgtgtgcatagacatatgtacatgactacatattctgcatacatttacattcatattaatttacgtacagtatgcacatattttcatgcattcacatatgcgtgcacatacacacatacatatatatttgtatttatgttttgaaggagagactcctgattattcctttgaagtgtgactatgatttggtataattatgatgtttggtttattaccagcttcatttatagaactaaaaggccatggttaattacttcaaatgaataacatattgattaacaaaagctgttttgtgcctttttgagacaccgtttaggtagcctaagacattcacatcctctaagaattagatgatttccctttcttgtgttgtttctagatgctggtaagcaaactgtagctccccagaaatagcctagatacatcatctacttgggaaatactgttctggacaaaaatcattacagttctgattgatgcccagcattttaagcagtcttcttctgaaagagagatgcctcccttttagccctgaataaatataactaagagatggttatttaattcctttgtcataaaaaggttttaagaaatcttgatcttttcacattatgtgaaaattgtttccttaatacatgggtcacaggcattaatataagtgatatgttttccacttttctaaaattccacagaccttgaaactgttctggatattgaggattcaacaattcatttttagtgctcatgacgactgggtgtagtaatttaggatgtggctatttattgaacaggaatgaaagctgacttgggagtataagctatttctcttattatatccagtcaagtattacagtcaagtactacagtgggccccaaggtaactaaaaagtgaaaacttgccctccaggttaagatacatatcctgtagctgcaggtatagaatcattcattctttcattctagagatgtttattgagtttcaatatagattgctttgttttcagagctgtctactcataaaaaataaagatgaaataataagatattcaacaaaaatgtttctgtttctatgttttgataaattttctcttaattaatgcttccacagaaaattgatgaatttacttcaatggaccattgtaattttcaaggatagtataaaattgtagcaaaattaaatgctgtatctattgtatatctatttttcttttctagtcatttatgatactatgtcttataaaagtttcatacaaagatattctcatttgtctgaaataatgagaatgcttctttcctacttgaccataattatctgctcttatttcctaaaataatccatttggaacttttttttatttctctaaaatacctttataattcaaaggaagtctttcagaattggtaactccagtctgacttaaggattggaaagtacattacatcttcttataacttgtaatttggaaatgttatgacattgcaaagcatgcaccgttatcaagagtcataatattgtgttcaaaataaaattaaatatggaaaaatatgcatataaatatataaaaatatgagaaacacttatttttattgattattttcaaatatgtataatatacctataaaaacataaacctctacaagtttgtagagtttccttttccatttcagttgaagaattttttgtccagatgcacaaatacctctgagacaaaggcggaatatgtcataggatccagaaaatcattatgaaaacaaagctcttttctctagtggcatgaggtatatagtatgatgaggggggtctattttgctctttgtacactggtcatttttgcaaaggccatttattaaagcaacagatagggagacatcagttatgtttttggccttctgtttactataaaatgttggaagacttgaaaagccccactaaaatcattgaaaagatcaaagcctaagtccagtgtcacaggagagaatggacactgtcaattgcagtggatgtagaatgttttactacaaaaagcttggaaatagtctttaatttgtatttttttcctatgtaagctgttaggtcagtggctgttttttaaaaaaaattacttttatgtgagctcgatagttgacagtcttctagtgatagacttcttatgcttggatatattgataagctgtaaaagtaccctgaaatttgatatcctttctcatcagcatctgcctatttgtatataaagtttatataatatacatattttcaagaagcacagtttctttaaaacaagcttttcccctgctcgagtgttctaactttttgctgttgcctcagatttcttttctcagattttgtagacctatgttacccttgtaacatttctattgttgaatcactaacagcagataatgaatcaccaccaatgtcaaaggcagagtgttgccctaaagatcaaatttaaatcttggccatgttgttttgagactctgattattttctcttcctccccctcctctccttcatttttatattattattttttgacttggaagtgctcccacatctctctctttgacaaaaagttatattaaagtctagactttgggaaggcaaagagccaatctctttacttttttgaccacaagaatgtgcagtgtcatcttttaaaaataagaattgttttcagtaacctaaatgaatctgtcagataagattttaggaggtgtttagggaagtatttcaattttatttattgttcattacttatgatgaatttagcacttacacacaggaatctttttgtgaaaagcacttaacagatttctttgaattctcccaataatcctgtaagaaatagaaatagagtatttataacctctatctcacaggtgaagctgctgaaaccacacatttatactcttgtgcgatttgctcttggaaagaaatttcttcaagtttggaagattcactattgctactctcttggaggcaaaaaaaaaaaagaaaaagttactaatactctgaatctagtggcctgaactcaaacctccttattgagtgcatttatgccacttagagggacttgatcacacatttctgtttggatccctttcatgtggggtttggactgtggatttgtggattgtggattgacagacatgtggattatggactgactttcccttcctttgagatcctgtgtagctgaagctttttctatgaaatggttcatgggtatgatataaaaggaagtagagctataacattgctgttttgcaaaactcttctaatattgaagttggcatttacactcacgcgtaattctctaaggattcagtccctgtgagtttttctaagctttgtattttatcttttaatctgttttttattgtagaacatgcagaatatttgcagattcaaacactcttaaattaaaggagtggtattcatttcaatgttataattttaaatttggggagcatttttgcctctaataaataagcataaaccatccaattttccagagatgccgcaagtttcattaatagctgcttttcattcattaaggacttattattttggatagacagtttcccatgaacctttcctaatccatttctaattagatcaacccaggcccaggtatgacttcttagcttacagaaggtaatgcctcataactgagggcagatgggccttctggatgtggaacacacaagtattcctttggtgaagggagaaaaataaaaaagatctgtcttagtttgggatgctataacaagataccatagactgggttgcttaaacaacagacatttatttcacacagttctggggactggaaagttggaaatcagggtgctagcatggttgggttctggtgaagaccctcttcctggcttgtaaagtaacactttcttgctatattctcacgtggcaaagcaagagcaagtgagagagggagatctcatatctcttcttataaaggtactaaactcatcatgaaagttccacccttatgatctaattactgcctgttatggactgaatgtttttggttcccccaaattcataagttgaaacctaaacttcagtttgatggtatttggagatgaggtctttgagaagcaaatctgttttggaagtgaagccttcccaaatgggcttagtgctcttataggaagagaccaaagagctagctggctattttttgccatatgagtatacaacaagaagtcagcagtttgtaaccaaggaaaaggccctcaccagaacctggccaggctggcaccctgacatcagactttcagcctctggaactgtgagtaataaattctcttgtttgtaaggcatccaggctcttatactttgttatagcagcccaaactgactttaacatctctccaaagccccatcttcaaataccatcacactgggggttagggattcaacacatgaatatattgaacacacaacttagtccatagcaagacctaaaatatatattaaactaaccattgtccatggtagtggccaattacctggctcccacttggctgcagtctatgctgaggtcctttgtaagcctcttgcatttagaaagaaagtctcttacccatttctctgtgtttttactacaggtctattgccagccctttttctgtttcaatgaagtcaatttttaatgtaaaatgaaatagttttaacgttaaatggtgcttcaaaattgtcaatgcaaagcaatgtataccagatatactttcaatagaaataggaaatttaaaacatagtgcctatgttttaattgcattcattctatcatggccatctttttatcacaaaaacataaggaaagagatgctagtaagtaccaccttttctaagctgagagatcatataatactgttagtcaactaataaatatggcacaattgaaggtgtgtttctaagtcaagatagatacaaagttaggaaaagatatgtagtcattggaagatatccagaatacatcaatctattttctgcactagcctagctcagatgacagtatttaaagacagaaattctttgataggccaataagatggaggaaatgtaccagataaaataaatgagagaatgcaagtgtgacacaagttaataacttcacatataaagatgaatttaatggctgtggcaggtagctactaagtattaagtagtttcaaacaaattaaagattcacttgacctagccatgaagatatatggactatgtgaagggcaatctgtagtcactaatcttaattctaaacatgtcaggaagaagttatctcataatgtgaaaaaacatacaatttactttctggtaatatattatgttcacatatttccaagtattttcaaagatagatagatagatagacagatagatagatagatagatagatagatagatagacagacagacagacagacagacagacagggtttggctctgtgtccccacccaaatctcagtttgaattctacttccttaattcccatatgttgtggcagggacctggtgggagataattgaaccatggaagtgggtctttgccatgctcttctcatgatagtgagatctgatagctttaaaaatgggagtttccctgcacaggctctctttttgcctgctgccatccatgtaaaacttgacttgctcctctttgccttctgccatgattatgaggcctcccagccacgtggaactgttaagtctgttaaatctctttttcttcccagtctcaggtatgtctttatcagcagcataaaaatggactaataaagtaaattggtaccagtagggtggggcattgctgaaaagatatccaaaaatgtggaagcaactgtggaactgggtaagagggagaggttgaacagtttagagggcacagaagaagacaggaaaatgtgggaaaatttggaactccctagaaacttattgaatggctttgacccaaatgctgatggtatggtcaatgaaatacagtctgagatgatctcagatggagatggggaaacttgttgagagctggagcaaaggtcactcttgctatgttttagcaaagagactggcagcatttttcccctgccctagagatttgtggaattttgaacttgagagagatgatttagggtatctgatgaaagaaatttctaagcaacaaagcatttaagaagtgacttgggtgctgttaaaggcattcagttttaaaagggaaacagagcataaaagtttggaaaatttgcagcctgacaatgtgatagaaaaccaagtctcattttctgagaaattcaagccagctgcagaaatttgcataagtgataaacagctgaatgttaatacccaagacaatggagaaaatgtctttagggcgtgtcagagccttttccaacagaccctgccatcagcccagaggtttaggaaggaaaaatggtttcatgggatgggcccagggtcccaatgctgtttgcagtctagggacttggtgccctatgtcccagcgactccagtcatgactacaaggggccaaaatacagctccagctgttgcttcagagggtggaagccccagtcctcagaagcttcatgcgggtgcaccgaagttaagaattggagtttgggaatctctgcctagatggcagatgatgtttggaaatgcctggatgttcaggcagaagtttgctgcaggggcagggctctcatggagaacctgttctagggcagtgtagaagggaaatgtaaggttggagaccccacacagagtccctactggggcacctcctagtggagctgtgagaagggggccactgtcctccagaccccacaatggtagatccactggcagcttgcgctctgcatctggaaaagacacagacactcaatgccagacagtgaaagcagctgagagggaggctataccctgcaaaactgcaggggcagagctacccaagaccgtgggaacccacctcttgcatcagcatgacctggatgtgagacacggtgtcaaaggaaatcattttggagctttaagatttaatggccctgctggatgttggacttgcatggggcctgtagcccctttgttttgaccaatctcccatttggaatgggtgtatttacccaatgcctgcatccccattgtatctaggaagtaactaacttgcttttgattttacaggctcataggcggaggaagggactttccttgtctcagataagactttagactgtcaacttttgagctaatgctgaaatgaattaagactttgggggactgttgagaaggaatgattggttttgaaatgtaaagacatgagatttgggagggacctggggtggaattatatggtttggttctgtgtccccacccaaatcttatcttgaattgtactcccataattcccacgtgtcatgggagggacttggtaggagataattgaatcatggggtgggtctttcccatgctgttcttgtgatagtgaataagtcttacgaaatctgatgttttaaaaatgggagtttccctgcacaagctctctttttgctttccaccataagacttgactttactccaccttgccttctgccatgattgcgaggcctccccagccatatggaactgtaagttcattaaacctctttttcttcccagtctcatgtatgtctttttcagcagtgtgaaaatggactaatatttatgtacattttttctagatatatacttctttatataaatatacatatatatatacttgcacatataagtatatatctaaaaagaatattcaaaaacatagaaaagacatttattcttttcttaattagaccctgtcttctctatcttcttcttttaacctttatatgtgattacaatacaacattttggatattcagaattttaaactccgttcttgtaggcacatctgacttacacaagatctcacaaactttttaagaatcggtcgacattcaaatattttctgcccattctctgcctaatttctcaacttatcactaggcatgccaaccacggggattctaatttcccagccttttctaagctttcttgtgacccagctcattctctgggtaaaactgactagacttcactgggcaaatagttaaaggctgtttaatctatggattgatcagcaacttataaaattacttgattagaaaaggtttgctagatgaactagaaaaggccaagtgaatgaaacagtaattagcaggaactgaaattaaaggaaacagagagagaagaacctggacagagaacaagccatgaaagatcatgatgagcctacatgttaaagaataaaaaatgataaatagcagaatctttgaggtaaagaacagtatatagattcgattgaaaaaatgagctaattgtactgaaagaagtgagtagatccttagagagaaacagaggcacaatgcaaaagaaactatgtgacacccaagacaagaaacaaatctttaatctaagtctgtctctatgttatccccccactttcctgattgaatctgtgtattttgctctcaaatttgcttacgtaaaatatgccccaatagaaccatcaatctgcatcaatttgccatcactggcaaaatggcattatttttgaggaaaaaaaaaatgatcttggtttgaggggatttggacaactattttccagtatattctgttactcacagtgcttgtgttagtcttctaaactaaactttttacattgcaccaatgtaaaaagccatataaaccccccaaccttgtaagtaatttatgaaaacttatgttattcggtaaaaacaaggtaattgcaacccttatatgctgattcctcagagcagggaaacataggaaatagacttggtggcagctttcagtaggaaaggagagaattctgagttgctgggggtacaatgggaaccagtctgggcctgagaaataattatttgggctacagttggatgacctatgagctaccatcatattaccacaacaatcaaaattttgtattatatattgcctattggattgtaatattcatactctacatgatctccttaggttaattttaaaagacaaagttaccttttagagaaaaaaaaaaacagaagttcactctatatgtgaattttacttcttgataattctttacaaaccataattatattctatcataacattttctgcactagcattgaaatgcaattggctgtcgccattgcttgcccctttagcaagttggtgagttttgctctttcccacctgtgtatccaggtgtcccagctcagttccctatggtgagccctgatggtgacagtgatgctgccaaagcaagataactaaaatcttgtctgcaaaccatcttcccattccatggctttggaagggagctgggattatgcttggtccttttccttgtcttcctttcctcaaattcactctcacatttaagaaaacatggtgaaaatgtgcccacataaggcatcttgactcttcaaactttaagatatgttatacattgatgacatatagatgtatttctttatgctttcaggacctttgtaatatgtgactcatttttatgtgatgtctactagggacattacataacatgtgatgtctagagaaagaatgggattcttcaaaaattctgcagtaacaagaatgaaatcttctaaagcttacctgtcaatatgctaggttatgtgtgatcactatactatacgaacattccaaaatcttacagatagcatgaccatttatctgtgtttttataatgttttcccccattagtaatcaacccatgtttgcttttgagtgattagttctcaatattatccacctgctcgtctatgctgtaggctttgtagatcattcccttcttcaaaattatcctgaaatttagtccttggatctatgtacctcagacatttatcaaggcaccccaattctctcactttccagctctttctgttgtctagttatttactcttggaagtctttgcagacttacttttcagcatcaagattgtcttaccatttttgtctctaaagcatcattgaatctgaacatgacacttcaatgctacagttcctaaaattttatttcttcctccatttatgcaatttttcctaaaatactatttctttcacagtcatttccaggaaaataatctaattcaacataaactttatgaataatccatttggatcccacactatgctagttgtaccttaaacacactgtaaaagaccttattggtggtgtccagtagggagaaaagaataattccaagtgaaaccactagggagctcaattagggcacattttcaagtgctaaattctagtatgcatacaatatgctctttataaatatagaaaccatattcttatttatctcttcctatttagccaattgcccatcatggtcctaggattacaaccaccatactatataggatttaatgcttgtctctgtatgtactgataaaatattatccattaacatactttatgttcaattttattacatatttttcttcatcctccatcggtgttgtctacttgggattttaagcttatgtaggatctggccatgtaggatttactaactgcacaatcagctcagtagcctcccacagattctaaataatattctaaaactaacaaaaaagttgtatcgatactttgttgattaaatgaatagtgcgaagttttcctcccaagtgcagtgtgtatttttatacttcttctaagctataagtttcattaacttcaagaacagtagttcccctagtagtgccaatttttccatcaagcaacttaataaggtatagttgtaatgctggctaccattcagatggtgacaggtggcagagaaagcacacaatggaattttccatctgtctcctactttctggccaaagcttaaaggacagagtatgatttgttctataatcttcacttacttcttttcatctacacaccaataaaaataagtatactttagcttatggaggtttacagatcttgaaggtcaaaaccatgtgcttcatctatcttcactttttggaaaaagtacatttgtttattccatatgaaagctgaattctggcttagaatttcaccccttttctatggaaaacatcttaccttccaaaagctttacaataatctgaattcatgtctccatacagagtaataaacataaagaagatggtatacatcctatttattgaattgctgaatgcattaaagacaacatcacttcattttattaatagttttgtaaagtttagattttggtggtattcattatgaaagtaagattataatactaataaggaacataacttatgacagatggagagctgcagctttaaattttgcatatgagggaaaatatatatttttgatggaaatggtgagttttggagtaaaattttagttttgtttttgtttttttgttgtttttttttttcctgagacagagtctcactctgtcacccagactggagtgcaatggtgcggtcttagctcactgcaacctctgcctcccaggttcaagcgattctcctgcctcagcctcccaagtagctgggattacaggcacccgtgaccactcccagctagtttttgtatttttagtagagacagggtttcaccatgttggccaggctgttctcaaactcctgacctcatgatccgcccatctcagcctcccaaagtgctcagattccatgagtgagccactgcacctggcctagtttttatttttttttctatttaatttttcatgattctttttatatagcctgttctgtgccattataatgcagtaaagtttaaaaaccataacagaggcagaaaatatgtagttataaaatgtttctagggaaattgctgtccttttcctctcactgaggtcttgagtggcattcttggataacatctagtaaagactatattttaatatgtttaaatttaagtgactatctgagtgaatgggttaactctattaaatccatttttctcaacaattattaaataatgtaaacaaggcagtatgctatgtgatatgtaataaagtatatgtcttttttaagaagcttataatgtagcatgaaagaattaaaatatagattgtgctgtaatcaaaaggagtgtacaatgaatgcaatgacaatggaacatgtattctctcaaagtcaaaacaagcagaggtcacgtgtgggtcggagcccatacacttgaggaaggcattgtaatattgatggaagtggcatcgctgtagaaagggcagaggatggtccaagttgtgggaacaatatgagtgatgatattgagtatggatagcactgaatttttcaatgatctgtaggtctaaaaatgtttctagaatgaaggatgtgaataaagaaataatgcaaatgaggccagaacagtaaattggagttaaactatgtgtcaatgtttcccaaatctgaatgctcagagtgatcatctggaaagcttattaaatatccagattccttggttttgtctaaggcaactgtattttaacaatctggtttgggcagggctagtataaaaggcaactcggatggtggtaaacatagatgcttccatgtgaaaggttttgagagattttgaacactagggagaagaagaaaaacctgtctttagtttggtaaacaataggaagacactaaaggtattggaaaagattaataagatgttaagagaagagtgcttttaaaagattcctctgatgtggagaaagacaggttgtggcactgaaaatgcaatgtaaaaaaaggaacatataaaatattgcacacattgaattcttcagttttggcaagaagttgggtgtgtgggatcaaggaaaattaagattctggataattcacataagtattctagtttaatcaagggaaccgacgatcattgagacatactatggaaagacaaaagttcaaatgtgtgaactctgacaataccgacatcagaaaataggaaagaatagtctgtaaagaagcagatataaatctagtagaatcagcaggtgagtgcatattgtggaaataggtcatagaatttaggaaacttgcatataactggcaacgtgaactaccacagaacaattgaggaaggagggacttggaaaagttagataatactgttctggaagccagtaatggctctagggataacttttttttgttgtttttgtttttgttttttttgagagagagagcctgaaacagaggatctggaatttatcaagaaatgagtggctagttagtaagcaggggcaatagaaagcatttctcttttgtttaattttgttatacaaaggaatgataggacaagaaattaacaaagtgttagtgagagaaagtataattgaaagaactgtactcaagaagattagtgtgaatgatttgtgtatttgtgtgttggtatgtgtatgtattttaagaacagctttccagtgaagtatagcattcacaaggtagtaagaatattcttcctcagaaacaggagtgagtgaagaaaggaaataaaaatactaggaaagtgtagtaaaatgcattaagcattatggtccttgatgtccagtatagcaatatcttgaatgtatgaggcaagaagaggattcttagataaccctggtattttcagcttgataaccaactgaaaggtaatgctatgatagggagcacagaagagcagttacactgaggagaaagatgatagaaagatgatgtgatttctttgagtggaggggtttttgaggtgtcatgagggcatccataagatgtggtcagaggataattaaatgtatagcacaagagaactaacacgatgcagagacttatttaggaaagtcattttcaaagaagtgagagttgaagctgtggaataagataaaacagaacaaatgatagagtagggaaaaaagggttgggagttcagcaccacctcatcatttttctgacatctgagggggtagatggataaaggttagccaggggggaagaaaaacaggaaggagcaggaatagcgaaaagggaatcctggaaatatgtgagacaaaattgagagacgggagctttcaagatgaaagttttgaattaagaataaaagaaacattaaaaatatataatcttatactttttaatgttcttggctgctttcatgaaagctattttaataaagtaggaaaaagagaaacaaggctaaaataggttgaaggatttcagacaagtaggaaatgtgggagccagtaatatacactatttttgaaatgttgtggaaaaatagaagtcacattcttagaggctaacatataaaaggaggtttttaaatataaaagcaatagaagttaaaatatagcttggaaaacaggatgactgaataggaacagctcctgtctgcagctcccagcgagatcaacacagaaggcgggtgatttctgcatttgcagctaaggtacccacctcatctcattgggactggttagacagtgggtgcagcccaagcttcataagcaaaggagaaataaaatcctttagagacaagcaaatgctgagatattttgtcaccaccaggcctgccttacaagagctcctgaaggaagcactaaatatggaaaggaaaaactgggaccagccactgcaaaaatataccaaattgtaaagaccgttgacactatgaagaaactgcatcaacaaattggcaaaataaccagctagcatcataatgacaggaacaaattcacacataacaatattaactttaaatgtaaatgggctaaatgcacaactagcaaattgtataaagagtcaagacccattggtgtgctgtattaggagacccatctcacatgcaaagacacacataggctcaaaataaagggatggaggaatatttaccaagcaaaaacaaaaaaaagcaggagttgcaatcctagtctctgataaaacagactttaaaccaacaaagataaaaaaaggaagggcattacataatgataaagtatcaatgcaacaggaagagcgaactatcataaatatatatgcacccaatacaggagcaaccagattcataaagcaagttattagagatgtacaaagagccttagactcccacacaataatagtggcaggatcccactgtcaatattagacagatcaatgagacaggaaattaacagcgatattcgggagttgaattcagttctgaaccaagcagacctaatagacatctatagaactctcctccccaaattaacagaatatacattcttctcagcaccacgtcacacttattctaaaattggccacataattggaagtaaaacactcttcagcaaatgaaaaagaacgaaaatcataaaaaacagtctctcagaccacagtgcaatcaaattagaactcaggattaagaaactcactcaacaccacacaactacatggaaactgaacaacctgctcctgaatgactactgggtaaataatgaaattaaggcagaaataaagatgttctttgaaaccaatgagaacaaagacacaatgtactagaatctctgggacacagttaaagcagtgtttagagggaaatttatagcactaaatgcccactggagaaagcgggaaagatctaaaatcgacatcctaccatcacaattaaaagaactagagcagcaaggcaaacaaattcaaaagctagcagaaaacaagaaataactaagatcagagcagaactgaaagagatatagacacgaaaacaccttcaaaaaatcaatgaatccaggagctggttttttgaaaggattgaaaaaatagatagaccactagccagactaataaagaagaaaagaaagaagaatcaaataggcacaataaaaaatgataaaggggatatcactactgatcccatagaaatacaaactaccatcagagaatactgtaaacaactctatgcaaataaactagaaaatctagaagaaatggataaattcctggacacatacaccctcccaagattaaaccaggaagaagtcaaatccctaaatagaccaataacaagttctaaaattgaggcagtaattaatagcctattaaccaaaaaaagcactggaccagacagattcacagccaaattctaccagaggtacaaagagaagctggtaccattccttctgaaactattccaaacattagaaaaacagagactcctccctaactcattttatgaggccagcattatcctgatatcaaaacccggtagagacacaacaaaaaaagaaaatttcaagccaatatccctgatgatcatcagtgcaaaaatcctcaataaaatactggcaaaccaaatccagcagcacatcaaaaagcttacccaccatgatcaagtcagcttcatccctgggatgtgaggctggttcaacatacactaatcaataaacataatccatcacataaacagaaccaatgacaaaaagcacatgattatctcaatagatgcagaaaaggccttcaaaaaaattaaacaccccttcatgctaaaaactctcaataaactaggtattgatggaatgtatctcaaaataatgagctatttatgacaatcccacagccagtatcatattgaatgggcaaaagctgtaagcattccatatgaaaaccagcacaagacagggataccctctctcaccactcctattcaacatagttggaagttctggctggggtaatcaggcaagataaagaaataaatggtattcaaataggaagagagggagtcaaattgcctctgtttgcagatgacatgattgtctatttagaaaaccccatcgtctcagcccaaaatctctttaagctgataagcagcttcagcaaagtctcaggatacaaaatcaatgtgcaaaaatgacaagcattcctatacaccaataatagaaaaacagagagccaaatcatgagagaactctcattcacaattgctacaaagataataaaatacctagaaatacaacttacaaggaatgtaaaggaccacttcaaggagaactataaaccactgctcaaggaaataagagaggatacaaacaaatggaaaaacattccatgctcatgactaggaaaaatcaatatcgtgaaaatggccatactgtccaaagtaatttatagattcaatgctattcccatcaagctaccattgactttcttcacagaattagaaaaaactactttaaatttcatctggaaccaaaaaagagcccatatagccaagacaatcctaagcaaaaagaacaaagctggaggcatcacgctacctgacttcaaactataatataaggcaacagtaaccaaaacagcatgctactggtaccaaaacagatatatagaccagtgaaacagaacagaggcctcagaaataatgccacacatctacaaccatctgatcttcgaaaaacctgacaaaaacaagcaacgggaaaggattccctgtttaataaatggtgttgggaaaactggctagccatatgcacccttgttttttcattctcgtgtttcctataattgagaaaagctttctactggagaaattactataaatccctccactgttagaccctttccttgtaaaatctatttaatatattttttttaaaagtactatcataataaaaatgaaaatgtatatgacagaaaactgaaactggaccccttccttacaccttatacaaaaattaactcaagatggattaaagacctgaacataagacctaaaaccataaaaaccctagaagaaaacctaggcaataccattcaggacataggcatgggcaaagacttcatgactaaaacaccaaaagcaatggcaacaaaagtcaaaattgacaaatggggtctaattaaagagcttatgcacagcaaaagaaactatcaacagagtgaacattcagcctacaaaatgggagaaaatgtttgcaaactatccatctgacaaagagctaatatccacaatctacaaggaagttaaacaaatttacaagaaaaaaacagccccatcaaaaagtggccaaagcatatgaacagacacttctcaaaagaagacatttatacggccaacaaacatatgaaaagaagctcatcatcactggtcattagagaaatgcaaatcaaaaccccaatgagataccatctcatgcaagttagaatggtgatcattaaaaaatcaggaaacaacagatgctggagaggatgtggagaaataggaatgcttttatgctgttggtgggagtgtaaattagttcaaccattgtgaaagacagtatggtgattcctcaaggatccagaaccagaaataccatttgacccagcaatcccattactggatatatacccaaaggattataaatcattctactataaagacacatgcacacatatgtttatgcagcactattcacaataccaaagacttggaaccaacccagatgcccatcaatgctagactggattaagaaaatgtggacgtatacaccatggaatactatgcagccataaaaaaggatgagttcgtgtcctttgcagggacatggattaaactggaaaccattccggcaaactaacacaggaacagaaaactaaacactgcatgttctcactcataagtgggagttgaacaatgagaacgcatggacacagggaggggaacatctcacacgggggcatgtcaggggctggggggctaggggagggatagcattagaagaaatacctaatgcagatgacgggatgatggatgaagtgaaccaccatggcatgtgtacacctgtgtaacatacctgcaggttctgcacatgtatcccagaacttaaagtataattaaaaaaaaaaaaacccaagggcggagtaaaaggagataaaagtgagtaaaagcacagatttgtcataagagatctgttgagaaaggtggaaggacagaagtaggtttcaaaacaatcacgacatgttctgaaacaggaggtaaagaggggaagatgaagaggaagatgttggttggctgggtgtagtgggtcactcctgtaatcccagcactttgggaggcccaggcagatgtaacacttgaggccaggagttggagaccactctgtccaacctaagaaaactccatctctactaaaaacacaaaagttagctgagcatagtagcacatgcctgtagtcctagctacttggcaggctgaggtaagagaataacttgaatctgggaggtggaggttgcagtgagccgagatcatgccacggtactccagcctgggtgacagaacaagaccccgtctcaaagaaaaaggaaagaaaaaaaaaaagaaggaagatgctggaactgggaagtttgaggaatttggcagccaatgtattggaaatgtcatccatatggatcttcaaatcaccaagattgttggtaactatggccttccataaatgtacctatggttttgtagtaattatgtgtggaaaactgtatgattcctcagtatttatttggttttccctgcactttctctgctaccaaacatcagaatcctagatcattggataagctgaagttttcagcaactctaatttgactgtcactacttttcttatctatagtagatgttgtccacaaagtgaccacgttatatacaggaaatattacaatcacatgtcaaattttgttctcaaattattattaatttcccaaaatattatgagtcttttgtatatcttgttgtttataatgacaataatttgagccttttgtttattggaatcttctttattttcatggctatggaggcattcacatcagtttccttgagaaaaatcaactacctagccaatagaaatgatttctttctgtaaaagatatcttttttttttaataatttaattagttctttttttttattatactttaagttttagggtacatgtgcacattgtgcaggttagttacatatgtatacatgtgccatgctggtgcgctgcacccactaactcgtcatctagcattaggtatatctcccaaagctatccctcccccctccccccaccccacaacagtccccagagtgtgatgttccccttcctgtgtccatgtgatctcatttttcaattcccacctatgagtgagaatatgcattgtttggttttttgttcttgcgatagtttactgagaatgatgatttccagtttcatccatgtccctacaaaggacatgaactcatcattttttatggctgcatagtattccatggtgtatatgtaaaagatatcttatctgcaggtacaactgaatggcttgtcaaacagcttaagtcagccgaccaatctaccactattgctgctctttgtatttaaaagttcagccgagatgatatacctaaataatagacattactcaactttccaaaatacaaacgggtatccaccaccactccactaaagtaaatcaggagcattctaacaatttaccatgttgcccctcaaacacaaaaacttaagcaccgtaaggactagaaccttcttacttttgttttctgttgtttccttgacactttacaggatacttaactctaaataaataaataaataaataccttgttgaattaaggataatatatgtagtaaattttggagggtagagaaggaatactaaaatatattttcactagtggaagataatttccattagtttctgagcttaccatggttatctcaaaaatattttcatttgtctagaaattttgctcagtattttttaatccacaactcagccacttatatatattcctagtgcatgttggctccatcctcaaagtatagtttaattgaagttctgtttccttggtgcattaattagagagagataagctggtgcatttttagtttgggaacatgtctctagctatttctcaggtgtttgcgcttggccaaccctagtgacattttcctatgttcttttttcacctaagtgtgttctccatatctcttaaaccagatagtattttgagagacatttaatccatctggtttattactttagctcatacacatcacattttagcacttcagtgtatcgtaaatgttctttgattcaaaagatactcagcagcttagtgaatatttaaagaatcctactctgggagaaataatatttggcaatttatgccaattccataattttagcattttgacttaatttagcatagaatttggaatccacaggagtgttatatatatatttatggtttcattagcttcaaatcttgtagtttagctactacaggttactagactattttcatttgctaagaaaaaaaatgttgattactcttcagcttgaacttatattgcccccagatgcagattaaccagagtaaaaaatatcagtgcttcagtaactgatattcagaaaaataaaattaactttctctgaaattagaagcttttaccaaactggaatatatcattgtgtcaggagttggacgaacattctatagtttaattgttgggactttcagctcagatagctctgagtttgaatctagactttgttaatttaatagatttgttatctttcacatgcatcacatcctttctatacttcagtatcaaatctgtgaaaggggcatattaagagtatgtatgttataaatttgttataaggcaaatatgacatgatacgcataagttgcttaaagtggaaccaagacatggtgcttactgaatgttaactattgataaaatatatataagcttcttaacagagtacctggtatatgctcacaaaagaagtttcagattatgaaatgtagtttcagatgatgaaatgtcatttcttcccagtattttacattcagcacccctcctcaaagcggtttttgtttttagtgtctcaaaactggcatttttctctgttttaaccatagtttctgttattattgcagctaagggaactaataagatagtgtttcaatggtttcggggattcttatttatagtccattcttactgcagttctttcccccacagtgccactaggttgatcatttaaatgcacatgtctgatcaacctcattcttgttcaaaagacattgatgtctctccattgtctattgcatatatcatattggtcatcatgccattcagtatcacccaacttgactcacatcagcatcagtgacctccccaaatcttcttgaaggggccagcaacactgggtctctagacatttctccaaaacaagataattttttacacctgagattatgcccagcctacctccacaactcataactcagttatccctctatctgtgttttatggtctggttgtcttaaaagttttatgacctattttgggaggagttgaaacaaatccgtgtggcctcgacacctctttcatagtgagatgagtttgaggagcaatacaatagatctggacttagaaggcagactttacagcctaacaccacaacctattgggagatggacttttgaaaagttctgtcgattgtttcagcactgattctctcaactaaaaaagggagctatcacccgttttctctccctcacaaggtttttgtggggatgaggcactgttttggttttctattgctaccatatcaatttaccacaaaacgtattggcttcaaacaacataaatgtgcttttcttatggttttataggttggagttccaacacaggtgtcccactgggctacaaccaagatgtttacaggacggtatgcctttttggaggcttacgggagcaatccatttttttgcctttttcaccttcctgaggcctctggcaggtctttgcacataatttctacatttcagaaccagcagggagatagtgttgtgtccttctcatactgccttcactctctgagcactgccaggaaaagttcttcactttaaggcctcatgtgattagattgtgcccacccagaatgcaagggcggggtcatggataacttttggagccaacctaaaagtaacatttgtccacccaccaaaatgtttagtgattgtgccacccctgtgatgtttcttttgaaacagatgaaagttcaaaactctctgtgtgtgagtatatgtttgtgctgagacatttttaaaaattgcttttgcttcgagagcaaagcaggagacattaatgtctctgaaatgatttcacaagaaatgatagtgaagtgaaaaagctattttatttcttttccgcaatttctactcaacgtcataaacttgagaatttaattccactagtagagaataatttggatcaagtcctcagatctatatgatattggtatatcagaatgtgaaaacgcttagggatgtcctcaagtcaagaaagactctcctggaggtgtgcaggaagtgacaggacaatggctcctctttgcatagatgcagcatgtaataagccaagtactgcaagtgttgtgaagagttttttctttatctctcctatatttaacaacaagattgcctagacatagaatataaaatttacatgtggctgatgcaatgattattccagttctctttgtggattaagttatatattgttgggaaactaacataaatatattctgtatccatcagtggactgaattttttcacatcagttttccgctgctatcattcagatgtccttaaattatggactgagttactataccattaattgtatttaattaagtaggaagagtcttctaagatgaattaaaagagtgttagctattgttgaaataatcaatgcatagaacacttaaacgaaaagtgactcttcatatcataccactctttaaaatcgtagccttttctcctttaaactgatgaagaatttcttgtgaatatgtgtaggagagacaaaaaagacaaaaacaaatgagctccagaatacattttagttcattgaccagtatgtcaataaaattttaataagattttctgtcttacaattttggaacttgaatgatagattagggttctgagaccatttttctagtaatcttcttttgtcctcagtttcttcattttgaaatggaatgatcataaaatggttttaagttgccttccacttaaatgtgatgtcttggaaattgaacagaggtggcttatagcgattgtacataaatgccttctactgttaagtggttaattagtatccctgtgtttgttttatgtcttccttcccccccaccgaaccttttcccaaataaacaaatttatttatttatttatttactattgctcatatacttcaaaagtgagttaactaattacttattaattcccaaggatttttaaaaggctctcttaatttatgtctttatgcttcaaacattatcatacattccttagtctgtgctgtactttattattaaccaaaaataaactaccttaagtagtttataattgtgtatgtggagctataattttatatgtgtgactataacttcccctagcagattgagttgtaaaaccatattttataaatcttagtacaatgccactgggcatatatataataagcacattctttggttatacaaggcatgcttcttgtcatacaggcttatgatctaaatctggtggtagactaaggaactgaatctgcttgccgacatcagtgtgctaacacaggataaggaaagggcaaaattacagcaaactttctcctgtgatagacattatataacctcaaagcgtaactatcccatcagagcatcctattctatacacagatgttgggcaatgaagtgaaattaacaggcaagtagcagaaatgttctgaagacaaaatgagttactaaacttcagttattaaatctcaataaatagtgaagaagaactgttggtctggttctttaaaaaggatatatttaaatatataaacaaatgcagagcctactgctacacaatttgctgcaatttgtgagcaactactgtgttactatgtagccacaatacctctttcaatggattagtctaaggtgggaaaagtttgtttcagacactaaatggtagtaccaggatacaaggtttgcctgacagcaaagctcctcctctttcctctgtcgaagtgagtggattctgcaaaacaatggtcattataacgaatcaaaggatatctttggtacttgtgatagaagagagtgggagacaagactgtttttagggagagctatggggggtagtcatatgaatcacattgaattaaatcattaaggcaaatgttttatacatgtcaatttatggtccaggttctctcactaagaagacaggatgaggcttccatttttactagtatgatggattagttaccctgagcacaactcttcttactgaaacaataagatgctggataaaaatatttctaaaaatctgtttaaatgcactttggggccagcacacacacacacgcacaacaaggaatccaaacagtaccacaataaagtgaaagtgggacccatgggagtttagtggacacccagtctagctttcatcctgagggtttatgttgaactcttgtgtcctggagtttcttctttgaaggctgcctgaagcacagagaacagaagttaaaacttagagctggctggccagatgtagggaagctaatatgagatctcaacaaaaagctggattttcaaaggactgtagcctatataaaggtgaatgagaaagaagtcctgtcacagaagaagatagcaaggaaacttttctgtcttgatcttggtactaggataagggggacaggtgtattttgagaattcatgtgttgaacccaatctccaatgtgaggacatttggaagtgaacctttggaaggtgattaggtcatgaggacagagccctcctgaatggaattagtgcccttttaatagaggccccatggagatctttgctgtttccaccatgtgagattgtagcttgaagatggccatttataaatcagaacatgggtactcaccaaacattagatctgctggtgccttgatcagggattttcctgcctcccaaaaggtgaaaaatacatttctgttctttgtaagctgctcagtctgtgatattttgttatagcagcctgaatttaacagaatttttgaagagcccaatcttaaaatccagtaatcccaaataattcaaaggagaataaattaaaaaaataattacaactaggcataccataataaaactatggactccaaatacaaagggaagatttttaaaacatctagaaaataatcacattattaaattaccggtaatttaattgatgtcagacttctcaacagcaacaatgaaaacaataagaccgtaaaatagtaccttcaatctactaaaagataacaattattaacctagaattccaagtgcaggaaaattatcttgctagcatttggtcaaaatgaaagtcttttaaagaagtgagagaattatcaataacatatactcactaaaggaaaatctaaaggaagtgcttcacataaaaggaatatgattgcaactggaaggtaggagacttacagaggtaatgttagtaaagatataggtacatactaagtatatatgagtaaatattgaatgaataaaaattataataatcctaattcataacgatgaaaagagtagactaatgggcaaaaaatggcacatattctaagaagagatggtcagaggtgttgatatctaaggacttggtatcatctgaagaaagataaagattattatttaaatgatggcaaataaagtatgcattctaaaacagctaaagtaatcactaaaagaataaacacaggtaaactttctaaacaaataaaaatgaagaattgaatggggaatttattgaaatctattgttttaaaataggacaatgtacacaaaaaggagagaactagaaaacataaaataagtttgtggaagtagtaatactgaaagcaagtttgtagaaataataatacacataaattgactaaactctccagttaaaagaaaaagatttttggattagattttttaaaagccagccatgttctgtgttaacttaaagtataaggagacagattgaaaactaaaaaatggaaaaatacataccatgtaaattttatccaaaagaaaggtaacatgtctgtattcttagcataaacacttttttattcatcaaaatatttataaagagaagaaaagacatgtcaagcccagaagaagttatttcaacaacataatgagcaccacaacaaaaagattaatttaccaaatatgtaaaaaacttatataacttaaggaaaatactagcactcagtagaagaatggactaaagaagtaagcagacattttacaaaagaggaaatcaaaattattaataattatctctataaatattaaagctctttagaagtaagcaaagtgataattaaatccacattgagaacctattataaaaccaccagattggcaaacgctacaaagttagtcaatattgttggtatgtactactggtgtatgagtgtcagtgaggatgtggtgcaaagggacccttcaatctcctctgataggaattcaaattgatagaaccctttggaaaaatgtttgatattacctaataaatattggtagtttgtacattatactgcctaaaaagtctacttctaaatgtaaaacctatagaaatttttgaacctgcaaagaagatatatataagaacattaccaacacaaagaaatgttaaatgtttgagatgatgaatatgctaattatcctgatttgatcactatatattacatgtattgaaacatcactatgtaccccatgaatatgtataattattatttgtcaattaaaaatgaaatgttaaaaaagaatatacatataacggtaacatttgcaacagcatgtgtgcaggtatgtgctcatgcgtggttcacatagtcacacaaatatacaccaaaaatgagaatctacccagaaatccattaacagtagaatggataaataaatgccatatgcatcattgaaaattgatgaaaaatctacaggtaaatgtatcataccaatccaatatcaaaagcatacttttgagcaaaaagaataaatcataaaataatttctaaactatgaatcatttctgtaatcagcttaacatatgtgtttagcgatacagacataggtgctaaaactacaaagaaaggaaaaggaatcattaatacaaatttcaggatcatccttacctgaaggaggaagatgagatgataaaaggaaaatgggggtggataggcacacatggggacttctaacttactggctatattcttagtcttgatagatattttcattctttaaaaatatatgtgtgtgcatgtataacatgcataacataaatatatgtatgtgtgtaaatatataaagacaaacctaggtgacaattagacattagttaaagtatattccaaatttatcagagtagaacagaagaagatccagttgcttctccttcctcttcacttcagtgtgatggttaaaaacagaattacagtttcggggttcagtcaactacctttgtgattttaggcaagttacttagcatctctgtgcctcagtatccttatctctaaattaaagataatgataatgtctaattcatgaggttgttaaaaggcttaaatgagtttacatttgtaaagcacttaaaacagtgcctgatatagaacgacaactatacgttagttaaataaaatttataaaagcatatccctttgtcttcctaattgtagttctatatttacttctcagaatccataagataacaaagagaggaaaaataccaagtggtacctggattggtttcacactgaatatatagaatgacatggcggagaattgatatttttacaatattgagttttgaagttcatgaacatggtctatccctgtatttatttcaattggtcttttctgccagtaatgtttataaatttcagtgtggaagccttgcacattttccactaattgtatttctagttattgataaatgcagtgctatttaaaatatatcttttatcaaaatgtcatttctaaatgtttgttgttactgaatataaataacatttgcttttgtatgtggcaaattcaccaacccaacttaaagcttttctgtagattctaattgtttacacaggaaatcatgtcttttgcaaatagtgatgatgttatttatctccatatgaagggattaaaaaataaaatagggatggagttatatttttaagtcagtctctgccaaaataaagcacatctagggcaatttgttagtgtggaggctgctttaagtcctccctagtccaataggactctctttcttgtggtgacatatgtgtgtgtaagtgttcaattactactattatttaccttgaaaatcaaaagtaaaccctccctaaaccctgatagcattcattataaaatttgcatggtgaaccatgaatgttatttgaaagaatgcaatagcatacctgttattttcccactatatcttgataactcactctgtgactcagaaattgtcttttctttttgtatcatcttctctataatactcggttgtttatgtgcaatgttctactttttttttttttttttttgaaacagagtcttactctgtcacccaggctggagtgtagttgcataaacctccactccccaggttcaagtgactcttctgcctcagcctcccaagtagctgggattacaggcatgcaccaccatgcctggctaattttgtatttttagtagagacggggtttcacaatgttggccaagatggtctcgttctcttgacctcgtgatccgcccgcctcggcctcccaaagtactgtggggattacaggcgtgagccaccgctcccggctaattttgtatttttagtagagatgggatttcaccatgttggccaggatggtttcgaaatcctgacctcaggtgatccgcctgcctcggcctcccaaagtgctgggattacaggcatgagccaccatgcctggcctaagtgttctactttcaattgaagtaatttgcccaattgagcaaattatcattcctgttttgttatatttagctagctgatggtaaaggacatccctatgagagcaacatctgtcaaagtattgtactttgttttatgaagagactggcttttaggaaatggtgaattgctttcttcttgctttttgtggtgggaggcactagagagtgtaatagagcagtgtagattgatttgtatttttcttttccacttgtgttgggttttgtttcactattatattataaaaaccaaaataatgggagttttccacaaatggaaggatgtgacaaatataggtgtgattcagcccaagataatgatttcgaatatgaagaaatcctacttgaaggacttggaagtcttattacattacttcatcattaaaacgacactaaaatttgatggtagtttcctctaagcactgttttaccatccttaaatattgaagtactagaactctaatatagaaatattagaaacattaaaactagatagtaaaatgctttaacaacagcaacaaaaaagcattacaaaacaatagtataacctaacatatgcttcatctcttcatgaacacctaattattactctaatgtagtcacctctatttatagtcagctttttatcgtgcttaatagcctttctcgttaagtcccctgactgctttagtcttcaccctgaacagaagtctcctaaaattgaggccaggtgatgaattaggccccttggctccgatagtgaactagtagagtccggctgtctaaacagctattcctgttcaattgcattagtgtgtttccctccagggtgataattgctcagaactcattgtggctcatttctttataatgcccataacagtgcttttacaagggaaggaattgcatattttagtgctgtgataaaatgcaagaaggcatgctgctgtaatgtggttggccccatcttgtgtacagctatgaacatttgtatttatgacagccatttcacacttgtatatttgggaaatggtgaaatgttgatgtgctcatataccagaatttgtgaatctttcatattctgctaagaataaaaaatacttatctaatttcaaacatttctttgaacagtgtctacctgggggtgtgagggaagcaaagtagttgtctacctcctcactctgtaaagataatacgcatgttaatttatgctggtagtttgaatgaggcacagctgctggataaccatgtgatccatctatttcgcggaggatgccgcatttttattcaacagccatggagcaatagaaggaaagcttccattttgtacattttttacaaacggaaaataagagaaagggaggctcacctatgaatactaaattagggaaagcctatcaccgtcagtgatcagaatgttcaaacttctttgtgttgctcattgatgcacaaacaaaccacatgaatctctatttgctcaaaccataattgaaaccatcaccccagtcataaccagttataggatgcttgccttaaaatatgctctcacttgtcctttgatttagaaatcccacagtctcttctgtttttcgtttatctacccaagtcacagacattctgtggcgctggtgtctttggggcatcgtttcctttcttagtttgctgctcttcaaaacctttgcaatcataaaggagcagcatcacctttatttgaagctcctctccactgaacaaatagatatgggaaagaaagttgattttagacatccaattaaatcactctcttacaagggaaattactccgtggagtgttaacgtgttagtctattctcagcaagtcagttggcaaaaaggaagccattttatctttgggcactgaggttatcatttgggcaaaaatactctgaaggtagggaaatgttgtcacaacaaaaatccaaaaggtcatcacccacagatacaggtcataaatttttcttaggaaaactgcattggtttatgatgaaggtgatttttctgtcatatatttctgtgaaaaataagatagttaagggagctcttatgtacatatgtgtaattcataaacttattaaagaatgaaaggtacaatctgatcaattttaaatttaagcaaccacatttgccatttcagagcccatagaaaggtaacccaggaaacagatgtaaactggcaatcgttaatgctgttatatatcttcaatgccattaccagaaataaagaaaaagaaaacacaccatcctaaatctgatagttctgtcctagtaacatttctttttcagtagtttagtatgattaagagtagataagtcttggaaatttgaaaaatcttaatttccagtctttctctaatgtttcagcttagacaatttagttaaaatatctgtgcctcagtttcttcatctttgcagcaatttaagagcccgtatcttggcattcttgattagaggaaagatatttctgatacattgtaaacactaataaacagtagcaaatagaatgtgtgtgtgtcaacaggatagagtttatcttcaaaccattttcttctgcagtgtccttcctcctggggtaaacaatgtttcaattagctttctgttgttttttttttttttttttttttttggtaaaatattagatgacaactgatatacaaacaacgtgcaaaagctataacttcttttggaagtgagggagataaatacaatcttatgcctgagatctctgatggttttctcgaaggcgttgtcactgactgggttttgttttttgtttttgtttttatttttttttcactagaggacaagtttctacacctctaatcagactggtcatacaaaaaaaccattccattgtcaaaatggatgaaagcagatggctgaagaattttgagctttttttatttattgtctctgttgtgctgaactaaccaaagggtaaaacattctctgggaatctctagcttcaagccttggttgcccttgcatgcacctttgaaaatgctccactaacagaaactcctaactgatggagccaagttccagatctgtggtttaagatttgcttcagggatcaggttgctcaaacttcctacagctcttaggagctcagagtatgaaattcatctttcaactcacccagaactaatgtatttgccccatattttctgaacaatggctttatcttggagtataccatatttgagacttcttgattataaaattagaaattatttatgtaaataaaaactcaatttttctgaacaatttatgaaagcccatttgaaatacaacataacctaatgcaatttacataagacctaaaaaggtctactctaatttccaggatataagaggaaataacagtccaaaatagagatgggtttgcacttgcattcctgtttcaaaacctagcaaatgcttataaagcactgccttgtggccagcactcctctatgagctggacatatattaattcatttaatttttttcttttctttttttttttttttgagacggggtttcactcttgttgcccaggctggagtacagtggcacgatcttggatcactacaacatttgcctccagggttcaagtgattctcctacctcagcctcccaagtagctgggattacaggcacccgccaccagcccccgggtaattttttgtatttttagtagagacggggtttcaccatgttggccaggctggtctcaaactcccgatctcaggtgattcattgcctcggcctcccaaagtgctgggattacaggtgtgagccaccgtgctggccaattcatttaattcttaaacaggcatatgaagcagatgctattgttttactctttttcaagattaaaaaaaaaaaaaaactgaggtatagacagaggaattaaattggtcagattcacacagttgctgagtggcaaagctgggactggaatccaggcagcatggttccaaagcctgcactcacacaactctgtagatttgtatatttgcattatttagttgtttccagtgtgccctgtgacagcaagaaataaaggatcagaacttaaattatggaggtgatttttattcattaatctgttccttcattcattttttggtagaagtccttgaaccaaaaaaccaaagttaagatcttgtaaaaagatttattttcttagctccttattttagtacatccagggaactgtggaaagcaaaatgataaacgataacttgaaactatgtaatatctaataatataaaactgacaggacttgaagctatatggtgcagagattaagaacataactttggaaccagtcaggccttcagacaagttacttaacctctctgggcactaattttctcaaactataaaatagggaaaataacagttttcaccacataaaattcattcaaagaggaaattaaatagtacgtatgtagcaagtatgaatctctggtaggcagggcctatattcttcactttctacagaacaacttaatttcttcttttaacttttattctcttgactggtggcaaatttaaccttagtcattaggggaagtactctcttccctatagtcttgtcatggttccattaggttacgtagttccaaggcattttgagagcagtggatgttcctccaattatatttatcattggataatttaaattttctcagtcttccataaagtgctttgtaaatccagatgaaagcacagcctctcatccaagctgggtttcctgagcccatctatataaatgttgcatggaggtggttactgaggaggggtttacctcagtacaccactgaggcatccatcattcctgtctgtctgcttcttctggtctactggccttttgttgattctgtaccatatgtggcactctctacttaaaagcccttctcagccattttctgtctcaaattggaataaaattgatggaataaaattggaggtttatatggtggggaaagaatacaagtacatgtgagtaaacagaaagcagagaggggtacagaaaccatgaggatgaggggcctggcatctcattgtttgggtgtggtggtctggtgagtttcagtcccttgatactatctgggagggctgagagttgatttcctgaggaaagaacccaaattaggcaaatgtaagcttgaagctttcgagaaagtcagtttctatgtttatttaaaaagactattaccatcagttctatgggccagtttcaaaatatgataccaaaaaacattactcaaggatttggtataaataggttagtattcagtaagtgcttgctttcattactactagtcttgctgtcattgttattattgataataggtgaagaacacagggaaaaacagaaccaccacaggccagaagacagaagaaaaacctatacctttaaaactaagcccaaggcagagtgggtccactttctgtctctgaaggctactgatgcctagatgactattatggtggttcttggctatctacacccgtgctgcaggtggggtgatctccctggacacctatttttttcacctttcatcattcttcaagcttatatacaaaaatagagtgttatggggccattctgtgaataagacactctaatgccaagggatttctgctttctgacaaagtatacattaaaccaaataatgattaatattctttattgattctaattgattatgactttgttgaagataatgaactcaatgattagtaatgattacacagctagttagaattagaactgcatcgataaatcactctaataacaagcaagtgccttccattataacaattttattatgtccaaaaaatcattttcataatggagattcatttaggtcttcagcaatatatattgagcacctataaaatgtcaagaaccattctatggactaagtatatgtttgtaagccatagagaaaaatctcagccttcaaggagcttacatcctagtggggaagatgagaaatcagtaagataaaaaagtagcatgcatagtgtgttagagggtgttaaatgcaaacgagaaataataaaacagaaatgggaagtttggaatgtgtggtcaaggtgagattgtaattttagacagagtgaccaggataacttttgagtaaatcactgaaagaagtgagagaataaaccacacaggtgtcagggaaaagagatctccaggcagacaggatggaacatgtaaaagcgctgaggcaggagaatgcctgctgtgttcaagaatcagcaaggagacctagtggagggaattgcaggagaggtacaggagagaagggggtggtgagacaaatcaggagactggggccatttgcaggaggggttccttttactctgacatgggaagccactggagaacatttagcagaggggtgacatgattttattatattttaagaggattactctggcttttatcctgtaaatagattgcaagggaacaagggcatggaaaagtctctaatatatgagctattgtagagaaaattttgatatagttgagacccattgaattctaattctataaattctccttttcctgtgctgcagtctgagaattttgagcagtgaaattctaacttctacatttgtacttacatccactcaacactcaataattgtgctgagagtaatatgtgtaagatgcagttcttggccctgtgagaaatactgtgatgaactagagaggactgcccgcaagaaattctcatttcagaagctgtgatataacctgtaaatgttagacttcaagaacatttatagagatggaaaaatagcataaaagattggctacagtgatgtggttattcaggtctctgagaaaaactctgaggccaaaaatgtcatctaaaaagattccagataggagaaataaacagataagctgtgatacaatctcgtcttgttttacttttctttcgttccttgttttcatttttcttttttactctctttctttttactattatgcaagaaaactaagcatgttgacatccattactcacagccttaactgatcactttgccaaatctctaagtttacagatgactacctagtttccattttgaattatcaaggaattaacacttcaacaatgttagttgcacctgatttacatgtttgaatccctcagacctcgagggaagtatcttagtaacaacctaggtgactgtcatagtcattgagatgtagttgaactgtagctgttaaatggaaaacattctaccacattaatagttgaggtttaaatggcaatttgaggccagcatggtacatgacgcccgtaatcctagcactttgggggccaaggtaggtggatcacttgaggtcaggagttcgagactagtctggccaagatggcaaagccccacctcggctaaaagtccaaaaattagcagggcattgtggcgtgcacctgtaatcccagctactcgggaggctgaggcaggagaatttcttgaatccgggaggcagagattgcagtgagccaagatcacgccactgcaacaatccagcctgggtgaaagagcatgattccatctcacacaaaaaaaaaaaaaaaattttgaaatggggacagccttaatatccatgctttgtttttttctcttcaggctgggttgagggtctctcctctgcttgcctgtcacccagtaagtacctatgttagtggaatgtatcaaaattaactgaaaatttgcgtgtgccactctgccatctctttgagggcagagccaggtgttattcacacctgtttatgaccaccacagggcctgacagacgttagttgttccataaatgtttattgcattaaaccgttgaactggctgtgactatggtacttaggcgactttcttatggaaggcaaatagacattgaataatcatttttgaatgccaaatatttatcaaatatcatgcactcataatccaaggatgcatcaaattccattgccgtcctggaagagcccaaagtccagtgggggagagagacttgaaaactcataattgtgacatggggatgtgactaaacaagtttaatctgagatttagacagcacagggaagggctactcatctctcttgaaattgcagcaggattcgctgaaaaagtttaataaagagcttgaagagtggaatttgttttgtcttctaaagaaaagttggaaacattacaggaaatgcacaccagatattgaaagctctagaggtataaaagtaaaaatgctgtcaattcctaaaatagtttagaccttgtttgtgagcatattgggtaagtgggatgagagcttaagccaaaagctaaagggatttatcacatatgagaatgaatttgaatgtatagattagttgaaaagaaatggaaagttatatagaaatggtaggctagaattgtattttagaaaggtcattttggtgacatatggagggtagattagaaaaggaaaagaccaaaaactggaaaaccagttaggttaataacaagcaacgatgggacctcacattgtgtattgctgtggttggaaatgtggactctggatcaagtctacctgggtttgccttctggtctccatgaccttgagcaacttagttaaccacttggtgcttcagttttctcatctgcataaggagaataataaggaaagctctttaagggatattacaagtattaaattaatgaagcatataaagttcatgacaaatagtaaccatttagtaagtgttgcttgttataattaaaaacttattggactatcataaacattctgtgaggaagatgcagtgtttacactcattttatagttataaatactaaggcttctagggtttaagtcactatgatggctaaatactatatttcgtacatttgcatatgaagtacacatacaagcagtcataagacagtgggtaaaataagagtttattatttactaatatctatcaatggatcttgaatttgatagatttattaaaatcatgcagtcatgaagctctcattccctttagatttttgctacaaattcagaagtttagagtataactgaagcaaccacagggcatccgtagaaaacgaggtttgagactatacagcagaaaagtatagactataaatgataacttttgctcattggccttgctctgcggacacaagcttcagtctgcctgactctgtacctatatttctcctgtcaactgaagagatactctgtagactcttagtttcctaacatggccatgttaatacattttacaaagttgcatatcttgtcagaagaaaaaaatcattacatagttaattcctagtcttctgtcatactaacaggccagataaggtctaaggtctaagaacttgtttgtaaaccgtatcatctatgctactataaatgtttgtttgtttgtttaatttaaacagcacgtgacaacaccatctgccagcttagcaaatgtcctatgtccctcatggttcttttaagacaggtagttctttgttacactgttactcagatatgcataatatcacttggttaaaaaaagattcaaatttcagaaccatctgtgctttatcaagcaatctatatgggtgagtttctgatgtgcaaactatggaaaatggcaattttgaagcacctatcagataaattttcaggaatgtgatgaaggagcagataaaaatctgttttccttgtaggaaaaaggaaatagaataccctgtggataagtcctaactacctcttaataggtgttagacttccccagctcatatgggtttaaggcatcacaattcacaaagtaaaagtttattttaattttcataagaacaatttatgtgtgtagcagagggaatgagaagctatttaacattggagaagtgcattaaaaattattcaatatttatttagtagtattttgtttaaactctccttttggatcctgagttccatagcttctagtacgcagatgcctcacctcagcaaccactcctgtattcactcatctcctcttgcctctgtcactgcccagtctgggagatctcctaaaacattacccggatggtatggaaaacaataagccatagttggcaaatatatattaaactttgaaaggttatttttttctttatacagttctaaattttggttcgatttttcagggcaatcataagttacattctaattaaaaataagtctaatatagaaaaaatctatagttggttatttcaaatggccaattgcttctgatgaaattgctctataaaatagatataagacctcctgtatcactaaatcttaattacattgtggaatgtggaaactagcactactcagtagctgtagaaaaagattggacccccagtggggaaaggatgctgaatagcagctaccatagccttatcatttttgcatttttgtgataaattcttgagtagggcagcatctaagtatagtttttaatttttagttgcttttttaaaatctatatctcattcagtgttacctaatatttaataacaatagtgtttgaacttgtctgtgccagctatataaaatggtgaataaaacaccattccaatctttaatatgtttaaaatctaggtataagtcatttacaattgatatctcataatttttataatatatgtgttgatagaaatcactgcataaatttcaccatttatgcagacaggtccacatccaaattatatggacatataagctgtatgtatattatatagctatatacgtggatgtacacatgtagatatagaaataggaatagatctagatatgtacatttacattttcagaagtcattgagacctatagcatttgttttttttcaagtgacttcattcaaatatgttaaattaatagaaagatacatgctttctttatgttagttaaactttacatcatgtctatgtatttattaggttcatgtttgctatccatgtctatttttaacaacggaaacaaactttggaacagtttataatttaaaaattaccctactcttagaaatattagaatatagaaatattattttttatgcttcatttttaatactgttgtataccaaacttgtttaaataagttcaattcaggacacatagcacataccattgttgtaaaatataccaattttaaagtaaatacatacttagaatttttaaaatggatacactgaaacaaatagcctaaaattggcaatttattttgtaataagataacagaagggagtttaggcaattttatgtgccttttatcaaaaagcccagagttattttcctacagaaaaaccaccagtgcaagtaattagtagattgtgctttactgaccaggctgctttctaattctcaccatgatgctactccattctctacgcatttacagggctgtaattacgtatgaggctttagactttgccaggccagcaaggcaatcagcccccttggaacaagttgaaatggaaagcggcaaaacagtataacacctgggtgatgtcacaccagcaaaacccatggacttagtggagctcacctgtagccaggggactggagtctgaaactgacattgtttccttcaaacagaaatgtgaaatgtcattttcagtaaatcaaataaaccccatcaagaagaactgaaaaataaacaaaacccaaaactccgagattaaaaagacaaagtaggaggcaataccattatttctagacttagttatgatttttattctgtctacttgattgttcacacctgaagcaaaatatattttgcataacttaatgtaatattttttgaatccatcataacctgtgacccataatactcatgatgattctttatataaagaagcattctaagaatgtttattgacaaataatttcctataagttttctctaaaatttttggagtataatttatctgttaggtcaaactctatatatgtgactgagatatggctggcttctcacattatttaacccatatttatcactctgctgcccagactggagtgcagtggcatgatcttggctcactttagcctcgacttcttgagctcaactgatcctcccacctgagcctcccaagtagctgggactacaggcacacaccaccacacccggctaattttttgcatttttggtagagatggggtttcgccagcttgcccaggctggtcttgaactcctgagctctagtgattcacccacctcagcctcccaaagtgctgggattacaggcatgagccaccataccaggactgatttaattgaactttttgccatgacattttactacttggctagcctctccctaagaaacgtagctgatttgaaacagaggtagagacaccttcaaggtattaagacattcatacagacctacattactgtaatgttgcttagcatagtgaggtaacataaaattggacaagagagtatgggcttcagttgtcaggtctattcagataaagatatggatgtggatataaacagtgcatggatatagatataaacatgtagatatatagatgcacatacacaattcttagatttaatgatcatatctttaaaatgcaagggaaaggactacctagtcatccttctcaggctttatctttcacttctgtgattagcaaacttgaagaattaacgaagtccaatctagtgataaagagattctataaagatagaaaagacattttaacattcttagaaactttcaactctggcaaaataaaatgttaaatcacaggaagctttgccaacaaactgtctttatgatatattttgaaagggtcagaatggctgtcagaactctgaagaacagtgcagctctagaacctgttactcctgctgagattgtcaagcaaggacaaatggatgtacaggatcctgattatttatctatgacaagaaaattgcttgattactttcagaaagttaacaccgttttcatgaaagatatcaaaaatgctaattgctaccactctttaggcttctatttcttccaatgtgtgggctgttggtaagaatgtatttttcagccaggcacagtggctcatgcctgtaatcccagcactttgggatgccaaggtgggtggatcacctgagttcaggagttcgagaccagcgtggccaataatatggcaaaaccatgtctctaaaaaaaaaaaaaaaaaaaaagagaaagtatttttcctaaacaacatcacaaattatggtctacagaatcacttgaatgctctagataatggtataatacagtggatatattaaaatttttacacagaattttaagaaatgtgttgcttatcacaataaagatacaataaacttctctttagacattgggactaatagtcagtcagttgatccaaaatatttttaaagcagtgatagatacatatctgacatatgttactttaattcaaattataaaatactcttgatatagaattaaggactcatttgtgtatgggataactggttggagctttactatatttggcatgaaaaatatctttaatttattgtctatgaatttttatgtgttgatttcttcacagtggaataagaactttaaaaagacttgtaaaataatttgggaagagaatccttttatatcttaattattgtttttccactcatcctttagaaactcatgttatgcctttatgtagtctttttaatatgcttaaacttcattttcattttttaaaaccttatttttccactcataagtctatcgtgtatgtaataattaaatcatgtaataacaagtaaaattgatatacttgcatttgtgtttacaacaagcatcgtgtaaacatacaattctagtgatgagagccaacacatgcaagcacaacttactgtaggtgtgcatgaaattcaactgatcagagcagaagtatgtgtaaggactctgggaagcccactatctgtaagaacatctcctacatgatatttaactcaagacatcagtataatattcatatttgtaagtagttctgtgctttagagagttcctaagcaaattggaccccttaaagaaatttagcattctatttttttctcccaatagtagtatcagttgcttcagagacaatgtcttaactttttgccattgccaatagaaggaaagtcgttaggagatagaagactgacagcacagcagcaatggaatatcatgctgagcactatgtgaagtagaaaaaaaactctattacttacatatttttattagctggtattttgtgttgttttatcacacataccaatgaatgcactgaaaagaaatgatatgatgagttcatggaactagaaaaatcatacttcaaagcaaaatataatgaaatataaacatatatacacatttgtatatattataacatatatattttatatatatacacatttattctacatattcagtattgtatgtgcatataaattttaataccactgctgaagtgatatcataatgttcaaactttgggctctagacaaatcatctttaccaaataacagccatgtaaccttggtcaagttaatctttctctctgcctcagttttctgatcttaaaaatggagataatatttcctaagttatactgttgcctacttcattaaataagctcatatgtataaaatgcttagagtaatgctattaatattaatagtagtatgtaaaatatgtgcacagatagatagaagaagcatgtataaaatttagcagttgaaatgctttgaattttcatgtttaaggtaccttgacagaacttaccattttgtgcctgtaccagttatctaagctgcattaatagtctgtggtagaacttctaaaactgatagaaaatatcatgtcttattacacttacccatggaaagccacagtcacctctgtcaacaggaaaacaaatattatgactacttcttttcagagcagcatctccgtatctgtgttgaattcaatactagggttacttcaaagggcacaggagacatggtatttaccataccagaaatagcatacctcatgacaaattctaaaacgtccctgcagccatctgaaatgatattctcttgtagttctggtggcaatttctttttcttttctttctttctttctttcttttttttttctttttctttttttttttctggagacatagtttcactcttgtcacctaggctgtggtgcaatggtgcgaactcggctcactgaaacctccgcctcccaagttcaagcgattctcctgcctcagcctcctgagtagcttggattacaggtgcctgccaccacatttggctaatttttatatttttagtagagatagggtttcaccatgttggccaggctggtctcaagctcctgacctcaggtgatccaacggcctcggcctcccaaagtgctggaattacaggtgtgagccaccacatagggcctctagttgcaatttctgagatactgactcccacagagactgccagtacatggtagcgatctcaataacagttctgctttcatttcatctcttgattggcctttagcagtcagagtaagtgaggctgtcatttcatctcccatccttatgaaattgaattttacgaaagagacgtcacctagagtttgagaggtttgattgacaatctccatatagctgccttgctctagtcagagacactgtcctgaaacctctgctgatgctttcacttgaggaaggaaagagcagatgggagggaagggagacagaggagacaccagcatgcaggtcactgtgacatctccttctcctgatgacaacagctcacacgcttccacctgcaatcctattaaatatagtacttgcttgacaggaaacagctgatgatggtaatgacattgttaagtcactgcctcaaatgggtggagggcagctaaaacggagagggcagaactattggagggccattttaccttgttttggattcataaaataaaaatgcaaatgaaacacacaaatatttatcaagacccaaacagaaagctgtctatacattgtttctctgataatgatatatgaggcatatttttggaaactttatcagcttttcagaaaaaaaaaatctgtatttttacctagttgacaaatttcaaattctccagagggcagctttaatatgtttaatatgattctgctgttaaaaaatagcaatcgagttttttctagagaaagtcatttgctatgagaaagcaataccatatgatacatgaacataagaacattgcaagctatttttatttggcttttactgagctctcaatgaatacaaaatcagtactgaacaaatagatgctgctgatgataaacctagcaacttattctactcaatttctaaagttcctgttaatatataggcaacccatcatccctcatctgcttttccatgtattggtaatgttagccacttattgatgtttttgtttgtgtatacttgctaaattaacagtaagagatatgggaatagattggaacatatagatccatggaaagactgtcatttgaacagctacacctgggccttcttgggtgttttgaaaatttctgccctaaaatccatttggctttgtgtccccacccaaatctcttctcaaattgtaatccgcatgtgttaagggagggacctggtgggacatcagagatgattggatcctgggagtggtttcccccatgttgttctcatgatagtgagtgagttttcacagatctgatggatttataagtggcagtttttttctttctctctctctcctgcctccatgtaaaaggtaccttgcttctccttccccttctgccatgattgtaagtttcctggggcctcactggccatgtggaattgtgagccaattaaacctcctttcttatttttttttgagacagagtcttgcttgtcacccaggctggagtgcagtggcacgatctcggctcactgcaagctccacctcccgggttcacgccattctcctgcctcagcctcccaagtagctgggactacaggcgcctgccaccacgcctggctaattttttgtatctttagtagagatggtgtttcaccatgttagccgggatggtcttgatctcctgacctcgtgatccacccgccttggcctcccaaactgctgggattacaggcgtgagccaccatacccggcctaaacctcctttctttacaaattacccagtctcagatggtatctttgtagcagtgtgaaaatggactaataaagtggattggtaccagcagaatacgaagctgctataaagataacctgaaaatgtggaattgggtaacagacagaggttggaacagtttagaggtcttgtaagaagacaggaagatgtggagaaatttgaaacttcctagagacttgttgaatggttttgaccaaaatgctgatagtgatatggacaatgaagtccaggctgaggtggtcacagatggagatgaggaacttattgggaactggagtaaaggtcactcgtgctatattttagcaaagagattggcagcatttttcccctgccctaaagatctatggaaatttgaacttgagagagatgatttagggtatctggcggaagaaatttctagcagtgaagcattcaagaggtgacttgggtgccgttcaagcattcagttttatgcagtcacaaagagatggtttggaattggaacttacatttaaaagggaagcagagcataaaaattcaaaaatttgcagcctgataatgcagtatgaaggaaaacccattttctggggagaaattcagaaatttgcataagtaacaaggagccaagtgttaatcgctaagacaatggggaaaatgtctccaggccatgtcagaggtctttacgcagccctcccatcacaggcccagaggcctaggaggaaaaattgtattcatgggctggtcccagggctctgctgctctgtgcagcctcagcacttggtgtcctgcatcccagctgttccagctccagccatggctaaaagggaccaacgtacagctcaggcctttgcttcagagtgttcaaaacccaagctttggtggcttccacatggtgttgagcttgtgggtactcagaagataagagttgagctttgagaaactgtgcctcaatttcagagaatgtatggaaatgcccagatatccatgcagaggtgtgctgcagagatggagccatcatggagaacttctgttagggcagtgcagaaaggaactgtgaagtttgagcccccacacagagtacccactggcccactgcctagtggagccatgagaagagggctactgttctccagaccccacatggtagaaccatcaacagcttgcaccatgcacctggaaaagccacaggcgctcaatgccagcttgtgaaagcagctatggcaactgtaccctgtagtgcacaggggtagagcttcccaaggccttgggagcccacccctcgccctggatgtgaggcatggagtcaaaaaatatcatctcagagctttacaattaaattacagccctactgggttttgaacttgcattgggcctgtggccactttgttttggcacatttctcgcatttggaatggaaacatttacccaatgcctgttcccccactgtatcttggaagtaactaacttgtttttgattttacaggctcataggtggaaggaaattgccttgtctctcagatgagattttagacttggacttttgggttaatgctggaatgagttaagactttggggcactgttgggaagtcatgatctgttttgaaatatgaaagggacatgagatttggaagaggtggaatgatatgttttggttttgtgtccccacccaaatctcatctccaattgtaatctccatgtgtggagggaaggacttggtggggtcgattggatcctgggggcagtttcccccatgctgttctcatgatagttagtgagttctcacaagacctgatggttttataagtggtagtttttcctgctatctctctcctgctgccatgtaagacatgccttgctttcccttcactttctaccatgattataagtttcctgaggcctcccagacatgcagaattgtgagttaattaaacctccattctctataaattacccagtctcaggtagtatctttatagcagtgtgaaaatggactaatacaccatttcagatattagcatatatcatagtgtaaaactaattctgtcagatgacatgaatatgtctgattcatctcatcattgatttgggtttccacacctcactagaactaaaacagtgtatcacattgctcaatacctatgatactctataactgcttgtagaagtgtgtgatttaaaagcccatggccattcctcttccaaacattaggtatttttttctgtgttatgaatatgtaaccaatttgtgtgttagcttgaccttgtatcagttgagactcctttgtgaagatattggaaattcaaggttaaatggacgcattatattttccaactgttacctgtcatgtactttgagtgaatcatgaaaactacctagaacagctgtcattttgatatgttctggttcttctgagaagttagatttccactgagtaaaattataggctctgtggagaaatcaaaacagtgctccatctaccaggaaggcctgcactgtgatcttttcagctcatttcacatgagtatagggagactttaaacttaataaatgagaatcagactacaaaggtataaaattattttatagtacaactccagataaatgtcatttttgtgcctctgcagtattattattctattaactgcattgatagtagaaactttcagttcatgtttttatcagaaatgttctgttcttactgtgaactagtctgtactgtgaattgcataatttgtagtaatagagtaatagtaataatcatggttattttataaggtcatcatagtgattataggaatttgcaaaccatggagttatatgtaaaaatagttattagtgtgtcttttcaaacttttatttcatctcaagaacaaagaacctattatatttactggcttattgaattagcaaagtatttggtagtaaagcagaagccctaaaaattgtgaaaacaataccataaggttcccctgtgttcagttgctaatgatatgtggttgaagtcatggccatggaagttaaaataacagctctggagttatgatcttggacatgttatgtattctctctcatcatcaatgtgattccctcatctgtgcaataaagataatggtagataatccttgtaaacgcatgatttaaaagtaagcattaacttaaaaacatattatttattgtagtgtacagaatataataactactcaatatatattaataattattatcacagaatgcggacacactattcaaaaaaaaggtgggagatttgtgttatgataaaaaaattaagctaaaaatctaaacactaaaaaaaccctattactgaaaatcaagtaactctttgcgattaggcatacacacacactcacatacacatttataaaacttggcatgtggacacacacaacaaggatcaggaattcacatgacttgttaagctcaattaaacaaaaaacaaacaatatttttgtgctctagagttaactttgtgttactttttagaagaattttctgttttttaaacctcatataatatgctagtcatcagcttgtcttttgatagcatgagtattaactatgaaatggttataaattgctatgcagaatgaacagctgtgagaaataataaatgattctgttatcacaactagagtattagatggcatatttagaattatatataaatgggattattatacaaaatagtggaaaagtcttaaaattaactatttgacttctatgggggcttttacataaacttactgatttaacttcagaaaaatgtgactctgtgtttcaaaaaggtatattaagaaatgccatgtatgatatttcagtaatacaaattatgagaaaatgcacttcttgtctctatttggtttctttgaacttatgccaaatcttctccaatattttcttggaaagctttattgtgatgaactatgtggagacagttttaaaaataaatgttgattttcatcatatgtgaaaggtggaaagagaggaggtggaaacagaggaattataatgtttgaagcctattcttttaccatagtaccacaacagatttaatatatggggtgttaaatcaggcaggaaaacatttctcaagaaagaccccctccaaatacttgaggttatttaggaatatttgtcatggtattatttgcatttgtaaccaatagaataagaaacatttgaacatctctaactgaaatagtctggcaagaacacaaatatagaatgataatgcactaaaacatgatttcaaatttgtattgaaatataaaataattaataatagcatccattttaagatgcaatccaggcatcttaataactaatgtatgtacattatcactctaattttcatgaaaatcttaggacttatgtattataacatccccatattgtagatgaagaaactgggattcatagagattagtgggccgcctgtagtcacatagtggttagaattcaaacatgattttccaattctaaaacttgaagtctgaaccaccatgatatgctgacttctcgtgtaatcagagcaattagggccaagtctctttttggtggtgtttcgttgtggtggcggtggtgatttatttccttaatttttttggttttgttttttgtttttctttttaaagaaaaaccattatatggaaaaaggcagacaattcttagttctactaaattaggataaattattatttttagtaatacctaacaattttattttcttccccttggtgaacacacacacacacacacacacacacacacatacacaccatcctaacaagtatgtacacatatatacacatgcatttgagatactttagttattcaaatgtaactaaaactctttaagtaaagctctgtggtttgtcctttatctttgctcctattttacatgtataatcattgcagactcaacttcaagtttatcctcttcattttatatgtgaatccgatctcttggtaagataaaacaaaattatatctagtatatctcttgcatataatgtttaaaagccagcacatatgttctcattgatcttgtccactacgaacaacacagagaatcttaaaaggagaacactatcaataatatttgtagagttttgctttgtgatattgtgatattttaggcaatcttgtaaagagcacagcagctcaacaatattataaagacctagaatatctttaaagtctttacaactttcttggtcattggcttaaaattagagaaaccaacatgggcatcctttctgactctggagcagacaggcccagagcgtgctcaagactacagtttacttaggactacaaacgaattaagcaataggaatggagatgagctctagtgtggcaacatccagcaaagggcagagtaaacctagacatcaaggttaacgcaaaattagcagctttaccaaagtgagcagacaacaaggaaacagaaatactgtactgagaagttgggcacaggggaaacctgaatccaaggcaaaatcacagggcaagggtttcctgctgaaggaacaaaattttacatgaatcaaggacgtagtattcaaactttctacatctcatttaatgttgttttaagatctctgtggggcaggaaacaaagagtggatgctactggaaactagaaattagccatacttgactggaatgtaaaaacaaacaaacgaatgttagcagcaacttttattgacaaaagtatgaccaacacatggccattctgtaggttaggctggaagtttatctaaactttaatggtacctacagatgaaataagactttggactcaacctagaaactgttaggccccttttaatttccatcttggattttccctagtagtatgtgtctgtgtgtcgtgtgtgtgtgtgtgtgtgtgtgtgtgtgtatctgtgtgtgtgtgtgtctgtgtaagatgctataacaggctaattttacttgttaggtaagttatattcccctgcaaacaactgaaatgaaaatcatttctttgttgattcctggaattgtattaacttttgacaagtttgttagttccttgaagtccactttgtcaatgcaaatagactttggaggggagcactctacttggcctaacactgaaatctgagtctgtcttctctctttcttcaaaaacttgagagttgagtcaatctgaaagctcagattcttgaagggacctggagacacttaagggggaagaggtacagagaggagaacagggatatccatagataagtttaatttccatttataatttagcactagaaacataatttggttgtttacagcctttaataacacaccttaaaaaaaaaactctgtttcatcatcatagtttcaaaagcccattttttctctcaaaatctacatataagttttattttatattatttgtttcaatatcaggttaagttttaaggacataaaaataatattatagtaatatttggaagaaaatttgattaagaaatattagttatgaacaaaatgcaatttcttaaggagaccaattacaggtcttaccagttgaggaaaactacctggaaaaatgtcattttggccttttaaaaaatatgttcaagtgcatgtaattttcttgttattaaagttgaatagcaatagatgcctaaccagtacaaaggcttcccttttgccttgcaaacatttgaagcaaacctgtttcagactaaatcctctcctatgaagaggtaaagcttagtttaacaaagtatgaacttaattgggcccagttttctcatgtgtaaattgaggagtatggagtaaaaagtcaataaatttatttatcttgaagacattttacagatgcttctgatgaacatttattgtcatggaaagtaagacaatttgtccttaatagcacttatcacaaaggttttgaaaactttttcagcttaagcatactctgctatattaacaattaccattaaaattaacatttactatggtgcaacgaaaagggtaatcttcatgttttccagctcatataatagcttatatacatatatatatacatacacacacgtacatacacacacaaacacacatatacatagctcatatatatatatatatatatatatatatatatatatatatgctattatatgagctggaaaacatgaaatatatatatagcacaaagaattaataaaacctgttatataatatttgggatttagcaaccagaattgacccaacatttctattttggggagtttgtcctatggctatattaacacacatacagaagattctataatgcacttatggatgttatagccaaaaactggaaatgaattaaagatttattaaaatgcaatgccttaataaggatataatgaggtagatctattaatgcagcatgtgctaatgtataaaaacctcatgacacatcactaagtgagaaacacaaggtgaaaacacacaactacattgcaatccattttgtaaataaaaataatttgaaaaatttttacacatacatgacagatatatgcctatatgctccatctacatacaatattttactgaacagctatgcagttagcagtagctccccaaattcacacaaattgcctttggggaaagttaatgtgactggatggttttctctacgtttattaagagttttggccaggtgcagtggctcacacctgtactctcagcactttgggaggccgacgtgggccgatcatgaggtcaggaaatcgagaccatcctggctaacacggtgaaaccccgtctctactaaaaagacaaaaaattagccaggtgtggtggcgggcacctgtagtcccagctacttgggaggctgaggcaggagaatggcgtgaacctgggaggcagagcttgcagtgagccgagatcacaccactgcactccatccagcctggacaacaaagcaagattccatctcaaaaaaaaaaaaaaaaaaagagttgtaaataaaatttgtgtcttacttatggtttgaggccagtgtaacctttataacagtgtcagaaaaagagagaaaaagaaattgaactgtaggtcagtttatagatacaaaaatcccaaataaaattttattttgtttaaattttataagtaaaatttaatccaaactaaaaatgtgctaaaaatgatatgccatcccaagtagggattttactagatataaaaggataatgacaaaaggatattgatcgaatactcaatctaatccatcacattcattgtataaaagaaaaaaaataatgtgattatctcaatagatgcagaaataataactgataaagattagtcactattgatgttacaaataaaaacttcataaagatagtaatggaagggaagataattctttgtggtagcaaagaattgaaagcaaccaaattatgcgttaataatgttgtgatctgtgcaagccaaacacaaggaaccaaaatttatatacaggaaaataggcaagcatgaaagggatgtacaccataagacttcttatgtgaaaataacacataaacagcagcatgtattttgctaggccaaatacatacatttctatgtcagatgattacaaggaccaaaagtaaatacattaaagaggtccccatgggcaaaatcagattaacactgagatgggttaaaagagggaaaaactaacctaaactaaacaaaaaaggagctttgtcttaaccaatgatgatataatgtcatgaactgacaagtatgatcagagagattctatgaagtagcatatattatataatcagcatggtctctactatataaccaacaaaaacaaaatctatttgtttttggactaagtgtggagtaaatagaaaaggtaagggcatagcaaaggggccatgcacagaagcccaaattcctgttctactacttacctcttctgtaacttcaagataatcacttagcacaccacagcttggattccttaatctgcaaaatgggacaatcctatttacctcccttggttttgtgtagaatcaatgtgataatacatgcctggagaaaagcataaagccccagcatacagtaggtgttctaacaaatatgtgctctctccatccctgcactcccaggtccactatacaggcccctcatagttaatagtcttcctgtgggaaggaattcataggaaagactgcagctactcctacacatattataacccttacacttactgaacttttcagacaatcttgcatttttcaggcctatcttaaattacagaacatatgataatgctacttatgatccctaatagggctaatcaaaaaggggaaaaaggcagaaatattatatgcaaagaattacagattagcttgttcagtctgcacaaacttgtaagtaagaaacaattggttgtgccataacaagaacccaataaatgttgacataatttcacttcagttttacagacttagttattacattatcatctctatattttttataattaataggactgctattttctttcataattggtgcatttattgagatatttcccactgttagactgatgtgtttcatcctctatacgtttgccctgctgtgtccccacagttatgatgctccaaatttatagagtttagatgtttcttgctgttggtttacattcctattcactatttattcataaaataaggcggagagggttctatgttgaaatgaacttttacacagaaaattagcaatcatgttctcagaacaactacttagtttttgataccattcacagattctaacttcgcatatgtaatactgcctaatgtcacaaatgggtctcatttctacaaaacgttaactatatgagaaagttgaaggaatggctcatcagaagacaattcaggtttataaagcttaagtgatattccagtcctatgacagtctgtgtttattaaggagtaagaatattgcattccactattgagactctgatgagtatcatggctttagcacagggtataacaaatcaaggttcttttgtttttttaattatggcgaagatgcaatgagaattacgatttgactaagttggactgtgactgctacaaccattacatggtgcccagtgtgccttagaaaatagaggtgtcatgaatttattttctctttcaatgcctgatgggaaaacgtgctactcagctaaagaactgcagtaggaataatgatcattcaagatgtcttcaaactgagctacagatatttaatttaaaagcacattgcctgttttgagagtcagtatttccttctgaaaagaaatatcattaaagcatagtgatgttaggaacttagggattttaaaatcatcattttccttgaaaacctggctgaataaaatattgaatcttggtatggagcatcaagtccttttacaatgtttttctctgaacagagagtttattatcatcccccctgagggcaggcaggaagaataaagccaacattctgctttactttgttggatctgatgagatcttgctagcttcctagatctcactttgggatgtaaaatggtacttccggactacccactaatctcagtttgttgttatttttggttagttggttggttttgtttttctcctctcactgcttagatttttatatgtcttaattatagttgtgaacacagatgaaaatagtataatttaaatcgacttaagtgtcttgcttttataacagtgatgcttgatttttgtgtttgttttccattgttctaattttcttttagggcccttcttttacctggtagccaggtatgacaaaacatcatatttgatctataatacaacactattagaactagaaggaccctacacacctcgtcaaagtccttcatttcacagacgagggccagcacccagagaagggaaatgacttgcgtaggccactgcggctacttagtggcagactcacgttcagaaatctttgtcttgctaaagggttcttgctacaactcttgctaaagatttctttttcctccacatcaaacttcctttgttctattctcaacttatataatgacgtttgaacagatctagcaacaaactctttatgtggacttccctgacttgctggttgatgacttcaaatgtttgacagtgcacatgacaatataatttatcctatgactgcaaagatgacatcttgtgaatactgcttgattcctccacaaaatcatccctgaaaggcttgtaggtgtctatagatccacagattccatagtgttcctttgaaataactgaaaatgtcattctcgctgttagttaaagacaaatgccagatatggtaacacagttataagtgctaattatgttattaataattttatccttttttcctctcaccactgtgctgtttctcacatgctgatctgtccatcctgttttgctattctaggtttgtgtgctggagaggcaaatatttgacttccttggatatcagtgggcacctatcctggcaaattttgtacatattattatcgtcattcttggtttgtttggaactattcaatatagacctcgttacataacaggagtaagtacattttctgccttttaaaaatcttattgaactagagaatgatgtgcaaactccaaatgccttgaaaacttatgtgtataatctatcttaaagatgtggatactctcttttaagtaccatgtgtttattttcatagtttcagattccatcaacagtaattgaaaatgtcaggtttaaggcacttgatagtgagtgtgatcagactgaattctcataatttgtactttcagcgaatagtctcataattacaagccaaactgtgtttctatgtttctacattataaagtcatgctttctggtttgacagattttaatggaaattttttctcattttaaataatcatattttatacattgaataaagagtttaaaatcaataggaatgaacatatactattgatgtgaaaatattaaccacattagggctaatatttggcgtatgagaaagccagaataatctggacagttgcctctgtgttctccataattctctttttggcttgaaggaagtattttgcattcccactcaagttaaacttacttaacataaaagtgaaatccaactgtgtttcagttactatgggaaccataactcagggttgcttttttttaaacttttgtatgtgcctcagatctcagctactgctcttcattaatgtacatttttttctttttagtttcatcattttttctatttcttctatttttgacaaaggaaatgtctataggcatttatttaaaattgtaaagcaggtttgtagtaaaagcatgtatataagatagtaccgtgaaagctctgccttgttcaacacaaaccagcagcccttctcatgttttatgaaagcgtcctcattaaagatgcccccccatgacctgttctctccatcatctagaacccagataaagctcattggtacagccaggcaatgtggtggtggctggaaccaaggaagaatgagaagcccacagtcctcgcctccaggtgcatgcccagcctccagtgcatgtcactgcagaggctaggtagccatctaaatcttgtaaaagtgggaggagttctgttgcagggtgaagttttttaatgcacaagatatgatagtattgtccattttcttttatgaatcgtaatttgatacagtgtagggcgggttgtacagtggttgagagtgagtcctctgaagtcataatatcaagattggaatcttcgatctgccaaattctgtgtgactttagataacttcacctcaccaatctttaattttcttatctttaaaatgaaagtagtcattacattaactcataatgatttaattaattgatatatattagccattatatgaaaaaaatttaacttaccattctttttttattagactttgaggttccttcatggttttattcttataaataatggttgctctgaatatcattatgtaaatatttcatctttatttctgataaagttcttgggataaaatctagatgtgacccaaaatatttgaactatttaaaaactcagaggttaattttgaggactaaaggggatgttctatgaaaagtccctagcaccgtgcttgatatttaaaaagcccccaataaatattagctataatatttttgtttttaattattattatttaaaaataatactaacctgtgtaacatagcaataggctgaaaggaaatttaaaatagagcaaggtgttctagatgttggatgaactatttctgtcccttttatcctaagatgctacaatgcaaaaaaaaaaaatttgggctttctatgtatcaaattattatctcatccttttgaataaagacgtaccacagatctttcactactggctactttctctggcatgggataagagttatgatgccaagggaaaacacctttaacattgttagaagttttgttttctgaggctattagacacaacctgaactctttttaaggtcttaacaatgaatttcagagccttgatttcatcttgactggtaacatcactgtgcatttggatttttccctgagacaatgtctttggaaatcttttgccggctggagatgatgtaaatgataaacttttttttccaactcagcaagtcctgggttagaaatatatcctctaaattctgcttgaaaatctttctttagctcatttctctcttacaatatcatgctgtctgtggctaaaagataacaaatagcactgtcatcttttttttgcttggaaatccccttaaccagacccataaactcataggcatattttctatctttccagttattgaagacaatagctaagataattgttctggcagtaaattccatgagtcttcttttctccagtcctcaaaaacaatttcctctctccactcagagtctccttgctgccctcctggtgtcatttgcctccttatctcaaaaccagtactgtgtgttttaggtttaagtatcactgactttctggtaccaatatctgttcaggtatctatgtctgtgtaacttctgtgcaacaaactacagttgacccttgaacagtgtgaggattaagggcaccaaaccccccacacagccaaaaatctgcttataactttctactcctcaaaaacttaactccaatagcctactattggttgaaaaccttactgataaacagttgattaacacatatttaatatgttttatgtgttatatgctgtattcttgcaatagtgcaagctaaagaaaagaaaatgttattaaaggaaatcataaggaaaatatatttattattgattaaatggaaaaggatcattgtaaaggtcttcatcctctagcaatgtagacctttataatttttatatttgccatattttctctgtaatatttttacattataaaatagcttgacataaaatataaaataatttgatacaaaaataagaaagcatttctcgacttcatgactgaagattaacattttgcgtatttcctttgtgtacatacaaatgaaacatgtctgtgtatgctatatatccaagtatgtcttaattttaaattgaacattatatcaaacaatttaaaaattaacatgactatttcattgtttctttaagcctttaatgttatacattatgctattttcatatttttctattatattaaataattccctataatcatttccaacaaaaatactctcgtctttttttgtgaatcattccttaggagaaatacctaggtataatcaaataatatgaacaattttaaggcttttactatataattaataataacctatccaaaattattttactgaattatcctcttaccagtgtacagcagagttgatttcactgcactcttgctaaccctgtgtattatctgttctcatagttgttaatttgatagaagaaaaaatgttattttcatttttaattgtatttctaatcgtagtgagttagaatttttcgtatgttcattacccatttttgttttctgtttggaaaattgtgtgtgtgtgtgtgtgtgtgtgtgtgtgtgcgcgcgcgtgtgtgtgtgtgtgtgtgagataagtttcgttcttgctgcccaggctggagtgcaatggtacggtctccgctcactgcaaactccacctcccaggttcaagcaattctcctgcctcagcctcccaagtagctgggactacaggcgtgtgccatcatgcccggctcatttttgtattttttcagtagagacgaggtttcaccatgttagccaggctggtctcgaactcctgacctcatgatccgcccaccttggcctcccaaagtgctgagattacaggtgtaagccattgtgcccggccagggatttgtcttttggtcttctttgctaattttttaccctgcagtcttagtgtttatcttaatttatgtagataatttaataaagacatttacctttaaaacatcataaagcttccttttgatacttagtatgtctatcttattacagttaactctctttcaacttgtgatattttctgctgcttttaagattatgaaattcaaataccattttgaaaaagataagtcttcattatccttatgtctaattttaccaaaacaaaaaggcaggttttctgatattgagactgagggcatttgctatatttgaagagcttcaaattattgatgggacattttatttaattgatcttgcctcccacacaaaaaagtatgtggacattcttcaaaccattgagcttgtagcaacaaataaatgagagtattggtaatgatttttgttttcttcattcatcttctttttcatagtagcaaagaaaaaaagattaaaaacttaaaacagataattggaacaagaactcattagtgccatagagagcttctgtcactttgcagaatatagtatgctgaaggaaaatgaaatagatgttttcaggtccaagcaaaggaaacctgaagccagaattcatagaaagaatcaatcttgtatctcaatcacatcaaatcccagaaaataattcataaataaatatatacaatggctcccaggaaagcattattttacatcataaatggaattatataatgcatcatcatttggggaagtagaatgtgatctgagatatccagtgtttataagttaatgataaaataatgttaaggagctgcactggcgctaaggagctgctttagattatctaaaataatctgaggaatatgtaggttcctatccattaaagccatagcaactttctcagtgatattgccaaaaacaaatgttgctgtgtaacatgccaaaaataaattatttctccccccctctccctttcttccttccttctttcctttcttccaaactcagtctccaaactagaaaaaaaaagtttcaaaatagctgaaaatctattactcagattttatagaggatagtatactaaaataacagtaatatttgtaagaataatttcttgtttcttaccaattccatcactgattctcctgtatatctacctttcttcataaattctataaccctcacattaacttgacacaacttttgttcaaactcatatggaaaggaaatagtagagttaggaggttgacacaggttctcctgacaaccagtctgtccttgtaaccaccacagtgaactgcctcttagaggcacagttcagagacccaaatctgtctgataaatgaacaaaggtgctgttaagttgtgggcaaatttaaaattcattacagcatttgtgatttccagaggatttagattttaagttgtggtctgcctctcccatatcaaggattatgtttttaactccttagttaatggagaaataacctcatgtttcaagagtttagaacagaaaactcttagtgatggatattttattcatgcgggaaaacaataacacaaactatctttaatctctagtaacagtgaattagaatggcatgttattctttttctatagcacccagctttttgatggtgattttacatatatgcatatgtacacattcatctatacaatataagttatatctaatatccattataattatatgttaaataaggacaaatgatctatttctacatttgctatttgtaaagagtttcaaataattgatgggagaatttatttctatgtaattgaataaaatactcaaaacatattggaaatacaaaagacctaggaaacaccaatatagacatacatacatacatatcattatgcctaatgaagaatctttctatgacaccaagttagactacaataactaattctaaaatcaaatgaaggagaaatattgggattggtttcctgttttgttactgaaaaagcaagagatgaaattaatgtgtttaaagctgatttgatgaagcaagtcatcaaatgatggttagaaagagaagccaatacacatgaatcttcatttcttgtgttctaagaattgtaaactctaagactgtcataataaccctgcttactcttccaaaataataaaaaagtaaatatttcttttagtctgcattttaaagttttgaatggtattttctgattaatgctgaacactgaacttctgttcaccaatttaggccactttttgttttactacattttttttaacgtgatacatatggtagttggtggctgttggtttctagattgatgtacatcctccttctccccagtgaggcaaggtcagcttcagacaaagtgtcacctgctttgacttccttaactttgctttttctagagccaacatggtaaaggatccccatggcatcctggccaaagcatggggccacagggtgactggagcaccagagacaaagacaggattcattttgtaaaaagattacgacacagcaacttgagaaatctatagacaccttagtggttctgtataagtaaagaatcgcatactcaatttgcatgggggaaaaatcctctaaatttctagaatttactatttgctgataattgccgtgatttgatttttaattgtccatggagctcaggtctccatagagactatcaccaacaacaataaatcaggagcactgtctccattttccaggtcatatgtttttctaaaactaataaatgttacctccctaaaaatttttgcactcctacaagtcatttctaagaagtcattaatctatgttcaagtagttgttttgccacctttattcaatttttctaggagaaaaaaatatctgaaaggaaacttattgcagctaaagcattaacaaatgcatgctttctgtgttgaggacagaaaatcaatgtagattagagatgaagagacttgagatactagtaaattaacaatacttctaatgactttagagtagttgtgaaaataagtcttttcccataagcctggaagggagggagaaaacaaaaaaaaacatcattacaagtttaatggatttagcctgtagtcctaaaataaatgtaataatgcaacattgcaaatgcaatttattctcaaaagaatgtgttcccttggggaaatgtggaccatttattctacaagaagatactttgtgccctcattttggtgttagactatgactaaagatttataggatgtggtacatataaataattacatttgacagtctagattcacttttttaaatcatctaataatttttgaaaatgaattttgaagaaaagatatattgtgatatgtttaagtattagtttctttttctaaaataaaaaaatcagattatgtagtttttttaatcaaaaagtaaaattgggcttataataaaataaaacttcctttccatactcttctccagctgttcctcatctctttatagttcttctggggttacctcagaaatgtgtgtgtgtgtgtgtgtgtgtgtgtgtgtgtgtgtgtgtgcgtctgtgttgctaattgttgatttttcagctttagacagtgtctaataacgacctgccccaaatcatttggtctaatttgtttttgaattatacgttgtttttacaggttttctttcccctctgaagtttctgattgctttttttttttttgtaagaaacaaaacaggccttgcttaagtgtatcctaaatacatttccaattcatgtgcattctattgcttgatattcattctgttttaattcttgaaatccactgctttactatttgaattatccagtccgtttatatttgaccatcactatctgtagctttttgtttttaatgcaatgttcttcttccctggagatttctcttagtactcttgtcattttactccgatgtcaactgtttgttctcaagccctattatacatctatctctcccttcttctgatttgattcatgctttcttaaattccatctattatctctttgatattctacaaacaacttcctgaaaagcatgtttgtgagagaaactttctgagttttatctgtctcatgacagagaatgactttattctacctttacacttgagtactagtttggccaggtgcagaattcagggttgaaaatcatttttttcttagaacactgaagtaattgttcacaatctaagaagcagtgttactgatggccagtctgatatcaatctgtaaataactttcaaagaactgcttgagatattcattttattattgttttggcatttcaaaatggcgtgtctaaatgtgaacctatttaaaaattgtgtagtcttttttttattatttaaacacttatagaagactttgttgtggctcagaaaatcatattcaatgtatggcaattttgaatgaaaagagtagcctcaaggtctctctgaccttccttcatcctctgtctctagatcctctctttcccaaagcaccaggagtccctttctctgaagttcacttgtctaactgaggtaagttcttccaaaagaaatgcaattgtcttgaaacccctccgcaggaatctcatcaagcagccagggaagattaatcactggagaggagattaaatgtcatccgcatacccagacagcctatcacttattcttctggaggctgctctgagaagctttatctgcataatacgacaacctttgttcatcttgtggttcttccttttttctctcccttaacttttctccacctcccctgaaagccctcaagcccctattcctttatggtataaaaactcaaccatctggctcctcctttgagttttatattttctgtgagtctcatgagcttaaataatgagtatgccttgtctcctgtttatctattgtcagtttatttcagcagactcagttgtcaaaccttcagagggaaagtttgaacctccctacaccttcaattctggaatttgcatgcatcattttgatgattcttgatgcttttcaacatttgcctttgctatgctatccccaggtaatttcatttaacagttattttatattatagtttttaatttatttatgaaaaatctccttgttttccccagagaaataaactcctggctgattctaaaagtggtagagggttattgctgttttccagcccactttacacactgacctttggtcatatgtttcttacccaagtctccagagcatgcaaaattctccctagcagtccagcatttttttgtctctttctcctccatacatattatagactggcaattgcttcattctgcttattaatcaatatccatctctttgtcttcctcttcaggcaattggttgaaatctctttgttgctaatgttttattactaatagttgtaggactatatttgttgtatgctcagtttgcctttttgaaccaaaagtgtaacaataactattagattgcattaagtatgttttactttggtgtaatttcctttttaacaatgagagctgagcagatgacttttttttttttttgagacagagtgagactctatggggaaggcaaccccataggtttcagcctcattttacccagctcctgttcaagatggatttgctctggtttaaaggccttttacattgatacattgatacttatcaaaagttcaattaagaaaaatgatatttatggagaattgcttacaagataagaggttcatgcattctgccagaccctaatgtatcctaggcagactctcatccctatactgtgtcagtttaatgttggcagtgtgttttaatttatttttttactactgtaatgtattttattaatgttattaaactacattgactgattttataagaaacacactcatgacacttatttatttattaggaagatttagttgaaagtattgctttaaataggtgcacaagaaaaacaatctaccccttgtctcaatcctgaaactagtgatactttccttgtgcattaggttgatctaatggcaatagcaaaaatctcagtcaacttcctgaatttaaatgagaagactttttagcagtctgcttactgtgttatagctattagtattcagtaaatggtctttactatatttaagtagtttccttcaattattaagaatagctaataatattttattacatatctttgaagctgtatgctaatatctctttaaaatttttggatgcattgaattagattaataagtgttctgatattaatttaactttccattactagactataccttatttgtttgtaatatgttattcttttttttgattgctatattcaacttttactatttttaattacttttttgcatccttattaaaaatgcaattaatttatagctttttacttgtaatatttttaaaattatgcggccttaagaaaataaattggggaaacttttttctgtggtatagaataattcaaataggattggaactacaaatgttcttagaactaatctatgaaaccatctagtcctgatactttcatgaatggtagctatctaattatctttccaatcttttctacaataattgatcttttcaaattttccacttcttgaatgattttggtgatataaatttcatcagagcatatattttctagagcatttgtttcatgttattgtcatagttttatttcaaattctattgctctttttagaatttctttgatattactgggttggtcttttttctgcatacccttttttgctcatttcatgtattaatatctcgtaagagaaaagtgacgacagataatatcaaaacacctcatttctgcttttttctattttctctcattccaagataatgggaagaggcaagtaggcaccatttccaggatatttgctaatttttatggcaatgagtgtagcaaactgataatgtgaatcaatgaattgtttttagtttagagtttcttagtataatgtcttagtcttttttgtgttgctatagcacactacctgagattggatgatttgcttatttatttattttaaaaaatgtttattttagctcaacgtactagaggctgggaagtccatgatagggtggctgtgtctggttagctactggtgagaacccagttctgtgtcataaatggcggagaagtagaaggggaactgggagcatgtgagaggagcaaaataggaggggcagcctcactttataacaatctgctctagtagtaactcatccagtacccagcgagtgagaacttacttattcccttgagaattaacccagttccgtaagagcagcattgatccctctcaatgacctaatcaccttggatagacccaacctaccaatatccattcatagcacacagtctgtttgtcaaataataattataaacaattatttttaaaggttttgactgcaaaagggtttcagcttcatgttaattctgaaattgattaaagactttcattgaccacaccagcaaaactgacactgcataaagaaagtctttggtagctgtaattactacaaaaccccttttgtataatattctttatagtatttatttccaaataaatctttccttgcaagtatataagcaatactctgaagctgacccttcagaggttttatgaattgttttatttgccagatgctttgtgattgcccagctgactctttaaggaaatagttgtcattttcctggtcatctctgtgttgtatttgtagatgtcttgtcagtggtttttggaaatgttgactcatctgggaactccatgcccagtaagatgttatctacaccccacagctaaacttctgtttgactagacctgtcattttctgaaacacagcggaatccatttttttcttcatatttttttcttttaaagataccagttatgtttatggaattttgtaaaagaaatgtttggctgcaagtattaagctcattttatctacaattcatttttatgggagtgtcatgcacttaaaatttaatatgtgtgtacacaaagatttcccttggaagtgaagcgactaccatattatagtacagtaaaattggaattatgagatgtcttattttaattctcttcttgttttgaaaggttagtgtttgatggggagtttctgtgcttacatttacacttaaagttacattttcagagtagtttgtacctaagaatttatcatggagcaaaactataatttggcatagttttcattctatcttctaaaacctttgtgtcgttttccttctccttgttcttttcttcttcttactattatcattctatttttcttcttttaatgcaataaatttagtcaaaggcatgagaagctctgtgaacacgttgagaggtttgtagcatagtgttgtttagctgacaatttagtaaaactaagacaaacagccccatagctgcaggttagtctagaataatggcttgaacctgctttttattattgcttatttatatcatatagaataaatgctgacactggctgctgtgaggagaagaaactcaccgattaggaaggagattaaaaaacataagccagtttgcaaaatcctaattttatttaaggagaaattagtatcatttgtaatctctgctatgccctactactattgatgcattagggttgaaagtgaatggatttcaataagccagacagaacatttctttcagatatcggatatcaaaacaattctcagggcacaatataattgttttctgaactaaaacatctataatgctcctggaaatgttttcaaaaattgtatttcttttaaccaactcaacttcccaatctgaactcccctttactcttctccataaaatactaaaaataaatgagacttcagggaacatatgccaatttgtcaatctggtgataccttttttcttgtaaccattgctacatccttcattatagtaaaaaagactatctcaatgaataacatcactgtttatgtataaagaacagcataattctatttttaaaattataaatttaaaaaattgtaactcttctcttttctttaaataatgtataattcctccacaattgcattctctttcacattcaccaccttggatgcaaatttcttcatggttaagcctctactcagctttcacttctccttgtatattagagtataatgaacacagtttttctatgctagtttgctttgagttataataggatatgtacagaataaaagtataaaattgaggtttataaagcaagaaatgatggcctaaatggagttgctagaggaaaaaattctcagttatgttttatttcaaaacatctttgatgaccttattcgatagttatggaaattattttacataactgcttctaatattttccccatcttatcattttatgtagctaggtatatgcaaataaatgtccaagcagaaatcattataatttcatttacaagaatgtttatgagttcagatattcttttgaaacatgcaataatttcataaaatgaggtatgtaaaacttatatacttaaagattgcattgaaaaccagattatagatgttggagaatggtgtacaaaacattcttgaaagataaaagaacatagactccatacaaggaaccacatcaaaattcctattatttccatgttttcaagtgtgatctgtggataagttatggggcagtgaagtagttttaaattaatttcaaattttcccagagatattaggagcaattaaaatcaaggaaataggaattgtttaggataaaagcattcaattaagacccagaacctttactgggcttcttgatgtgcctgcttctttagtgttgtacatcacacacggacacacataaaaaaagtagtgcctatttaggcacaaagtccttcagcatgtgttttggactagatcagtcaaaccagcactaagacactgaagcagcttccttctctcagatgcctgtacagtctgcagaaccatgagcattttctctctcataaatgatacacagctttcactatacaacgattaaaaccagataataagaattaccatgatgactagtatgtcataaaattatgaaaactgttatacatactgttgatccttgaacaacataggggttagggatgctgacccacacacagtcaaaaatctgcatataagttttgactcccccaaatcttaactactaatagtctattatttattggaagccttactgataacataaacaatggattaattaaaacatttcatttctgatatgtgttatatactgtattcttacaacaaatcaagctagagaaaagaaaatattaagaaaataataagaacagaaaacatatttactattatgtaaaagtggatcattataaagatctttatgttcatcatcttcatgttgagtaggctgaagaaaagaagggttggtcttggtgtctcaggagtggcagaggcagaaaaggtggaaactggcccccctgccccgtgtggctctcaggtgggctgcagcaccatactgctcttccttcctctccctggatcataccacccttctagtcagttctgatggagaacctggttaccttggttgctggtgaaggattcacatgcttattattgttcttttccttgagagcctcagaactgagctgtttccgagtcggccatcttggccccgccccctgtcagtaatttttaaagccatggctttctccgtgtttttatgtggaacaaaatcgggcatttggcaagaaaccaccagttgttcataatttaaatcatttcttctctaaaaccctcaaaatttcataagaagttgaggtcccagaatctgaggctaaaaacctgactctatcaatgaaatgtgttaatgcatctgcttttatacaagtcagataaactctttactttggtttcttcttcacatcagttatcagttgtgagtatggaatgaaaggttaatataaaatattgagcatgtgtcttgcataagtagactctcaaatgttatctattatgttaataactttcacttctttgtctatttcaacatgatccttggccatgttttactgaaactcaatagcaataacacctcatctaggagtcaaaatatttctgaactaagagataaaaaaaattactgaaatatttttctgaatagggtttcaatactcttttagcagaacttttttttaatgttttttatgtattgccttctcacaaatctctataaccatgttttgtgtagcaatatacctgttttcttctttatctctttctatttttaatgtttccattatgattttcaactttcatggttcagcagaaaaaagtccactactttttcaaaccttacttgttgtcatgattcgaattactaggaatgaaacattttcaatctgacactgaaaatcaagataaatatcatgtgtggtgagaaactgctgcgctaaagatgttccaaaatgtccattgttcactatttccataatttacctgtcaacagctctatttatttgggattatttttgtgggttattgtctacactcaggcatagatgataatgccacacacattcatctgggataaacagaactataaataatatataattttaaatatagaatgataaagatcccagaaaagcagtttcttgccttctgtgaactcagcagataatgcatgaattggtaatgcttggaaggagagaagaccccccgtgtctattatcagtggggatgctatcattaaaccactttagaacagcacagcaaatggtttcatgtaagggctgctacaggacttgagtgaagccctcagagaacagtgtgattttagcctgcctagggctaatgatgtatcaaggatctctccacagtaaccatgtgtggcagcttgtggataggctttgtccttagtaaagaaataatcttacatttaatgactaagcattttaatccacttaaatgtttttagatcaaattgattcttgaggcatgggaattcactgccctggcaggcagaaagagacactgatgctctgttacatctggaaaatgcctgtagggagtctactgctactcagagaatccaaggcttctttctgaaggacaagaagagaaagaagcagcagccacagcagcagaaacagcagcagtgtaagagatatcagaatatcagtgcttagaagacacatatgaggaaactgcagaaacaaaattgtaataaacataatttctaaaattcactttggaaatcacttagatttatacgaattgcctatcacttctaatttggagactgaaactgatagaaactcaggacttttagaatgttactggactctagagtttgtttttccactgagatatatttttcctacattttctccaaatcggatcattgctctaaatagaaaaatgattttttttaaagagtggtattaccaaatgtagcctttccttgacgattcatgatgtaaattgttgttattgcaataaggaagataaaaacatttatttgacatgataaaaaaatgttgtttctatgtcttaaaaataacatcgtcatagatattagtatgcatatatgcaaaattccatgatttttcttcaaatttttcccctgaagtatacattaccccttcttttctagttctacttctgttttctattatcctatatttttctattctgaataagtacaaaagttaattagactgaatttaattgttcactgaatgttgcctacgaaaatgtatggaaatgttcaatttaaaagtgtaacttaacaatgaagattacaacaatgaagtgttgtactttgtcgaataatctatttcacatttctttcccagtatgtgcgatgtttcacattatttcacatggtagagaggattcaaaacttgttctgttgttactgtgtgtatgactggcatatctcaaatcagctttccagaggcagagttgggtgacccagcatcacctggaaatgtcaccaacaaatgttggcaggatggttgagagagagaatatttaaaattctttccaacccccaattcctctttacatggttgatctgtgtccccacccaaatctcatcttgaattgtaataatccccatgtgtcaagtgggggggccaggtggagataattgaatcatggaggtcatttcccctatactgtcctcatagtagtgaataagtctcaaagatttcatggttttaaaaatgggagtattcctgcacaagctgtctctttgcctgctgccacccatgtaacacatgacttgctcctcattgtcttctgtcatgattgtgagacctccccagccatgtggaactgtgagtcaattaaacctcttcccagtattaattacccagtctcaggtgtgtctttactagcagcctgacaatagactaatatagtaaattggtaccagtaaagtgggatgctgctgtagagataccagaaaatgtggaagtgactttggaacagggtaacgggcagagtttggaacagttcagaagtctcagaagaagataagaaaatgtgggaatgtttggaacttccttgagacttgttgaatggctttgatcaaagtactgacagttttatggaccataaggtccaggccgaggtggtctcagatggagaggaggagcttgttgggaactggagcaaaggtaactcttgttatgctttagcaaagacaccactggcattttgcccctgccctagagatctgtgaaacttttaaattgaaagagatgatttagggtatctggcagaagaaatttctaggtgtcaaagtgttcaagagaaagaagagcataaaaatttgaaaaatttgcagcctgatattgcagtgggaaagaaaaacccattttctgggtataaattcaagcctgctgcagaaatttgcataagtaacaaggagccaaatgctaatcaccaagacaaagcagaaaatgtctccagggcatgtcagagaactttgcagcagcccctcccatcacagggtcagaggcctcagaggcaaaaatggtttcctggcccagtccagggcccctctcctgtgtgccacctagggacttgctgccctacatcctagtcactctagctgtggctaaaaggggccaaggtacagctcgggccatggcttcagagggtgcaagccccaagccttggcagcttccatggggtgttgagcctacgggtgcacagaagtaaagaattgaggttcaggaactgctgcctagatttcagaggatgtatggaaatgcctggatgtccaggtagaggtgtcctgcaggcgcagaaccctcgtggggaacctctgctagggcagtgcagaagggaaatgtgtggtggaagcccctacattgtccccactggggcactgcctagtggagctgtgagaagaaggccaccatcctccagaccccacaatggtagacccactgacagcttgcactgtgtacctggaaaagctgcagacactcaacaccagcccctgaaagcggctaggagggctgctgtaccctgcaaagccacagggtcagagctgcccaagaatgagaacccacctattgtatcagtatgacctggatgtgagatatggagtcaaaggaaatcattttggagctttcagatttgactgcctcattggatttcagacttgcatggggcctgtagccccttcattttggccaatttctttcatttggaatgggcatatttacccaatgcccataagcccattttacctaacttgcttttgattttacaggctcataggcagaagggacttgcattgcctcagatgagactttggactgtggacttttgagttaatgctgaaatgagttaacactttggggcaatgttggttttgaaatatgagaacctgagttttgggaggggctggggtggaatgatatggtttagctgtgtcccgacccaaatctcaccttgaattgtaataatcccccatgtcaagggtggggccaggcagagataactgaatcatgggggccacttcccccatactgttctggtggtagtgaataagtctcacaagatctgacgtttttataatgggagttcccctgcacaagctctcttgcctgctgtcatgtaagaggtgactttgctcctccttcaccttctgacttgattatgaggcctcccggccatgtgaaactgtgagtcagttaaacctctttcctttataaattactcactcacaggtatgtctttattagctgtgtgagaacagactaatagagtaatctgattcttagatttctaggtatcaaatggtttttacaagtattgaaagttttcctccatgacacagactatccattttaagtattacaataaagactttcttgttaatcattcctcagttataatattgtttttataatttttgagtatgctaatatgtcaaaatgggtaatgttttttaaatttttttatctggaggatggtcattttatttaaactaagctatcctatctttgatttttgcatattaagtttcttatattatcttcaggtgaaaactaattaaagcaaaacagaaataaataattatctgccatgttccaggcactttggtatgtaaaaggtatgcaatatataaaatattatcttcaaagggttcacacaacaaataaatagtaagcttgtgtacattattggaaaaaaaaacttagaagaaacatccatgtctgactcatgaattaatgaagacactgtagagaagataaaatttgggctgaaaccaagaatacatggtatattcccaggcagaaaacaatctaagaaaggtatcaaaatatgtagaggcaaagcagcaagaaagagcataccatatttagaagacttcccaggcttctgcacagagtttatgaatgagagcagcaggaatttggaccttttatgtagacatattttggcctgtgaagcaggcatctttggtctgattcaataatttaaaattagatggggtatgtatgtgcatctttcaggagagaggatctattattttgaacactattagagaactttaagatgcacaaaatataaaaaacaacttgtgaagattacagacaaccattggtagtttttaaaatacagaatgatatgattaattttaaatagattttaaacagaaaatcttccatgaaatgaccatatatgcaaagtgacccccaaaattggaaggagccaagaaaccaaagaacatggcaaacaaatccagtttgttggtgatgggtgatttattggggaacttatgtaaagcatagtcttcggcagcagcaaaacaggtagatctctacactgttactcttcagaaccaaggcttactacagggaaagagtttatgtggtctatagagacaagtaaacagaacccttgagaacaggcaagaatgctatgtgtgtcaaaggccgtaatttgtgcaataacattaaggttgctttgatctaaagacagtatttatagtcagtacgtggtcttccactaaggacagtaaatgaatagaagtaaggaagcattgctgggactggcattaatcagaactcaacaaggtgggttagcacccaagatggagttacttttgtctctacagggaagttatatgatcagatataataatcaatctggagacaatataaagggttaataaaaggggagaagcacctgagtctgaaagaaaaattatcagacctgcagtattcccagttaaagatgaagaggacttgaactggtggggcagtaattaaaatggagacaagagagtggattcaagggatatagagatgagtgaatctgaatgatttgttcatgattgcaagggaaaagtatcaaatggaactcaaatattgggcttgggtaaccaaatgagtgaaaatgccatttactgtagtgggtgatgaaaggcaaaccaagttttggcatggagatgatggctttagtttagaaattgcttaatttaaggtgcctattgataacaggttgaaactgccaatcaagcaggaatgtataggaatctggaactcaggaaagtaatattgaatggatactagagacacggtagatttgtttagtcatcagtatttagatcagagtcaggaatagtaaataataattaactcatttccaccttcccatccatgcccatagtgagctttattcattgactgaaacttcttactgagcctaaattttatctggattcttaatattgctctgcatttattaatccgttttcagtcatataatttgacatttgatttaatcctttcctatatgcttgatatagaccataactgaaggcaagaatatgtggtataagaagaagaaaagcatacatatagaggcctagtcaaaaatataaaatgagtgcagaaaaaaacacaaaggagacttaagaagtatagttagagtagaaaaacggctgaaagagtagtgtcatgaaaattaaggaatcatgcatttcagaaataagcgagtagtggtcaatagtagatcaactactcagagagatccacttccttataaaagtctataattggccaggcgtggtggctcatgcctgtaatcccagcactttgggaggccaaggtggggggatcatgaggtcagaagatagagaccattctggccaacatggtgaaaccccatctctactaaaatacaaaaaattagccaggcgtggtggtgtgtgcctgtagtcctggctagtcaggaggctgaggcaggggactcacttaaacccaggaggtggagactgtagtgagccaagatcatgccactgcactccagcctggcgacagaacaagacttgcctccaaaaaaaaaagtctgtaattgccttcaaactaagatataatggataacacaacttacataatgtcaggaattgtagaaagagaaacaagattgctgtaggttaatatggaatccgagatgatgaaggattttggtacacatttaaaaaaattagctacgaaagaatgaaaaatgggtagtggtagctagagggaatgaaaggtatactttgaagaagagtttttcatttttaagattaaaaaattaatctatttaaatatttagagagatattcccatcaataaaaaatgtttacaagtgacgtgattggaactgagctttaagatttctggtattacagtggagaatgtatttgggtagagagatacttaatgtgaggaggccacctcggaggcaatcaaacaagggacaatgaggaaccaaattaggctgtggtcttgagaatgtaaagaagataaattcaaataatatttatggtatctttggcaggacttcacgacttactggatttagagtgtttgaaaaggatatatgttgttgataattctgattttggtggtaggggacagtggctctaattaatacaaggatgccttccttggaggggaagtttgacaaggaaataaataaaatctaatgaataagacacccaaatggagatgttcaaaagtttaggaatgtgagactagagatcaggattaaaaataaaatctgagatactcccggggtcatactttaagccacagtcgtggcaaaagggtggtagactgctgatcttgatacttcattttcactttctatcttatgttcttagctttgctcatcttttagacattttcttgctgttaggcacttatttctggtccatttggttttaattttcaatatactcattgccattttagcaacctcctggccctgctgctgcaaacccatgttctgtacaaataaagctctgctgtctctcattattgtctccctttcttatttcctaattctttcttttcttctttccttcctttcagttatctttggccctctgttttatatttaatttctcccaattgtccttactcttcaagttactagtagatgattcttgtcatcaccctcaccctcacctctccactaactccagattagtttattggatgtttataatcagaatctgcaaggatttgctgaggaaaagcattttgaaatagattattaaatgttttggggattggtatctttttagccttctaatatggtaagttgcttcttgttactaaagagttgataggtaagaaatttaggaaggaggacctttgaaaaataaatgtctgctccatggtgatttccaagttttagttttcataggtccaagaaataccagggaacactgcaatagcctttataacttcaaaaagaaaggtaaagaatgttgtatttttactcctgagtgaatatatatatatctgatatacattagaaaggcagtgtgaatgcaataatcttttcccatctaaaaagcaaaatatggatcttaacttcttatgcataaactagaaatttctggaattttaatgtgttcaagtgttatttcaatccaagcaactgatgattaaagaaaaacaaaatctgtcatgactcagtacttctattgatcaatacagcaagctgcctttgaagtttatatgctgaggtcttaaaagtgcaaatgaaataggtaccagatcactctaatacccagctaagacatatatattcattttcctctcttcttaagtagcatgataaaaaactatttgaagtatacaataaaaaattctgtgcagtgttgccctgctaattgctgtttgagtttgtggatcagaagacaagtcaatcttaatggccattattcagaactgtatgtgacaattctgcttataaggaaagtaacatatatttctatgcaagtaagctaaacaatattaaggcacaatacaatcagccaatatttgctaacctttcattaagaaaacgagcttaaattgaaagctaaatcagtaataatgattattagtgttgcaacttgcatttattacatgcctaacaagtgtcaagagttttacctaaatcatgcctattcttatgttaaatgagttctgttaccacagtgaggaaaaggcccgctcgggaaggtctaacatagaggacctctacaagaaaattgtttttctgacataaatttagtatatatcatagtcaatatgaatgaaattatttctctgataaaaaattatatatgggataggctaaagggcaaatgagttaggtctggctatgcttattttgagatagccaacagatattttaacaattcactagtaaaatgttctggctaaataaaagtgaaaatagataaaatttcttgaacaacatggttgggtcaggatatgtaattaatatgcttatggttaaattatagtttattgtgtatttcttattccacacggtactatcttaagaaacctctggggaggagtggtaggtaggtgaatgggattggatgctattaatggttgtttaacagtttgaaggtttgatgagctcaggttgaaatatttatatttacgagagaagaaaccattaatccatcctgaaaaaatagcttacaatcaataaccatgtgtatcctgtggttgtcactgatggaagtggaaagcttttaatatacataaaggttgacaattacaattgaatttcttgttctttattacatgatccataggaaaatattctcttaaagcaatgtaaattactatatcttggaattatttattaaaatatgacagctttgttgtacttttaaaaaatgaaagcaagagctagcaatctattccaaaataagcatttctcagaaatgttgcaatagtgtttgaaaaattttacaagttttatttggaactaaatatattctttctaattatcagaatttatcatttcaatatataaaatgtgaagtatgataaaaatgtattattaatcctaagtgaaaactgaaagcaactaattccccataactttctttaaaaaaaattttttttattttactttaagttctcagatacatgtgtagaacgtgtaggtttgttacataggtatacatgtaccatggtggtttgctgcacctatcaacctgtcatctaggttttaagccccgcatgcattaggtatttgttctaatgctctccctccctttgccccccaccccgcagcaggccccagtgcctgatgttcccctccctgtaaccatgtgttctcatttttcaacttccacttacgagtgagaacatgcggagtttagttttctgttcctgtgttggtttgctgagaatgatggcttccagcttcatccatgtccctgaaaaggacattaactcattctcttaccattgtattacttggtagaagatttatcaaactccacgactattagttaatttttatatgcctgaagaacaatattatttattttatctgctaaagataagccaagtttacatgagatataaatgtaatcaaaattaatatttagcaaacagatataaacatttaaagctgaaatatttcctgagtagttatttatctgagttgcttttgttttgttttgtttttcttaacagtaaagattgaagtaaaagatgaaggcttattgtgctttagaaagagattcagatccaattatttaatctcggcactttcttgcctactgtatcaaattaaatctatcttctcctcttaagtatattcacccattttatggtgctagttggtacctatttcatttcccttcttaagtatatttacccattttatggtactggttggcacctatttcatttggacatctaaacccattcatagttgggatggtggaaaaatgaatccaagtcccaaatctttcaataaggaaaggatccactaaagttttcctttcaaataccaaaggatttaaaatggtacagttaaacccattgtaacaacacagtctacaatttggagttttaaaagtaaagattattacagaatgataatacctatcgacttggaaaataaaagagactacagaaacaaaccgagaacaggcatccattctattttacctttgaaatttgactcttttgttttgatctggtttgtttctggaaaggagaagtgtattaaatctgaaagatcctgaagctcactcacatactagtgtaacttatagaaagtgcagtggacagggaatttgggagtcctcaaatccaaaccactaattttagatgagttattggaagcttagaaagggtaaatcattccctcaatgctttaaaattggtgtaaaagactcaagcctggaactaattatttgatgttttttcagtcacaacatgctatttgaaggaaatcacaccaaaagcattttctaaattgaaatttttgggggataatttattaacttgagttaatagcaggtctatatctgaaatcaagttgatattctcatgaaaaaatgtaattagaactgtatgttgtagacatttcccttaatgtattagggttttaaatagataaaacctactaatttttaaatttcatgaagacttctatctataatattgacagcttaatttagcatattatttaaataatttattattacttgcaatgtatgtctttatttgtgtcttgattttcaaccaagaaccttacattgtatggcctcaggcaagagaggttttctgggtgtctttgtcatctcaattgtaagtggattgattttgacaatgtgatcctgtagattcatttcagtcacaacagtctgtcagtgcctgggatttttactgggctttttaaatgacactcactagtcatcctagttttattgattttaccccagaatgttaatcaaatggtatcccttctttctaactttcttgctctttttttcttctttcccttctctctccttcacctttaccttttgccagtcttctcaccttcattctcactcttgggacttaagacctcaaacaatagtaaaagaggtaaaattacttagttcagcttatttccatacataggtcagacttgaaatacctgtgtttcacagaaactaagttctttcagataaatggagcttggtgggaatagatgtcccgaaatgtttatcataaaagcacacaactgatgaaatactaaaatgagatcaaaccacgaagaaaaatgaagaaaaatgcattgaaaagcacatagctgttttagtattgttaacatgggaatagaagatgatatatatagttatgttagtactttcatttatgtagatttttttttgtaattttatttttattatttgtgcagctgcattataagtgccttgtattgccatgcctgcatagaatggtattgctgacacatcattagtaataagagattttcattccttaagacaaagactttaatgatctttctgaaatcatagttagaaagttaatatttgaaatgcattacatgttttaacaaacagaatgtgggctacagatttttttttctttttttatgtatctacagctcacagaaaaactaaatgtacctccctgggttgtgatttgttaggatgaactaaaaaatattactgtcccttggaggacgttaggaacctacaatgaatttgaaacataccatgcacttcttacaggataagtagattcattcagaaattaactgaaagccgaaagtagctgttctgccaaatatgacccgaatctccactgaagtcagaggtgatgttagtgaataattatgatcttgattcttagattgccagcgaattcctctcacaattagtttgaccagatatgttcagaatcccaggccctgaaagctagaagtgatactaacaatgagattagcagcaaaaggaaggcagcgtggtaaggtggaagcacactgatctgagagttaaaagctttggtcccggtgttggtttcacagtgtttgcaactaaaaatctgtgaacaaaatcactcattaataaagaaacaaaactaattttgttcattcctaactaaagttgtttgaagactttcaaatttccttccgtaagtaaaattctgggtctaaagccacaattttcaaagtttgaacacctgatttcccttttcatcaacttattaggagagattttaatatgtagagcaaagaacagtgaagatactcagtgaaagcagaaagaggggacaaaggcccacacttccactgtgacccccatcctcagtccagagcagggtcttcagagcaagtctgcagagttggacaatactgagaagccctaattttggacaagataaaatattagcaattataaacagataagactactatatcccatttgaaaatacacaaggaggaaaatgccacaaactctccgcatttaataggattatggacccagcaaagtttccccacttgtacaaaccaccctgtggccatgcgctcacatgcttccattgtgtggatatgcttctgggccaccctgaaaatatttatatatccactgccaccatggaaaaatcatagatttgcttttcacgttttaaaaataggaaatttcaaataagtcagtttctaaagattacatctactacgtttacttatgtgaaaacaaatgtaagcaggaagcaaaacgcaaatagggaggaacatgaccaggatggagttaataacgtgagaggcacgtttgcttattgaatttgcattcacatgctcagtagagcccattcttaattggtatcgttagtgattataaagtcacaacatgttcactagtgtcttaagagacctggttgcagaaaagagaccattgcctgtctgatgaatctattcctttcactttgttttcctgtttataaaaaatatgtattttttagctttcaaaggttaaacgtatgtggtataaaaatgcaagcaacacagataaagcaaaaatgtactctcctttactcccaataactactagtaagtagtggttaacaggattgaccactgttaacctctaattctaacccctgtcaacctccagttgtaaactttggggagagagaaagaggtatataaatagagaaaacctatgcaaacataaaatcacacactttttatttgcatacatgggagtatttagcatcgctttctctttttaactcaatgctatgctatggtcatccttccttctgtgtcagtgtgagtgaaaaaaacacaaactttacaccacaacaatcagcattgaagacttctgtgacttaatgtgcagagatttctccccaccagcaagcaagaagtctattctgctgcagacaccagctagctgtcttccaattcagttctgacactctacctggagatagcgtcagatcccacaggttgagactcagtcccagaaaactgcacccccttcagacaccagttgcatgtccaggcctctggaacttctgacagacctgctttcagttgggttctcataacccctctttgggttagattaacctgctaggacagttcagggaaatacttacatttaccagtttattataaaaagaatattacaaagaatacagatgaagagatgcaaaaggcagggtgtgggggaaggagcacagagcttcggtgccctcgctgagtgtgctgctctctgggaatcttcatgagttcagctgcctagaggctcttcataccgtgtcctcttcggtcttttatggagacttcattggctagttacgattgaagcaatgaacaattatgcataaatgtgattggacaaaagggtgtgatctaatgctaatagactgagtgggggaaacccagcaaggcctgtgcagattctttttggcttttcaatgcagcattccttcctcccagttatggggccagacctatattcagaaaagttaagtcagagaatacctatggtcagctccaagacagaaaagcgggaggaaattagagtcacgccttgggcaggtgcaaggaggatgggagaagatcagagagggattctgctttctgaggcctaaagtgccccaacattataacaaaagcctgtattaagggttatgggagtcataagctaggaaccatgggaaaaaaaaccatttatacatataatatcacagtcagtatgtatgaaaattttgtaagaaaaacctgcatagctgactaaactctttagtaaacagaaaaattttccttcagttagtgcatcaaatcaagcaggatagcaaatgttcttaatcatacttctccaataaagtaggttaagatttctcatatatttacaaaaatgaaatgtaaccagtccttgaacactcttaaactagtaggtggaaacatctttttttttattccaatcattgccttcgtgctgtgtctgatatctattgcctgtcccttaaaagcatctcaggcaggtctcatagattctcatgcattttcagatattaatattctcattagttcagtttaaaacttcagtcacttatccaatttaccatgtatcattcccatcgactttcctccccagtacaggtgcctaggctgggaatagggcatgacctgcttttctatgctttcactacacttctgccctcttccttgctattctgggatttcttcttctccagtgtattggtgaccttagaggaaagatggggtaaaagaggtaaactcctcttacttaattggtggtattgtgattttctcactattgattcttgaaatttctccaattgtacactctgggtggccggtttccccatgctggctctttgacagagtatctgttgtttccttaaaggatctttcaatagcctcatgatggcaaaatcaattttcaatgcagaaaatctaccctagctcggtgtcttttaaccttttatctccttcctcaacttcaagggcactaaggcccatcagcaagtttgctacaaaaatgccctattgaataagttgccgggctctctttgtgattatctcagatctctgcaagggattctcttgacattcccgggggtagaagattgggaaaagggcacaaactaggttaaggctgaaggtccacacctttcagtttttgcttatacaggccagaatgggagggctaggatgaaaatttagggagcacgggtggattggctgccagaggccaccctctttttagaatatgaagtgctttctgcttgtctttgtttcctagcagtcaattctagacaactggaaaattcttcctcaacatccattacatacacagaaactaaagaaagtcacagagagatttaccttaccttttaaatcagaataaattattaatggaaaatgagcaaaccattcaggactttgggtttagcactttgtgtttggtcctctaaactaatttccactaaacattactcctataagttttgcaagataaaaatgtttagacgttttcttggattggaaaatgtgctctgaggtgcagagggcttatttggaagtgctctgaaagacacaccagcaaagaagctagaggagttaagatccaggaaagggcagagggagcagctgcaatgatgttgcaaataaagcctgggctcctcctacaaaggagctcaggagcaggcatagcccttcagagttgtgccaaattgagacaatctagaggctggggcctttctatccataccttatcagccagtcagtagctgaatcctgtcccctgaaaagggttcagcctacgatgaggaagttctcttaggacaagggcaatgcccagtgagactgctgtgagccctcaacagctaatatttccagcagctggggtggtgcctctgcctaaagaggatatacagaaagcaccactgcaatatccattacagaaaatatgaattcattctaatattctactaggataagttgtttctgtttgaacatacgttaaccaaggattctatctcataagtgcctggtgcctagtatcaatattcaatttaaataaagaggccttgcttcagttcttctaagtgtaaaaatctctaatgtgtaattgttaatatactaattatgtaagttttttatataataaatgattgatttttggccagaagtagtaatgtgcattacacattcttttcattatattattattaatgatgattcctagaacttatattccaggaagaactgtatttctcttgtagatgatgaagtaggtacatccacatttgtaagatctttggtgcatcccagatcaacaagtcttgcatcttgggtttgtaaactaatcgataaagccatccaaccctcccagacacatggccacaaagtgacaagaatccagagataaaggtaccgattttttctaaaaggatattacaaaaagcaaatgagcaggtattacttctagatataaatagttacaatgtcagagaaggtagtgaatgcactttaaaaaaagagcaatttttttaggatagtggcacaaaaagaaaatctcataaagctgcagaaacttacaattttggaagcaattgacatgtgtaaaattattcatggatcaaaagttgctaagagcctaaactcttttctagtttctagagaatcaacatattgaagacatgacttaaattgtaaggacttagcagatgaatagaattggcaaaggattaattttccaaagtgtcgaatctccagatataaattacactgcactggcactttgttcaccaaatgcattggagaaaagatattatcctgctaggtgtccttgcttttgcctcagaaatgaacatttagagtaatgtctaatcctttttatattgatattatagtaagaaatggaaaaatgtgcaggatatattatcattaactcttatttgcttatatctcttcttattcaaaacattttattttcctattaaaataaaaacatttttagaaactcagagaattgatgggtcaagttaaaatgttcttatgacaagatgggtgaatctttttcctagtacgctgcacctaagaggctcagtatcaagaaagaaaaatcaacaaagaggatttggttcatgagtaaaaaatacaataaggaggaataacatctagtgttcagtagcacagtagggtgactagagttaacttttttttgtatatttgaaaataagtggaaagtagaatgtttctaatacaaataaatgatacatgtttaaggtaatgtatatcttgactaccctgatttgatcattacacatttgtacgcttgcagcttgttttaaaatatcacatgtatcccataaatgtgcacacctattatgtatccataacaattaaaaatttaagaaagaaaaatcaacatagtcataaatactcattaaatttcttagctctcataactacatgtatgtctgcatgacacagaaatgaacatcaacacatagacacagatgattgatggatccatggttaggatcagtgtaatcagtgtaaattaagcaaactgtatgatataaccgcatttctcattactatatgcaataatttgcctagtcacagtttatacactgagtgtccaagagtcactagtttaattaagtaattttatgatctgatattcacaaactttataaaaataaatgaaagttgaaaagagggacattgatgagatttgtaaaagtcataagatacagttaagaaaagggaaagctaagaggaatttcaagtaatacttcttaatgcaattgtgatatcctggaagagtttctaaaagttggtagcaaatgtgctattagagagaataaagttcaataaggtgactcattctactcagcaccttctggaacttgaagattcaggtggactgggaaagcatcattatatatttattctctctaatagcacatctagaattcagcaccttctggattcaaagattcaggtggactgggaaagcatcattatatattaaatgtgttgtgttgctttatttttctctattggtagctatggaaggttaaaagcaccttcagtccattaggagtgggactctaattgaaacaaatttaagaaagccaggcacggttgcatgtgcttatagtcccagctgctctggaggataaggtgggagaatctctagcttaggggattaaggccagcatgggcaacataacatctctttaaaaaataaaataaaataaggagactactgctgggctcttgagatggtagatgtcaggagtgtttcctacaactagagaaggtgaactcaagttagcattgttccaaagcttgtcagaaccctggactgtggtcttttctcaagttttaattgtaattttcatatcaatgcatcaagtacctcttaaggttccaccatattgcaagtcattgaatcaaagtctgtgtctggagtgtgcagtgtaggaaagaatattctctttgcttttaaaaacattttggagggactagtttagacatttggtactgattcagtgtttctaaataacttccttagagtatattaaagacaggatgggaaagatgtctagtattgtgtaaagcagggtgctctcattgttttgaacacataagattgtctatatcacaatcattggcactcctgtgaactttactagggtgattgagttaggttacaataaaaatcattcttcattaacttatatactattttaacataaactggaaaggaaaggaaatctggttaattttcttaagttataggcccctaaaatgtacatatttcttagtgctcagggaaatactagagcaaaatattctttcatttattttgatcatcagactactaggttattcacatcttgtgaaacttttagttgaagaattttctaaaattctgctcatgcttgtattcaatatatttataataactccaccaaatatgcctaatttgtagacccatttgttgtaatacttgtaaatagtttttttacttttcctgtaactttcttggctaatgaagtttgctggttggatttgttctgatcatccttaaatccttccatgctgacagttttaattaaaagaaaaatttccaatcatttctctaatgccagagaaatgctaagtataaatcatttctattcagaatttcaataccatgtcttctgctaaagcctcatgaaatagttttggcatgtgtggaatatttcatagattgtataataaatgtgagcaatactttacttcttttaaaaaatgctattagaggacctaaacagattacaaatgtagtattcttgatgttttgctattttagtctcattatgggtttaattaggtcttctaattttgaaattttgtcaaactttgtcacactttgcctcagctactgattttttttttaaatcttgtttggggagttttatgtctgttggtgacatttactcaaaatcatcttcagagagatgaaacaaatggtggattttcattttagcagcatttttatcatctcccaataaattattcttgataattattaaagtaaggatggcctcttgacagacttttgggtgttaattgccctggaaaaatatcttagctttattatgtatccctcttctatcatttaacttaaaaaaaattttccctgtactcttgccatttgttttctttacttcaacttatctgtctttgtcttaaatctcctcagtttaactgagaatctgaataccccatgaaagaattatgcatttctggacctgatgaggaagttatgctgacactaagatgacagaatcataacactaagtacagaaacaagagtgcagccattcaggggaacacatagtttagttctctttgatcaaagccagaccctaaaattaaaaggccaaccattgcctctcattttcagaccccaagaaaaagagattccaaagtctgctgagtaaacaagtctgggtgttatgcttaaccaagaggcacaagtgaacatttctccctttagaatttattcttatttattttaattatatgtatttaacacagaattataatcagaatgctttgcttctttactttcagcagtggtggattatccaggtggtttctgggctataggtcctatttaggcctatgtgccccactgagataggatgcaaagataaagttgcggtctctcctaccagtccctagaaggaagtaataagcctcagtaaacccattttacaaataggaaaactatagtccagagaatttatgtgacttgctggaaattatgaaaataatacatacaagagcacatatttaaattagtttctaacttcaagctcacttctatttccaatagtagcccattattttagcatgttccatttcgacattcaaatttggagaaaacgcaaatgctggtttcatacctagttgttctccaaagacatagggacacattttatcagctaacagattaagagaagtctagctacctgtgcattcagtaacagagcatttcaagactttaaaaacatgtagagaacctctatcatatgtcactggtgatggggtgatttttattagttgtttgtttatgcttcccgaagtatggcaatctaattatgccattatctttgctacaaatgttttcattacttagaaaatcattctgctctttttgaatctcaggtacttttatttgcttttcatgacctccagtaactgcgagtgctaaaatgttattatacatgctgggaaaataaatatgtccattcattttaaatttcctgccctttaatttcattgaatttgtcccctcaatcttttattatgcatcaggatataagggcagagcaaattcatttttattctgccctttgttattttgaaaaaccaatgtcaactctttttaatttccattattctggattgttaattctatacttttcacatttaattttacaagtctaattagtatcatccagatcatcaggcagagaaattagtagccataaattaagccacagttttaaaaatgggtttaaaaaaatacgttgaaagatgacttgatctaatatgttacactttcactgtgggatttgtggaagagccatctggcttgtggtcctcctgcccttgaattgaaatctgggttaattgaggcaaagctgagcttgctcttttgtgaaatatgtggaaggctactgctcttttaattgagaaaatcatcaatactgtcttgacatttggatatattcccattttgtttaaaatgtcagctatttgctctcatatttagttgtctcttgccctataaggtttttaatttaaatttccacccaaaatggcatccatctctaatgttgtaagaaatgcactattttcattgcagtcttgttccaaaattcaagagcccaactcaaatgaagaaattttaaagatatgtttcttctttgaaatatctttaaaataagagataaaaagcatttgaataatgacattttgcaacactccaagagttctgaaggataaggtttataattagaatgaagtttttttctaacctgagagagcctactccctttatcccccaatacatatttcaatgtatccaatcatttattcatttccttgtccatctcttacaatagattgtgagttctttgaaggcaaactgcctattatttgtttatcagtaaatctatagcccctagcccaatttatgggctcaataaatgtttgttatgagaataaatacttagccagcatggcaagaatgtagcaaaagtagatgaccttttgatttaaaatgtttcatccatgatattcaatgaataccttgaagtataatgactgccttatccattgttagaagtgttgaacttgaagctgtgaagactttttgggtgcttgtgggttctcaagcagctaattgcttcttttataaaccataattactttaaaaccaaggatgagaaatgaggacattaaaggaagcttcagctaggaattactttaatctgtaattatcccggtgtgtctccctgcctctcctggactgtgagccacataagagcaggcagcgtataggatttcatctcaaaggctgtagcacctaccacaggacctaacacaaataagtgttttataattcaatatttcttgggcatttcatgaagtcaaaaatggttggaataagtattttcactgaaataatctaaccgtggcaatcctgcctgccttccttttagcacctttgcatctgttttcccattgattactttaaaatccccattccccctttattctttccctaagaaactcatacagctgccttgctacttatataaacttttggataaatagcagtgcttaagcatcacacactggggcctgtcatggggtggggactaggggaagaataccattaggagaaatacctaatgtagatgacaggttgatgggtgcagcaaaccaccatgtcacgtgtataccaatgtaacaaacctgcacgttctgcacatgtatcccagaacttaaagtataataaaaattaaaaaagagttttgctaagtcataaataaagcattctatttgcaaggtaagtggctaatggaaggaacctcttttatattcctagtatcataattttacatagtgatacctttctgcaagctcccagtgctttggcagctgttatttatgcttacaacaaacatccagtgaagagccaggatataccatgtcatattgctttcatactataaaagaataacctgagctctggatggctaagtgattcacaggcttgcagttcatccctggactttgggggccctccttgcaaattccttggtgcagccatttagaggcaataaaaacattggcatggctgctcagaaaatactatgctgaagtcttataaacaaatcacttaatatggttattatccatatggacttaatattttaacaactattacttgaaatggaaataagcagaatatgtaggaataccataagtacattttccttctaaattctgactttaatatatatttctataagtaattctgtaatctttagtaaatgaagttctgcaatactcgaaacatagccagatatctaatgataaaatagttttgcatatagagccacaaaataattccaaccaaaagataagaacaaagacatattgcactaaaaaactttgtaaaccagatttagtagaatatacctttttgcttattaagatgaaaatgtttatttaataagaaaattatagagcattacacttgaaggtgatgatttaaaaaataactctagccttaattagtaagtatcaatgactggctaaaaagataataaaatagattataactttttttcaaataattagatttataggaagttgaagaactagtccaaagatgccctgtacccttcacccagttttccctaatcgttatattctatttaactatagcgcaatatccaaaatgagaaattgacattggcaaaatgtgttgtgtagttctatgccattttatcaagatgcagaatgattccaccatgataaaaatatttgtgctaccaccttatagttatacccaccctcatcatccctaccatcctttaaactctagcaatcattaatttattcttcatatctataactgtgtcatttctagactattattgaaacaatttgtttaaatattcacccaatatttaattaaatattgtaggacatttcagttggttctaatttgaggctgttacaaatgaagttgctgtgaacaattatgtagagatttttgtgtgagcatagttcctatttctcaggaataaagactcagcagtgtaattggcatatcatatggtcagtaggcttttctttgagttgtgttatttaagaaactgccaaattactttcccaagtggctgtacaattttacatcctcaccagctctgaatgagagagccagtttctccacatcctcaccagcatttggtatgggcatatatttattttaattttagctgttccaataattatgtagtgatatctcattgtagccttaatttgcatttccctaatggctagtgatactgaaaatgtttttcatgtgcttatttgccatctgcatatcctcttcagtgaaatgtcttcataacttttcctcatttctgaattgtattgtctggttttatattattaacttttggattgtttaaatataataaatataagttagctgccaggtatgtggtttacaaatattttctcccattctgaagcttatcttttcatacttttagtagggactttcacagaataaaagtaatcgattttgattaaatccagtttatcagtttttttgtcttatgaattacgtttttggtgtcatctaagaacactgccaactactcattctcaaacattctgtcctacaaaatcttagaaaagttttataaatttggaaaagttttaaagttggtttagctgtttttcatttaaatctcatccattttgaattaatttttgcataagatatacagtttaggtcaaggctcatttactgcatgtggatatttaattgttcccatagtatttgttgaaaagactactctttccccccacttaatcacttttgtacctttctcaaaaattaggcatgttcgtgtggggcatttctgggtttattagtatgttccatttttctatatgtcagtctctctgccgaaaccacactatcttgattacaatggctatatattaaaacttaatattggtacagtaatttctctcactttcttcttttgaaagattgatttagctgtttcaattcttttaattttttctttttttttttttttttttctgagacggagtctcgctctgtcacccaggctggagttcagtggcacaatctcggctcactgcaagctccacctcctgggtacatgccattctcctgcctcagcctcccgaggagctgggactacaggcgcctgccaccacactcggctaattttgtttttgtatttttaatggtgacggggttacaccgtgttagccaggatggtctcgatctcctgacctcgtgatccacccgcctcagcctcccaaagtgctgggattacaggcatgagtcactgcaccaggccttcttctaactttctgtaaaaattgtacagtaattttatctatatttgtaaacagtcttggtgggatttaaatggcaatttctttaaaactgtatcccaatttgaggataattggcatctttactacgatgagtcttttaatccatgaacatggtatgtctcttcattcatttagatcatctttgatttctttcataagtgttttgtagtttttaccatacaaattctatacatttttctagatttatacctaagtatctgaggcctttttttagcaattgtaaatgttattctatttttaatttctgtgcttattgctagtatataggaataaaatataatgatgtcatagtctgtgatcttaactcatttaatatttctaatttttttgtgaatttcttctgaattcagtatagaaaattataagtagattcaactgaattcctttttttctgatctgtcttttaattacttttcttgcatgattgtgctggctagaaattctagtactgtgtttaataggagcagtgggaccaaacattcttgctttatttacagtcttatggggaaagcattcagtcttttaccattaagtagaattttagttggtatgttttggaagttttttttttatcacattgaggaaattcacctatatttgtatttttctgagattcttaaatcatgaattagtgctgaattttttcaaatgttttttctacatcaaatgatataatcatgcaatttttttcttccttagcctattattattaaatgaacttttcatcccttgaataaacactacttggtcatagtgtatttaatatgtatacattgctgaatttccttggttaatattttgttaaggatttttgcatctatgatcatgacagatatttctatgtaattctcttcttgtcttgtacaactttacatatataaatttaacaatttaaatacaaggggccaattctttaaaggcataaagagccaattcatgaaaaatgaaattaatgatttgaatagcctcatcactcttaaataaatttaatttattatttaaaagcttccataaggaaattttcaggctcagacaattgcactggagaattgcaccaaaggttcaatgtagatttaacactgattctacaaaatttcttccagaaaatagaagaggagaaaacactttgcaattcatattatattgctagtggggatgtaaaatggttcaaatactatggaaaacagtttagcagtttcttttaatgacatactctgtgacccagcaataccacttctaggtatttacccaagagatgttgaaaaaacatgtccacagaaagtcttatatatgaatgtcaaaagcagacttacaactcataataactaaaaaaacaggaaaaaaattgtaatacccatcaactgatgaatgagtaaacaggttagatgtattcataaaaaataatacaataaaagacaataagctactggcacatgcaataatattggtcaatatcagaaacattatgtggagtgatagaagccagatactgtatattttacggttccatctatatgaagttctagcaaagggaaaactaagctatattgacataatcagaacagtggtcttctcaggttatggtgattattaggggtgttagaaatgttttatgtcctaatgtgggtgctgattatatgggtttatataattgttaaaacccaatagcacccttaaaatttatgcattttatcacttgtaaattatacttcaatgtaaaaagcaatacttttactagcatatgtctcaatgtttttattttattttgatgattaatatgtggaattgaattctcttttaagaaagttttattgaattagagtttatatatttttggttacagtctttgattttattctttggtgactcctgtttctgtgtgtgtgtatgtatatgatattttttcaaatttttttacttcttttgttatttttattttatcctttatacctttctatttttgtttgtttatataaattttaattccttctgaaggattttttttttcgtctaaccatcaaatttctgagcttttctgttctttcaaagctcttttttttttcatttattttagctcattttaaagtattagaatgcactttttacttttgtggccacttttttatggtgattttactttcatctttatctttctagtttttaaaaaaatataattttcaggacttttagtaagagattcctgtggtgaatgcagagatgaaccaaaatgtctttcacagcttcctcactccagggttgcctcccctcctgttaccatgaacacctcaaattatagcctttctgtgtagccatgtctctgcctctcagagctaagcccaattcaaaaggttatctcctcaattctatttttcaagacaatgcttcatctttagatttgcagttacaggactttgccagatctgctctctggatgcatttcctctactatttactcacccttacctccagggttctagctctgctcatttttgttttacttctagcagtgttccttcagggtactgctctatacttctagatagttctgagatcctggagatagacttgccagataaaatatagatgcctggtataattagattttctggtaaacaataattgtttaatgtaaatatgtcacatacaatatttttgtttcttaacttgagtaattctaccaggagggcataggtaaccatagcagtgttcatctttccccattcttccctctcccagctccccttagtgaccttagccacttagtttttgtacccatatatgattttcctatgtttttgacctttccaagaaactgagatccagcgttctgatcaatgtgagattcttgccaataggagtgagttttatttacaattgagcagttctgttgctcatgaggttcctcagactatttttttttttcattttctgtcactttcattgcttggctgtattagtggtttggccacacccacccatattctgagttttttatagaacattcctagtcaacaaatttttctggaaacatatttttcttttcttgccatagttgacatgtgtagtttctaaaggaattttggagggattaaaaactacatagctacatctcaagtgtgagccagaagtagtaggagccatagcttttaaaattatatcttctattttttctttgtgtataggaacaaaactgatttgatatatgtatcatctttcattgttgaactcttaattagctctaatcatttgtctgccaattctcatgtaaataatcatataatctataaataataaaagtataatttctttcttcccaactttttaatttgcttttcatattttcttttgctacctaaggcatctaatagaatagtgaagagaagaggtgatagcaaacattttagtcttgtgtctatttactcaattttataatggggataataatagtatctactaaacagagttgttagagaattgaaagaggcaatcataaaattatgtaagcagcatttagtacacattgaactagtaataaatgatagccattatttttttaaatgtcaataaaattattttgtgttatacttatagaggtataaagtggttgaaataaattaaagaccttgggaaatagcaattagaatatgtatgtggatgcactcacaaataagcatattactctgggccacattacattaagaagaaaatatgatcggaattaagagtagatatgtagtaatttcttgaatgaatcatggttttccatattctctttaaaaataaagaggctagtcacattcaaatttcaagtatttagataaacattcagaataagtactttgtaaaacattggattatcatcgcttcctttacagtggtggaaactttatagttgtaagtgtacacagggaattaaagaacaggaaaggaacaaaacaatctaaatggaaagaaagatccagctgcagaagccagaagtgaaagcatggatatattatttagtaacagcctggatgtactatactgcaggtaccagctttatagagatcatcgtacagatattattaatatattactggacatttggaatataaacctttaaaacctgtgtgatgtttaaatatctgtgatgtatttgtttattttacaaatagagtattttctatattgatcctggcttataaattttcacatataatttagccctgttcttgcttatttcttattctactactacagtttatgcttatggtgattcatcaaagtgttctgtggaatctcattttgtgttggagaaattcaggggtctttctctttgctataatctgtagtgatttccacacatgtatcagctaccctgggatacagactctgagatggagatttacatgcagcaagcttactgagctgtgctctcaagaacaaaatcaggattgagcagacaaaatattgtaaaagcaaagcagttgcaacacaagcactatttggtgttatagggctctctaaagccatgggggcctttcatatatgcccaaaactgagcatatacatccaaaattacaggaatggtaagcaggcgtttgtactccccgtggagctgtcattggatgtaggctacctaaaggaaggggacatgccattgaatgaagaaacttcctttggccaggtatttaaaaataagccatactggaagaataagagcttaatcctaaaggggagatgtgactggcacaccacaggattctcttttgtccataatttacactccgtggacccacttgcttcagataataatgtcatcccttctggaaacaacccctccacattagtggttggtttcttttccaaggtgaatatacaagattagagagtaaaaccacagccccactgctgcagatggttgtgagaaaactgacacatattgtctctgtcctctactatccttccaatctttattctccaaacactcatctagcacctctaccagtctggccagcttacctagtgggatgatccagaccctcaatcccaaggggtctatgccactgttcagcatgcctgtcaagttgtggcaactgctctgatgcactgccatcaaaacttggtaaagaattagcaagcgatgcctcattatctcatctgggtgccaaacatattcttttctggacccaatgatgatcaggatctattacttctgccaggagagtgacttcttttctttgttcctgatctcttagatcaaagaatttaaagtaactgggtggcagctatggtttaaatgtaatggaattctggctttattccctaatggaagcacttttctcagcaatgtaggacccccagatccacagagcctaatttgtggaaatgagaaacacaaattcccccaagattgtcgctgggagtgatgagcagaactactcctgggtccactgctccacccctggatccacacattctacctattggagacatagcaccatgtaaccatcattcatataagacaattactgcatcacagagaagacacctacacttgcacagtatcatctccaagttagcacctcatctgcatcttcaaaagccagattggtctgtcagactggcagcatctaggtgctatgtgaccaatgggtatctgctgacttccctcctttctttactataaagtatgtctctagtagcaatacagtattttctaagatcgtatgttgttggaacaaacattctatatggcctcagtgactggttcttctaaagcttataagcagaaaaggtaatccatactcagaatatttccaattttgcccagatgaatctttccgacttcaaggatgcaagggatccaatgtaatcatctgttactgactggctgttggtcttatcaagaagtagcaccattttggggattgagcattgctctgttgctggcagattagttattcagctgtggctaaatgtgccatcccaattcaccatcagtgtgcatattaagagtttcagtgttactgaatgccaagaactattatcacaccatctatttcaagtggtgaggtcctcattgccagctatcatgaagtgatctagtgtctcttttcctggacaacttctgattttaatggttgtttgttcagtacctcggtaatagactctgagatggagatttgcatacaagcaatttattagagtgtgtttccaggaacaattgtaatggaatgagagaagcatgactggtcagaaggaaaagatttgctgcaattcagtagcaatagaagctgatcccatgtagagcactgaagctgggctagtctttcatgaatgtccagaattgagacaaggacctggtagccttgtacctccacatcaaccagtcatgacatgaaggctgcacctgaaggagtgcataaccatgagacaccttactttggctaagggtaattcctgagcaagaacttgactgtgagctgtcaacaaataatatttccagcagctggaggaataattagcatctcagtcctaaaggaacacatgggatgttcccttacagtagaggtccccaaccccggggctatggactggtactggtctgtggcttgttagaaattgggccacacagcaacaggtgaacggcaggcaagagaacattactgcctgagttcctgagctctgcctcctgtcagatcagcagtagcattagattctcacaggagcgccaaccctattgtgaattgtgcatgcaagagatctaggttgcgtgctccttatgagaatctaagtaatggctgatgatctgaggcggaacagtttcatcccgaaaccatccccacacccatctgtccatggaaaaattatcttccacgaaattggtccctggtgccaaaaaggttgggaccgctgccctacagcatctactacaatctgagttctagaatgcgttaattgaattatgcttctttcaagtacatatttggcaccccaaagttttataggaaagataagtttgtactgaaataaactgatgatactttttttcaatttagagttaggatctactgtaaaacaaaaatcggccgggcacagtggctcacgcctataatcccagcactttgggaggatgaggcaggcgtatcacgaggtcaggagatcgagaccatcctggctaacacggtgaaaccctgtctctactaaatatacaaaaaaaaaaaaaaaaaaaaaaaaaaaaaaaaaactagctgggcgtggtggcggatgcctgtagtcccaactacacgggaggccgaggcaggagaatggcgtgaacctgcgaggcagaccttgcagtgagccaagatcatgccactgcactccagcctgggtgacagagcgagactccgtctcaaaaaaaaaaaaaaaaaaaaaatcatttccctgtgaagatgacactattaaagtaccaataataaatagggctcaggattttacaagttgtttggctgaattttcatcattcctcacatttgcttaccttgtaacaccttgtggccctgcatttgcaagatgtgtctctgctgagacttacgttctatagacaaagagcaggaaaaacactaagaagcctcatacatagaaattcaatccaaaaccatgacctcattagtagagtattctaaatacctgtgcatagaattatgaatttgataaagatacaatggttatttctggagccaaatgataaaacttgatttttatgctgatttagacaaaactcaattttacccttgagtaggagaaaacatttttcagaggaagatagtttttaaacttttcagcattgaatcatatgtttaagctgtgaattagtaaatttggccctagggtgatttaaaaaactaaacaatctaaagattggaagaagctaatatatatagttttaaagacaaaatggataaggatataggcttaccttctgaatcaaggccttagtttttaagtgcaaactttgaactgcaaataaaatacctgtcaacgaagtatgttcttgaaaatccacttggcatttttctcaagttcatgcatatatatgtgtgtgtgtgtatatacacacacacacacacacagagagagagagagagaaagagaaagagagagagtgtatatattcttcatggatagtgaaacataactatccattgttggtgcttgcagagcactcttacttggccttctttcatcttttggaatgattactacacacgacactctaattcaaagagtattttagtactaaatgtttatttaaatttgtacatttttggcattattttaacatatcctctaaggccctatctactgacaccctatctactgaatttgatcaacacatttgatcaagtagcataagtcttgcaaataatgtgtctacttgatggccattagagggccttatttttttttctcatgatatattcgttaagaaattataactacaccctttattaaagaattcttgtataatgatacaaaaagtaatcccagtgctgatacttttgtttgatgtcactctacaatcattatttccaataaaaatgattgactgtctaagtggctgacataaggaatgagacattctgtttgttgctatcaccactgttggacttgcccatgggcactgcagctaagacttgttatatgagaaaagtatacttctccagaaaaaaataacaataaaatccctttgcactcatccaggaatgttagtttcaaaagtagatagaactagaaatatcagtagatttcagattatacaggtaggttcacaatggagttaagacttaaactcaggtctccaaacttctatatatgtcttcctattaaataactaatttaaataaatattattaacaattgaattctagaaatctgcctagaaaaattaatatatttaaatgtctcaggattcaaaagaaaatgcatataccaaaagtcagtgtgaaagattctattaaatccagtccactcaatatagaatatatgtatagcacttggccctcgtggcaaattacttgacactaataaatcttttctttttaatcaaaaacctcaatattaacatattcatttcctgttgctaaataacaaagtaccacaaacccagaggcttaaattaacaaccatttactatctcacagttctaggggccatcattctgcctaccacacttaaaatagggaataaaaaataaatgaacttaggctgggtgcagtgtctcatgcctgtaatcacaaactgggaagccaaagcggggggatcacctgaggtcaggagttggagaccagcctggccaacatgatgaaaaccaatctctactaaaaatacaaaaattagctgggcgtggtggtgggtgctggtaatcccagctactcaggaggctgaggcagaagaatcacttgaacctgggaggcggaggttgcagtgagctgagatcacaccactgcactccggcctaggtgacagagtgagactcagtctctaaataaataaataaataaataaatacataaataaataaaataaacttaagaaaaatgccaagcagattttcaagaacacactttgttggtattttatttgtagttcaaagcttgcacttaagaactaaggctttaattcagaaggtaagcctatacctttatcctttttgtccttaaaagctagaaatgaaatcaaaaggatattttattggatactatgaccatattcagattacaaagtcatagccaaaatatgcataacttaaaactgaattatgctttttgttaaagcaagtacttttaacagttttttattttaaattgaccattttaaaaaaaagtttttatattccatgataatttactttagctcttctgagagcaagctttcctgctatccatgtttccgtcttatgtggtatgcatttaaatacagatatttcattaattaaaagtctcgatgattttaagtatttctctgtaacactgaatcaatatttagatttgagcacatggttctctcttcaggagattttatttctctgcacttctcagtgtaccagaacccttgagcccaaaataccagtatactaatgtaatgttcaatgtataatataatgtatacatgtgataggtaacatccaaagggttctccttgcctgctccccagacagagtcgatttatccggacaggagaatagagagtttaattcatgcaatgctggctgaacacaagactggagttttgttattactcaaatcagtcccttcgaaaatttggagactaaggtttcttaaagaaagataatttggtgggtagggggccagggagtgcagactactgattggtcaggctgtagctgtcatttgcactgagtcagtcggttcctggtggggggcactagaagaccagataagccagtttatagatctgggtggcaccagctgatccaaccagtgcagagtctgaaaaatacttcaaacatgaatcttaggttttataatactaatgttatctattagagcaatttgggagattagtgatcttgcggcatctagctgcatgactcctcgccagaacttctaatttgtggctaatttgttaattttacaaaggcagtctggtccctaggcaagaagggggtttgttttggaaaagggctattgtcatctttatttcaaagttaaactgtaaaatgagttcctcccaaagttagttgagcccacgctcaggaatgaacagcttggaagttagaagcaagatggagtcagttaggtcagatctttttcactgtcataactttctcactgttatgatttttgcaaaggtggtttcactgaaaattcactagatatagaaagagtgagcttttgctcttgacggtatccaaccaagacaggtatttagaagacaggtatcacacgaaatattggtaaatgcctatcctgtcacttgtgtaggcagaaaaaaaatatgcacccagtaaaaatttagatagaaatcttttttatataaaagcaaattgggaagttgtattgtagcaatttaaaatgtttagaaaaatgttatgactcagcctacacttataatctaataccatacaaaagactcaaaaggaatgaggatttcttaatgtgtttgcctaaaacaagattttatatatagagagagattgattgacctgtatctgtatttggatacttttaaaccaaacacaatgaacagatctttttaaggttctactgattgatgtctcatatttcccaattaagataatttacatattttagaagctgtttacatgattcttagaattgctttgaatttgaaatgaaggctgggggataggacagctgaaatgagattaaagcatctctgatgagaggaaaccacttatttttccaactctaaaagggaagaatagtagactatgcttattcaaaaaaatttacaactaccacacatctaccataccttagtaaatgataattatataaattttgaaaatattattaactttctatttttgggtctttaaaagttcctgatttccttattctaatattcttaacattctctacaatattttttcgtctttctcaaaacacagatgtatgatatttccaatgagacatctaatattacatgtatttttcctctttactggttaagttgaaacttgctgattggttggaacacactttatctatttttttgtttgcttctttgtcttatctttctgtttttcatgccattcctcatagactaagatctaaaatctaatatttacttagggaaaactatgattgctaaattaattctctatttagttgaatttgtatcatcttactgaagcaaagggttgggtgtttctctagaaaacaagagactcataaaaatataaaataccaataattcacttttacatattaaagaaaagcaaaatgaaacagaaaagcaaaatgaaacagaaaagctgtatataggttgtagtggcagatacctctattcttctgttaacagaatcctaatttgctccaggagtttagaggaacagcaaagctctcaggcaggtcaaatcatcgtgcagttccaagggatgcattacaattgattaagcagccataatcatcccaaacttttttgccagtggtttaatttggggtaggcttgttacaaatttcagctaatgagatgtaagaaatctcatgtgtgcctctctaggaagagttttccttcctggaagaacagagtgttatacaaggaaaggagcttttttctcctgcctagtgcctttctatgtgtctaatgtgttactttgtggggatttgaaagaaaatcccagaagtatagatctagagctctgatagcattgagccattttgtcaacagtagcccatttccagactttatatatgagaaatttttttaaacatagtatttaaaccacgtgtaatttagtattttcttatgtgtagccaaaagtacttctaactgaaatagtttgtttttttttgtttgttttttttttgagacggagtcttgctctgtcactaggctggagtgcagtggctagatcttggcttactgcaacctctgcctcctgggttcaagcaattcccctgcttcagcctcccaagtagctgggactacaggcatgcaccccacacccggctaattttttgtattttaatagagacagggtttcaccatgttggccaggatggtctcgatcttctgacattgtgatccacctgcctcggcctcccaaagtgctgggattacaggagtgagccacagcacctggcctgtttttcattttttaatgaatcttaccaaagtaattatgatactaatagattggaaccctgcttttgttgatagtcactggagagctgttagatcttaaaaatatatgtgcttctaaaatgggggaaaatacaaagctgcaaagctttaattcatattaatcatttatgatgtaccatcaataaatttatttaaatttgaaacttcactctccaaatgagcatttgcaatacaaaaaaatactcgctgggtgtggtggctcacgcctgtaatcccatcacattgggaggccaagatgggcagatcccttgagcttaggagtgcgagaccagcctggataagatggcaagaccctgtctctacgaaactacaaaataataataataattagccaggcatggctgtacacacctgtagtcccagctgctcaacaggctgaggtaagaggaccactctagcctaggagttggagggtgcattgagccgagattgctccactgcactccagcctgggtaagggagtgagaccctgtctcaaaaaaccaaaccaaataaaaaaacaacaataaataaacttaagcacctagtttagaattctgtaagagaaatgcaaaccgagtgatcactgcctccttgatttgtccacattatctaaaattgctgagcaattaattggatcagccacatgatattcagaagctccctataggtgactatagaatatacagactcctggggaactctagttaccctgttgagcaggttgagcagacagactatttttgatacattagcaagcctatctttttgaaaagaaattgtgtactatatatgtttttctgagcaaaacacttcccaatagtctcacaggtaatagtttacagatgtgctgggatgttgagctcctcatgaggaacaaggggtggctagagtccttgggttagtcactttcagctgctgcaagctatcttttttgtttacattggtgtaccttacgcatagtatcattgtctatgagtgctatgaattttttcatgaagcacagtagaaaaactataattaaatatatggttaataatgcttctgtttaaaattaattacttatcacaaggggaaaggactcaacacttttagctatcccaggatacatcagttaataagaatcacagatgccttcgaagtggtcaaaatggtcataaaaatctaagaacatagctaaaagtgatgctctccactcacttttctgggccaaatacagcagtattcatttatagtgttaaaatttgtcaaaaagtcatagtgaagaatatttggtatgaaaactaaaatgacagatattaaacaattagtaatttaaactctctcccaatttttaagggagcaatgataggtgataagtgtagagctgctacttggttattagaattttaatatttttgatgatatcatgtaattcattattctaactaaaaagtattacaccgtcatactgatgatgattatcacttgcttttctccttctttgctttcaaagtttgttgcaataaaaagttatttgattaggtatatttttctaggcgcttaactcattttgacaattttttcacaagtttggaaatattcagaactctaaatttatttatttctgcatcctagaactttattctaaaaacaaacaaaaaaagtcttatattgttagaatgttggaaatacactgagaatttgcagagatgcttatgaaacaacagtacctcatttcctgtcatagaccttcacagtaattacatcagccaaataaccaaaaaaaaattttctatttgcatgccatttaaagattagcaatggactgattctgaagtagtgatgtaattgcctaaaaggagtgaatcaattttgaaattaattacactactccacaagtatttagatattacactcttcagcattatattttagtgacagagaggttaggtggggagagattttggtgggtgtactagtttcccatggctgctgtaacaaattaccacagatcattacaaacttggtggtttaaaactgcagaaattggccggacccagtggctcacgggctgggtgcagtggctcatgcctgtaatcccagcattgtgggaggccaaggcgggcggatcacgacatcaagagattgagaccatactggccaacatggtgaaaccctatctgtactaaaaatacaaaaagtagccgggcgtggtggcgcgcacctgtagtcccagctactcacccgggaggctgaggcaggagaatcgcttgaacccaggaggcagaagttgcagtgagccgagatcgcaccactgcactccagcctggcaacagaatgagactccatctcaaacaaacaaacaacaacaacaacaaaaactgcagaaatttattcttctggagtccacaagtttgaaatctgtagcaatgagcagaaatcagagagacttcagagtctctgggggaaaattcgatccttgcctcttccaggttctgttagctgtgggattacctggtttgtggccacattagtccagtctttaagtccacatcttcaaccccctctctgctctatcctcatcatcaatttctttttgtgtgtgaaataggcatctacctccttctcataaggatacaggtggttacattggacctacgcagataatccaaaataatctcttcatctcaaaatctttaacttaattacatctgcaaagactttttggatatttatttattttttgctataatagtaacattcacaggtcctagggattagcatgtgaatatcttcgagagagccatttcccagcctactattgtgcgtgtggaaggtcgggggaggccaggaagagggccttaaagcaatagaataaagagagtatcagacgtattatatgaaaatcttcaaatttacatgaccctaattttttaaaaactgtattataatacatcttgactatgttctttcaatacctaggtaatcagaaccagagacaattttattttattttattttttagtgttattgggctaatccaagaaacttcaacatagggaaagccccttttattagaattctaaaactgagacttccaaaaccaaatagatcaataaatatgactcatattatttgctgactggccaaaattaagtttatattttgatgccacttctaaaaacaagtagtgatgaatatgtgacaatgagacagaagttgctgttttcaacagtttgctggagattattttcttattattcatcattttgagatctatgaattacacatctacatcttaaagccttgttataaggacaaatatacatgaacaaaaatcactatatgattattttttaaaaaaactcatccctaggccttttctttttttagctttcattttaggttcatgggtgcacgtaaaggtttcttaatagataaacttgtgtcatgggggtttgttgtacatattatttcatcacctaggtattaagcccagtacccaatagttattttttctgctcctctccctcctcccatcctctcccccaccaagtagaccccagtgcctgctgtttccttctttgtattcataagttttcatcatttagctcccacttagaggtgagaacatgctgtatttgatgttctgttcctgtgttagtttgctaaggataagcatgtaaaagtatagtttggtatttttcaccagtttttatgttttgttaacgttcaagtttctaatttatttacatacatgcagggtaatgtttctatataacttaatttataattgtaggtgtttaaagacgcttcagtggcatgctcccagccttaggactataggaatgtaaatatcttggcatgaaatgttttgcaccagtaaaggcaagcaattaatcatatacaggtgttttcatgctgaatgagtattattttttcaatcaaagggaattatttttcactttttacttcaagaaaattgaatacctttggtatactgtttttatttggagcttcataaaacttaaaagtcatgtttatatgttcattaaaataatgcctgttggatgttctaacattgatagtctgtcttaagaatagtgtttaagcaaaatattttcaggcatgatttccaaaagagtttatatgtcttactaaactaaaccgttttttgcaaaatggaaatttctgggaattgatcataatataagcaagaaaatgacaaaaagctaagtaatattgaaataaataatagtagttgaataactcacagtaaatgattgaactgacacatatgttatagaatacttagtgagactttttaatcaactgaaaaaaatcaggtaacagaatatagagcaagattcccatttcatttaaacacatattaaaccatatattcataggaaaaagaatggaaacctgtacactaaaatgatacagatgattacattaaatatggcattttctcaatttccctttttgatgctcaaaattttaaatattttctagaataagaaatttctataaagggggaaaacaaatcttattttaaaatgaattaaacttaatcattaaaacatctatgcaaatataaaatcacaagaaagcttgatcatatgacagcagcactgataaaaaatgagaaggtagaaatctgacttcctctatgatctgcagcataatctatgattagaattggatttctgtcacactctggctgataaccttatcagaacttttatccctgacaaactagaagttataataatagtgtgtttttatgtaggtgtttttcttaagggacaggtttatataggttgatttagatgtaacaggatttgtgaattagaacacaagatttacatcgtaatgtagactgccattggtcctaaaggaaataagttgctttatttgggccacttttgctcttcatttatcataacaataggaaaagaataagaccatggtgagaatgcctaaacattaaatgctactgctattggagatgagaaaactaagctgaaaatataattaactttgtacaaacggtaaatattgtcctactattttgaccagggatgtttgttttatgagtatacatttatatctattaaaacaccttggccaggcacggtggctcacgcctgtaatcccagcactttgggaggccaaggcaggcggatcacgaggtcagaagatcgagaccatcttggctgacatggtgaaaccccgtgtctactaaaaaaaaaaaatacaaaaaaattagccaggcgtggtggtgggcacctgtagtcccagctactcaggaggctgaggcaggagaatggagtgaacctgggaggcagagcttgcagtgagccgagattgccccactgcactccagtctgggtgacagagtgagactccatctcaaaaaaaaaaaaaacaaaacacctttattattaatattaaaacacctcattgttaaaaattctaaacctttttcttgcttaaacaagtctttttttgttgttttttcttttattttcaatacagggtcttgctctgtcacccaggctgaagcacagtgggatgatcttggctcactgcaacctccaactccagggttcaagagatcttcccacctcagcctcctgagtagctgggattacaggaacatgccaccatgcccagcacattttttgtattttttgtagggacggggtttcatcctattctaggctggtcttgaactcctgggctaaggatttgcccacttcagcctccaaaagtactgggattacaaggatgagccaccacacctgcccagaagatgttttattattattattattattattattattattatactttaagttttagggtacatgtgcacaatgtgccagttagttacatatgtatacatgtgccatgttggtgtgctgcacccattaactcatcatttagcattagctatatctcctaatgctatcccttccccctccccccaccccacaacagtccccagagtgtgatgttccccttcctgtgttcatgtgttctcattgttcaattcccatctatgagtgagaacatgcggtctttggttttttgtccttgtgatagtttactgagaatgatggtttccagcttcatccatgtccctacaaaggacatgaactcatcattttttatggctgcatagtattcatggtgtatatgtgccacattttcttaatccaatctatcattgttggacatttgggttggttccaagtctttgctattgtgaatagtgccgaaataaacatacgtgtgcatgtgtctttatagcagcatgatttatagtcctttgggtatatacccagtaatgggatggctgggtcaaatggtatttctagttctagatcccagaggaatcgccacactgacttccacaatggttgaactagtttacagtcccaccaactgtgtaaaagtgttcctatttctccacatcctctccagcacctgttgtttcctgactttttaatgattgccattctaactggtgtgagatggtatctcattgtggttttgatttgtatttctctgatggtcagtgatgatgagcatgttttcatgtgtcttttggctgcataaatgtcttcttttgagaagtgtctgttgatatccttcgcccactttttgatggggttgtttgtttttttcttgtaaatttgtttgagttcattgtagattctggatattagccctttgtcagaagagtagtttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtcgttgcacatgcctatgtcctgaatggtattgcctaggttttcttctaaagtttttatggttttaggtctaaggtttaagtctttaatccatcttaaattaatttttgtataaggtataaggaaggcatccagtttcagctttctccatatggctagccagttttcccagcaccatttattaaatagggaatcctttccccattgcttgtttttctcaggtttgtcaaagatcagatagttgtagatatgcagcattatttctgagggctctgttctgtcacattgatctatatctctgttttggtaccagtaccatgctgttttggttactgtagccttgtagtatagtttgaagtcaggtagcgtgatgcctccagctttgttcttttggcttaggattcacttggtgatgcgggctcttttttggttccatatgaattttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggtttttagttctccttgaagaggtccttcacgtcccttgtaagttggattcctaagtattttattctctttgaagcaattgtgaatgggagttcactcatgatttggctctctgtttgtctgttattggtgtataagaatgcttgtgatttttgcacatttattttgtatcctgagactttgctgaagttgcttatgagcttaaggagattttgggctgagacaatggggttttctagatatacaatgatgtcatctgcaaacagggacaatttgacttcctcttttcctaactgaataccctttatttccttctactgcctgattgccctggccagaacttccaacactatgttgaataggagtggtgagagaggacatccctgtcttgtgccagttttcaaagggaacgcttccagtttttgcccattcagtatgatattggctgtggttttgtcatagatagcccttattattttgagatacgtcccatcaatacctaatttattgagagtttttagcatgaagggttgttgaattttgtcaaaggccttttctgcatctattgagataatcatgtgggttttgtctttggttctgtttatatgctagtttacatttattgatttgcgtgtattgaaccagccttgcatcccagggatgaagtccacttgatcttggtggacaagctttttgatgggctactggattcagtttgccagtattttattgatgatttttgcatcaatgttcatcaaggatattggtctaaaattctcttttttggttgtgtctctgccagtctttggtatcaggatgatgctggcctcataaaatgagttagggaggattccctctttttctgttgtttggaattgtttcagaaggaattagtacgagttcctccttatacctctggtagaatttggctgtgaatccatctggtcctggactctttttggttggtaagctattgattattgccacaatttcagatcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtgatgatatcccctttatcattttttattgcgtctatttgattcttctctcttttcttctttattagtcttgctagcggtctatcaattttgttgatcctttcaaaaaaccagctcctggattcattaattttttgaagggttttttatgtctctatttccttcagttgtgttctgattttagttatttctgccttctgctagcttttgaatgtgtttgctcttgcttttctagttcttttaattgtgatgttagtgtgtcaattttggatctttcctgctttctcttctgggcatttagggctataaatttccctctacacactgctttgaatgtgtcctagagattgtggtatgttgtgtctttgttctcgttggtttcaaagagcatctttatttctgccttcatttcgttatgtacccagtagtcattcaggagcaggttgttcagtttccatgtagttgagcagttttgagtgagtttcttaatcctgagttctagtttgattgcactgtggtttgagagacagttttttataatttctgttcttttacatttgctgaggagagctttacttgcaactatgtggtcaattttggaataggtgtggtgtggtgctgaaaaaaatgtatattctgttgatttagggtggagagttctgtagatgtctattaggtccgcttggtgcagagctgagttcaattcctgggtatccctgtcaactttccgtctcattgatctgtctaatgttgacagtggggtgttaaagtctcccattgttattgtgtgggagtctaagtctctttgtaggtcactcaggacttgctttatgaatctgggtgctcctgtattgggtgcatatatatttaggacaattagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcatgtgagatgggtttcctgaatacagcacaatgatgggtcttgactctttatcctatttgccagtctgtgccttttaattggagcatttagtccatttacatttaaagttaatattgttatgtgtgaatttgatcctgtcattatgatgttagctggtgattttgcacattagttgatgcagtttcttcctagtctcaatggtctttacattttggcatgattttgcagcagctggtaccggttgtgcctttccatgtttagtgcttccttcaggagctcttttagggcaggcctggtggtgacaaaatctctcagcatttgcttgtctgtaaagtattttatttctccttcacttatgaagcttagtttggctggatatgaaattctggcttgaaaattcttttctttaagaatgttgaatattggcccccactctcttctggcttgtagagtttctgctgagagatcagctgttagtctgatgggcttccctttgtgggtaacccgacctttctctctggctgcctttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttggttccattctccccgtcagtttcaggtacaccaatcagacacagatttggtcttttcacatagtcccatatttcttggaggctttgttcgtttccttttattcttttttctctaaacttcccttctcacttcatttcattcatttcatcttccgtcactgataccctttcttccagttgatcgcatcagctcctgaggcttctgcattcttcacgtagttctcgagccttggctttcagctccatcagctcctttaagcacttctctgtattggttattctagttatacattcatctaaatttttttccaagttttcagcttctttgcctttggtttgaatttcctcctgtagctcggagcagtttgatcatctgaagccttcttctctgcactcgtcaaagtcattctccgtccagctttgttccgttgctggtgaggaactgcgttcctttggaggaggagaggcgctctgctttttagagtttccagtttttctgctctgttttttcaccatctttgtggttttatctacttttggtctttgatgatggtgatgtacagatgggtttttggtgtggatgtcctttctgtttgttagttttccttctaacagacaggaccctcagctgcaggtctgttggagtttgctagaggtccactccagaccctgtttgcatagttagcagcagcattgtctgcagaaccgtggattttcgtgatccgcgaatgctgctgtctgcttgttcctctggaagttttgtctcagagttgtacccggctgtgtgaggtgtcagtctgcccccactggggggtgcctctcaggctgctcgggggtcaggggtcaggggcccacttgaggaggcagtctgcccgttctcagatctccagctgcgtgctgggagaaccactgctctcctcaaagctgtcagacagggacatttaagtctgcagaggttactgctgtctttttgtttgtctgtgtcctgcccccagaggtggagcctacagaggcaggcaggcctccttgagctgtggtgggctgcacccagtttgagcttcctggctgctttgtttacctaatcaagcctgggcaatggcgggtgcccctcccccagcctcgctgctgccttgcagtttgatctcagactgctgtgctagcaatcagcgagactgagccaagatggccaaataggaacagctccggtctacagctcccagcatgagcgacgcagaagatgggtgatttctgcatttccatctgaggtactgggttcatctcactagggagtgccagacagtgggcacaggtcagtgggtgcagtgcaccttgcatgagccgaagcagggcgaggcattgcctcactggggaagctcaaggggtcagggagttccctttcctagtcaaagaaaggggtgacagacaacacctggaaaatcgggtcactcccaccccaatactgtgcttttccgacgggcttaaaaaacggtgcaccaggagattatatcccacacctggctcggagggtcctatgcccagggagtctcgctgattgctagcagttgtttttaagacaagatttgttagtacaatgttccttaggagtgattctaacgtagtttattagaactgattatattattgttgtaggaaaaaaccgggttcttatcagaggaccaggataatttagacacgtggacatattgtagggtgagtagggcagggtttattgggtgcaaaggaaaaaagggaaacaggaaccctcagcaaagcaagagagtcctgttagctggtttaccccctcacagattgaatcccaggttaccacacaggaagaggagagccagcctgctcccccctacaaaggcgggaacttcccgaggctccaccccattctcccagtgcacaggccggttgggtattctccagggacccctttttacttggctgcctcattattacattaaaattagcagcatgatatctgtgatattggtgagctgatactagttttgcatcctagtagaaacaatcacacctaaaaacattcctatagattgcattaattgtcaatcattaatacatatagataatattaggagagttactcagttatattctgtaatatttccctgtagcttctgttgcagtcacttgcatccagctggtatttaataaaagtgaactcattcatgactcacctccttttctaattaagttcttagtcttatactaccttggtctacctttctaattattgtataacccatgacatataatagggccatgtctctgagcctgaccaatattttggcctttcatgattaacagccttaactaatttttatcttatatagctaatttgatttcatcattggagccacaaataccacagggaagccatgatgattcaattacttttttcagctgatagttttaaccatttccctggattctcaagttaagttaatctctcagatggttcacctggtgcttcagaaatcaattcttaaaagtgaattttatcatacaatagaatttttctctcatcacagacaatatctcaaagtttctgtctgaaacataaaatataagattttcttcacaagaaaaaatgaggctaaaacaaaattagttttatagcagaaaactacaagttaggtggtatctagcaattgtgatactttattatattaggtcatctctccagggcagaacatcttttccaattatactcaaactgcatcattgtcaattatatcacatcaactagttgtagcaacagggaagaagtttgtactgatctttatactcttaaataactatgctgagtaattttaagagcagggtttattgacaaaaatcataggccgaattacaaggcagtacaaaatctccatcaatgtttaggcaactaggcaaaatccaattacaggatatttgatatagataagtgccagctactaaaatgagaaaaaaaatgtagaaaagaataaaaaaagaaaataggattaagataggaggtataagaaagataaatgagagaaaattaatgaggaaagttaaatgagataaattagataaagtcctgcctttggatagtgatgcacaagtagcaattaccctctgtagcactagggtggatttctatgttcattaaaggggttacaccagtgtttttggcaaatctgtaatgaaggatagtgcattgtgagactaactggattgtaatgaaatatacaattaagtgaaaatagtgaaagtaaatgcaaggatatgaaaggaacatttgctatattctttatgtacatatccttctgaattactctggaaaaaagaggataaaaaattatattctactccaaagtaattgccaataaatactgtcaagaggcaactcatagctgcgcatggtggcacatgcctgtagtcctagctattcaagagactgaggcaggaggatcactagagtccaggaattcaaggctgcagtgagctatgatagcaccactgcactccagccttggcaacagagtgagacgccttctctaaaaagtaaataaataaataaaaatatttttaaaaaagtaactcataaaacaagacatagaaaatgctttataattatgtgttgcactaagttagaaataataaattgtattttagatcaaatgaaggttggtttcatgaaatagcattcgtctatacataatggcgttaatatatcaaaaacccttaatctagtgaataatatgttgcattaagtaaacaagtctagtttgcaagttcaatatgatggaacaatgttttatatcagttaatatgagaagtttgagaggctgaggcaggcagatagcttgagcccaggagtttgagaccaacatggtgaaactctctctacaaaaaatacaacaaattagccaggcatggtgatgcatgcctgtagttccagctacccaagaggctgaagtggaaggattacctgaaccagtgcagttgaggctgcagtgatccaaggccactgccttccagccggggtggcagagtgagatcctgtctcaaaaaaaccaaaaaaaaaaaaaaaagaaaagaagaagaaatcatgtgggaagtatattttgtaatatcctaataaataaatctttgaggattactgctattttatttatttatttatctatttattcattcgtttattttgagatgaagtcttgcgctgtcacccaggctggagtgaagtggtgcgatcttggctcactgcaacctctgcctcctgggttcaagtgattctcttgcctcaagcctccctagtagctgggattacaggcgtctgccaccatgcctggctaattttgtatttttagtagagatggggttttgccacgttggcccactggtctcaaactgctgacctcaggtgatccacccacctcggcctcccaaagtgctgatattacaggcctgagccaccgcgcccgaccctactgcttattattttaacaagaagagatgatgatgtgacataatcatcataataaaatgacaacatatagtgaaaattcaagtattgtgtactttcaaacagttgatcattccattcccatacaagccatggagtttgctactactaagaagcctattttatatttaagtaaacttaattgtaatgggtcatatcacttgaagatagtcaaagagcatccaagtgacagagccagatgttaggttctgtgttctcattctctatatgctatttatttgcatgtaatccattacctttcatatgctttcataaaattattaattttggtggctaaaacataaatgtttcaacttgatttttaaccaaactaggtataatttacatttatacatacacataaatgtaagtaactaagtataaatgaagattccaaatttttattatattttcaacatataatactgaagtagtgactattccatatataccatgtgaatacagataaacatggttagcatttaataagcataaaatataattttagttatgaaattaaaaagcttcagcattgacatttttaaatactatattggaaagaatgcttgccgacgacaaattttcaggagagtttgatatgtgtaatacagtgtctttcattagctcatcagccattgctgaagtcctagtatcctgctactttgacttttagtaaatagtgtttatttagctctccattataaataatatggggaaaatatgtcattgtgcacaaaggaagtgataaaacattataatcagtcatgcgttttctatctcttgtaatcagttaagtcattgaaacaaacttaaatgtctccttagatctctgttctataactgaagttcctctcttgctacagcctgcttagccccctaattctgtctctagacccagccctcaactcatagagcttctcaaattccatattttgtcttggatcatttagtttgccctaacattatactctattgagcaacgcacacattaagcagttagatgaaaccaactcctttagaaaacagttttgagttatcatttattgttacataaactcttcacgtagagctctcactcctcatactacatgaatgatcatagtaaatctgataaaaaccgggtctgagagggaagaatgggttctgaatctgaaaataatgattttctccatattgctacttattcattgacttacaaaacattgtcttaataactattttgtgcaaagtactaagttaggaacctaggaatataaacaaaaattaagaagtagtatttttaaggagattaccactgtgcattggagaaaatatgcaaataatcagatataagacatttcatatgaaattaggagaaacaaagtttgttgcagcactaagcagggctcagccaattctggttcggaatcatgagggaggtgatatttgaattaaccttttaaaaaaaatgataggtggtaagaagagaaagtaaaagtattcaagaatacaaggataatatacaaagaggcacaggccgggcgtggtggctcaatcctgtaatcccagcactttgggaggccgagacgggcagatcacaaggtcaggagatcgagaccatcctggctaacacggtgaaaccccgtctctactaaaaatacaaaaaaattagccgggcatagtggcaggcgcctgtagtcccagctactggggaggctgaggcaggagaatggcttgaacctgggaggaggagctctcagtgagccgagatcgcgccactgcactccagcctgggcgacagagcgagactccgtctcaaaaaaaaaagaggcacagaggtgggaaataactttccatctacatggaacagcaaataatatatgtgtctggaatcaaggatgactccagagatcaactgaaacacatggctcaaaaggtaacaaggtgcaagatcatgatcatgatcatggaggttcttgaagcataaattaaagatgttggaactcacctagaaaggttgggagccattggcatttgtttagaagggaagtgacatgatatcctcttgtttcactttttcagaattcacacctgctctttcctttgtttacaggatcctcccatgaaagcccttccaaccccgcatgcttttaagtccattcgttttaagcttgattcatctcttctggaaggtgtttcttaacctcttttgttaagctttgcagactctttttcccaggacaggttatgtactcctctcattttcctgtcttgtgctcagactttatatatttttatgattcttgtataataatgatctatttttaaaaagtcactctcatttgatttgagttcaggaggaattcatcattggtctttgcattctcagtgtcttgctagcatgttgccttctggatgcttcatacattttaactgactgaatgatcagaactatgtcttagtaagaaaatctatcatcattatagaaggtacactagagagaaaatagaataaatttagggacactagttagatggtcactgtaatgggagatagtgaaatgataaaataagaaggtgaatggagaaatgaaaaggagacaccaaagagagaaagctgattggaatgggacagaggcagaaagactgatttgattatccttgacaacttggggaaaggttgatcattgtcctacacggagatggttttgctaaggaaactgtgagtcttcttttggtgggttgtatcagacatatatgttagagcactgaattttttagatgtctagaaactataattattcacttttaaaacaataatgtggattactattttttttgtcttaaaacctaaaaatttatccttaagcaggtttgagctgtaatcctatgagtccataacagtaagaaaaaaaaaaaaaaaaaactcaacagtccagtctggccaacatgacaaaaccccatccctactaaaaatacaaaaactagctgggtgtggtggtgcgcacctgtagtcccagctattcgggaggctgagggtggagaatcacttcaacctgaaagaaagaggttacagtgagccgagatcatgccactgcactccagcctgggcaacagagtgcgactttgtcattaaaaaaaaaaaaggaaagaaggaaaaaaaaatctcaacagagataaacgtacatctaatcctgttccttagagagaagcaatatttaacctttcccactaatcttatattagggtgtgcgaaagttcgttttatttgaatcatactcaactgattccaaattaattatacgttatttctctcttgcttctctacagtatgctgtctggctagtcctctgggttacgtggaatgtgtttgttatctgcttctatttggaggctggggacctctcaaaggtaatttacatctaatttgcctgagtcatcagtagggtgttaacaagtctcttcctaagtaaggcagagtctcatcctgttctgcttgcttagctgcacctcaatgaaagtaaattgaaaggtgtcttgatttatatttctgcatttttatcattaaaaatatgtctggtgagtcacaaaaatgtactttttcttaagcaaaactaagtgaactgttgcttattatagtgaccaggcagtgcactttaaaacattaaccactgaatgatttctgaagcaaaatgtgaatttttttcagagaaaaaaatcttgaagatttctgaaatcacttagtttgcttataactctgctaaacattgtccttattgattttaaataacagtgcaataattgaaacagttaatgggctttggttgaatgaaattgttactagaggtatataatatgttatagaaatgaatacaatcaaccctttattctaaataggctaggaaaactaaatacttgcttttttcatttagtttttttgtgctctgtatgtgtgcatcttgctactatatttttcacatggatgcccttactacacaaatagtgtaggcttcagatctcgaacaccatcatccttctgttagaatgcaattaacagcaaagaagtcaaatgaggtaatccattcaaggtagtagcaaattctgactcttgagagagtttcaaacttgtatgtacttcctcgtatttaaaactttaaaacataaaaattgtaaaatgttcttttacttaccctgtattagagcagaaggcccctgcaaacatgttgatatttgtaaaacccagagatactcacgtgctttaaaagaccaagagagctaaaaaaaattttttttaaagaaaattcctcaggaactacctttgccttgtcaagctatatattttggaaggagagagaagagaatggtaatacacatttatgatcttacatgcaggagtttcacaaagcactcatcatgtgatgtttgtttattagttaactgtgatatgtggctttatatcaaggaaaaatcattttgatttgtttttattcaatgacaaaagatgaaggatcaaataggaggatgacatcatgatatgagagagaaccaaaacttcttggatgtgtaattttatgatcagaatgtggacaagtcctcaccgtggctagcaaaatctccctagaggatgccatttgtgtgttttttgcagggcatcgttccccacactctggttagcaggcagccttttcaggaaggtgccgtgaccaatgaaaataaattgttcagtggctctaggagggacccagaccagattgctgcttaaaactcacattcgcctcagtgtaagaaaagcagacacgcttttccaaggatttgaattccttgcccaatttatacatctctgctactctataatccactttcttcaaaggaattccatagtcgaatgacttttaatgatattttcaattttaaataatcaccttaaaaattgtaaggcaggtgttcagacatatggcctgagtaaaatgatccagcagatcagataatttgtttaatattaagaaaagagagaaagagatttgagcaaagctggctgcacaaaagttctgtaattgtgctcactgctccccatgatgactgcaggcacagaataaagctggtgatttcatgacctcagacacaggcattgaaaccacagcaagggcactaagaattcttccaatgtacatgggcagataatttctatcccttggcaatgaaacagttgataatattttattttcttctcatcctataaaccaaggctgggctctgcagagcacatgaaaatttaataatttcctttttaacaaataacctaaaaaaaaaccataaagggcaaagttatatagttatcgttatatagttatctgtactgggtttttcctctctttcgtgttcaaagcatttgaaaaaaggtgtatttataccatttaattctttagtcgttgcaactgcctcacattcttcaggtaatacagtgccagaaggaagcaatggtaattggtaatggaaaaatgtacagaaagatagaaactcaaaaatggtacatatgaaacttctgataatactaaaagaatgtaaaccattgtttttctcaatccatcagaaaaaaaaaagcaatttgaatgtgtctaccctatgaatggatcagttagtttgaggctgagggagaaatttgtgaaaaagaatcagggttgacattctgtgggctttatatatgtgaaagaaatgtatttatttccatgaaatcttttgtaaataagtgatggcttcataatggatattggtaagaggtaataaaacgtgataaaacattaaggtaaatttttgttacctgattagagtttagaacttttcttttttttattattatactttaagttttagggtacatgtgcacaacgtgcaggtttgttacatatgtatacatgtgccatgttggtgtgctgcacccattaactcgtcatttaacattaggtatatctcctaatgctatccctcccccaacccgcacgccacaacaggcccctgtgtgtgatgttccccttcctgtgttcatgtgttctcattgttcaattcccgtctatgagtgagaacatgcggtgtttggttttttgtccttgcaatagtttgctcagaatgatggtttccagcttcatctatgtccctacaaaggacatgaactcatcattttttatggctgcatagtattccatgatgtatatgtgccacattttcttaatccagtctatcattgttggacatctgggttggttccaagtctttgctattgtgaatagtgccgaaataaacatacgtgtgcatgtgtctttatagcagcatgttttatagtcctttgggtatgtacccagtaatagaatggctgggtcaaatgatatttctagttctagatccctgaggaatcgccacactgacttccacaatggttgaactagtttacagtcccaccaacagtgtaaaagtgttcctatatctccacatcctctccagcacctgttgtttcctgactttttaatgatcaccattctaactggtgtgagatggtatctcattgtggttttgatttgcatttctctgatggtcagtgatgatgagcattttttcatgtgtcttttggctccataaatgtcttcttttgagaagtgtctgtttatatccttcacccactttttgatggggttgtttttttcttgtaaatttgtttgagttcattgtagattctggatattggccctttgtcagatgagtagattgcacaaattttctcccatgttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctccatatggctagccagttttcccagcaccatttattaaatagggaatcctttccccatttcttgtttttctcaggtttgtcaaagatcagatagttgtagatatgcagcattatttctgagggccctgttctgtcacattggtctgtatctctgttttggtaccagtatcatgctgttttggttactgtagccttgtagtatagtttgaagtcaggtagcgtgatgcctccagctttgttcttttggcttaggattgacttggcaatgtgggctcttttttgttccatatgaactttaaagtagctttttccaattctgtgaagaaagtcattggtagcttgatggggatggcattgaatctataaattaccttgggcagtatggccattttcacgatattgattcttcttacgcatgagcatggaatgttcttccatttgtttatatcctcttttatttcattgagcagtggtttgtagttctctttgaagaggtccttcacatcccttgtaagttggagtcctaggtattttattctctttgaagcaattgtgaatgggagttcactcatgatttggctctctgtttgtctgttattggtgtataagaatgcttgtgatttttgcacattcattttgtatcctgagactttgctgaagttgcctatcagcttaaggagattttgggctgagacaatggggttttctagatatacaatgatgtcatctgcgaacagggacaatttgacttcctcttttcctaattgaataccctttatttgcttctcctgcctgattgctctggccagaacttccaacactatgttgaataggagtggtgagagagggcatccctgtcttgtgccagttttcaaagggaatgcttccagtttttgcccattcagtatgatattggctgtggttttgtcatagataactcttattattttgagatatgtcccatcaatacctaatttattgagcgtttttagcatgaagggttgttgaattttgtcaaaggccttttctgcatctattgagataatcatgtggtttttgtcgttggttctgtttatatgctggattacgtatattgatttgcgaatgttgaaccagccttgcatcccagggatgaagcccacttgatcatggtggataagctttttgatgtgctgctggattcagtttgccagtattttattgaggatttttcatcgatgttcatcagggatattggtctaaaattctcttttttggttgtgtctctgccaggctttggtatcaggatgatgctggcctcataaaatgagttctggaggattccctctttttctattgattaggctgtcttttctgcttttcctaatgaactctctgccatatgcttatgagtgaaacagaaattatagtaatcaaccaactcacagtgtacattcatattgaaatgacttaatttcaataatatgatacacaggactaacccttttgatcatgttttctttgtacacatagaggtatagttaatatattttcttcattgaaaattctatgaaaatccaacattattattaaaatttccattaacatattttaattacagtgtccacaaaatctaaagaaaaataaaaataatccaccggagaaacttttaaatgttatatcatagttaaattaacaaaatgatgggaatatagtataaaatgatacataagatgataggagcaaataaacatacacatttcatataattatttctgctaatgctaatgcattgagatattagtgttgaaactaaatatcctaaagcatttagcagtgtgtaacttcctgggttgatattttcctagatgtcctgttaaggaaactgagaaaaaattagtctgtaacctgaagtgtctggtaacggtttgaaattgcctttgggcatcaaatgtgacatgggttattgaattaagagttttgacaattcctcatatagcttcattattctgttgtattattcttggcaattgtggttcccttgatcatatatcaaatagagagaaataagaactaacctcagccatcaactgagttgaggtattttcaacacagaagagatatgctatttgttctgaagtgatttttaagttgaaagtatatagcagtaggaaagaaaacatatataatatggtgattaatctattcatttcatcacctggaaaaacaaaatttattaaattattttttgaatagtaatacaaagggaagaaaacttagtggtcttctggattgtccgtaaaaacctatattttattgcatgtgataaaattataaattactcaggctgaaattaaatacttacacttttcttcatattactattttcagatatgtttctaccttcataatgtatggggcaccattagtgaatggtgtgcctatctttagaaataaaacaataaacttatagagcgtaaaggataaaccaagggattattgtacacttaaaacaacccaacttgtctttatttaaccctttgggactagggatgcaggtatatctctctcagatttcactatagtaacagaaatttatacctaatgtttgtttcagaatgaacacatttagaagcaactcctagaaagctgtcatattttaataattttgatagttgcttcagagatctagatataacttgtcaatttgaaaatttgttatataaaaaagtcatgtaacaatgtggcttatttaagctttagggaataaaattgcactcttttgaatgtaagagacaggaaggagataaaagttgtcatatactgtagactatagggaacaaatccttaaaaccagatgcaagtgcaatgtggaataatgtactgttccaacaatgtcagttttatttcttctgtaacaaaatgaataattcatttagaaagatatcagatatttggattcttttgctcaataaaaccaatgcttgtatcaaaatttgcttttctgacctcatatgtaaaaagatggtatgcagagaaatatgctgtaatctttttttatttgaaaaaataactcttcctctttagtcttcttcatgagataaaaatatatgagcaattactattaaacaaagactacctataataattgatttaagacaaaatttaacaaatattatgatgataatatattgggttcattttttaaattttgattttcttactgtaaaatttatatatctgagaaaatttcaattaactattactaaagtaattagaaaaaatttttatttcccaactatcaaagcagatttttgccttatgatgcagggaaagatattcgacctattattaataattaaatgtaatgtaactctttcccaaatctagaaatgaaccaaccagttggaatttggtcagtcacaatctctcttctctcgttttccttcataattcatgaattaaactgattatttcctcatttcttaaattcatttttctttgttttattttctgtttccttttactacccctaaagtgaggaaaacagttcatgaacctttcttattctctgtctccattctttttcttgaaaatgccatttgctgacataaactatcatctttacacatatgtctaccagatttatgtcttcagtcttgaccttgttgctaagttaatgtgtcacatctccaacttcctgctggtgtcaggtcaattctattgtcaccttaaattcaaaatgtccaaaatgatttattatcatccccaaagaatccaacttctttaattcactttctactaagagaagaaaaaagagataaaaccaaaatttattttgaaaaaatgaataaaaaaggaaaaagaattttattattattatttttttgagatagagtcccactctgtcgcccaggctgtagtacattggtgcactctcagctcactgtagcctccgcctcccaggttcaagtgattctcctgcctcagcctcccgagtagctgggtttacatatgcgtgccaccacactaggctaatttttgtatttttagtagagatggggttttgcaatgttcgccaggctggtctggaactcctgacctcaagtgatctgccctcattggcctcccaaagtgttgggattacaggcatgagccaccacgctcagccagaattttttatgtggactactaaaatccttataaattgaccatgagataaagcaagaaatatatgtttgtataatgtatctattacttgtttgtgtgtgtatattgtaaactttagataccaacaagttgaaaacaacagagatctgttaaagtaatgactactcaaaaaaagctatattcgaaaaagatgagctaactttgtaaacatgctataccctgggtgcatttgttgtttctggttggggcaggaggctaagtattcaggctttacaccctgttgaatgctattttttgacaaatgtataaatcagcatagctttgagggaggtggtctagtgcacataggcaatttttctgttaaggcattaggcaaattctgtaccaggctaaaaatataaatggaaaaactctgtaaatgcataatgaaaatttttcggcagtcatgccaaattagtttgaagacagggaaggactctatagaataaactagactttcatgtgaaaagatctgaagaacaagccaggggcaaaccaaatacagactgaagattaccagaactaaatccaggctcaactcagcacaattcttgattgaaataaactgattacccatcactttatctctctagttgagagaaaagagaaacatcttaggataaagacaccattatattagacatttacagtttatttatgtgcatgacatcaggcaattgaaaattattacagatgctaaaagaaagaatgtaatgattgaaagagaagaagaagatacacaattgaaatagaccaagagatgattcagatattttaattatctggtaaagatttttaaaaacacataaacaatatattagagaaaataaacgggaaaactggaactaatacattgaaagagaaataatttagccccagagaactggaatttatgtaaagaatcaaatggaaattctaagacttaaaaatataatatctagaagtaagaactcattaagtaggtttaatagtagatttaaaagaatagaagagaggattaaggaacttgagaaataattgattaacattctccaaactaaagcacaggaaagggttaaaaataccaaaaaaaaaaaaaagagagaaaagaatgtcaaaaacatatgggttcaacaaaagattcaatatgcacattattgaattaccaggataaaaaaacagaattggatagaagcaatatctgaagtgaagatgacagagaattttccaaaattaattagtaacatcaacccacagattcaagaatactttcatatttcaagtgtaatcgagaaaaccagatttaggtatagatgaacagaaacattaaaaatctaaatcaaagagaagattataagaggtgccaaagataaaagacccaaaggaacagcaaaaagactgacagttgacctttcaacaggaaggcaattgaatgacatctttaaagtgctttaaaatgccaacctagaattctttaccctgcaaaaatattcttcaacaattaagatgaaatgaaagcatttttcaacaacacgtaagataaataattactagcaaactttaactgaaggaaatactaaaggtagttctttaggcagagtgagaaaaaaaacaccccagagagaaaaagggaattttaggaaggaaagaagataatggaaagaataacacaggttgtattgttaaacacaaaacaatagcaataaaatatttggggatttaaatatttgtaaaactcaaatgcatgacaacaataacacaagaggtagaaaggagctaaagtgttctaaggttgtagcattattatggaaatgttaatggtaatatttatgttagattataatagttcaagactagtaatgtctagagtaactactaaaagatggcataactcctaaaaactaagtataggtgaaaaattaaataatgaaaataattgattagcctaagcaatgctaagaaggaagaaatgctaacaacaacagagagggtcaataagaaaaaaatatcaagatgggtgctataatcttaaatatatcaataaatatattaaatgtaaatatactaatattccaattaaaaggctaagattgttggtctggataaagacacaaaacccaaatgtattgttgtctataagagatatgccttaaataggatttaaattataagttaagaacaagtaaaatctgttcctataaaaacaaatatagtttttgtagatttgtgatgtagtaattttaatataagatgaggtaatgtttaaggcaggaaacattactaaagataaagggggaaatgtaataatgataaaaaggtaaatccacatgaagatattgcaaagcaacattacctgaataaaataatacagcttcaaagtatatgaagtaaaaattaatagaattaaaaggagaaatagccatatccacaatcacagtgggaaacttttacattactctctggatacatcaatcagatgaaaattcaataaggatatagaatatctatataaaacagttaaaaaacttgatataattgacatatagaatacactccaccaaacaaaagggttttcaaaggcatatagaatattcaatcatataatgattcaaaatgtagaaagtcaaattttagaatgatttgcaattattcagcaagtattgtctgacaactatagaattaagctagaaaatctgcaactgtgtggaaattaaacaatatacttctaaacctatggacctaataggttggaatggagtttagaaagtattctgaactcaataaaaatgaatttattgctaaaaaaaaaacttggtggtgtgaaattgcagaaatgcttagaggaaaaaatgaccttaaagagagatattaaaagagtagaaatcctcaaaactcaatgatcttaacttccatagccagaagctagtgaaagaacaacaaatgaaacttctctaaagtgaaaacattctaataacaaggacaatagcagaactcaatgcatatacaataggggaaaaaaagcaataaagccaaattgctttttagtgtttataaaattgaggggatccttatcaatagtgattaaacgaaaaaaagagtaaaatcaccttttgctaatatcacaaataactctatagatgattggagagagtacattatgaacaagtttaagccaatatatttgcaatcagggtgaaatagacaaattctttggagaccacaacttgaaataaattaaaaatctgaagacctttttattcattaaataaattgcatcattaatcaaaatcttttgacagaaaaaaaaaaccattttgtgttcacatgatttcactgaaaaattcttaaaaatgtttaggaatgttatactaccaatatacacaaattctttctaagaatacagcagaagtgcctcccatctcatcttttgaggccagtataaccttacttattgaggatacgtgtgattgtcaaataacagattactgaactcaaatgtaataggccaggcacggtggctcatgcctataatcccagaactttgggaggctgaggtgggtggatcacctgagctagaccagcctcagcaacatggtgaaaccccatcgctaccaaaaatacaaaaaattagccaggcatggtggttcacacctgtattcttagctactcaggaggctgaggtgggaggatcacttaagcccaggaggtagaggctgcagtaagctgagatcgtgccactgcactccagcctgggtgacagagtgagaccctgtctcgaaaaaaaaaaaaaaaagtaataagaattttaaaatgctgaataactctccataaatttataaataattatgatattatttcccacactgtattgtaatacatatgtacatttccatctctctttctaaacttgtatttgctaaaagaccacacatcatcgttatgcaggagaatgccactgagctactacacagtagtgaggaattatagaatcagttaagagcattttaggtgtttataaataagcccatttgatacatcataaaacaaatgcaataagttgttcttatcaatatattctaattatatgtttccttaactatctgttcttcaatgttggaatcatgttttatgcatccctaggatcaaggaaaatgtcaggcatatgaacaatgctcactggaatgaaatcaaatggtaatagagtggacttcagtaattgtctagatctacaaatacagctgctggggactttttcttcccctccactattgcatggataatgaggtctacatctctcacgtcgattccagcactctgtggtggtagcaagcaaaaggaaagtaatcccagcattagggcacctcaaatcagggctctttaaaactaaccattatataaatcactttgatatctttttaattatagattatggttctcttagagtgaggcctaagttatttcatccctaactgctatgtgattacattcttgttgcctgtcaaacatattttgagttgtaaggatttaattactgggaacttcgacatagggcacaaggtgagttcttgatttctggccatcctttgaatcagagatcctagggtacatcttgataattgcgcataaacaaattcatcacctgatgtatcacttactgctgataccacccaagatatcaagtgaaataaccacttgacctaaggggccacttaataggaaataattcttatgtggaccaattatttcaaggttttcagaaaattacagtggtgtccattttttaaaattcaaatatttttaaatttaaagccatggaactcttaatgctgggtaggttatacccagagctctaaggaaaatttaggcttaaattcttcctttaattcccaagttacattatgctgcttttgtgtggtaaaattcttttagaaatgtccccatcctttctccaaggtggatctgactccaaaatgtatccagacatcctctagtttttctttattttcattataattgaattttcagaagcaaaagatctcaattttcagggtattctttggttgaaaactacaactatgcttgcatatttccacacaaatgttggccttccttactcttgtggttaaaacaatttaaaccatttcatagttctcttgtttcctctcataacttgagttgaattctttccctgcataagatctagatggcagctacagttcctatgactctatgaatgaactgctttaatttgtactttcttactttgacatcttttactattcctaaaacctctttcagattccccagtggatgtcaagaaccccattttcttttttgtgggcctcaaaaaatatgatgggtattgaaagagggtccttccaaacagaagagtccccctgagcatcagcaaagttttggaacataagctagcattatttcttctgggtgactcataggcaccatgcatagaaaatgttcgtagaaggtcctcccaaagagcaatgagagcaggtaatcagagttgtttgaaacttagctgtcttcacaagatgatctgttactcattcaaaggcataccttacccaattactgcaacttcttactctgttctctctggaaatggacttttatggttttatctgttctcttttcaatctgttagtaaaaaataaactatgtgcagtttcccttacccaacatttctttctcagcaaccttttattctctcatagatcaaaagctttggtttcaaagctgttatttctgatgtggtctttgagaggctcttttgaaaaataaaataaaaatcaagcaccaaccatttctttctttttgcattcctactaaaacaatgctaattctctttgaagcaatgaggatattactaactcagaagagaaagtttgcaaaacataagtataaaaattaaaagcacagataataacattccaagatagtatcctgctggaaataaaataataacaaatatgaacatgacgtaagcaattaccatccttgtttgtctctaaagcccactctatggaaattattctaggatagtaatttttattctgtcccccattttaaaaacctgtgcttgtataggtttattatttatggagtcatgtaaaataacaagaatacatttgcattaagagttccatggctttaaatttaaaaataattgaattttaaaaaatggacaccactgtaattttctgaaaaccttgaaataattggtccacataagaattatttcctattaagtggccccttaggtcaagcttgtccaatccacagcctgcaagctgcatgcaacccaggatggctttgagtgtggcccaacacacatttgtaaactgtcttaaacattgtgagttttttgtgtgtgatttatgttttcagctcatcagctatagtcagtgttagtatatttcatgtgatccccaagacaattacttttcttccagtgtggcccagggaagccaaaagattgggtaccctgccttacatcccaaaatagtttcaaaatttacctgaaaagtatgtccaattcctcataccaccccagcccctggtgtgcttttggtctttgataagttctgtgatggctgtgtcaaaatcaccgcctttatttaaactactacccagacatgatccttgggactcatttggaaactaaattaagattggcagttgacaaatttgctttagagggcagaatgtcaattttttttttttttttttaacctgtggattcactctgggacaattgatgctttgatgaaatagggggaaattatataaaaatacaactcaagggatattaaatagcaaaatttgtttctggcatccagggttatttggcaaagaaagagcaaacaagtgactgtttttcatgcctttcatatgatgacaaacctattctattctgctttgcacttaaaatttacattgaaaatgcaattgaacctttggtttagtagttcagtacgctacaggtaaccagggagcaatgttcagtaaataccgtgctactagatgcaaaacaatacagagaaaatgaggctatttagctctctttcttgattgagatttgcatgaagaaatttcgaaatatttaagtttcagcgtagcacttagagtgtcacttctcttccgcctctttataggttatatttttaatttttaataacgcaaaatgtgtatacagcctgatgcaatcagaaaggcatcttagaagggtaaaaagaggaggatgactcactaataaacagtcatttatagaatataattagtttttctcttttcttcattagcacatgcaacctgctagaggaatgagtctaagggtaattgtaggactccagggttttcacactcagaggtagcataatatataaaactgaagtaattaggagctacgtcaaaaatgtcatctttcttatgtgtaaaaactaggcattttgtagcaaaatagcaatattaataccacagggatactctgtttcttttccactctgacagaaaaatctctagtgataggtcctcaaatcttttatttaaattataagtgagaatgagtttggtgccctcaattagtccttagaggggaaccaatagcacacaagcaggcacacttcttgcaattgcttctgaagagatctgtagctatataggcactcgcaaaggctgtgacccccccggaaggtacacccagtacactcgattcaccagaaagcctacagaatgaatggactcgagattttgcactctggttttatgagtacaagtaatccattgagaaatttttacacccagaccccccagtacttattttctaacgcatttctgcagtgtgttaactgcggcatcatagtgtgctacataatgagtccaattcttcttgtctgtttcttgtttccttctcaatgaaaaataaaaaacaaagatagctgagtttaatattgccaaatagccaaataattagtacaactgaatattattttctctttaagttatacctcaataaatataaagctagaagcatagttttgaaaacaaagttaacagaatattatctaacagcaataatgggtctgaaatgttccatgcaaggaaacataaaatgttaattgcttacgagataacgagacaagagtgtttccctacaatcttgtaactctagaaagatgagcattcttagtctgtgactaattccattgtttattaattccattgttttttaacagtgtaagttggtcaagagcagtggctcacacctgtaatcccagcactttgggaggccaaggtgggaggatcatgaggtcaggagttcaagaccagtctgaccaacagggtgaaaccccgtctctactaaaaatacaaaaaaattagctgggcatggtgacgtgtgcctgtaatcccagctactcaggaggctgaggcaggagaatcgcttgaacttgggaggcaaaggttgcagtgaaccaagattgcgccactgcactccagcctgggggagagagcaagactctgtctcaaaaaaaaaaaaaaaaaaagaaagaaaggaaaaaaaagagtgtaagttaagttttagcagtgttgtgttagagttttcttttataaaggtaaaaaaaacacactgtaaatgtgatttatgagggttacaacattttccaagtttatatcacttccctggttgtgttttattttctcagtgattccattctgtcgagtattgcataagatcaaagtctctctaccagggcacacatgacgtgatcctgtttggaaaacattatcaaacagtcaagctaaaatgcaaatgaacacaaaccctagtattttctcttgacaactgtggaattactaaacataaagacatgaagattgagaaaggaagggagtaaaacaattacatatttaaaaataaggagaaactggattggttttgatgataaatttattggtactacaaaaagctctcatgacaaaataccatacatgtttatacaaagtattattaatgaaagaaatttggtttcagttttatattattacaaggtattttataatctaaatatttcatcatatgtttggccgaatttcaagttacattctcccagcgtgtgttaaaaggaaaaatacaacatgaaaaaacaatattttgagtgggatgtgcaggctgtctgtatgtgacatgtatcacccctcagatcttcagggtctgttccatctgtgtttatttttcctgaagctgtccactcacttgagcaggctgcccttcccagatagagaaaagccagtctttgaaattcactagaattgctgttctcaggatttttatgtttgtcttaattgataaactgccttaagagaaaggatactcaagtttacttcacactgaaatgttctctttaggaaacatacattttggaaaatattaaaaaatactttaccctgactaaaaacaagttaccatatatggtgattttgcatattcaatgttcctgtatattccaagtatacttttagtttatgtgtcaaaattaggtacatctaaatcactggcaaatattctttttcattatgattctaattcttgttccattattataaacatttctatacttttctaatatgctttgctgaaaagaaaataatagatatttgttaaaaatttttctgaacattctgggttgatcctcacatttgattgaacttaagcaatgtaaaataactcgtaattttcctcagctttctaaaaacagagtttggatattgttctaagtgtaaggaaacattgaaaaacataagtatgatatgattcaaattatagttataaatatcactatgactgttgtgaaaataactctggcaggagcaagagttgcaagaggaaaatcagtttgggtatttttgcattagtctaagttagagatgcttttggctttgattgagaaagcagtaatggaggcagtaaaaagtatatatcctaatgtcatataagattacatctagttatattctcgatatcataaagttagtgctacaagatttgctaatgtcatggatgcagggtgtaggaagggagtgatcaggtttgacatctaggtttgtagtctgaggcatcagaatttggtgtttccctttgttgacatgagaaagacagggagcaggtttggaaatgaaagtagtatgtgtgcagaatccatggctctattttgtcaacatcaagtcttggttgcccattagacatctcaagcagtgttgtcaagcagggtgtagggtgtgtcagtctttaattcagatgctttttgaacagtagacaggagtttcagtcattagtatgtaaatagagattaaaggcacatgaaagaatgagatttcttaggggagacacttagggaaaggaagagagctgagaattatgccccagggctctgcaacttctcatgtctgaagaagaggatccagaaaaggagacaaaggaggagtgcccagtgacgtaggaaggaagccagggcactagtgttcaagagctttggttaaaacactgacagggaaggatgataaattggataaggatgaagattaaaaagtgaatattaagtatggcaaagagaaagttattgccaactttgctaaaagtggttttggtggaaaaatagtaaagagagctttattaaatgaggtgaggtgagaaaatgcagacagagagtaaaggcggctttttcatgaggtcttgtagtaagatgctgagaaatagggatgcaggaaaaaagacacagaggagtccagggaggtttgttcatttgtttttgttggttttgttgaatacagttattggaagatgtttgtatgctgatggaagcaacatagtgagacggagaaactgatggagtgggagcaaaattcttgagtaacttagagaggatggaaaccagtgctgaagtacagggtttgaccttaggtaagaaaagggacagtgaatctgctgcaaggagaaaatgcagagctgatgtatgtagatgcaggcagactggtagatttggtggtaaggcagttaggaaactcttttaattgcttcaatgtgcttcagtaaaatgagtcaaaggtcatcaatttaagtgaaaaggtataaagagagttttgaaaaaaaaaatggaaaagtgtatatgaatggagtgacccacaagaatctatttgacattaattttctaataatgatgaccccgatgtgctgctccattaacagggttgtcaagtgttacctatgacctatgaaactcatggaagctggttaggttgagcagcaatgatgttagccaacatagccatttgcttgtaactgttactgcatcagcgtcacgctcttttgaaccaattaaggaaattagattcagagacctgactagcgagaaagcttatttagcatcaattttctgtattggtttcttacgcaacaaagttataatttttctttgtttttaaatgttatcagtaattaaaatgcaacttcagagtgtcctgtcctacacataattagaaattaggacaaagtgttatgtgcaaagatgttaaaacattatttatactgggaaaatataacaacctaactatccaacagtaagagaatagttataatatatccctaggtggtttattttacggtgcttttaagatcagaaaattagttctaaaatgataataatatattaatagttctgtaggaaagaatttaacacaatggcatgcaagacactggctgaaatggcctctgctatctcctcagctcattctctgcccactatcccttgcagattcctctatggcattctactttctgctgtccttcaaaacctccaagcagatccttctctcacttcattttttggtgttattccatctgcctagagccttgtttctcagacctcctcatggccttagacatgagacatgagaaaataagacaactccttatcttcacgtaggtctctggtctacggtcacctcctcaataaggtcttcttagattattctgcctaaaacacgtgctccagatcccactcctattacttgtcttcactgctaatcatggcacttatcatagtctggcattactttttacacttgtttacttgtggaatgtctgtctttcctgtgaaaatggggacttacctcttccatatacgtatcaagaacaatgccagtaggtactcactatatatatatatatgtatataaattatatatatatgtatataaattacatatatatataaattacatttatatatattacataaactaatgaattgataatgcgtcaaaggaatagcattttaatatattctataatgataaaattatactttgatatccacttttgctcacccagaaagttctcacatcatttaggtatcagtaaatgtctaaaaggaagcagtacagactttatacaataaagaacaaaacaaaacaaaaactgaggtagagcagataaaaatcagaaaaggtgctccccattcagctgaagaaactatcagctcacgagaaaatgttgttgaaaccatcattttctccagaaagttaagaggttacagaactcagaaagaagggggaggaagacattttttaaatgaagaaacacagaaattatttgtagtcagaataaacaccagacctctatcaagaacctaatggctcaaaaactcttaatcaagtactgctttaatgttacatagagaatactctctaggttaagcctttgcccttagttctaagagacataatgtctgagggtgcctgcacatagtttacattggagtatgaatagagaatgtaaaagaagattctaatagtaggtagcaggaaaggtcagaaaagcaatgaacagttttgagatttgaagtgtttgtgtgggagaaaggtgcaaagaaattgaaatttaattactctctaattggagatataatgttgcttaaaagaaaaaattacaaatgcacaactctaaaaacccaccctgataaatcacatatcatatccacttcctttcagccacacatacatatgcaaagacatagaaaatgatttcttttcatccaagtgtgattaaatgagatttagaaaatggctacttggtgagatttttgtaaggcactgaaatcaacaatttttatggtaaagaacatatgttggttttgatttattatttattttccagtttgaataatgcaagatgtttttataaaaagttatggggaaatgctaagcagacaaaaaatctcatagtgtgaaatacatgagtacattaaaaaattgcaataaagcctcctgcaaggagaattagcattgagtgtatgcaatatgtattttccccaagcaaatttaatttgatacatattttcaaagtttaaaagttttctctctttattaaatcagagaacatgtgacaagtataaacttccctacatcactgcctttgtttaagcttaccctacagttagaggcccttctcacatccagcctcaatcttccctatccaatataaaacagaataatgtgatgcattttagaattatgtttttataaatttctctactataaatatcatttatctgactttgatttttattctttcttggaaaaatgacataaaaatccatgccatttatgatgtttgcttttatctagatgtatcctaattcataaaaaaaagacgtttcctttaaaattgatctattggttaaattctgaccatactccctacaaatcagcttctggatcaacaaaatattcttgatgaaggaactttggtattgtcagccatgttgatggatgcttggtaaacagcaatatattctatcacccatttaaggtgggtttagagttttctgatctatgggactagcaaaatgttgctttagcaaagactttaatatgccatctagatggaagacatattataataatatcactaaaaatgggtgatatttaatatcagtgcattctttgacattggatattttgaaacaatattctacaaatcttcagatctcaccatttaccattattctcttatttcaatctactatttctttcttccttctttccttccttcctttctttcaacatgtactttttgagaatcaattacatggcctgggcccaaggatcagggcagtaagcaagccagacccaggtttcctagtcatatattctaaagcctagcagagaagacagttaattaaagcataattgcaatggtgtgtgatgggtgtaataatggagcgtgtaccagatggacatagcactgggacttaactgaaatttggggaaagtctccaagaagcaatatttcaaatggtacctaaaggatgagtcagagttagccacagaaaagttggagaagaagaaaataatcctgataaaaagctgagaacttcactggccaggagagcaagagaaagaggaagagaaatgtgaggggtgaggctggaggattaggcaggaattatattattgacagctttgaaaattcaccattgaactttaccatgagaagattgaggtaaatggaatgatttttagcgtggaatgacataaaatagtttgcattttaggaatataactagagtgaccctcttcataattaggttgcaataatttgccttgggagtcctcaatattgcctgccagtaataacaggggtccagaaatccatattctcttcacatgagactccagcctcctttctcttatgtatcttggtctccattaccctccagaatcttaagatctcaagagagaagagttgagctttttgaatcctgccacattgtgtcaaccctgctggctgtgtggataccacctgaactatagaagctgagtgaaatttccagtccctgtgtacactattggtgtcagtgtgacttcttgctccagtattctttacacttactgaaggggcccctgtgaagcaggttcactgtgcacccattatcacttcagcccaatgcactttgggctgcacttttactatttgtctgagtctggtgacagaacactcacactccatgaagtgggcttattacttatagataggcagcaagggacagcaaaagcctaggattcatggtgtgtcatttctcaaggctcaggaaagctacccagggtgtgaagagtctcatctgtgcatgtcctactttcaccacaactgaggcaccctggaaagcagcttgccctgggttttataccctatgggcaacaggatacactggggtaaagcactgaaggacatcctgttcctatgagtgactggagcagagtctttgctatactggcacaggccagtttctccttatttcaggatgttgcattcccagtgtattccacagttattcttaagaattacaagtgagaaagtggggagaattggatcagtccaaggccacccagagaacattcctgcagcacccaagcacactggctaggcccttcaggttaataattttttattttgtcactgcgcttcctccaccagcactggcatcttcctggatggtggggaagagaatgttgaggcagctgcaatttccatggtggtgctacagagttatgggttttgaagttctgttcagttaaagaatgaggactgagagcagtggctcacacctgtagtcccagtactttgggaggctaagactggaggatcacttgaacccaggagtttgagtccagcctgggcaacaacgtaaagagacctgactctacattttttttttttaatagctgggcatggtggtgcaaacctctggtaccagctacttatgaggctgctgtgggaggatgacctgggcccaggagtttgaggttgcagtgagccaagactgtgccactgcactccagcctggacaacagagcgaaaccttgtctcaaaaataaagaaaggaaagaagaggagaggggaggggaggagaggggaggggagggagggagggaggggaggggagggagggagggaagaggaggggagggagggaaaggaggaagggagggaaaggagggaagaggggaggaaggagagaagggagagagaagggaggagaggagagaaaggaggagagaggagaggagagagaaaggagaaaggggagaggagagaaagaagggaggagagaggggagtaaggagagaagggagagagaaaggagagaagggaggaaagaagggaggaaggagggagggagattggttttcttcaacatcccaagttcagcttctcaattctttcatcatttatgtaatgaattccctgccttataaatttagtttctaatagtgcaagtgctttctttttttctgaattggccccgatacaggttttatatgcagtaagaataatggcacagcaattctgtgtgggaaaaaggtgggacagaggcttggaaaaggtctagaagtggaagcttacctgactgcagagccagtactgtatttgattatcatttctatgattacaaaacatctctacagaaggaagtatgtgtgatatcatcttgaaaaatccatcaagagttcagttgtagaactatgatgtcatttgcacatcaggaaagacattttgaaaggaacttggcttacctttgtgaaatgttagtatagccccattatcttgtgcaatcccagtgtcccttacctgagtaatttccttgttagtttgactttttgtgttttcagaaaattaacaaaagttctggaagaaaatgccagaattttcactgagtttaccaaggagaagaggaggggatcaggcactagaagggagggagacttttacttttcatttatataccctttgaaactgcttttacatattttcacgctatgcagttattactcttctaataaaatttcaagaagaaatgtgctccattgttgaatagttagtacaaggatcaacagaagcaaggggcagccaccgcagccacactgcgtcccagctattcagtaacgcagcagtattatgactgaatctcatctgtgagggctgctttctctttgttcatttaggttcgggatttccttaagaagtaactatgctattgtcaagatgctgaggttgaaagaatctcccctgcaattcagtgtatatacagcacaatgttagagcattttagcagcaagacaatatttcctagggactatatttcatgtctcacttcttcacatgtagatgtgcccatataaatagttctcaccagtggaatactagcagacataatgtgtgtcatttctgggaaattgatttttaagaattgagtgtgccatccaggatctgtctccttcaactggctggatgtagacaacctgatgaggtcttaaggaggatagaaaagcaagggctggaagaagccaggatctttggatcattgtatggagcagtggtgcaagaagtctcatctggaaactcttggggaaccctgatactctttggagggtctgtgaagtcagaagtatttgtctaatgacatcaagaaaatcagagatattagcagatgtgactttttgatattgtataattaaataaggtaacatttgggagatctgtataacttggcaaaccaatattttccaaatgaccaagacgtgacatagaaatcatctgaggataaaagattcatttgaagttcaagatacaccaatggatttcagtttaaaataccatgaaaagctcattgatatggcccagattccacattgcaagtaacctttaaaagactaccacttgtatcgaagtgtaacttcaaagaagactatctactattatttgaaacattcacaaatgtctggaaggactacgaaattgctcttccctttacttagtatatttccctataagaccagatgcaaatatgtatatattagaaccaaagcaagatgtgacaaaagtataatgaaaaagcatatatgaaatccaactgtcttctattaagctatagacattatagaggtttataaaaatgtaaagcagtgtcactcttctcactaaaatttgtttgaaaatatgtagttttttctaatcaagtgcattacttatgttaacatagcagagttattactacttttaaagaaattagtaaatattttaaatttgttttaatttttatatctataaatattcatagctatcacagaagtaaatcaaaacttttacagttctcagtaatatttaagagtgtaaactggtcttgagataaaataaaaagtgttgagaaccatttatttggaagaaagccatttgcttagtaagaaccaatgtatgagaaataaactccattgagtttaggcactttgtattttgaggcctgcgtgttacagcccttaactataacctaactaatgcaaacccctgggatagctttccagcacctaaaagtgagctatacgtttcatcgaacttctctataacactgaattgtagacttgaatatcttctcgtctacagttaaggagaagacagtacatggagactgaataataaagattagccaaatataaaaggttttgagaacttttaaaaatggaagtttcttgtattctttaatgacaaaataatttaatttctactaaacactgatcaggaatcacaatttgtaaatgttacttttaagcaaaacatgagtatttgtgtataatgcattatttgattctaagcttctcagtgctttagtatgaaagcacacattttgtgttaaagcctaactttaaggcaatgaaaataatatcttctctttgtttcctgtcacatcaaacaaattgatcactttatttactatagtaaacagtgcaaccaaaatggtgtatttgtatttagaggtatctgggagtttagatggtttttaggaacagtatttctttttctctcattgttagatttattattgaggtaatgcaattacccattttttttgcattcatataaaacatgtaagacagatgttttactgtaatcctatatccaatcaatatattatttaaaagactactgagtagaaagaggaaaatgcagtttatattgtttacatccttgatgcacacatcctttctgagaggagaaaaaaggagaaaggagaaattgatttatgaacaatctatattttattcattttccaacttttctctttatatccatcataaatgaaatcagcaacagtcaggcacctagacaaattgaaacaaatgcgagctaaaactctgatgggcccagtcccattctggtagagttctgtgtaatgtgttcctggattgcaagtttgatcttgaagatattctatgataggccttttccaatctgctcaagctacacaatattggggtagttcctgtcctctaattctctgccagattgtcatagctaatggcagacaatgtaaaagcaaggaagtttggtggagctgtgagattttgctatcctcaactatatcccacatacaaagtaagcagaagaaaacagtaccccaaaatctattaaagggaacaaaacatgctatataattaatgcactgtctcaaggtgaggtctaacatttattttgttacaggtttcagacttgtttaaattcatcttgccaagttcagtttatttgtggtgacaatttaatcacaaatgtttgatacccttaactattgtgagagaaagagaaggagaaacaaaattacatccgttaccatggcatcatgatatctgttagttttctggcctgtgcctgaaaccatccaaagtggcttatatgtttcacaagttactggtccttaccacagtcaaggaggtaaatgctattttcctcctcacttttcaaatcaggaaagcaagcatagcggttagcattttttctgtactgcttcactttaattatgttgttcctccaatagtgtcaccattcatccagtttctaaaaccagaaactggggaatccactaggatttctcccccaggcaccctttcctttaacaagccatgttaattttacctcgctagtgtctttgctagaaataatatccatcctcacagttgctggctgacatcaattatcaactcttggctgacccacagataaacttttccaaaccatcttcccagagtttgactctctccaatccatttttttgacactggaaacagggtgatctttctaaaagggcagattgtataaggtcacttacccaccagaaacacttcagtggcttcctgtaagctacggaataaaatcaaacatctagcttggtatataaggcctggcacaattgacctctgcctaactatctctttcttccctcacctcccacagctccttgaacctatacccctgacacactggattggatctggtgggcatgctcttgtggccacacacgtgctgttccctcagcctggcagagtgttccttcattcttactgaccttggataaactccatttacacacacactcagctccaatgccaatctcaaggaagttttctctccacttctgtactagcacctatcatgtacttatctctgttattttgttttcatcactctgtcttccatacctggacttgttaggaaaagcttggacaatcagctagcttggctttaaacctttgttttcattgttctgtattccatacctggacttgttaggaaaagcttggaccatcaactagcttggctttaaatcttggctcttcctgaatgatcttacatttctctgtttctctgactctcagtctctccattagggaaataagaatattaattatacctacattagacaatgcaaatatgagttgatatcagaggagtaccattcttagctatgggctcatatagtgtaagtattcaataaacattaattatcagtattagccattctctaggaacataatagaaatactgctatcccaaagagttgtcttcgttgtacttatcactctctgaaattatcttgtttatataagttaattatctgtctccccagacctggaaagtaagattcatgagaacagtgaacttggtaatgaacttggtaaccttgttcgctattgttcttatcacccgatataccatgggaagtcaatatgttatctgagttaatgaatatatttagtagaatattgcagcaatctaaaaaagctgacatgagcaaggagttgagaagtattcaagcaggatcaaagacagattgaactattgcacaggattactctatatcatcttcaccaagaataagtggggtgatgtaggactttttgagaccgcattgataatttgatgccacttaataattaaattatgtgctttatcaagacacaatggattgtccctattaatcacaaaaattattgagatgagcaaggcctaatacttatggcttgtatttgcttgtgatacacaattgcttacaatagtttgactctcttgcacactttctgtttttttgagacagggtctttatttgtcacctatgctggagtgcagtggcatgattatggctcactgcagcctcagcctcaacctcctgggttcaagcgatccttctcacttcagcctcctgggtaggaaggaccacaggcatgtgtaaacacacccagctagttcttgtatttttttgcggggttttgccatgttgcccaggctgctctgaaactcctgggctcaaatgatccacccgcttcagcctcctaaagtgctgggattaaaggcttgagccactctgcccgtctcttttactcactttttaaattaacgcagtcaattccttttaacttgctttctaactataagccattgatgttactgaatggccatgaatcattaatttcacttttgctgaccatttaaaataatatccctgaaattgcaagaatagattccaaatgagaaaatagctgcagaaaaatagtatcatggtgccaaaagtctcgccaagttaagtcacgtgtcacaaatggaaaaagctcaacacctgaatatattttcttttagccagctatgaggtataaaaagttctgttggacatttaaaggccaattggagggcaatgccatcagcaggactgggcatgtcagggagatggacgaggtgccttgagaagctgtgaaaggagaaacaggagtctcttagccactggcagccctctcataatttcttgagactgcttatagacctgttgggaggcttctcccctctaatgtcattctctactaatgcagccaatctccacctcagcaatgcacgattataaccaccccaaatgcacgattataaccacccctagatctttttaaacataaagatcaccaggatctggccccgactcactgaatcggtgtctcttaaaactggaaatttgaatttttaattctgtatatccacaatgatcataaatccttgtttgcccagttcagtctgggtcttcacttgttcttccactataattcattccaaaaaagctctgtgtttggacaataaattatgtgttcaccttacctataggtgaacacatctatctttatgttctataggtgaacatatctatctcatgagtagccaagatctaccccctctcaaatgctgtttctcatatttatgctacatatttatggagttcttgctaaaatcttccactgatacatgtacatactcatatatatgtagttacttcaaaaaagttcatgaaaaatagaacaaaaagataaaaataaaaaatatagactttatttctcagcataatctccatcaagtttaagacacttatgtaagcaatgatatcagccatttagcccatttctaaagaactgggggtcctgggaatataatcagtcaatgcagtcttttttacattattaattgaagaaaaatgggtgtcctttaaagattttttaagattagaaaacagaaagaagtcagaaggagccaagtcgggactgtaagatggatgcctaatgatttcccgttggaaatcttgcaaaattggccttgtttgatgaaagaaatgaacacctgtcgaggtagagaagtactcgctggtaacgccttcctggatgtttttctgataaaacttggctaactttctcaaaacactcttataataagcaggtgttatcattcaatagctttccagaaggcaaaaaacaaaatgcttgagcatcccataaaaccgttgccatgacatttactgttgactggttcactgttgctttgactggaccacttccacctcttggtaaccattgctctgattgtgctttgccttcaggatcatactgctaaagctaaagttcatctcctgttacaaatgtttgaagaaatacttcaggatcttcattccacttgtttataatttccattgaaagctctgctcttgtctgcagctgatccgggcgcaatggttttggcattcactgagtggaaaattggcttagctttaatttttcagtcagaattgtataagctgagtcaattgagatgtctgtggtgttggcttttgtttgtgctgttaattgccaatcctcttcaattagggcatggacaagataaattctcttctcacaaatctacctggatggtctgctgctgcaggcttcatcttcaatatcatctcatcccttcccaaaacaagttatttatttgtaaactattgatttctttgggccattgtccccctaaaccttttgtaacacatcaatgattttacaattcttctacccatgctttaccatacatttgatgtttgttcttgcttcagttttagcagaattcatgttgctctacttggggctcttttcaaactaatttcttattcttcttagtgcctcagagtagatccttttcatacatgtcctaagttaatgtgagtttattttggctcaacaactttgaaatccatgcatagtgttttgaaaacatgcattttccatgaactttttgaaaacttgtataaaatatatgagtgtacacttacatgtatgcatatacatacatacatttatatctttttaaagttgattttacaatagaaaaatgataagcaagcagtgacatcatgtgtctttagtcttctattctgtaaaaaaagtttggacctaattaaaggttttttttttttttttaatcactgtacttcttgcaaagtgtgtgaaagaacctccttgccccattgcatgaaactgaattcacaaactgaactacttcagaatatttagctcttgctcctagtcatataaacaaagcatcagactcaaaggcaaagaaatagtatgccaatgcctggctgattacctgtcatcctcttatctatcattttatgtccagaaaacaacagcattaggtgaagcttgaaatgacaaaatgatccgcatgataaccaaagcatatgagtaacaaaattccagtctaatgtttgtgtatagcttttgtgtttgcaaaattggatttttttcaaatccagcgtgctaccagctaaatctatagactgatggtttaatctatacaaatcagaataagaatacctatttttcgccttttaaagatgaactagtttgtttctaaaagctatgacctcagagaaaagttaatataatctgtgccttgtatatctctgcatctgtactccaggcccagtctgagacctaattggtagtcaagaaatactagccaaattaagatgaataatttaaaaggcaaatggaaacagcactgttctatgtgggtagttctcgactagaggcaatcttgcctctcagttgatacttggtaatttctggagacatttttggttgttataaggagaaggtgctactatcatgtagtgaataaagacctggaatgctgttaaatatcgcccaatgcacagaagagccctaataacacaaaattatctagcccgaaatgtcaacagttccaaggttcagagattctgctctggttcaataccctagatctagactacttccacattttttaacctgaattattaattttacaaaaaaaaaaccctgcttaccctcttgttactattggataaagatcaatttcattgacttggacatcaggacactgttaggtttatttattataccctttctattcactattatgtcctatttattactcaggctagaaacctctacggtggtggttctctgtaacacactcacctggacagcttgttaaaacaaatgtttctggggttctttctcagagtctttgatttaactggtctggggtaaggactggtaatgctgatgctgctggcccatgtgccccactttgaaaaacactgatctacagtaatgtaatctacctcttcatattccccaaattatttcactcctccccttcttccaggttatttgtaatgcagacctcctacttccttttataaatacaatcaattttcattatttgagggttctatattttcaaatttacttaataaaattttctatagcctcagaattaatactcacggtgatttaatgatcattagtggacatatgcaaagcaaagaaaaatttgagccttttaatgcacacgttcttagctgaggttgaacaaagagatgctctgccttcttattttggctctcatattgtgaacaagtatgccttgtatagtctatttagtgccatttttggcatttttatgctttttttgtcagtgattttcctgattaaaatggactccaagcatagtgctaaagtactgactactgtttcaaagtacaaaaaggctgtgatgtgcctttcagaaaacacgtatgtgtttataagctttatttaagcatgaatgatagtgctgttggctattacgtcaatgttaataaataaataatatgtattaaataaggtgtctgtaaacagaatcacacataatacaaaattatatattgatgaattcacctaaatgttgtaaccagaggcttataggaacctaacactgtatttcccctaggaacaatggttcagtattcactaattcagtgtttgctgtgactttatacacaacattattggaatgagacttaagaactgactgtaaataaatctttctcacccacctcccactactttttctaactgccctgtctcccacagggcttcctttcttcctattaaatagctcctcctatctgcaatttaaaaattctgcctcagcaatgctggtgttatttcataatgccctgctgggttgagtttgtatttgatattgtttggtttattctgtgttaagcataatgttgggtacttgataagggtttactaaatattactgaataagttaattcaaatgcaaatatgttatctcagtggagggacattgcaatgttagcaaggattctttttctaatctcttggaacctaataaagccctgaggaaatagactaccttacaagtcagtgttaagaaaaggtaagatatgaaatgattttttttcccaaaaggtcaaaactgttagatcctcaccctctttctctctatctttctctctcctttcctcatctctgtgtacatttgtgtgtgtgtgtgtgtgtgtgtgtgtgtgtgtgtgggtttgaatctgtgactgtagaaaagaaaataaaagataatttattggcatgttagaaaaggaaaaaaatagacatgacagtaattgctgaacaatgcacccatttccattccctatccgtggcctcacttttgaccccagagtagaaaactcttaggtagatattgcttgttgaagagggcatggaaatggatattcctgggccattaacaagctgtgtgtgagtccccatcttttatcctgaagatatctgaaggcttaggttatgttagcacactcagcctgacaagatacagtagacttaataggtattccaaagctctgaaaaggtacagtgttctttcgtctttgctgccagtgcaaagtggtttttctctagtccttttctagcaaagctctcaagctctcctcctatcaacaactcaaaggcgggtgggtgaggagttacttttcattagtatatttccacctaagactgaagcaggggattttaacaaacgtttcttatttgaggtacagcagcactcagggagcttgggacatggctgtttactaaccattctggaactatttcaatactctagcaattaggcaggctgaagcaaacaagctcgagatcagctatgaagacaagtttactgaatgagaacattattctgtcttaataacgttaaccagtagaaaactggcttttattgcttaatatgctatctgaacactatctggcatgtgtcttttccaaaggaagaaataccatctgcagatgaagatttgtaatacagaaaaatacctggttcctattttctgtaccaatttgaaggttagagatacatgaacagagttcaaagaaatattgactacagaatagattaggaaaagtccagtgatttgcaaggaagatgaacatatgagatctacctatggggctttcccttcttaccttgcccagaaaataatgataggtttctctgtctacctcagcacccatctgtgaactggtggaaggagccatgtttatcaaacagagagtggaagaaagcaccagaactgcaaatccagaatttcagtctacagagtaaggaagggacaaggctggccctgcatctattcctgtagaccctgcaatgccaggggatatagcacaaggccattgtaagttccatgaggaactaggaaagagaaaaaaaaaagagaagcatctaaaaatatgttaaaagttcacatttctggtgctgttttggacattttttatgggaaagttctttgtaagtaatacaatatctttgaaagaaatttttgctttcttgccctggtttccatgagatgaataactatatttccataacctgtgcatagatgtggatgattaacaaatacacattgaatggttaaagccttgctatccaggataaaatgatccaaacatgaatgcttactgagtagtatcaggtaaagctccaagtcagtacaagtctacagtgaagaaagatgtggtaaaaattattcttgtcacaaacttacctgtcagctgatgaagtgatgtttatatgtgtgggcaaaaggggttagcaggtgtctgtaatcactctgtcctcttgcctttttgttttcttaatctgtcagtggcaatttggtatgataggaccttttgaagtccagggctgtgcctctcttgttcaccagggcctgacacagagtagctgctcaataaatatttgttcagtgaatgaggagccctttaacaattgggaacatatacctctacagagcagtggactctgaatccattctgagatcgcttctgcttccttgcctcttaaaatccaaaagagtcagaacacacaaagagagctctccatcaagtaaaaatcccccagtgacaacagagtctaaggttaaatataatttttcaagttgtcttctaagattcagagttctcagtttcaactcactattcccagaggatgttcaaagaccaggaaataatgtgaaaagaccgagtctatttataaattacttttggtggtgctcaaaacttgaacttcttgtgatcttatgaactcttcgacttccctgtcccataccctactatccttccccctacctaagtcagagtgtggacttcatggattctattggttactaatctctgctgagcaactcagcacttctggttgtttgtatgaaactggaatctccaggtaaagagtaatttgtcttgttacttgatgccaaacaatgaattcacctgatataacacattcattgaatatctatgcttctttatacaggcagaactcaaggcaatgtatctattatataaatgatatttttcgttccttttctaatatcactattatatatttttttcctgaatcaaaagtgcttttaaaaactggaaaatttgttggatatcttttttatttctcattgtttttaaaataattagatcttattcagggcagccaaattcttaaaatggtagttcacacaaactgtaagctttgtaaggcccgtattttattggtttactgtaatattcagtacctaataccatgctatggccatagtaagtactcaatagctatttgctgaattaacaaataaatgtcctttgtgacgtttttcacttcctccattacttcttagctacaggcacagagcaataaattggttagaaataacccttaaggtttttaaatcataagcaaagcagagattaattctagaaatatcagatgaggacttttccagcagaggtcatagtgagaagtgtgtgtgtgtgcgcttgtgtgtatttgccctgagccgaagaaaagtttagggctatgctagactgtagcagttgccattgaaaaagctgtggaagcacgctcactacagttggttatttcgtagttttgttccagttgtacataaaaagtgtatttatgatagaaaaaaatacaattcttccttctattgatttttgaagggtagaacaatttaaaagttgctgcatttgacagcaatgccagaaatataaattttataaataattcagtgaaaggctggaggtcttatctcatgtaataaggtctctggtctatgatcaatcacctacttgggacaatatgctcctagttttttcttattttctcattctcctgaaagcttgctacttggcacccttgagcccaggattttgaggctgctgtaagctgtgattgcacccctgcactccagcctggatgacagagtgagactctgtctttaaaacaaataaatacataaatacagtttgatctacatccctttccttttggactgtgtttcttgtcagattgttgttatataagtaaaatcaagaagttatagttggagacagctgtggctcagtagaaactctttggggctaaaagtaaggaaatccaggtttagtctgagtctttcacgtgagcaagaaagaagacttacatttaagtgtgtgaaattaacttttaactataaaatactacagagatattcattagcatcatcgttacacaatggcccaatacgtaagatgcaactataaactgatgagaataattattcatgtcacttatagaattttttttttttggaaatttctcatgtaatgtctcttaagtgatatgtgtacattaacaagactgtgagtagtggaaagaattagaatcagaagacctggtttctaatgctggcaatactgtttgctagttttatgatacagacaaacgcttcttctctctaaagttaatagattcatttatgtaattaagacaaaaataatagagcattgctgaaatactgagtgacggttaaaaagcattctattactaatgaagaattaaaaggatgaatcataataaaatgccaggtactggtacagatggtgaggagccgagtctcaaaacctcaccccctgactccagacaccctatacccagcaagcagctactgtcagttccaccctggaacctagtgttagtcatgcatgcgtaatggctgtataaatatacttgtatgaccacaaaaggaaccatgttttatgtgcatgcgcattatatgccactcagttagaattctgtgaactgtttcatttaattctcactacaaacttcaaaaatagatactatttccccaccttttacaagtgagggaatgaagaccaaaagaagtaaaatccattgattaaagttacacagtttctaggcagcaaagaaagagttgaatcccagacttattgagtttaaagtctatgatgtcacctagtatactcaggccctaagcacctaagagtgtctgcagagatctggacatctgttctgggtataatacttgcattgtctaatattttaaggccatgtatttatttactgcatagatttcctctttattttatttgtatttttcatgagtcattactctgcacaaatgactttgggcaaatcatgtgaaaaaaattgggctccatgagatcatctataaaatggctgggttatgttttctccagcttttgtagttctgtaattctgttaagggagtttgataagcacactttctcaatgtcttcactctttttcttggcttcctttaacagcataatactataggatcaaaaagaaaaaagtaaaacatgacctcctaataatgcatggcccttgtattagtcagggttttccagaaaaacagaatcaatatgagatagatagatagatagatagatagatagatagatagatagatagatagattagatagatacagacagacagatagatacatagacagtataagaaattgactcatgtaattatagaggatagaagtcccaatatctgcagtctgcaggttcaagactaagaagagccagtatttcagtccaaacccaaatggcagaaaaaaaaaaaaaaacagtgtcccaggtcagcggtcagaaggaggaattcagcctttttgttctattcaggtttgcaattgcttagatgaagcccgcctatgtaagagagcaaaatatgctttactcagtctatgaattcaaatgctaatctcatccacaaacacccataatagtgtttgaccaaatgtctgaagatctctcggcccagtcaaattaacatataaagttaaccatcacacccccagaagattgtgcttcattgctcagaaaagcttttcttggccatgcggtgaaggcatggggaaaaagagtgataatatgggcttggacttcctgaacatcgtcagtcaggtctctctaatctctttccagagagccagaataagacctgtaagtgagttaacattgaagatgatttataatacctcctctgtatataattaaaaatagacaaaattaaacataaaataggtacaaagtaattgaaataaatcttctcatgaatattttaatacttcaaatttgaaggtaccccctttttcctgatgttctcaatatgcttgccaacactgtcctattcccacaggatgaacatccaaactccatccaagtcataggtgattccagagagaaatcttctatgaaattcttccatctgtcatattttgaattttgcatttttaccttttatactgaaaattattcctgttatttcatttaccaaatagtgtattctttatttatggttataagtggatatcatagatacacttataacaagttactaacaacattaaaacccataaattaatctcattcagtggtaaacacataatgttgcattctagttttccaaaagagataaaagaaatggttaataaaattgagatactcatggatgtctctaataccagctgacttggaaaggtaaacatctcagtcacaactgaaacttagcatgtgagttagaggaatgtaatattaaattcctctcttaaacccttcagatcattatccccatttcacttttaggtaaagtaacatcagtgatgtttttcatttgattatttctttgattacattcataaatagaatggcaatggatatgtccagtgtggaagcatttgaataaatagttgctgaaattgctttataggaaaatagatctagtatcattccatgctgaaaatattgttatatgtcctatacagagtctcggagtaataagtatcatttagtcttgtggtgatatatttgctcatttattctttaactgtgttcaacaaatacttattgagtgaccactgtgtgctaagcctctaggctctggggctacatcagtgaacaaaacatacaaaacctctgccctcaggagcttataatctggtataacttccatggtactttgcatttatatatacatatctccaggtgccctcagtccagggagaaggcactactggtttgttctctaggactttatcttattaaacagatgaggttaaaaacactctaccactcaaaatgaaacaatgggtatctcccaatacatggtaagatgccatgggcatcgcaagatttaataatatttaataatttaataataaattgttactattagaatagaatatgaaagggggaaagataataccaagatgtgaagaataaatttttcaagcaaagagagtggctgggaatgagagaggaattgatacaataaaatgggtaccaaaaaaacacaaaaggaataatgaataagacctgctatttgattaaaaaaaaaaaaaagaaaagaaaaaaagagattcaatgaggcttggaaaaagtctgtcacctagatttgatgaagggcatcggctgactagtagagatacataaggggaatagttttaatgaaacacgatgagtcagaactgtgatttcagtcatgtcattctgccttacttaaagggaagaaggtctagaatcagagttgctgatggagagtatgtttcagcaattcaggccagagatcattaagaatgtgtatagatggaaaggaataaataactattacagatattgttgaattagaattatgtgtgggagagtgggaggtgtatgaggcatcaaagatgaccaaaaacttgcttctgatgcatcaaagatagtggcatttcccacagtgatggaaaggttacatttaaaagatgaattctatttgtttaaatttatttttaactttaatacaggcattatttagtctttcttatggagaagtattaattatcatcagaacattagaactttatgatttttgtaagttgtggtgaaaatacaaaaaggcattagagaatgattttacttttttatctggaaaaggaacagttaactgttttattaacagtagtggttgatacttccatagatctgataaaataaatatgggcctttgatttttattcatatctctgatataattatttaatatatccctaaatataactctaaatacacataataaagaaaattataatgatggttttaacatttatagtgtagtgttcctgctttgaaattttgctcaaagaaattaacagtttgtataaattgcattgtaatttaaataatataaataaatgtaattataatttttcagtaatttctgataattatttacttttttctagaacacattatggtagaattcaattcaaacatattcagtgcttaccaataatgatgacgtctaagaacaacgataatataattactccaaataatagctaacaattgtgtacattcactgtgtacctaccattgggctgttttacctcatttaataatagatgattgtccctgctttattgattgagatactgtgtcacagagagttttttttttttaattataaccaggtttgcattaagccagattttgaacccaacaatttcaaccaatatgttatgcaatactagagtgggcgttgaaatgtggaaaaaaaagaatttaaaaaaaaactgtttaaattgtatacatttgaaattgttttctcatggaaatttgtccttatccatataacaagcatgtcaggtagtcaggtgttattatctccgtttcaaaccagaaaacctggctcaggaagattaacgaattgtgaaagtcaaaactgtttttcagtggtcaagagggaattttaatgctctttatattttgattttaaaattagattagcttcattggaagaagaatggcctgaagtggacctaaagccaggttctcagagtttatggtgcttaaaaattcctagggaatttatttaaaatgaagatacccggggccgggcgtggtggctcacacctgtaatcccagcactttgggaggccgaggcgggcggatcacgaggtcaggagatcgagaccatcctcgctaacacggtgaaaccccatctgtactaaaactacaaaaaattagccgggcgtggttgcgggcacctgtagtcccagctactcgggaggctgaggcaggagaatggcctgaacctgggaggcggagcttgcagtgagccgagatcgcgccactgcactccagcctgggtgacagagagagactgcatctcaaaaaaaaaaaaaaaaaaaaaaaaaaaaaagatgagcccaaattacagaatctcaaatctcatttgccttttgacaaaataccacttcacaggtagaatttaagtgggctgagacgatggcaggattccatttgactgaaggcacaaaagtggaaatcctaaggtaggttgaagaaatcagacaaattgatggaacagaggttttgcagaggtgagaatgaaaggtatgatggaaaataggctagaattagtctatggagatccaaattgcaagctcatactcacatctaatatgtttatagttcactcataggcttgagaaggcctgaaaaagttttgaacatgttaagtgtattatgatgattaaaactacaggtggtatgaagaacggcttatagaggcaatttaaaattgtgcagttttaagagaaatgttatcaacctaaggtgagtacggtgttacaattggtaatgaatggaatggaaaagacataatcaagcctactagttgattagtcagaaattaagtacaaaaaatagtagaaaaacaaatgcaatgagctttttaagtttgagactaagtatatactccagagggggaagatatttgaaaattatccccatcctgtttcaaatttctgaaaaatgtcaacagcaattatttcttttgccttgattttatttatttatttagagacagagtctccctctcttgcccaggatggagtggagtggtgtgatattggcttattgcaacctctgcctctcaggttcaagtgattctcttgcctcattatcctgagtagctgggattacaggcacgcacccccacacctgactaatttttgtatttttagtagagacagggtttcaccatgttggccaggctggtcttgaactcctgacctcaagtgatccacctaccttggactcccaaaatgctgtgattacaagcatgagccaccaggcttggcctttatttttaaaatctgtttttattttaggttttacttattttcaagtttatgatactcatgaggcttagcagatctctactttgggatgggtttggttcacctagtagttttggaatttctaataattgagggtcaattatttggattcttggttcttcttcactagattatcttcctctgtggccaaggggccccacaacatctacaggctacattaagaaataagagtttgtagggttagagaaacctctaacactcatagagcctttttgtgaaattcaagtttccatgggtgaaaactcccatgtggcctacagatgacaggtgttcagggggtagcataagggtttgagttgggtggcggtgagtcaggcaggcagaacattccagaaacacactgcaaattttggcaagttgtgtctctcatagtatctgtctgcttaagtgccaccaacaaacacagattccttagcgaagcagaggatagaattaaaagaagaacagccggctttggccaagtattaggtacaattaatggtttccgctttataaaaattgttcctgacaaatgctggtagacaagggatcattagggagacaaacagcatcctggggccacagtaatacaaaaattgctggtgacgatcagtgaattcatttatttatgcttttactatttctatgaatgaatgataaacatttagagaaaagaaaaacaaggatgtttttacaggagctttaggaagaagaatgcttcctcctatttgataaaaataaattagagactatgtgagataaattggacttcaccagagccattatatttttcttcctaattgactgcactgaggcaagcagaacattcgcgacttaattatgcatacttctgagggtgccatcagacaggtcagtggttctcaaatctgccacacattagaatctcctgcggatctttaaaaatgcctgggccacaccccaagagaacctaatttaattagtctgagctagatttaggctatggatttttttttaaacttaagttgccaattgattttagtacgcagccagagttgaaaaccactgagagagataagtgtcagcacttcagtgctcactggcagaaaaccacgtttttcatagaaccagtgactcctccaaatatagagcaaaatgcacagtaagagtggaaaaattgggaaaaggaactggattctatctatatatttttttaatttgtaaggttctgttacttggcttgatatagtcacaagcaaagagaaatacttggcatgctgtgaatttggcctaggcagcagtactcaatatcctggcaggagagaaaactccctaatttgagtgtctgctgtacaccaagtttccattatatcaatattcctatttctttcttttttctcttcaaaaaagaagattctaaaatgcctgtaaacatttttaaattatttttattttaatatatagtatagcactttcacacttcaaacagaagtatgaaaatgtgcatgaaacaaagcaaattcttgtgtaaacactgtgcaggtcaagaaatggaagacaggtggcatcccagaacccttccatgctcactctcctaatcagtacactattatcctgatttttatggtcacacctatttttctttattaatatttccatataaattaaagaagcattgctaaatgttagagttttgctcaaattttccttttaaaaattatgtaaatggaatcttacagtatgtacccttttatgtctggcttctttcaaatgtcattatgcttgtttgacacaatgcattggtctgttatttttgttgctgtaaaatcttacatttttaaaaatattacaaaatatgtatcccttttgctgtcagtatatatgagatagtgcttttatttattattaccaaaaagagtaccaataaattatgtacctgtctctcagtacacatttctgaggagtatataatcttagagtgaaattgctgggaaggtatgggtacttctaatttagacgataatgacattttccccccaattttttgtgctaatgtatactcctacaagcaatatttgagcattcctgctgctctacatcaggagtctgcaaactatggctcgccatccaaatccagcctgccactgatatttaaaagtaagattgttttggaacacagctgtgtcccttcatttacccattgtctctagatgcttttgggggacagcagcagagttgaatacttgtgacagagaccatatagccttcaatacctgaaatacttactccttgacacttcacggaaaaagtttaccaacctctgctctacagcatagctcactcttggtgtggtcaggctttttccatgttgccatttctgctgcatatgttgtgtaatttccttgtggattgtttgcattttcctgattactcgtgatgcataacaccttttttgtatattttttggccatttggatatcttcatttcatgaaacctcttgatcatttttctattgggtttttgtcatttttgtattcagtgctttataaaatctggttttgaactccctgctgggtatacaactattatttactcccactttgtggcttacctttttattctcctaatgatgtcttttgataaatggaacttctattttttgatgtagtcaaatttaagattttatttttggatatagcattttgtgtcctgtttaagtaatcattctttatcctaaataataaatactctcctgtactcccaaataataaatactatcttacaaatctttccaggggacatttgttaatgtctgtggacatgtttggttgccacagctgaggttgtgctactaacatttcgtgtgtagagaccagggattctgctaaatgtcctacaatgaacaggacagcccccaccccaccaagacttacctgaccacaaatgtcagtagcactgctgttaagaaacctggacctaaaagatttattgacttacctttcacattatgatgtgtaatctaatagaagtcgataaatctatagtaagttggttttatgagtggcgtgaagtaggattcaagtttcacttttttctgtatgcatatttgactgcctcagtaccatgtcctgaaacaaccatcctttcccgttacatctgtgttgtgataagtcaagtgttcctatatacaaagttctctgggctttccatacgatttaactgttctatttgtctatcctcatgccaaacactttcttttaaatattacagctttatataaggtcttgatataaatagagcatttagtctcaacatattcttactggataaagaaaatgtggtacatgtgcaccatgtggctgtgcagccacacacacacaaaacaaacaatgtcatgtcctttgcagcaacatggatgaagctggaggtcatgatcctaagcaaactaacgccggaacagaaaagcacatactgcatgttctcacttataagtgggagctaaatattgagtacctatagacacaaagaagggagtaacagacactgggccatacttgagggtggtggatacaaggaaggtaaaggtggaaaaactacctatcgggcaccatgcttattacctggggcacaaaataatctgtacaccaaatccttgtgacatgcaatttacctatataacaaacctgcacctatacccacgaacctaaaataaaagttaaaaaaaattatttctcaagagcttgactcttcttggtccttgcattgtctataagttatagaatcaggttggtaaatgtatacaaaatcatcttatttttgtatcagaattacgttgattcatttgttagaataaaattgttatttttagaatattgaaactttaaatgcataaatatggcatgtctccttaggtaatatttcttttcaattttctattttccgttttatagtctaaacatctagtttcatattttatgcatattttacattttgatgctaaacgttctcttttaaattccatttttaaattatttctatatagagatatcaatttgattttttgtgtattgacattatatccagcaacatttctaaatttactaattctaataaattacatatacattcataatcatattgtctctgaaaagcaacatttctttctctctttccctccccagttccagtagcttttacttccttttaccccccttacttcgctggttaggagttattctccaaagttatttcagcatagtcaatcacatttaagcagtgaatatactgtcaaaagtattgtagtggcaatgattatatacatttttctgagcaattttttattcaacaattatttaatgggcatccactatgtgctaagaattttgctagacactagtaaaattagagtgaacaagtcataatctggacacagggagtttatgttttagtgggaggagagaaatcaaaaacagataaattagaaaaaattagttgctccatgccatatacattcttctgaccttgcctttagtttactaatttttatctcaattgtatagtatgctgttaaacacatcctttgaattattaagatgggtaaccatatttttcagttctagaatttcaatttagttcaaatctgttctttcttttatagtttccatttctttagcagaattcataattatgtattttatttctcaagttattttaaagcctatgcaagttaacttttctatctaaagcacctatgtgtgtgtttttattttctatatttatatttattcttgtctgccttcttttataactggttatattttaatatatatgagatatgtatctgaaaatattgtgtagaaataagctgagtcttaggataatttttatcatccttcatcgtggatgtttatttaagtctgttgcttgcctgggggtgctgcaagtttgaatcacctttattcatttccaggcgtggagatgattggaagataggaggatttctctacttctgattaactgttattctcgtggagggggagtcgtctcaggtcccaacccaaaagagagagggttcaccagggatcactttttgttgattcctgagcatcattcactatgccctagccaagagaagctgccaatgtttcctctcagcagccttgtcaggaatcaataaatactgccagaagaacagtggcaccacctccctgagtttctttccttctccaaatcctaaaccagtaatccttccctatgttgtcagatctccacttccttcagatgcttttagaatttattctgcttttttagaggcactcagtaaaagagttggctagagttacctagttcactattactggaagggaagtcttaatgatttttttttaatgtaaacgactaaagagtaatggaattaaaaattctcaaaacacttattttttgaatattttatgtatactttaaagttacaaactatgcatatatgcatatttttgaccctattacatttacatagatttaagttagaatttaagatatgtttgtttactatatcattaaaatataaatcttgtatcttaaatttaccaagagattctttttattcatttcattctcaaatgaaatatacttaatacagaaattattaatatcatgtagtctgtatcttcccattgcaatgttaacataaaacccaggatcttctcttttttgttgactcttatacctcagtacctagtgaagtgtctggcccacattagagaagcaaacgaatctttgctgagtgaatgaatgccgtgtacaaactatttgcttctatagtagtgtccactgcactacttttgacaacttacctgttcagtaaaaatggttgcagatcagattggaagaattttctaacataaagtattaaacatagtcgagtgttagaccatttttcatgatttactgggtactaagtttttgcaaatatgttttgtaagcctaaaattttgcaaaatatggtaaaaccacaaataatctcaataatacttagattcttgatagaaaacaagaaaagtttttgcagaaaatttgtggataattaccatgagtctaagaagcacaaataatgatgtacagtttttgtgggacaattttcagaccttagaaactaagatttccttccctatctagaaatgtaggatgggatatttatttttaaatcctcaatggaaagcttctctgttggtgatatttagaaagtctcatgaattcacaatactaagacaaatataaaaaccttttgttttgtctttttttttttttttcctttttgtggagaacagggtctcactatattgcccaggcaggtctcaaactcctgggctcaagttgtcctcccgactctgcctcccgaagagctggaactataggcgtgagccaccgcacccggcaaaaccttttttattatcctaaaatattaggaaacccaagtgaattatcccatcagtgaaagagtgtgatatccccccaaaatattgttttaaatacaaataacttaaagtttaatacattttgcattgcctggattcggaaatataagacaaagtaaaacaaaacaatggcaaaaagaattcagtaacactacttcattactagggctttgaaataaataatagctgtctaaaattactgagtattcttattaagtttaaagtaagccagcctctgactagcttgatgcagtgtaaacctgtaccctttacccaattcattcattaccaccacggtgtgtgtgtgtgtgtgtgtgtaattctgtacaaatgagtatgttttaaagttttattgaggcataattaacatacaataaactgtacataaagtgtaaaatttggtaagttttgacatatgtatatacttaagaaaccatcaccaaaatcaagataaatatattcctcaccattgaaaaatttctacatatgcctttataatccttcacttctgtcctccccataccacctgagctgttcctaggcaaccactaatcttatttatttctttctctataaactagtttgcattattttatgatattaaataaattgatcatacaatatgtatgtactctttttgagtcaacatatttattttgagatttgtccatgttgcagcatataccaatagttaatttctttttatttctgattagatggatacatgacaatttttcaatccattcagctactgatgggcattcaggttgtttcattgttgaaagtatatgtccatacaaagacttgtatataatgatgctaaaagactatgcacagtctttgcatggttatagactttgtttctcttgggttaattcccagtggtataatggctggattatatgaatggttgtatgtttaatttttagcaaaactgccaagcagttttgcaaaacagttgtaccattttacgttcttacaagtagcatatgagaatcagattttctctgcatcattgacaaaatttgttgtttttttatttgagttatttcaataggcatgtagtgctatataattgtggttttaataagtgttttcattacgactactgatgttgatcatcttctcaagtgctactttccatctatatatctatatatcttctttcatgaagcttgcattcaaatgctttgcccaatttttcttgttctttttcttattattatgtttataattttatgtatattcgatacaattgccttatcagatatatgacttacaaattttgcccccattggtggcttaacatttcatttcatgaacaatgttttgctgatgaagtcaaatgtttttcttttatcgatcaagcttttgatgtcatttataccaaactccaggtcacaaaaattttatattttcttttagaaattttatagttttaggatttacatttaggtttatgatttattctgagctagtttatttttattattatactttaagttttagggtacatgtgcacaacatgcaggtttgttacatatgtatacatgtgccatgttggtgtgctgcacccattaactcgtcatttagcattaggtatatctcctaatgctatccctcccccctccccacatgccacaaccatcccctgtgtgtgatattccccttcctgtgtccttgtgttctcattgttcaattcccacctatgagtgagaacatgcggtgtttggttttttgtccttgcaatagtttgctgagaatgatggtttccagcttcatccatgtccctgcaaaggacatgaactcatcattttttatggcttcatagtattccatggtgtatatgtgccacattttcttaatccagtctatcattgttggacatttgggttggttccaagtctttgctattgtgactagtgccgcaataaacatacgtgtgcatgtgtctttatagcagcatgatttataatcctttgggtatatacccagtaatgagatggctgggtcaaatggtacttctagttctagatccctgaggaatggccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatattatttgcccactttttgatggggttgtttgtttttttcttgtaaatttgtttgagttcattgtagattctggatattagccctttgtcagatgagtagattgcgaaaattttctcccattctgtaggttgcctgttcactctgatggtagtttgttttgctgtgcagaagctctttagtttaattagatcccatttgtcaattttggcttttgttgccattgcttttggtgttttagacatgaagtccttgcccatgcctatgtcctgaatggtattgtctaggttttcttctagggtttttatggttttacatctaacatgtaagtctttaatccatcttgaattaatttttgtatgaggtgtaaggaagggatccagtttcagctttctacacatgactagccagttttcccagcaccatttattaaatagggaatcctttccccattgtttgtttttgtcaggtttgtcaaagatcagatagttgtagatatgcggcattatttctgagggctctgttctgttccattgatctatatgtctgttttggtaccagtaccatgctgttttggttactgtagccttgtagtaaagtttgaagtcaggtagtgtgatgcctccagctttgttcttttggcttaggattgtcttggcaatgtgggctcttttttggttccatatgaactttaaagtagttttttccaattctgtgaagaaagtcattggtagcttaatggggatggtattgaatctataaattaccttgggcagtatggccattttcacgatattgattcttcctacccatgagcatggaatgttcctccatttgtttatatcctcttctatttcattgagcagtggtttgtagttctccttgaagtggtctttcacatcccttgtaagttggattcctaggtattttattgtctttgaagcaattgtgaatgggagttcactcatgatttggctgtttgtctgttattggtgtataagaatgcttgtgatttttgcacattcattttgtatcctgagactttgctgaagttgcctatcagcttaaggagattgtgggctgagacaatggggttttctagatatacaatgatgtcgtctgcgaacagggacaatttgacttcctcttttcctaactgaatgccgtttatttccttctcctgcctgattgccctggccagaacttccaacactatgttgaataggagtggcgagagagggcatccctgtcttgtgccagttttcaaagggaatgcttccagtttttgcccattcagtatgatattggctgtgggtttgtcatagatagctcttattattttgagatacgtcccatcaataactaatttattgagagtttttagcatgaagggttgttgaattttgtcaaaggccttttctgcatctattgagataatcatgtggtttttgtctttggttctgtttatatgctgtattacgtttattgattttcctatgttggaccagccttgcatcccagggatgaagcccacttgatcatggtggataagctttttgatgtgttgctggatgcggtttgccagtattttattgaggatttttgcatcaatgttcatcaaggatattggtctaaaattctcttttcttgttgtgtctctgctaggctttggtatcaggatgatgctgcctcataaaatgagttagggaggattccctctttttctattgattggaatagtttcagaaggaatggtaccagctcctcattgtacctatggtagaattcggctgtgaatccatctggtcctggactttttttggttggtaatctattaatcattgcctcaatttcagagcctgttactggtctattcagagattcaactgcttcctagtttagtcttgggagggtgtatgtgtcgaggaatttatccatttcttctagattttctagtttatttgcatagaggtgtttatagtattctctgatggtagtttgtatttctgtgggatcggtggtgatatcccctttgtcattttttattgtgtctatctgattcttctctcttttcttctttattagtcttgctagtggtctatcaattttgttgatcttttcaaaaaaccagctcctggattcattgattttttgaagggttttttgtgtctctctctccttcagttctgctctgatcttagttatttcttgccttctgctagcttttgaatgtgtttgctcttgcttctctagttcttttaattgtgatgttagggtgtcaattttagatctttcctcctttctcttgtgggcatttagtgctaaaatttccctctacacactgctttgaatgtgtcccagggattctggtatgttctgtctttgttctcattggtttcaaaggacatctttatttctgccttcatttcgttatgtacccagtagtcattcaggagcaggtttttgtttagtttccatgtagttgagcggttttgagtgagtttcttaatcctgagttctagtttgattgcactgtggtctgagagacagtttgctataatttctgttcttttacatttgctgaggagagctttacttccaaccatgtggtcaattttggaatacatgtggtgtggtgctgaaaagaatgtatattctattgatttggggtggagagttctgtagatgtctattaggtccgcttggtgcagagctgagttcaattcctggatatccttgttaactttctgtctcgatctgtctaatgttgacagtggggtgttaaagtctcccattattattgtgtgggagtctaagtttctttgtagtcactcggggcttgctttatgtgctcctgtattgggtgcatatatatttaggatagttagttcttgttgaattgatccctttaccattatgtaatggccttctttgtctcttttgatctttgttggtttaaagtctgttttatcagagactaggattgcaacccctgcctttttttgttttccatttgcttggtagatcttcctccatccctttattttgagcctatgtgtgtctctgcacgtgagatgggtttcctgaatacagcacactgatgggtcttgactctttatccagtttgccagtctgtgccttttaattggagcatttagcccatttacatttaagattagtattggtatgtgtgaatttgatcctgtcattatgatgttagctggttattttgctcgttagttgatgcagtttcttcctagccttgatggtctttacaatttggcatgtttttgcagtggctggtaccggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctggcttgaaaattcttttctttaagaatgctgaatattggcccccagtctcttctggcttgtagagtttctgctgagagatcagctgttagtctgatgggcttccttttgtgggtaacctgacctttctctctggctgcccttaacattttttccttcatttcaactttggtgaatctgacaattatgtgtcttggcgttgctcttctcgaggagtatctttgtggcgttctctgtatttcctgaatttgaattttggcctgccttgctagattggggaagttctcctggataatatcctgcagaatgttttccagcttggttccattctctccgtcactttcaggtacaccaatcagacatggatttggtcttttcacgtagttccatatttcatggaggctttgttcatttctttttattctttttctctaaacttctcttcatgcttcatttcattcattttgtcttccatcgctgataccctttcttccagttgattacattggttactgaggcttgtgcattcatcacgtggttctcgtgccgtggttttcagctccatcaggtcctttaaggacttctctgcattggttattctatttatccgttcatctaattttttttcaaagtttttaacttctttgccattggtttgaacttcctcctttagctcggagtagttcgatcttctgaagccttctctcaactcctcaaagtcagtctccgtccagctttgttccattgctggtgaggagctgttcttttggaggaggagatgtgctgtgaattttagagtttctggtttttctgctctgttttttccccatctttgtggttttatctacttttggtctttgatgatggtgacgtacagatgggtttggtgtggatgtcctttctgtttgttagttttccgtctgacagtcaggactctcagctgcaggtctgttggagtttgctggaggtccactctagaccctgtttgcctgggtatcagcagtggtggctgcagaacagcggatattggtgaaccgcaaatgctgctgcctgattgttcctctggaagttttgtctcagaggagtacccggccgtgcgaggtgtcagtctgcccctactgaggggtgcctcccagttaggctactcaggggtcggggacccacttgaggaggcagtctgcccattctcagatctcaagctgcgtgctgggagaaccactactctcttcaaagctgtcagacagggacatttaagtctgcagaggttactgctgtcttttgtttgtctgtgccctgcccccagaggtggagcctacctaggcaggcaggcctccttgatctgtggtgggctccacccagttcgagcttcctggctgctttgtttacctactcaagcctgggcaatggcgggcgcccctccccgagcctccctgtcaccttgcagcttgatctgagactgttgtgttagcaatgagcaaggctccatgggcgtaggaccctccgagccaggtgcaggagataatctcctggtgtgccgtttgttaagcccgttggaaaagtgcagtattaaagtgggagtgacccgattttccaggtgctgtctgtcacccctttctttgactaggaaagggaattccctgaccccttgcacttcccgggtgaggtgatgcctcaccctgcttcggctcacacacggtgagctgcaccccatgtcctgcagccactgtccggcactccccagtgagatgaacccagtacctcagttggaaatgcagaaatcacctgtcttctgcgtcgctctttttgtttaagaattgacgttcattcttttaagtatgcagattttcaattgttgtggcaccgtttattgaaaagcctgttctttcttcactcctctgtgcctttgtctaaagtccattgtctatatatgtgtaggtctatttgatctcactgatatatctttatatcaataccacgctgtattgatttctgtaactttttattgaaatcagatggtatttgtcctccaattttgttctttttcaaagatgttttggtgcttttcaaagttttgtgtttccatacaaatttcagaataaaatagtcagtgtctcaaaatatcttgctgggattgggatagggattgcactaaagctatcagtaaagtttgggggaactgacattctaataatattaagtgttctggactataaaggtgatatattgctccacttactttgtcatcttcaatttttctcagcaatggaaaatatacatatctttcagatcatttgttgaatttacccctaaatatttcatatttttgatcatactggaaatggtatttttatttccatatatgattgtgtattgctaatatatagtaattcagctgatttttatattgacattgtaatttatgaacatactaaactcatttattagatccagaagcactttttgtagatctatgggattttctacatagataatcatgttgtctcaaaaagatagttttacttttttctgttgaacctgaatactttgttcgtttgtttttttttttaattacattgcactaattagaacctcagtacaatgctgaataagaatgctgagagtagatatccttgtcttcttcctgatcttagagggaacacattcagggttttaccattaaatagaatgttagctgtaaatttttggtaaatgctctttattacattgaagaagtttccttctgtttcttctttgtcaacagtttttatcggaaatgtgtgaatagatttttataaaatgttttttcttcacttattaagatgatcacattttagtttgataatatcatgaattatattgacttttgaattttaaacagatgcttgctactgtattcttagaatattatccatcttatataatgttggattctatttgctaaaattttgtttagaattgctatatctatgttcatgagagatattggtctataattttcgttacttgtatttcttgtccaatcttgataggaggacaatgctggcctcatagaaggaattgggagatagtccttccacttaaattttctgtaagactgtttatgggattggtattttgcttttgctaaatatttgttataaatcaccagtgaagccatttggacttggagtttatttttgggaaaatttttaactacaatttcaatttctttatagatataggtttatttggttttctatttcttcttaactgagttttgatagtttgtatctttcaaggaatttgcacatttgatttatttaataagtattgaatatgttagtcccaagttgtttatatcattttaatagcagtaggatttccagtgaagctaccctcttatttctgatattgttaacttgctaattttaaattatgattcataattaatctgactgaatatttataatattattgatcctctctaagaatcagctttaaaaaagaatcatcttgaggttttgagtgaaaaaaaaaactcaaattgctttttctatcgtctcactcaacaatagtcaacacagaagacttctgtgagcaaatatttggggatttctctccaccaacaggaaagtaatgcattctgcagcagacaacagctgggtatcatttaatttagttcaatccagacactatccacctgcagatagcatcagattccacagatttaggtctcagtctcataagactgccctcaattcagatgctaatagcaagctcctggtggttttgtctgtgcttctgaccaactgactacaaattggggatcccactctccccttcttgaagttgactaattttctagaatggttcagagaactcaggaccacacttactttcattcaacaactcattataaactatattacaaaggatacagataaagagatggataaggcgaggcatgggggatggagtgtggagcttccaagccatcctggctatgccaccctccaggaacccacatgcgttcagctatccagaagtatccagaagctctgtgaatcctgtccttctgtgtttttatggaggcttcattatgtgggcatgattgattaaaccaatggccattgagaatcaattttaccttcatcccctatttctcctagatgattggagggtgagactgaaagtctcaatcctctattccttccttggtctttctggtaaccagccttcatcctgaagctacctaggaggtgtcaaccatcagtcaactcatgagcatacaaaaacccatcactttagagactctaaggactttaggagttataggcctggaaatggggtcaaaccaactatgtattttaacaatagcataggtttcattgatttttatttgcttttttttttaatttgctttttttatttgctttttttttttttttttgctaatttctcatcacagaatgttaaagtcttatcttctcctctgtgactccaacaacacaaatatttgatctttggttatagtcctgcatgtccctgagcctctgttcattttttttaaaatttaagtttattgcacagcgtttctccttctggaaagatagacaacaattttttctatttctcccactaaggataactaagacctctggacataatacaaacaagcataagaaaaccctgaaaggccaagagaagaggtgaccacctgtattcccaaagaattgcatggccagcatggcattgagtagcctggattttctttgtacttcaaataatttaaactgggtaacaataacagtttatctggatcataaaaacaaagagaaatctcctcacctaagttatatgtgcatttttctggcataaaatttggaattcagtagcaccttattaaagtggtatcaggccagctatggtggcccatacctgtaattgtagcactttgggaggaggccaaggcacaaactcaggagtctgagaccagcctgggcaacatagcaaaaccctgtctttacaaaaataaaaataaaaattagccaagcgtgatggcatgcacctgtagtcccggctgcttggtaggctgtggccagaggactgcttgagcccagaagattgaggttgtgatgatccaggatagtgccactgcactctagcctgggtgacaaagcaagactctcaaaacaaacaaacaaataatgaaaataaagtagtgtcagaggagatatagtgaagagtcatgacattcatcaccactcagcagtgaagaggcaacaccccttctcctgcccctgtgtgaataggggaacatggggagcagtaatggggtactcttcctgtccagccaaggtggtatcagtagagatctagtggggagcctgaactccaccctcatccatcagttataaggaaccctcccctctacagaccaggatttcagcatagggcaagtggagatactgcacttttactcccacttagcagcaatgaaatggtttcatgcatgcttcccccagtggagcagtgtcagagaaggcctgctgaaacccacaaataaacgaggtccagaatcttataacataataccaaataatcttgttttcaattaaagaaatcacttagcatattaagaattaggcagacatcaaaatgtatgagaaaagatgataaatagatggcatactgagaggacagctgttaaatgatttgacaaagattttaaaatatccatgacaaagtgctttaacaagcaattacggacacatctgaaacaaatagaaaacagaaagtttcaacaaaatctgaaagtcttaacaaagatatagaatatagagaatcaaatggaaatttcagaatgaaaaaatacatttaaacactcagtggatggactcaaaagcagaatagagaaaacagaaggaagaataagtgtagttgaagataaaacaatagaaattaacccctctgaacaacagagagaaatagactgtaatatgtaaaaaatatttacacatattatcattttctgctaatcttgcttatttatttatttatttatttattaactttaaagcattttgatatttttactttggttctaaataaagtattctttccctaaaaatagtatacgtgttgtagaccaaacgtcctaataccataattgagattaaaaatctttgtatctgagcccttctactctatgttttgtgactttgtcttcagaacactctttgtagaactcataggcatattttgaacgtgatggtggccaaagtgaacaatgctgtttcctctgtctcaggctttcttcagcctggagttgtcaagtgaaaattccagggtctctttcacattctctattttactttctcttctaatgctgtccagtaggtatcaaggaattacaagacatcctggtggacaatagccagaatttcctcttttttatggtgaaatataaagttatagttaaagggaatgagattcagaatcagatagacagggttgaaattcttccattccccattcttaactgtgtcacactgaacaaggtagttaattgcttgcttattatgacccaggtttgcatatacaataatataaaagttcagcagcttgagagacttattaggcattaaatatatttcagcttcgctttcattcctggccaaaaaaaatgttatgaacaatgtccctgtgtggactgtgtgtgtgtgtgtgtgtctgtgtgtgtgtgtgtttgtatggtgtgtgttccatgtaactcagggtacttaaaagttcagagtaacttgtaacaaaccagtttaaagccaggctaagacaatattttataaaggaatgatttgtctagctttcttgttctgaacacaaaataatattttgttgtatgacataggtcgggtcttccaagatgattttcagatccctgcagcattggactctgaagattacggagcattttgttagaataactgaacccttattctgaaatgggaactatacatatagtttatatagtatatatatatagtttatttatatatatagtttatatatgatatatatactttataaacaaaagggattatatattatatatataaaatatatatataatatctataaactatatatataaaactatacagttaacttgagcaaatcgtatacaacaaactagaactatcacgtagtgcatgccattactgtgctttctcctcatttggaagctgaaatgatttcttacaccttgtgtccaagataatgaggtattgtgtttctttgaactctccctaacaatgtgtttttccagtactgattgttgatgtcctgttagcactcttatcctgttctgtcctgactggaataacggatcatttgatttggttcttttactagtgttcaatcttttgcatatgcgaatgattctcattacacacagtctatatcaaatggtttctcaggggactttacatctttcttacatgctttgcaaaattctttaatatttttggcctaagaagggtaatgattctctctaaaatgactatccattgtctgagtgtctgcttcccattctgtgatttgcatttactctgcctgttttaatgttgttgttttttctcaaactgagagaaaattaatttgcctccacttctaagcatctgggcctcatagaggaatcttctttcactttctctctctccctcttcatcttttctttttgaatctactttattcttctctagtcttgtttctctttctccttaccccaagcttcacttctctgtgttatttgcaaagtaacctctattaatctcatggtctagaagcactgctggtgaagaaacagtgactctgaagtctcatctgatcacctgccatagtatcaaacatgtctaacaccagatctgtcatgacaagttttccaaaattccagtgagaaatgaaactcaatagctaaaggacttcgttccttgtagtttggtgggattcataaccaaggtgctctgctgctagggaataggaacattgcagacacttagttacctaagaaggaggctgctgaattccaaatttcacaccagaaaaatgcatatacagtgtgtgtgaggatatttctatctttctatgatccaaattaactcttactgctacttagaaagcaacaagttcatagtcctgaaatgacccattcattgagaaacaatagaagacataagataatattttattgcaaatagtagtctacattccctctttgttcctttctgaattatttttcagatctagtaatactttcttttttatatgtcatggatgagtttttagaagtcgctcttactaaggagaggaacaaaaaaagtgaccttaattgtgatgtctttgtagttataatatctttaactacaaatacaagattctgaagcactgctgacagtatgaaaattttgcacactgtctgtcttgtcagcaagatttcttccttttttttcccggaatatcctggaatatgatcatttgaatagactgttcatatagggaggagaggaactgattaagaagaattagaaaaaatatactgttaagttagccagggtgagttaaagatcattaaacttggttatatactctttaaaaatggaaaagaaaaatcaaacaataacttcagaaaaatagttacttaaaagacaggcttttgatgacagcttatgaaaaatcaaatattcttttctgtgggcattaatgcattatgaaggactcccttttgttctgacacttgaagtaggaaaccatttcctttgtcttggccttactctctgtattgttgcctagaaacacagtcttttagagacatttgcccatcaaagtgcagataaggtaacacatttacttttcaaatgaaaattactagaaagaagtgaagtgaaggtaggttaaacaaaatgagttttttgttatgtgtaggtagagcctaaaattactcacactacctgcgtacaaataccgaagaattaagtataatcacaaagaaaagcataaagctatagggtgatttcttttttaagaaagcaaaaaataggcttctcagtgttaaaattgttaaaggaaccatatgtagaagctcattatctgcacagtaaaacgattaacagttgactatatgccaagcattttctctttgaatgttccaacattatcccagattgtttgagattggccaactgttgctaatccatttgctttgcggggtcacatcaaagacatccaaagagtctggtcaaaggatgaggttgtgtttgtctatggattattttatattgtttattctgcttttgtatagctttatcttcctttccataagatataattattttttaatactcaggataaaattatcactacaaattctactcactcactaggacgagtagcatttgttgttatgagtagaatttgtactagaaaaaaagtagatggctgcaataaatatttcaccacatgcatacgtgatataaaatgcacttcctgtactcatttctcattagaagtttagccacgaagtagcttttcaagaaaattcaggggatcatataatagctggcactgtcaaaattaaaaaaaaaaaaaaaaaaaacatgttttctctcagttggacccattgtccttgaagaaatatcctgagtgattaattcatcttggttttctctctagaaagtagggttttttccacttctccccactgctattcgtgtgctttactcatggggaccctcactgtaactggtaaccaaaatcatgaccaaaagaatattaactcttttaactcctctcaaaaggttaagatgaaagatggtttatacttccaaaaagtggtgtgtattaacctccaagtaaggaattagtagtgattacacgtggagatgacgtctcagttacccagaacctatccatatgaaagcatttctattagggcacttctttggataccatccacgcacagcagaaatgttcaactaaaacttttgtgttgaatcaaacttggtttattacagtaactctgacaaggacttaactataacattttaataggttctacagtaaataagtcactattactatcttttttttgttttgtactagcaaagataatcacttgtgattccatgttgtaactcacatgagggttaatgatgtgctgtggaaatgcagtgtgagttcacaataagggtagcaaatggtgggaaagtgactaggaagcatatgaggaaaactaatagaaggtaagggttattttattaaggtttgtacagattcattttcaaattgactcacatttccagagatgagtgttctcctcttcctgcagggaagggttctttctcacgggaaacgtatgtccggcgtgattttaggaagaaagggagaggtcagagagcccttctcgcatctgctgtttctcaattgccttctgttcaaaatagttaatttgccaaagtggcgtattttggggtgacatattctggtccccttcagtaggaaattattttaaacaaatgaataattgaattaggagggaggatgaagcaagatgcaaatgaaattgcttatagaatgacagaaaaaataaaagtataatttgagaggtattaaatagtttatggtataaaatattaaataatattaatgtgatttatttttaatttagtatatgtcagttctgttatttggcccaagatactcatttcaattgaactttttatataatggcaactgaattagacatactgataattgccttctttgtgggatctcttaagtaagttaccaaattgaaaagacaatagcaaataattcccatacttttaaaggccaagcagaagaacaataaaaaacttggaatacatttctaaagaaagattgagttttgaaacaacttggatatttttatatcccattgcctgcatgccctaaccattgttagcgtctttggctattaatcctattatctttgttcaaattattactgtgtactatctcagaaagattagtatttttatctttttttttccatctttgttctaaatttacaagtgagattaccacactcaaatttggcttaatagattattcatgcctaactaatgaattaaatggattttgtctttggcctttgcctgaaaagaaaaacaaaacaacaaaacaacaattacaaaaaacagcaataaaagcagcttacttgcaatctggatcacatatcctctttattttactattctcaacagggttagaattgcattgagccaagatgcagcagtgctgtgctgaagttgtttgtcttttaaggttcagtgaaaatcactgtgaggttctgacctttccaacagatagtatgtgtttggggactgttacagtatttgcgatgagttcctcaggatcttattataaatggttgagtaaatctccaaaccctcaacttcatgacatacaaaagaaaattattttcaaaataagaactaattcccgagataaaaataggaaaacacatacatttttgcaagctagtcaagaaaaatcattgaatttaactgcatttcacatctaaatagtttaaacatttctgttgctgatattgattgtcaaatacaaatgcacacctgtgctctttcctgtgagttctcaaagtgatgtaccagtgctggaaattgaattttctattttttcatattttagtgaccaaaatcattgagtgtcatatgaactattactattaattaagaaataataaagaagaatatacaagcattgatcttacagccaatgaagcacagtgagaaaagcaagggctttggagtcagaaagacctagactctgaagtgaatgtaattgttagacatgtaagtttgatcaatacatcttacctttgtgagatttatgttctccatatgtaaaatgtacataataatacctacctcatcaggttttcaaaggagcacatatttatgtttctagcccaatatagggacccaaaaggtgatgttaattttgacactacaatcaaaacaaataaaaaattaaacagtgttgtggtctgaatgtggaaccccaaatgcatatgttgaaacttaatagccaacatgatactattaagtggtggaaactttagaaggtgattaattcatgagggggcagagccctcatggatgggattatggcccttataaaaggatttgaaagagtgggttcctttccttccaccttgtaggagcacagcattcatccctttcaggggatgaagcaacaggatgtgatctttgaagcagagggcagcactcaccagacactgaatctgctagtgcctgggcagatgtctctttgagatactgacttcctttcctgtcctagcctttaaaactgtgacaaataatttttttgttctttataagttatccagtctcaagtgtttccttaaagcagcacgaatagactaaggcagtatgtaatacatattatactgttgtaaacacttttaatttaacttttttatttttttgagacaagagtctggctctgttgcccaggctggagttcagtggcgcattctcggctcactgcaagctctgcctcccgggttcacgccgttctcctgtctcagcctcctgagtagctgtgactacaggtgcccgccaccatgcccagctaattttttgtatttttagtagagacggggtttcacagtgttagccaggatggtctccatctcctgacctcatgatccgtctgctcggcctcccaaagtgcttaatttaactttgaataaaaattgtctaaaggggtataatgtgctgttttgatacacatatacaatgaactgatcactccaataaaaccaattaacatattcagctcattacatagttactactgtgtgtgtgtatgtgtgtgtgtgtgataagtacacttaatatctaccatcttagcaagtttcaaacatacaacacagtattaactgtagtcatcatgctgtacattagaactctagaacttcttcatcctacataaatgaacttttataccctttaaccaacatctcattttcctcactccaacccctgaaccatgactggacccctagtaaccatcattctactctctgcttctattcattattattttcttttttagattcaacatttaagtgagatcatgcaatgtttttctttttgtctgacttattttacttagcataatgacccccccaccaggtttatccgtattgtcataaatggtaggatttccttctttttaaggctgattaacactttgttttctatatgtctatatgttcatctatgatgcacacagcttatttccttatcttggctattgtgaataatactgcaatgaacatgaggatacagataactcttcaagatattggtttcttttcctttgaatatatacccagaagaaggattgctggatcaatggtagttctatttttaattttttgaggaacctccaaacagttttccctatggctataccaattaacattcccagagtagagagcccagaaataaatctatacatatatggccagctaattttcaaccagggcaccaagaaaaagatcgttgcaacaatctttggaaaatccaatctgccacatatttcaagggagaagacagttttaagaagagagataaagtcataagtgtttattaccacagacagcctaggttacatgaacattgaagaaaaagataagtctttcaataaagagtgttgggaaaaccggatatccacatgcaggaaatgaaattagacatgtatcttatgatatacacaataatcaattcgaaatgggttaaagacttaaatataagacctgaaatcttaacactcctagaagaaaatgtagggaaaatttccatgatattggtcttggcagtgaccaaacaaaagcaacaaaaacaaaaataaataagtagggctacaccaaaatgaagtttctacacagcaaaggaaagtatcaataatgaaatggcaaactaccgactgggatgaagtatttgcaaactctatatctgataggggtttaatatttaaaatatatgaggaatttatacaacacagtagcaaaaaaataaataatagcctaatttaaaaattggcaaaggacctgaacagacctttctccaaagaagacgtacctaccaatggtcaataggtatgtgaaaaagtgttcaaggtcattcatcaccagtaaaatgcaaattaaaagcacaatgagttatgagctaatatctgttaatgtggttattaccaaaaagagaaaaaataacaagtgttggagggtatattgaggaatgagaacccttattgtaaagactgttgacttattcacaatatgatttttttgccttcttacctcttaagatttttacttgtattatttttatttacatatgcatactcgtttaacaagacaaattgctcaagccaaaagtgccaataaatccttaatagcaaactactggcctttatcttcaatgttcatgtaacctagactctttgtagtaataaacacttatgacctttatctttctccttaatactgtcttctcccttggaatatgtagctgattgtattttccaaagattgttgcaacagtaactcccatctcacttgccattcttataatatgactttatatttcttctacggaaaggtgtagtctatgtccctacttgtgaaatgcagagagctactgtacttttccagtggaagaaaatctttgtgattttaaatgaggaaaacattttttgataagacactaaaaacatgatccacacttaaaaaatgataaaactgactttactgatactaaaacttctgttcttcaaaagaaactattaagagaatgaaaataaaatccacaggataggagaaaatattttccaatcatgtatctggtaagttacttgtatccagaataagtaaagaaccctcaaaagttaagaattaaagaaaaaataaaacagagataaatgatttaaacagaccttttgccaaagaagatagacagatcgaaaataagtacctgaattagtcattaagaaagtgcagttaaaatcacaatgaggtaccaatgtacatggctaaaatattttttgaagtagcacaccaagtgttgataaggatatagaagaacaagcatactgatatggtttgtctgtgtccccacccaaatctcatcttgaattatagctcccataattcccacatgttctgggagcgactcggtgggagataattgaatcatggcagtgggtctttcccatgccattctcatgatagtgagtaagtctcacgagatctgatggttttataaaggggagtttccctgaactagctctcttctcttctctgctgccatgtgagatgtacctttcaccttccaccatgattatgaggcctccccagccatgtagaactgtgagtccattaaacctctttcttgtataaattgcccagtctcaggcatgtctttatcaggagcctggaaatggactaatacacatacactctggtgagattataaaatattacaaccattttggaaagcaattcatttctttaaaagttaaatatgcacttatgttataacacatatcttggatgttctactcctaggtatttgcccaagagaaaataaaagtgtatgacaatataataaattgtacatgaatgttcataacagtttatttgtaatagccaaatatgaaaaatgaccaaatgttcatcaacaaatgaacagataaattgtgatgtatccataccattcaatgatattcagcaatgtaaagaaagaactactgatatatacaacatggataaatcccaaaataatcaccatcatcctaatcatcatcttgattatggtgatgatttcatacttgtatgcataagcccaaacttaaatggtatactttaaatataagaaatattatatgttaattatacctcagtaaattctttgtaaaatgtaaaacagcttccaggagaatctcattctcttatgccacttaaccaggacttttcagcaaatcattgaatctatgtgtccctgttttcttgaataatttggataaagaatagtatcaactacatagcttgttaatcttgctttagtattaaatgagttaatctctgtaaaccccttagaggtgcctgaaatacgatctaagaattagttattagctacgcttaatatataggaagaggcagcaggttcctcactggtcttatagaccacatatttccctgatgtgatggaagtctatttcttctttcagtgtcacgaaaccacggaaataggtcgttcggggctacaaaatctttgtatttggcacagctacatgttggcaatctaacaatttattttaaaaattatttaaaataaaatacttaaaattaagtattacttaagttttacttcaagaaaatggaatgtcaaagacagatttttctaacacttccaaagacattttccatatttgctcatttccttttggtctgggttctatgtcactatagtgctctttagctcagcagaatatctcctctatatctccatgaataactaaaaaaatagatccagcaggttttcaattgctagtcactactcagaaattttgttgtttttaaaaatctttcattctggaattcctttcactccttccatctcctaagtaccataaactgagtttttaaacatagcttttcatggaatgagtacttcttacaaaatagaaaataccaccgaagagctggagacatgtttcaccccaaccccagattgctggaaataactaggattcttccatactatatacgacactttgttaacaatatctctgggctgagatgccatatctgagagaccaaactaagtatacttggttttttatttagtggaactgaaagcagctgcatttctgtttgaattgctccctgagctctcctgcaaatatataaagggatgttataaataagttagaagttgatgattctcatttgtcagtgagggcagcctaagtaaaagctacagcaggaaaaaacagaagcaaaatattaggaaatccttcataagtgtagggtgagttaatcattcagaagctattctcagagaacctgaggaaatatttaaggctagggacaatatcttttctctggaaaagatagcaagaaggagatatgtcttttccaagattaaatacaggattttgtaacttgattctctgatattaccaaattaatttgaacactgacacttcaagactaaaggtatgtgcatctctaagtatgcatgtgtgtgcccgtgtgctgatgtggggtgtgtataagaggggtaaagaatatgcatagcagggttttaaatcacccagccccttgctttcttgttctcacgggacatggctgtatctgcagttccagcagaactagctactttctgttttctgaatatgaatgttgatatccatttgttctcatgcatgtgaactcatacttttactcttttttttatgttttgagatagaatttcactcgttacccaggctggagtgcaatggtgggatctctgctcactgcaacctctgcctgttgggttcaagcagttctcctgcctcagcctctggagtagctgggatcacgggtgcccaccaccactcctggctaatttttttttttttttctatttttagtagagacgaggtttcactgttttggtcaggctggtcttgaactcctgacctcatatgattcacctgcctcagcctcccaaaggcctgggattactggcgtgagccactgcgcctggcccatattttttctttttgaatttccattatttatttattagttccattgctgcattggctgagataacttcttcaacctccctaggctgatgtgagaagtctctcctctgtgttcccatggcactttgtgcatacttctgttgtggctagccactcagttctatcaacatcagtgtggttggctctctccagatggaatctttccaagactggggtcatattttaattttctttgtatcattggtgctaagactgtatttggctttgtagttggtgtttttcataggcttgtggaatgaaggactgaataaataaatgaagaaatgaaaccctggggcttcaagaggcagtaaacaggtgcagtacttcaggggactttattgtgttggtgctggcactggtgacacagacactggtttactgtgctggtctctagcagctactgctccccttgctgccaggtcttttcacgtccctgggcctatcctgaattgctggggagtctggcagggtgatcagttgaatgtacttaaaaaagtgcaagatgctagaaagaattagcatcggggacagagctgaaataacatgatcaaaataagatgaataaagagacattaaatttaggtagatgaaatgaggcaataaaaaagtcaaggggaaaaatatgagaaagatttcaaaggaaagagctgtgcaataaagacaaatatttcaaaattctgcaacaacccaagagatcaaatatgtaatgtaaattgccaagtgcaattatttttaaggaaaatgaattactggaataattccttgaggaaatttacaatatagagaatttttctgtcaactaaaaaaataaagtcctctttcatgctatgatatttgagaaaatagctcaagttattttgaaaagtttctctagaaatatgtggtcataatggaatcattctcactttgtgcatatgagcacatgttcctatcatatgttgctgtatagcaagctatccccaaattccaaaatttagtgatttacaataacaacaatcattttactgttatctcttatggaggttgactgggttcagcttgggagttctcacttgagtccttcatgtagttgctatcagaggacggtttggcctgcagtcttctaaggcacactcactcacatgtctggtaactgggctcataagatgcaaatagccaggggctgaaacaatccagtatctccttccatctctttacagtatctccatgtggtttctccaacatggtagcttcagatagtattcttgcatggtagctcagagctacgaagatgtatatttcaaaaaaaaaaaatggtggaaatgtatttcctgcttggcttcagtaatcatgcagtattatttccaccacgtgtattccttgagaacagttacaaagactctcaggttcaagaggaggtgacatatactccacctctcaatgggtggaccttttaaaaccatcatatacattttctaacacagagcaacacgtgcacacacgcgcgcgcacatacacacatgcacacacttccttacaagctttcagttacttgggtgtcaggaattttcagcatgattcagacatgcttttagaactgctcatgtcttgctaatatgcatgacctccatagacatgtaaatggaactttattgagtgaaaatggcaataagttagaatgagataacttcttcattgcctatttttagagagactaattcctagagagattttacaaaatgcatatgattgcagtgggattgcgatgcccattctgacactctgtaacaggcaaaggttgcttgggaaacagaaactgccaactgttttgcatccaggggcttgtttgatggaataactgatttttcttggtccctcttctctatttactcgttgcaatatctctggccagattcccacatgtagactttctatttatgccttattttccactctcttcagaaaaatgactgaaactactatcactccactgcaaatcaaaacaaaaccatgaaagccaaagcagtcaccaagattattcaaaacgtattttaaaataattaccaccattgataccattacaaatgtctgatgccagtgttcttaatcttttgttttctattattgtcccgtgagaatttcctttcccatgatagttgaaaccacagatatattatatgctatatgtatatctgtgctttatacatataaaataagatattttaaccccctcaagagccaatttttcctccttgggatgatataacatctatggaaaatatatgacctataggtattgatttaaaccaatgatttaattaattagaacagcaaatgggagatactgccatctcagagattcacatctaaattttgacattttctaagtgtttgtaacacacacacacatatataattgtgttcatatatctaaatatctgtacataacacataggaaactccataaatccttatgtaaagagatatttccaccaccactaacagcaacaacaacaaaaaacaaagaggaaaaaatagttatttcacatatttcagatactgaaatatatctgtaaaggccagaatcgttgttcagaaagaagactttgggaaacaagggaaataaaagccattgtttggcttttagaaatacacaaactttgttaaactcccttcttaatttgaatagggatctgtgagaatagcaaatttcaaaaaggagatattgtaagtgtcacaattgtgtacatgccttgtacatggaagcgctgcatttactgccatgcttcagaatcaaccatgcaatggtcaggtggcccctttttctgggtcagaaagtcagggaatttcaaagtttaaaagttgatgacagtactataagcagtgaaagacagtttaatctgtaatgcccctcacaggcaggcaacatgggcttgatatgttattgtcaagccacatgtgcagtgttttctgttccataactaggttcagttgtgtgcttttatagatcctcagtgtacaaatgtatgcatgttaaatcttaggtagtactaagtgcttttagagagctctatttaaaattataaagctttagccagtcatagtggtgtgcgcctataagtcacagcttctcaggaggctgaggagggaggatcacttgagcctggaaggtagaggctacagtgaaccgtgattgtgtcactgcactccagcctgggcagcagagcaagacctgactcaaaaatctaaacaaataaataaataaaataaaattataaagtttgagtgaaccaccatatagagaaagatttatgtttagattaaaatgaggatgaaataaactgactagatctccagcctctatggccaccaacaaggatcattggtctacttggtggaaaccctgaatcagcttcccagatttggcttcacagtcacctctcttaagaggtctctccagactgcttcttcccccacagtcaaccacttcctcctctgtgtctccaaagcactaatataccccaagcacactataggaaccatcttccttgtgaactggcctgcttggctccccccgacacatccatgaagttgtgatcctctaaacagtcagggcatctagctgtctttgtatccctagttgggaaacacagtatgtgcacgtgtaaactatgttttgaagaaaggaaggcaaactggcaggttatggtaagttagtttaatcgactttggagaaaacctggtatggcctcaatatcagccctcgccattctgaccattcactctcagaagacacaggcactgaaattaggcggtggaagcactgaattggactgggccactttttccacttgcttgttagaaaaagggcataattgtattccataacttcactcttcccctctttctcatgaagaaaactctagagaaaagaaagctaatgctgtgtctttcaaacgggggagaatttgtatttagttgaatctcattggtatttttatggtggcattgctgcccttggaggggcagtcctccccagctacaggatagaacttgtctcattttctgtcaccagcccctatgacttcatatagaattccagaattctgataaactgtcatgtggaaaaatgataaagtgatttatgctcaatttttctggaagggagaaatgcaagggctgtcagtctgggtcttgagaacaaatgagttacagttcatgaggcagctcaataaggctatcatttcccatcagctcctatcactgacagccaagatttactagctggggaatgggaagggggctgagatttggtgccaggtgaatcggcactattattctatcaaccaggctcatatagacaagaggctaccatgaatatttgatggaagtgtcttcccagaaatgttgtgaaacagcattagttttcttccattcgccaggagcctctcctttctatccacgtgcacctctttgaaaaatgaccacttgtaaaccacaaaagcatttgggattgtttgtttttgctgctccggctggtggtatattcctcttggcagtctgtgcatgcagtgcactaattcactgtcctccattctcataggataaagcgaaaaaaatccctcatctactgagatgctatagacattacatctgtcattatccatctgatgcagtggcagtgagcgtatagccttccagccccctatgtgctcagagaaaacagactttgatctatggcatttgctgtgttctccaggaaaacaaaaggtggagaggtgggtttggactcagcataggcctagcaattgctcttgctgatttactctgaagtagaaaaacataactgtaaattctaaaatattatatgtctcttttatttgggacatttgttttcagtgggaaggggctttgcaggggacacacatcagtacatttcatatgggtcaggttattttttaaaaaagacacacttaacatttgcttttttgagctagggaaatgtatttctaaaatctcttgtgggaagtttagtatttagtatttatgttgtattcaaaatcatctgtagatgatttcgaatgcaccgtatctatttcatcatttctcaagtgtaatcttttgtaatctttggaatgttagttccaaaagacaacagtaggtatttggtgaacatgtgggaaatctgggccatttaataaggaagatatttttgaactgctagatattttgtttgtctttctactgccactacataggcagattgcttcattgcattatgaaactttcacttctcttaagaaattgtctaaatgttcagtctagtgaaatattgagcaaaaatgtttcttttatatgagtatgatgccagttgctggctaccagtctttctggcactgtgagatctttccttaatagcagtataagttttgaggctgcccaagccatgccttgtagggtcacgtagtgggtcagtgagatggcttatagagttaagtatgcaaaagatggtcagagaatttgaagctaagacaatacaaattttgagttttaacttattattttactcattcaacaaatatttattcagtaaatattatatgcagccatcattcttgaatagagttacttattaatcaagagaacagaaataaaaataattatcatgaagagtttcagaaaatcacaaatattttgagagaactaatcagagtgagctaaaagagagtggttattgattttagtttgaagtcaaagacatttttctgaggcaatgacttttaagctgaaatctggataactagaaggaatatggcatgcaaacatcttgagaaggtgcgttcccagacaagaaatagctagaatgtttgagaaatcaaggaaagtcagaggcaagactgtagaggtcttggtacatcattaagttgtatggagcagaagacttcaaagctctatttctggccccaggaagtcagatacactcataagtttccataaaaaacaagaaaggaaaattacggttgatgagtattctccgcaaccatcatagctaatgttaaatgtgtgttttttgtttgctatagttctaaatgctgtatatgtattaaatctttcgattctcacaacaatcctatgatgctgtatttttattaatccctttactgtacacctgcaaacagaatcacagagactttaaatgcacttcccacagtctcacagctagtaagtgactgagccaggatttgaccccaagaggtttggctccagagctcgtgttcgtattaggagacttaccactgaggaaacagacttagaggaagtctttgctggatagtttttctgaacttcatgtgagtatacaacttatgccactgagatcaaaataataacaaagtgttatatttttctcaaatgcttctttcttaggcttacctaatcctttatattaaaaagtcccaaagcctaactaacattctatagtccaaacagacacagtattattgggttcttggaaatctattcttcagaaatacaaattctaaaataaaaataccagattaaatataagtagtttctttataacgtttaaattcagaatccccaatgtcaagtgctctacggacgaaatattcactttattactttttaaagttaagctaaccccaatatagagaattaaatgatagacagtaaaccagcaggttttaagttttaatccacgtatctttgtctttctgctttatcagctaacgtattatctgccttaaaggcttctatttggtacactgatggaaatgatatgctgagtattgtatgcatttgtagtctgtatactttcatttgatgacaaaatgttattcattaaaactagctaaaaaagaccctctgtagtatcaattgtttcttctcttaatattagctcagatgcctttctcagctccttcctctaagcatgaagtaagatacaccagaaatgaggacttttccaattaaagcagcactcacagaatttataaatgcttgtttttctatcattacaatatcataaaacaccgtgtttttgattcatgaacttaagaactgatctaattcataatatcaataagtgagaataaaaagaatttcaagtttgtgtttattcatatatgaatgctttgagaacatagaaacgtatttgaatagaacttttaatcccagaactggaatttagtgaaattgaaatttctcttggtgcctctctcccacagcccactccaatcctagagcaaatccccttgcctctgtcctcagggtacacccggaatcccaccacttttctcacctccactgctgccaacctggtccaggccaccaggatctcctgtctggcctctcactggttcccagcttctattctaatgcaacagttcctttaaatgcaggttctttgaaagtttaagccagaacatgtcactgctctgctaaacaccctcaatcaagaggcttccatcttctgctagtaaaagtctgcaatgactatacggttctccatgagctggagctgcctcctctccccatcacctttatcacctctcttcgctctgcttttagccaccctggctttctacactccaggcccacactgtctcagagctttttcacttttggtttctgtccttcgaatgcctttcctctggaacatatgcatgactctgagtcaaatgtcttttttgtgactcttaccctaactacctattttaaaatttcagtctctcacccttgcactgtcagtccaggtggctctgctgtatttttttccataacacttaacaacttaaatcatactgtataactaatgtattaagatgacttaccctagaaaatgaaatccaaaagggcagggaatttttttcttgtttataatatatcatccagtggcgccatgcctggcacagaataggtgctcaagaaatatttgaggaattaatgaatcattgccttttagttaagaacatttgtcagtttgaccaagtaaataattgcaagttttatttttgccaattatttgatcacaagccgttatgttctgtgatactacattatttcattttattctttcttttgctctttttttacttcccttccttccttcctttctcaccttctgatttccattctttctctttctctcctgcttctctttcttctgtctctgtcttttctacctatctcattcaacaatatggaacaagagttaggttctgtgaatatgcaaagttgaatcagaagctgttcctccccataaagctcacagtctaatcctagaaacttagaatagaaactggccattcatgaggttaagtgctatgaggtaaggcatgtgctttgtgcatagagttggaggtgaggttagggaagtagtctagtgggatgatgcttgacttgggttttgaagaatgaataataatttcctcaacgcatgggatacggtagctgaattgtagggaatacgtactgatctattgatttttttttttttttttttcttaaccccaggtaacggtctgatggtaagttctgattttctcaatagttattatttgtacaattttaactggcagctccttatatctggaaatacagaggcatgtggatatagcaagaaagcccattggcatcatattaaatgagtgcatttagacctgggcttcacatatgattatccagtgagtgaaaattttacagaaatggctttctcaacacatagcttgtcattgttttcatcattattggaaaatttgacataatttgtaatctgagaaagaaaaccaaaatttagcttgataatcagcgtcaagctgcaataattgtctaaaaatccccagaatttaattttaacttatttctgcttctataatgttttttttccaaacacttcaccttataaacactacacccactcagttttagaaaagaggggacaggctatttgaatgcattgctatcttctgccatgtggaagataagaagtcactctgggtaattcaggatccttacttatgttatcaattattccttttgtgttttgtttattcaacctctaacttaaactcagttttttctgttgactcttaactgtgcttccttctgagagatagagatagatacagaaaagaaagaagagaaatcattatgaacaaaacaaaaactcagggcttactacctttcacttgtcatcctctctgttccactttttgcagctgaatctgtggccatttcctcatatgttctcactgcttagcctgctctcatgcagcgtgcagccttccctttccagcaaacagctcttgatgatattaccaatggcctccctgtcactaactaaataacattttttcagtctgtcttacttgctgtatcagcatcattcaacaccaattctcacaccctctttcttgaaacattttctttccttgtcttctgggacacaacagccatctgtttttcctctgtaaatgtttctccagtgtatccttttataagtgtatttttacgacccagctgctaaatcgtggagttaataaaggcttgctcctaggccttcctttattcacactatccaatgtgatctcatccatatatggagcttcaattaccgcttattaatctattcaagtggttcccaaaactgtatctcaggcatacacttcttcagatcctagaatcacatatataacattttactcgacagctcttctcaatagctaatggcatctccaaagttaaagtgtgaaacaaacaactcccgattttcgcattacgcttccgctctaaagaaacctagcttggttttcattctgtgttttctagctcatgaatgataccaccaatcacctggttgctgatttaaaaaccagagtcactttttactccctatgttcatcctaaaactaagtactacagatttcacctgctaaatatctctcaaatctctcaatctatccacttgttgttttttttttttatctccatgaaacactctcatctgttttgggtggacgactacacggggcctgctcatgaggttacatctcttatccttatttcttcgtacactagactcagtggtcttttcagaagcaaatcgtatgatgtcaggcttttcctcttaaatactttcccactatccttagggtctgtattaggcctttaaaattattttaatgtctagaaaatccgaattctaacctcttcctgcttgttttgttttgtatttgtttccgttttttttttaatcagatctgtgttttggatgtaaaataagtcattaatgtatatactacaacaaaaaatattgccaataaaacagtaacacaagccttgtttatcacatgaattataaactgcatttcaactttagagatataaaaatgtgaaaaaggaatgtgggccatatacatgatgagaaaatatgatatttcttctggtccccgcacttcatctccttgtctatctccttcctctctcgactcatctcagataggggtctccaggaagcctgctctgaagatttctatgcaggaaatttactggagcacactctcaggattaacacctgagggtgatcctaaaaagcaaatttgggtagagaactatgtctgagatgattctacaaaggactcaggctgggatggcccttcttcagtatcttgaattggacaagaagtctagacatttatatttctgcattaaccaatcatcaaatgtgagctgcctgcccatagagagcagacatgaccttgagtcaatttctagcaaagcaagcagctggagaatgagtgctcagtcctgaggtaggactgatgaatctaggtgacacaccacagtatccgctatagtccacttcctgctttatatagtaagttatagaagagctgctccaagattctactggtcctcttttacctgggcataagttgcaagaaaaagtttaatgggatagacttaagctccttttgctgcagctggtctcaagaccataacttatactttcaccattagtcctgaatttccttcaccctacattagtacttctgaaagtctaggtaacttgccagatgaggtggctcagatcctcatacctgagaagtctgatcctcttgttaccatccctttctagggccatgcctgctgcacttttctacttaccattaaaattgggcaagtgagtaccaagaaatgtccaagtggatcacctagtttccaaactaagaatatgattccttgatccactgtgtagtatcagtttcaccttctaatgatcaatatcatttagcccttccaggatgcagacttctctctttgcttcgtagtctcttagaatgagaagtcctaagttactgggcaaaacctagattttgagatataacgggacacttctttgtcccttggtagaagtatgttctctctcagaatcaagacatgtaaatctgtacagcctagaattatggagacaggaagcagaaattcctccaagtggttctctaggaatgattgtaagtaggtccattcctactttgactccatagtttctagacacatatattctacctagcatggacacacagtgccatatactagtaattgatttcacctgtacattgtcatcctttctgggtatcacctaagatcacacttggataattgtgtcttaaacaggcaatttcttcactatgtataaagctggaagcttatgaatggtcagtatatgatagagccgtgaatctcatgattcacacacttctacccctcttttctctaagataagtcagtttttataatatggctttatgcagaatcctgtgtcaatggatcaaacactgtaaatctctagactctagttctgcagagtttctgcaggcagaaaagaataatccataccatgatatatattaattccaatcaagagaaatgtggtagtttaaaatgtatccaaaaattccttaacagtccttcaccaaaaagtggactttaatatactttctcttgaatatggtatagctttagtcatctgcttttagtgacactggcaggagtgaagttacgtgacttacaaagccagattagaaaaggtgatccagttctcgcctggctctaccttgcatttgggacacatgtctttagagtccaccactatgctctgaaaaggtccacatggaggagtttacccacagactcagctgaagttccagctgagagccagtatctatttccagccatgtgattgagcaagtacactttcagatgattctattccccagcctttgagctgctctggcttatgtgcagtgaagcagagaagtgttgctgatttatgagcaaagcaagtgttgtcattttaagccactagagatggttttctgtgcagcgataaataaacaaaacatagaattactaccccttctaggtggaaggggtttaatatagtcaactttccaccatatctgtggcatgttccttcaagggatagtgctatattgggtgctaagtattttctattctagcaggttgaatagttgatgagggcagtaactagataatttttgtaaatgggcccatgtacatttacatacacataagactagcacttgggctgatgctgagtcttctgtcgtgttggcaggtgcttcttgtgcatgttagatcaatatgaagattttaaatatagtgcctattctcatatagtcattaacatgccaccaatccagacctccttatccctcatcattcaactcttccccttccagatccataatcaaccagctaagccctttgccactgtctgtgagtcagtctaagttctacctaaggccacttttatttccaaacaaagtggacaaccagatgcatgacatgataaccattggagaattgaagatatgttaaccattggagaattgcacctccccactaaattttccagtcacccttcagcagagctgtaaagtcatcaatgcccttttttctttttcttatgtccatgtagtaagctgattgatgcatggcccaagcttgaacgttttcttcttctgccagctagttataaaggacctccctcccattcagccatatgaattgagagccatatgaattgcaataatggtggatggcatggggatctaagacaccggctcctgcatcttatttggaacccctggtctggcttatgcccaatccctgaaataccatttctgtgttacattagattgttactgggtacacctgaattatgatgcagtagttctgatagacactagattataatgggtagttctgacatagtgacctctaccctatgttcagtcacttcatcttttccaaatcccagtagcatgccagaagctctatgttggcatggtcttgcagatagtatggttttgctccaggatcatacagtctatgttatgattcttctttttggattttacataaactaccattaggcttgctcatcaaagatgtttctggcatcataatattttctgggttgtttgtcccaaggagcagggccacttataccacagcctagttctgttttagactctgctcaaagctgacagcccttcatgtcatgcggtaaatgagtttgagcagtattctcaagtatggaacttgctatgctcagaagattgtgtagcctataaggtattgtttgcttttcttggtaatgacagttgcaagatgcaataatttgctttttactttaaggaagtgtttcatgatgtcagagaccattagacccctacacgcttcactcatgtgtggggctcctcaatttttattgggtttttctcctatcctcccacatgtgtcttctcaagcctccaattcatttgctacttttgctcttctgtttcaattagcgggatgttattgatatggttccatcaatatagtgaacaaagatgatattctccaaggtgtccagacaatcagttcccttcagactatattttgacataagaaaaaataattaacagtatattggagtaaggcaataaatatttactgtttctgatcgcatatgacatccagaggcagtactaatctgctctagcaaagatgccatgtctggtataatggttgcaattagagataacacttgtttgtttgagtcttcagtagtttactgtcattgaccaacattctatctggccttagtatgacccaaacctgcaaattatagggggtagcataggaccattataagggtggctttaatctctgctattccttacagggtgagatactgattttactgtcttgacagggtctaatatttggacttcctcattacagtagttcttaccccacacatcaggaaacgtgtcataaatttgtaactataaagtatatccattccactatacagtcatgactaggtaaatgatcatagctgtgagcacttcccttacaagatctttgcagacactgtttcttctccaaaatgctgttcattttcttctttgtgttcttaactcttatctatcctttcaatctcgtatatctgagagacattcctgactatatgaattcccacttcatatactcttatatgacctgtaactctcctttttagtatatagcagagttttggttttataatcatttgcatgaatatttaagtaatatttattttactgactaagctgcaagcttcatgaaataaagggaggattttgtatttacatcatctaccatagcacctggcatgcagtaggaataaaagttattgttgataaattattgattcgatagttgatatagaataaaggtgaatacattaatgaattatggaatgtactagaatttggattagaaaattgatagaaaatctcaaattctatcttataaaaatagattcttaggacccttacaacttcaaaaaaatgtttattagtatctggcacatagtataaattatgtaaatagttttgactgaatgaatgtatggcacacagatttgattctacatattttatccagactcatgtttaactagcttgagtagctcaaaaccattttaaattcctaactgggatggttgtaccgtaatggttgttgctttcaatatgcctttaaacataagacacgcatataacaacattttagagaaataggagtaaccgtattatatatactgttaaatcattcattaagtcaatgtgtttacttttgttcaattttacatattctcaactacaaaacttttctagtattaaatatattcttgaattaggcttttattctgtgtgacattttatattatgtaacatgttagagcatattaaatataagaacatgaatttctatctcctgatctttttttatgtccctatagaattccaaacacaaaaattacaaaaaagaagtaatttctcattgagagaaatgtctgattcaaggagcttttttgaaatttaagaaattgaattttaagaaatttcttattaggaatgaatctcatgaatgcttttaaatattgctgaaggatgtatgtacagaatttagaatatacaattatttggaagcaaaaaaatggaaaatctgcaactcttcatcaaaaggaattgttaaaaaaaacaaataatacatgcatgcaatggaatacatacctcaaaatgcagactacgaggtcattagaaagaatacagtggatatatgagttttaataacgaaacctctgcaaggatgtctttaagtttaaaaagtctttaagtaaaaaaggaaagtatagagcaactctatgtagaatggtatcttctgtgcaaataaaactttctgaaaagatacacaaaaaattgttaatacttcctaaggaaaggattagaaggtggaggaaaagtatatcattcactttttggtttttgctcttctttgctatttgaggttttatgttgtccctatattacttttatcataaaaattaatttgaaaaatactttttattattatatcactttatgaaataaaaactttaaacatccctgtatttgttaagggttgaaattttgtattgttgtctaaattgcattttattgtacattttatttctcaggtcatttaatatttgatttcctctggaagacaaaaaaaattcaaaataatcaataagacttcacactgttttattattgaaaatgtgatcaattttttttcctcacagttatcatgccactgttggatcaggtttcaaaatgtcatgtaacaacactttgtttgtgattaacacctataatcttttgtcatggcaacaatgatataataaatgctgaaggaagcgttgactgaaaaccatgtattactgccaagtgttgggacattaaaagggaaaagagaggaaaaaagaaaaaaacaaaaatgaaaacgaaacaaaacaaaaaaaaaaaacagacactgctgcccaggcttggcatgtcattaaggatgctatgtgacctcttcactgcctttgctaaaaacatacgtgagattgccagtggttcattcatctggctaattctatgtatatatagtacatatttgttttgtaaagttcatcaaaatcaaaataaacaaagtcattttcattcaatttgtgtgccttcaaaatgggggagcgggaatccctgtgcaatgtaattctttacttatttgcagaacaacggcagaacattggtcttgttggctgtcttactctgccaggagtcctgttcaccaaggcatggcaagaccaacatcctgtttattattttactctcattatgttgaaagcaaacactacattattgcttttgttcctccatattgcttctataagagtgtcacatatacaagaaacatttgaaatatttctattggtcatgctagtttaggaatttagaaccactttgaaatgggtaaagctcaagcctctctccacaaaactttataattgcaaaatatataagttttttgtttgtttgtttgtttgtttgagacagggtcttgctctgttgcccaggctggagtgcagtgacgtgatctcagctcaccacagcctcgaattcctgggctcaagtgatcctcccacctcagcttccagagtagctaaaaccacagccatgtgctaccacacctggctaatttttgtatttttgatagagacggggttttgccacattgcccaggctggtcttgaacttttgacctggagcaatcctgccaccttgtcctcccaaagtgctggaattacaggcatcagccgtcacacctgacaaaaatatacaagttatataaaattatataaaacatcagatgatatatatgcttgtattctatgggaaatggggtctctatgaaacgtggcatctcattactatgtatgtgataatatccaaactcctttgtaggtatatacagctcttgtttatctaacttacaccaattttccagtgactttccaaccaggaaagattctgtccacaaggggacatttcacaaggtctggagacatttttattaacacattatgatgatggtggtgggagcatgtatctagtgggtgaacagcacggatgctgctatacatcctacaatgcacaggacagccccaacaacaacgaataattaagtccagcatgtcagtagtgccaaggttgagataccctggatggcttttttctactgccactttccaaatcttattcagcttcttctacacattaaacctcttgtcatttccattctctctacaatgcccttcctctttgaccacataatcactcatgtttgacgtatttccttttgggtaactattcatcagtgtttgcatagaactctgctgagaatgcccccgttgtaatattatgatgtttactagcatatatatcctgcccaccagaccttaagctccttcagggcttctgaaatgctagtgcctggtagtcagtagccactaaataatatttgttgaatgctaactgaataaaaataaatttttaaggttaaaatatatttaagttttgtttgatgttttcatgaaagaaggatggaaatgccttaaccagttattcttgtaattaatccaggaggttggctatgatgaaactaggaggaaatgacctattataggaaataaaatttcggtcacaacaaaggaatactctgcttggaagttaaatcaggccttatgcagttgcaggtgctttcattatgcagaagatgtaaaatacagtgattgaacggcactttcttagcagagagatgatacaagaacaggtcatagaatcttaattgacttcagctatttcaagcattctgctatcctgtaatcattttagcctgacttctgcataattgcatcccatctctgcagggcatagtaaccgtggaagcttctccaggactgaaagtttttaaatgctggtgagtttgtggaggtgcaactgaaactcattctctccactcctcaccctgtggcacatattaacacgatggccctctgtcttcacctttctctgtgaagtgctgtcactccttcaagtcattaggttgccctttgcactagagtaaattccatcgtatgatgtgtgaagggatacagtatgtatcccttaagtatggtgtctccagtttctctagagcatggatgtattttcagtttcccctgcaatgctgcatacattggacttaacataacatgtggtctgagttcaggctctgctgtttgtcaactaaatggcgctatgcatattacttattatcttgggtttcagtttctttacctgtaaaatgaagcattggaataaattatctctaaggacactcatgggatgaatctcctttaattctatgattactattgattaaggaaatctctgctcattatcttctatgtgcacataagggattttatcgtggcatgaccctcagcctacttgatgtttaaacaacttgccatcagacattactgagaactttactaatttaagactactcaaatgaatttgcattgaaattgtgaccaagaccaagagagacttgtcaattcccttcaataatcaaacaataaatgcttttccttaatttggaagcagcttcctgcttcttgccctatctctagcctctacaatccatattcaggggactggctaacagagagacactgctgtccattgtctggctagctaataaatccaatctccctatgagcctgttgtgaactttggttatacttccacaggatagggtcaagagacactaaccttaatgaatagaaagctacacatttcctgtattgggattttttagtgcattatgaaccatttagtcttttctggcagcctacacttaaggaaacatgaattctgggaacaggaatggagcttctaagcatagattctaacctgaggttatttttgttaaatgtcagctaattctgcctatgtatagtgaatagaattcatgattagaatttaaattatcagttcctgttcctacctgctctgataattggcctcataaagataattgatagcttatgcctaaactcatgcctggtcaagccttctccttctatgtacgaaaccacttttaagggacaaggaattgttaattaaataacatcataagtaagtgaaaatatatacataatgttaccttaatgactatgctccataaatttcaaaggcagccacacaaacatatagagaattctcttaatgaatattttcacatttaggttaagcctactaagattctcataggaagtcagataagcgacctagttttaatatgaaaaatatttcaatgtattttaatggtaatctgtatataatgtagttatctacctaaggtgtgttttaatttttttttcctaaaatagaccttaatctgacatcaatatttttatgttcctgtaatggctgcatttggggaaagaactattggagacataaagcaatatctaaataggaatggacaggcatccacaggggcaaaaacatgcaccagcctgagctcaggatacctttcaaatgtaaccagccaacactgttaataagtagaagcagtggagaaccatgcagtattcctacacacaacacaaaatagaggtaagtgacaaacctacagattgaaaggtcaacaggctatcttttaggtcaggcaaaggatgcatacaattagtgctgaggaagattaagtatctgaggctaggacaataacatccacatttagaccttcttgtaattaatccttcagtttgaagacaattttacgtgcatacacacacatacacacacacacatacaaacatatacattcacacacacacccacatgtcaaatttcaaagttttgagtcattataaagttttgttgaaggcatttagtataatgtaactgaaataactgttggcatagtcgtgatggtttggaatacttatatgaccaaaggggtggagctgtagctcatatcaagaaatgctaattagatttggactataaattgttcctatcagccacattgaccatacagctgtgacttttcggttaggctgttttatttggtttattttttgtccaggacagccaaagaatgaagtaattttaattgcataaatttgactttcaatggatgcagtcactaaatactcatctccagaatgaagctttagcttgcaaagctaaatataaatttccttataactgaagagaaaatacgcatcttgaaatgggacaaaacaaagatattttccaatattaactgcaaagtcagtattgttttcatcctttcgtgtttatccccattatcacatttctcaaaatgtgacatttagtttttatgatccatcaaaccaactatttggaagactaccaaatattaacagaataaattcaagacaattgtttttctgtttcatcttctgtccaatagaaaaccttagaatgtatgtgtacatgtatctatatttacatatgtcttctgttagcaatttaccattcttaaagttttgcttattttaatctgaaaactcccttcttatatgtgcatgtatgataaatttttgatattcaagtatttataattaaaagtattattctgaacattaataatccaaatcaacactgccataataatactgttttttattaataatgtaagcctacagttataattttaactctcaattttgtacagatggtgatttttgtatcaaaaatatattcttaacaatagaaattgaaagaaaagatacttccatttaatagactctgcatatcctgataagaatattaattgattctgagattggaaaagcatttaaatacagtgaaaatactaagttataaattaactgttcatatttgaacctgagattgttagataattgaacatttcttttaccaagcataattttaatttaattttgacccaaataactacatttccactcaaggaatagttttcttttcctttttttaaaaatttgaactccactattttctcacctctatagagtttaaaaatttaaacaaatataatccaaattgcttaagctacctagggaagataatgtaaaagtcagtaataatgcataaggactatttaacccagctatgcagtaatgcaaaaaatatgactaaaacatgcatcaatgaaaccagaaatagaaagaatcagttaaaataatggaaccttttagcccaagcacactatctgtaaagtaattttatcatgattattctaggtccctccacctgaaatcacttatctatattcattgaaagaaaagccaagtgcattatctgaagggcccaagtggattcatatttatttttccattttactttaggcccattgatttttattactggcaatgttgttttaataacataccacagcagatttttaaaacacaacattatgatgtaatgaatttgatgtttgcctttaaaaatcactaatatatccacagggttgttaaaaatataaaataaaataaaagttcttaagacaaatatatttctgaggaagaattacttatttagttatataagctagatgactgatgaatggaggctttactcctctgatttcaaaggagtgggaagacccgatctggagtattgtttgcattacttggtttcccattttcagatagttattcgcaagctagggtgctcataaaagaggatgagagaccaattatgatttatacattacacctcactgaggataatcgaagccagtgagtatgtgcaacttggagataatatcagtgcgaagagccttagaaagatttcttcaaatatgtgaaaggctaacatggaaaagaatgaatagatttctttctttatagatatctcaaacctctaatcaccaaatggacttagatcaatataataaggaatattctaacagtgatatccaatgggaagagtgcttcaagggaagagatgggtttcttatactgaattttcctctgttgtggatgtgataaggggatttcctagatgatctcttaaaatctcttcaaacctggaggctcgacatggtggctcaaagcctgtaatcccagcactttgggaggccaaggtgggcagatcacttgagtccaggagtttgagaccagcctgggaggcatggcaaaaccccatctccacaaaaaatataaaaattatcctggtgcagtggtgtatgcctatagtcccagccgctcaggaggctgaggcaggaggaccacttgagcctgggaggcagaggttgcagtgagcaaagatcatgccactgcactctagcctgggtgacagagcaagacatcatctcgaaaaaaaaaaaaaaaactgacgtaatccttccttttttatatatgtgaaattatattgaaataaaaggggtattgtgtactgagttgctccttttgcaaacctcagtttgttgaccagagcattggtcaacaaagtgtaatgagcccaccccatggctatgtatgacaatcagtccattgggacggggcaagaacacattgaaacttctattggggtttattttattgacttttctgtttttatatatttggatgatcaatataatattagtgcagttaattatcattataatttataaatgaatgcttaaagattttaaatgtcaaatgtaaatatgtaacctttttactgataggagtatgaaataaaaataaacatttggggaccacttcaatgaagttaaagcagaggaaagttagtttagaataagtgcactggaatcttttatatctatgacagaaatagagaacaactcaaagaaaacttaacctttagatatttatgttggtcaagttcatgccaataaagctatgctaggattaaaaactgaaagtatattggaagaacaggacttgttagccatattaatgttaaaaatttcatacattgtcacagaattaattgcgtatgtaaattcgggtgcagtaataatggcatcataggtgaagcactaccctttcacatctagggtcatgttacatctaacccaaggttttaaccacaattagttgagtggtttggggttattacctgccaagcagtagttcttcattagaatgaatataaagcacatagtttatcacaattaggcttaattggctatcttagtctctgttcagtagatgccaagaacagagacagcatggacaaaaattctcatctcaatacccagaaaggacagttttaggtcatttcttgccaggttctgtgatggatgtggtctgacttcactttaaagtactcaaacagagggcattcatagctaacaataccatattttattttatcttcctgagagttattgacttatctttatttcttaccccagcttcttccttttttctcattcttttccggtgccatttttttccttcccccactttctccccctcatacatgcatataaacacacacacacacacacacacacacacacacacacacacacacacagttctgaggtcaatcaggaggctccaatcaagcaatgaatacacaaggaggactataacagaatgatatatgatttgcattaataaatgccattcttgcttttatattggattctgaaagaatttttgtatgtagaggatgaaaaaaaagtgaggaaccatttttacctaaatgtttcaaaaatatcctttccaatatgcagcattttaaattcagagactattaaaagagagaaaaacaatcagttttacttcataatgttgagagctcttggcagagttgttagaagcactgtaatctattgtgcaaatgatgctgaaattttgtatcatctctgatcaatgagtgtttctagagtacttagaatcaagagaaaacaatgaaacaaattagtagatgagaggtatagatttgcctcatccacagggaaacatatatttttaagtcacaatgattaatagatctagacccatcatatagttaaaaaaagtattgatttctccttcaggcttacctaagaaaaattatgaacatgagtttataaaagcaaacgtattggtaataaactgagaacagaatgacaaaataactttaaagccagaaaatcctgatcaaagttattcagtaaatatgttattcagtagctatgacacagattgttcctaaatataaaccagaagagtataaaattatttcattgaaatacttagttctttaatatgttgggttttttttttgggggggggggttgctggtttatttgcttttgtgtgttcatgtacattagaccaaacatacaaatagattatgttgacttctgcccttagtgaatattatgtttgtatttaaaggttattttcatcaacttttcatcataaaaattgaattattttcattctttctgttttagtccagtcccaccatttaatttggacattaaatcctctgagtataaatatgacagtaacataaataaaattgtagaggtgaaagtaaattggcatatacagtgttttatgcagaaagtattattgcaactactaaattttcctgtagttgtgctctaaaatataaacatgcaagagtcttaattttatttccattataagtgataattgttattgcttgaggtgaatgataatatatagtaaacaaagagcccagatttctatcaaaactgaaaatccacttatgtgagcaaagatgaaaggtcttctgttttaaaactgaaaatcttatgaatggccataaatgtgtcttttaggtaacaatcagtgtagtgagtatcttattttctgaaaacatgcttggaaatttattgaattattgttactgagttgttctgctaggaattgtgagcccatgagtggaagaagggtggtgtcttgtcagaaattgaaatatatatgaagaaaactgagcattttattaccatttagcttctttcaggactacttaacaggactgatatcccttagcattgaaaacaaatggtgttctctttagttattggatactgcatttaagaatctctataaagataagcactcagccttgacaatgtaaaatctgaaaggagcaactcacaagctatcagaagaaaagaatgaaacacagaattttgtctatttatcagcccatctacctgaaattatttagattatttaaaaaattaaagtcaaacatgcatgatcatcttagcactatcatgtatgttgaaataaggtttataacgctttgaactttaccccttcaggttactcatcggtgttctgaaacatgtgcatacaatattcaggttagaaatcattgagaaaaaagagtatttaatttttaatgagtatgcatgtccttattgtctagaaatagtcactataaagatgttgatgtgcgtgcaaaagtttgaccttcgacatgagctgcccagcactcacatatgcgtacaagcccttgtcagttaacaaagaggatctgaggtaaaactcctaaaacaaaggtactaccagctgaagtgcagacaaatttaggaactatgagtagggttgatctagttttcgaaatgatattgagctcttagagaaaatgaataagtggaaaatgaatagtttatacttcagagaagccctgacaattataaacagtatgaatccacaaaacacataagtgataaatgactatgatgatattaaagaaaatcccccagagttcctttttagtctctttggtttgattccttttataaattattaatatttttattaattatgaaagtaatttttgccataagaaaaataatgaataagagaaaaggtaacatttcccctagttacatgctaatcccaatcctcagaataatgttgacaagttggtattctttggacatttgcatgtgcctatttaaaaatatgtataatatataagtgtaatataaatatatacagaaacatatatgcacatatatctaatgtaacaggtgtcccttcagcctgattggtcccatggctagtagacttgtgagatttccttaattatctgcaaataaaatggaaaccccatttcctacaaggaagtgtgtagtgacttcccacaggagtcactatttttttcagtgaagtgcagcatgacaggggacagggataggatggtgtaacagtctgtgattattgtaagtgacatttttttttctttcaggtatacctatacttgcacacacatcacacccagacctatacacataaactttaaaaaatatccctaaataatggtgcatgtctgtttctgcttcttgcttatttccctcaatacattttggacagttctaatgtcaatacatacaaagctttttatttctctcacagaccagtgggaagtattccattctgtaatgtaccaaaatgtattttcactttccccttttgatgatatcatgccattattccacaataaaaaaaaaacgacatacctaactatacatctatctatctgtgtaaatatataatatagtcctttacccactcattcttatatatctgcagaacaaattcctaatatgggatttgactgaagtatacacaacttaaatatttttaggtatgaagaccaccgttcctttgttcatttgccagtgctggagtttatcattcctttaatttgcttgatctaataacgtggaatatgttatagtttcacttcagaattcacagtgaatatatttgcatatggttactggccatttctctccttaaatatttttttgcccatttcttatatagattgttttattgacttataaaactattttatactttattaatatgagatctttgactccgtgaacattttcttttagaatgccatttgtctttttaatgtgtttatgatatctttcatcctcatgagatgtattattttatgttattttatttttactaaaacttgtggtatgttatacattatattaagaaatgccctctctacttaaatatttttaaaatgtctgctgtattttcataattctttcatagtttgtttgctgattcttgggcccttaattgttctcatttattgtggcagtggtgtaagatgggactttacttgggttcatatatttaaagcgtttagaaaggttcttgggacactagaaactcttcgtgaatgtactttaatttttatttacaattctggatcagggtaagttgcaactccctgaagcacctgctctgtgtgtactgccttcacaggaggtagggctacatactggttggacaccgaatgaaaataagcacctagattctagaactttgtatccagtgactaatttgtaaccccagtaacataacttggttctctaggcctcagtttccttcctgagaagctgagaatcaatccccttgtcatttctcaaattcttctttcacaagcactgattctatagggcatttgtttacttgaagaaaatagaagtgaaatacatcggagaaatgctgaaagctaaagtagtggtatgtgtgtgagagagttttgttttgcttctcactgtaagccttcccgaagtcataaagattacctgtgttgtgaatctacgtgtgtgatacaatattttctaaacttctctaaccacatatccttttgttccctcagaacttctcataaaaattaatatcttagggactatatttttcgtgaacagcagagttagatcatctctaagtcccttttcttctctaatgttctgggaaccgcatatgttctgaggctaagccatgctgataaacagaacttgatttctgaagtcactccacaggatacacattattaacacccatttccaacaattacactgtttctcatgatggccccacatactcacgtattcattcaaagtgttattacttccattgccaggtgccaagatgctgaggactcagagatacttaaaacctggtgccttcccttggagttcttagtacctctgtagtgtgttgggagcaccatttatttcttagttttagaggcatatctactttatagaatcaactactcagtaacctgtgtgtatgaaaggtgcatgatattttaatattgcaagatgctaaagagattgctttgttattttttagataatgactatcttcacagtgtaagaagtatttatgttttgaatcctgatagcctctaaactgaaacataagttgtttcactgtcaaatttgcttaaaataattatattttcatagctctgtatttagcatagcttatgcaagtttattatatacatttttatgaatgcttattgaaaaagtaaagtattgaaatattacagttattaaaaaagcaaataagccatatgatcaaggagctgttctatagatctaatttgtgacttaattattttaaggtaaagtataaaatagccaaagcaaatctaaataaatttgtgcagcaggtttagcattccttttgtggttattgttgaaactctagcagggtaattaacagattgaaaactatactattgttttgtacattttcaaaagaaattgaagcagtgtattagatggaagtagtagctgtaggctacagctctctctctgctgttggatctgtatatcattaactggaaataaaatgacccattgagggaataccatttcctctggattcatatctataccatacttactattattaatcggtcttaaattatgcttacatttaaaataacctattctgcaagtagaaaaatgaaaaacacatagaaaaaaataaaattgaaaattctatgttgtcaggtaacatgagcagaattataggactgtattattttgaggcgatcttctaatactatatctagacactgcaatatctcctgcaaaactggagatttgcctgagacttggtcatctaaccctgaaagctgaggaccagaaacaaatgtgtaaacttgacctttcccctgcctactaggagcgtgttttgaattctcactatagtcatgaatgagtaaatgcagaaaatgggagaaagaatctgcttcctgccgtatttcccactattgtaggaactgagagagtttcttctacaggtccttgtgaccactgactccaacttctgggtcaagccatcagacaaattctgtctgcaatttaatgatctctagtgaatgtcgattgactttctagtttttgatcaccaaaggcaagtataatgtgggtacgctaaaattcccttactaaaatattttagaaaatttgttctaaacgttaccactttctggcccactgaggcaaagagaggaggagtccccaaagacaaataaaataataaattaatttagaccctgggagattgactggcttataaagtcctatgttggcaatttcaatggtctgaacaaagtccgcaaaataagcctgttcctggctctatggcttacatatgtcctcaaaaagagcaacttgctgatgcattgtaacatgaattaccttagtacatttacattaaaatgtgacatgatatcaaaagattataagattgcatatctttgtcatactacctggaaaaaaattatggataagtgtcatgttaaaatcttgttctgtcatgaatataagctgagtgtaatcacaaatgacagctgaaagaggatagaaaaaccatcttgacacctaagtgatgatattgttatctgtattctgaataattttacttataacaggtattgctctgtaagtttgtcttatgatccgtgttttaattctgatgagagaagaatgttggagttgaatatcatattccttaacatttattttccctaatgttaatattgcttcatcagttttctttctgttggtataatataactatagtcatctctttactgtaaaattaattccccatgccatcttgctaaggtttgtcttctataaatcctgtttagatgttttttattttattagtattttgaaaaatcttaatctttcaaaaagcaagtatcatctgtttatatttattgtcattactgatattagtgaccatttattttacgtagatgtatatgtgtttatacattctttccttattttctcttgtcctgacctactttatattggattcatgtttcttaattctctttactgtttcagtggtttgaaagctatatattctatttgtagtctttctagggtttaaccttaatgtgttcacttaatttacagagctatggtagatcaaaatcactacattactacaaaatattattggaaatgtagagttctttagccttcaggttagcctttagcctttctctttttcactccctgtctttgcctctcagctttcagataccgtccttatgttactatttagttttctagttctactttaaaatattttcctatatttgtcctttcctttaacaatgttcatttatttacattaatctataaattgaataatgaggtggtcacaactgctgcatatgttttagcccttcatttttatttggctttcttctcactaaaccacatcctttagaagtttcttaagtgcaggtctgtaaatagtaacatatctttgtctttgaaaatgtctttagttaaccctcattcttttcaatgctagttgtatggaattcaggattgttaggttgaaaattcttttcctttggaattattaaggtattatttcatgtatttacctcttattattgctgatgataaacctgctgtcaatctgttcaccattcctttacagatcatatgcatttttcttttctatggcttttaaagatttttcttttatgttctaaaatttcaccatggtttctctaaaagtgatttgttaactgctttaaatttggcttactacttgaacttgaagacttatgtctttcttcagctctggaaaattattaatcattttctgtgtgattactgcttccctttaattctatctatccttaccctttggaatattttattaaatgtatattgcattgatttgtgtagttctgtttaacttaaccacacttatttcccccccttttaattttctgcattctgggtggttatcttgaattggaagtttctggaacttttctttctcagtaatgtattttttaagttttttaaagttatattttatttaacatatataggtattggtagcaaaagagaggtcacttatgttagttcagtctgccattattttagatttagttgaattctgtatacaaagttttgacacaaaatgtgtctttatactatgctgagacaacatctaaagcttctcaggaatagcaaaactcttttaattccttggtcaaaaaaggtcaacctggcttcgaatgtgctggaagtataaaatgactctacaaaattacagggcacattactattttctctttagtgtagcttaattgtgaccgtgtgtgtgtgtgtagatacatgcgtgtgcacagaaagactgatttctttccacactttaattaattgaagagatgtagattatgcagcccatttatttacttttctcctatacacgttttacttttctaccaacttcagttgttaatattagactgttttcttaatctgtgttgcttttttatctccttcttaattacttttagaaaatttctcttttttactccctatctttgcctctccgttcaatatattttttaaaagtttcctaaattttggctttttgtacctgttacaaattatatatacatattaaaactgtcatcatagtactagaataataaaaagcaatgctattatcatcaaaaccattgagaatgcctttaaattttatttagaatatcaacaatagttaattggctagtgcactcattgaaggagagcctattttctctaaaatattttaccagtagtgggagaagaactgccacatggcttctaaggttttatagataactccttgttaacctcaatcatttgactttagacttttgtgaattcctttttccatctttcttttttcactttattttgtttagatgctggtttgattgaggttaataaaaaaaaaaagaaaagaagaatagtggtcaaaaccaaaaggaatgaatgtgtatcttctgtgtaattaaaagttgatgatatctcaatatttgcatgtaacaatattaaattctaggactaacacataatatttcagcacattttaatgtttaggtgtcttaaaaatacatccattttggaataaatctatcttctacagtcttagctccgtgaggggatacagcttctaaaagcattacctacaaagtttggaacataataaggaatggagagaattgttaaagggaagagaaggaaagagagtatgcacaatgagaaataatatactgtttgaagaaaataaaagcaccataatctaataaaattctcagtcttttcagtcattagagcttagctttagagagcagtcttactttgttgttaatttgtttgagtttttaaaccagacttactaatttaaatattagtacaaaaatattgtaacagcctatgcatatttgagaatataaacctctcatccttttttcaaatacaaacctcacattcttcatacaaagatcacaattttaattcttgttcaaagctttgtgaacatagctttcagagttactaagtctacaaatagttacagatatacaataggtaatgccatttttatatatctcaggctgcctgtccccagtaatctagaatgagtaatttcaaaaacaagcattctgacagttcaatattataatttatttttataccaaatttttaaagtatttttttactttgtaatactatatgcttattcaggactctagagaaaagaactccattcacaaaacaattcctacaacgtttttatatgtacttcgatgtatatctctattgagtaccacatcagagaaaatatagaatgtgaattctgtattatgacttgcagggaacacaaaatactctgacatatgattgaaatctgcctaatagcagtaaagtgaatcttaggaagaaaatcttaagcatttattccacaactctgcaaaacagcttcacactgaacctctgagcctgaaatgtgagaaaataaagtgattgaagcctgtcagcaaagaaaatcagccaacagagtgatgattccccagacaagaaaattgaaacaagtatctctactgcattaaatctgaatcagttaccattcaaaaggaagaaatttttagataaagctgagatttacgtgaattaaaaaactaagtgtgtgtgtgtatgtgtgtgtgttccatttatttacccaacaacctaagtttaaagaataattcataattgagtaacataaaatagcccaatgaaatataataaaagagaacatttaattattgccactactactttaaaatgtttgcactctatttcaaccaattatgtgcatatacatatgcacgttttactgtagcaagtgaagtcctggttgcctttggatcccttaatgcttccaagataaattctaaacctcttaacctgccaataaaagtcttctaccatctgcctctattgtatcactcccacattatctcctatttattccctacaacataacacctgttccagccactgttgttttcatcctgtccctcaagtgttctaccaccttctactccatgtgcctgtgcatcgccctatctctttacctttgccaatgccttcttccctcctcccttccaattatttaaagaggtaagtttgtgctatctcatcgtacctttcttaacttattctgcctcaaattaacacttttctctgaactcccatagcatttaactataaagatatacacatgcctgtacagggctattactaaatgtattatttaaagattgctttgtgtttttattgcgatttaagatgttattgcttttccaagttgtttaaacattgtagtcattttttattgtgcttggattttgattggtttcaatccaaaatatgatctttagaaatgtctaaaacgtctatttagctatttgtaacctctaaagatagtaaggttggtgcaggaaatcatttgaatggcactttgttttgttttgttttgttatgctttgtgacaaagtcttactttgtcacctaggctggagtgcagtggcatgatctcgactcactgcaacctccatctcccgggttcaaatgattctattctcatgccccagcctcctgagtagctggaattacaggcctgtgccaccatgcccgaataatttttgcatttttagtagagatggagttttgtcacattggccagagtggtcttgaacttgtgacctcaagtaatctgcctgcttcagtctcccgaagtgctgggattacatgtgtgagcctggcctgaatggcatttttaatgtgatggtttcagagtccttaacgaagtaagatataatctcccattctttattacatgtctatgattgtgtcaagaagtcattattgccattttttttactttcatggtaaaaatagccatgaattataagctttttttttttctgccagcctaaattgttacttagtgaagatgagagtacaactgatggactttgatttattacatctttttttcctctaaggcatatttatttccaaatttgcttaatgttatagtatacatgccatcttaattagattatcattaattacctaatgagaagagtttgtgtgttgtaacaaagcacttaccattaagaaattcctttgacaggtttgttaaagatctcatgattgtagatgtgtggcgttatttctgaggcctctgttctgttccattggtctctatatctgttttggtaccagtaccatgctgttttgtttactgtagccttgtagtatagtttgaagtcaggtcacgtgatgcctccagttttgttctttttgcttaggattgtcttggctatatgggctctttttggttccatatgaaatttaaagtagtttttttttctaattctgtgaagaaagtcaatggtagcttcatggggatagcattgaatctataaattactttggacagtatggccattttcacaatattgattcttcctatccatgagcgtgtactgtttttccatttgattatgtcctctcttattttcttgagcagtggtttgtagttctccttaacaaggtccttcacatcccttataaacagaaataccatttgacccagcaatcccattgcaaggtatatacccaaaggattataaatatttctactataaagacacatgcacatgtatgtttattgcagcactgttctcaatagcaaagacttggaaccaacccaaatgccgatcaatggtagactggataaagacaatgtggcacatatacaccatggaatactatgcagccataaaaacggatgaattcatgtcctttgcagggacatggatgaagctagaaaccatcattctcagcaaactaacacaggaacagaaaaccaaacaccacatgttcgcactcataagtgggagtcgaacaatgagaacacatggacaaggaagggaaacatcacacactggggcctgtcagggggtgggggctagatgagggacagcattaggagaaatacctaatgtagatgacaggttgatgggtgcagcaaaccaccatggcacatgtatacctatgtaacaaacctgcaggttctgcacatgtatcccaggacttaaagtaaagttaaaaaaaaaaaaaaaagaaattcctttgacaaggaacctcaatttctttgtctatgtaagattgtgctatagaaactacatggtcacctccatttctaaattgttagaatgctgtcaacctgtaaacatcatggcattaagagagcatttgcctaactgtgaaagggttgtatggaaaaataataatatattgcatcaatagttagaaagttttaacttttagaaaatgattttatgaaattagcctgtgtaacttcataaatagatgagttaatgaaattctaaacatgtgaatgtttgctaaaaataaaaatattttatcccctttccactttaggaaaaaatatattaaatataaaaacaaactcacatgtatcaatatttttttaaatcattaaccatccttctttcataggtttaaaatctttattgaagggatcactgtaatgttttacacacaacgtttggctgatagtaactggcaattggatttagaatcccaattcaagcacaaatccctggatgtcacaggggaaccttgatccttgatctaaggcaaataagttcttctccaagttttataaaagaggatcacttatagccaaccatgacgttataactctcatggcatggtgcttagtgagagaacaagctactctaagtagcaaagcattgaaaactgaagagcctcctgtaaaatgtaagctacttttagcatgcagtcatagggagctggattttatttttttaattcagtaattcagctttcaaatgatagtgttcagttgttataaaggtcacctgcccttggcctcatttcagcttaattgggacaggttaatcttcttttctgttgttctttcaatttggaatgaaactgggatctctattagtactgctcatccatcaaatcctatgaccttgaaagaaggcagcagcccttcttctcaggagagagtctgaagatgagaattaaaataggtcttctcagtggagacccacggcaacatgtaataagacatgtaaaaaaagactctatcactgcaggcatcctgtaacatttctccaagttacatatggagtcaaaaagagaatttatttaagctcagagtaaaaaaagaaaaaaaaaaaaagaaatcaggaaaatatgttaaattcttctaaaaatcaactaaaattgtctatgaaaatgttcaatggacgtagattttaaaatatgttttctttccaattatgaaactttccaggtatgaaagttttaactttctcgctagaaatatttccaaaaaaaggaagagtagttatattagcaaaaggtgtggataataatgcccttttcataattataaaaaatatttttgtttaaacaatgagaagacttgttgaagtaaccgtaggataggctgcttgtatgataataaacacaaagtgaggatgaatatataaagatcactattataacagcaatacttcatacatgagtcaatgtttattttgctaggtttggttattgaggaaaattgccatgatcccagaccactatggaaagtttataaaaacaaggtgtaatgcttccttttaacttcacaataagcaacctatgtaagaacacataccgaacaccaagtaaattaccactcttcttctagaattatccaagaaaacaacatcaggaagaaaaattagtttgatgcatgtaagactgaagagcttttcacatgatataggactacaaacattaaatagtctgaaaaaatgttgaattcattataattaaagaccattatctgaaaatgaaagaaaagacttcactacagttacatgttttacatgcttcattttccatgtgatttcatgcttgtaaagccacccagaaggatccctacatctccaagttcagtgctgtgttctgtttataagttgctctatttacaaggaaaactcagagaaggctctccaaaagtgattcaaagtctagggcaatttaatgatcattcatcgaaagttgttatctttacattaatatttagatagccaatcttatccaacctgatattttattaagtataaaattatctgtgacaaacaagtatatccttaacatctggtacaaataaaacatcaaaaggataatgattataatatttcatgttttattcatttttaaagaaaatgtttactttgaaaatattattataaatttaattgatcaaagctcaggctgagccaactgaaaaagaatttatattccaattttatgtcctactagttggtggccttagataaattatttaacttatttaaatttcagtttcttcaagtatatgtttggggtaatagaactcacatcattagatcattgtaagactaaatgagaaatttatacttggttgaagtgaataacaaggtgctacttccatgatagatgcttgataaatataatttttaatgttttctgtattattttgatactttcatggaataacatgggtatatcttattatgaatctaatgtacagattttacatcttccaatattgataaagtgagcaacctatttaatattctttaaaattttcaagataatttagaaattttcaagataagttagaccagggtgatacacttatattggaggcaatctcatagcccaggtccgttaaaatgtcaatgtcaaccaaagaaaatgtaagaatagcaaaatcctgaaatcttgattatataccccatcctttctccttttcctttcaccatcatagcaatctctgctagttggcgaatcttctaaatcaagatttcaaggcagagtttatagggttttgttccacaggtacagttctctaaatttatgatgaaatataatgggaaaaagtggctttacctaaattgttttagttcagattgcataaaatttcgattacacatggttattactcagccctctttatgtgtatatgctcataggatgcacatatatttagacttttgctctattgacttcataattgaaagaaaagaaaaaatataatggctctattaattatttacatattacatttaattctaccagatgctgaaaagagcaaaagaaacactgatcgatgaaacttatatatgggccaagttgctgttgcagagtggagcttgcaacttgaggcagagtacagttgtgttgtagaaaacaaatacactaacattttgaaccaaactcaaaatgtgcctagaaaattctataacataggatcaggtagtttaagtaaagttcctgtgaaaggtggcatatgttttcttggatagtttagtttttatcttttaagtatattaaagctcaagataaagctttgtctaccttacaacattgctctaatctacttatatcaattctgccctttggggacacccacacactgtgtaactccagagacccatattcccagagaacaccatgtgaatggtgcccctggaattgctcgttgcagtagccctgctgctgatctgggtgctctgaataacttgattgaatcttttccatgattttagtaatttatcagagtgactgttgcttacaaagtattcccttaggtgatttctttctttcctttttctttttgatggagcagtgtgcagttatggtgttacaaagttataacattgtggcaataaattttagagcaaacgataaaataagataaaactcaactagccttatgaaaaataattctgctcagcagggtttctttttcaggatagtcaagatttttcttggtaaaatgcatatattaatggaccatggtcaatataattatatgactcaatctgtacatgttcaggaaatgaaaaatactctctctgtttctaattcaagccatttttattcagtgttatcctgataatcattgcaaataacaaaggtctattatggtccttttttattttgctaatgtaaacaacaatcatataaagctatgtagctacttatgaatgcatttaaactggaactgtttcatttaaaaacagaaaattcacactccatctaaactccctataggactcataggattcctcttatagatctcatatattgatcagtttcactgggacagtttttcacagtaaaaatcccagagatccacaataaagtgtaggcttcaaagagggatgacatgtattttccatcccttagttgtggaccctgcactggcctggaattacatgctaattagatgttcttctccccgtcacctcttcttatcttcctgaagaccataaccacactgcatgcccctgagaataagagacttctttgtgcttcacttacttcaccctgatccaagtcctaatggtgcaaggattactctggagttacagtttgagatgctcagggaaattaggaaaggattcactgggaaagcaaaacataagttctgaagaatgaatcaaagttagcaagatgggggcaggtcatgagtgagggtggtggatgctgttcctagtagaaaaacagcaggtgtaaaggtccattgatggcagctagtgtgacaaggatgaggaaccaagaccaggccaccgtggctgcagctcagaacatcaaagggtgctggtgagagacgaggcaggagaagactgcaggagcctggccaggcagagctgtggaagcctcataagggattttaatttctatattaactcaagataaataattcaagcagggtggtgacatgatcagctctgccttttgaaaggaacagtggagcagcagtgtggaggaatgatgggagtgctttccaatcaggtggctttgcagaagactagacaagatgatgatgaaggtgaaaacagatgagtgaggtgtcaggaataacttgcaggttttattatgattataattaggagagacaattaggtgaatgtattgaacacacagcacacatgcacacacacatacaaagaaatagtaaatcagagaaatagtaaatcttttctctgatcatccagatgattactgggcttgtaattaggggaattagggagatttggggaatcccagctttaaaagataataaaggtgttctgcaagccatatagcaaatgatctcatatatgaaattgttaggataatattagactaatggggagatagatgaattgagttatagcaaaaaaacaagaacagaaacaaaacttatctttcaagtaagtcaatttaaacttactcttttagctttgctaaacttatgtttttctttttattaatattagctcttctgtatttaaaactgaggctggtgaactacagcttaagggtcaaatctggttctcagtcagttttgtagataaagttttattgagacacagccacaaccctttatttacctgttgtctatggcttccctttggctacaagcccagagtggaatccttgcaacaacagctgtatgccctgcaaagcctgatgtatttactagttggcctcaacagaaaaagtttgccaactcctgggttgaaggatttttgctttccttgcttttattctcctctgctaaatgttggttgataaggtcatttatatccttcctttcaaataaattttgatatattttgtttttggaatttgatcttttgtatggggcctcaaaacatgaaattctaaatacataataaaaatttttaaatatgatatattctcccatatattattttcttgtttctttagaacaaatatgattttatatctaattttgggggccctaaaataatcactccagtcaaccattcttaccattttgcttttgggattttactctttttctgatacatatctcattagtaaatctctggcatattcaaagacagacatagtctcaagatgattacatatataacttgcaatttttattgcacgcattccatttcagtacatcagctgctttattaaaatatttggaaaatacattaagtactgtgtctaaatgccttactgaaagaataaatctaaaggcttcagcttaaaggttataaagcactgacatgacgtggttggagcctacttttctatacaacataatctaatagtctgtagatgcaaagatactcaatgagaagttcttttaattaagtacatttagacctagataaactcatatgtatgttttctatcatatttgtttttacgtattattttttatgccattaattgtataagttaatggtgacttaatataggagaaaataatcaaaatgaaatactactttatttacatttttgagaatttttaatggataattatagttattattgttccattcttcttccttccttgaatctttttaatgagcaaatagttattaaagtatgttttttctgagtggaatgatcagtagacaacaacaaggatccccaatttcttttcatcattttgatatatttagagcacctaaatgaataggaaattataggtattgtctacccagccattgtcacattttattaaattaaatcttatacattttactgataacatcaaaatatctgtaacacacacctaagaatcccttaagctgtgaaaatgaaggccttgctgaaaggatacattagatgaatttttggaaaaatatctaagtggttttattcatttacaaatgatttgtttagcatctattttgaataaggtgcagtggtcatatccaaaaaatataaatgaagagttacaatcctatactcaagcaccacatagtatatagagagcaaataactgatgcttaagaattatttataggataaatacgaacaattacaacacagaatgctacatagtcatctgtacataagccatctgcttgtggtaggtacacaggcctttgggagcacacatagaacaagagcatctcaccaggaaacggggaggaagaatttcaggacctgagacttgatgagtcagaggaagcttttcatgcagacacagaatgggttcgagcatcgtgattagcataaacaatgatacacgcttgaacaaacgtaaaggtttgggaaataacatttaacgtgtgattattgtgagaaaggagaagaaaggagagagtaggcagataaaaaaaaaaaagaccagattatgaaggaccttgtattactttttaaggagattttttagatagtgtagtattttttatttttagtctagtagatgtacataattctaaatatatatacacatacatatatatgtttattttttatgtaaagaaagagaatgtgtgtgctatctagatatataaataaaatgcattgaggtggagctatgtggtaaattgggagagtttggcttagaatttcatactctctgcctcctctcgctggagaatagcaggactcaccagtgattatacatccaaccagacaggttctgcagaaggatagaagctttctgttagagaacccacaaaggaaagcgcccaaatttaatgtaatgcttttaaaacaattaatttgttagcataggatgatgaaaacaatttgtactaaaaaggaccagggattaatgattaatgactgttcagttttctttttgcaggcaatctttctaaaacacttacattggaacctgttccaacaatgctcattgtaagtctagggcttcattatgggagatgagagttgaccaggaaggtgaggtggccaggcttctgtaattgcactttccttagataaaacagataaaagttcttacaaagactgaatttgaaataaggtacccctttactttaaaatttgaaaaacattgcactacttaataagatatacagattgtgtttttttaattcaagaacatttatggctttgtgatttatttcattcgttgtagtaactagtatttttttcctttgaggtttatgtaggcaaagtcttacaaaaattatcttacttgttggcacttttttagtataagattgtttccttacatagctgttttacaaatgcacaatactaaataaaacatacaaaatgctgttgaaaatgccatgacaattttatgctcttctatatgctccattgctaaggaattagatggctcttcataaaaagagactctctgtagacttcgaatctaaggctttatgacttctaagatgctgattcaccatcatctcacatacaataattcatctggaacccattgagtgcactggtttcacatcagttcagttaagccatgcgtcaaaaccttggaaaaagtaaaacaaaacagaaagtcctcaagacagtgtgcaaacaactgctaaagcagaaattgtatgcaaaaataaaagaatattattcaggtgctgctaaccaataattgatcgtttcagccacatgtatgtatatgagttaacttcaaaatcagcattatcttcttctatacaaaatacagttgcatatcagtggaagccaaagcacaatgtcagtaaatatttatgcttcagattttcttaggactgtattttttttttaagagacaggtttctcgctctatcgcccaggctagcgtgcagtggtatgatcataatctttagagctctatttaaaggaaaaaaaaatacaccttttcaaggtggaatctgccaaatttcatcatcttaaaggggcttttcccctttgtaagtgacattaagttttttatcacaaagaaggaaaaggaaagatgtaagaaattggtcaaaatcagcacagatcatgttaaaacaaacaccctctgagtttgcttctgttgggatttggctatagtctccatgaacatgctgtacaagcttcttaatatgtctcatttggaagaacaaagtgattcttcaaacggaaccactttctgcactttaagtattactggtagttgtgctcaggatacctgttgtagtagtgtgtatgtgcacacacacaagcacacaccctttacatacgcatacatactttcaattaaaaatgcaaaaaccaaatattttaaagatcaccatgactagcacatactaagttttaaatatttgtcaaattttgtaggcatagaaatattttttatataaattttgtcagtaactatgcctaagctagtattagaagcaatagaactattttgagctctctatgatatatacttctgtaccctgtctagaagattatcttacccctgtatatatatatacacacatattagatatatacatatatattttacatacatatataatatatacatatatattttatatacatatattgtatattatatattatatatgtatcatattatatactatatatgtatgcattatataggtatatatcatatatacatatatatataacgtatagacacgcatgcatatatatatatgtatataattttctcatgagtagatccagggttcctttgactcaaccggatataaagtaatgcattggttcagactagatcattctagagctaaactaagaggagttctttgaaagacttgatggatttctcaagccataagagggcaactgattttgatgagaacagaaagcaccaaaattgacaaaatagatttcagttaacataggcattgatcttttgtgaacctgagcagggtggcctcgcctttatcttttcttctctcattatgagtcatttttaggaccaggcatttagagcacatatctctagtttctgctaaaatgaatctaacagttaacacattggtacttatgctacagcatattatcaccttctgaaataacataacagttttttttaagctaagcaagatggttaagcttgaaaatttaacaaaacccaaagatggaaaatgtaaaagacctgtggattttcttccatgagtggatataaatgctaatgaaatgttccttagaacacatttaaattaaaccatgagctaccttcaatgattatagaaaaattgttcaagaaggattgaaaacttaactgccattagataagaaagttctaaggtgctgatgggccacatgcacagctctgtaactagaccgaaggtagttttcctttctctgcatattaataatgacaggtggtgctggagataattttaaccagattatggtgagctgtagttctgattcaaaggcttttttcactgccttacttgaatagagtatgactgaacacactttaaaatttatttctttcccgaaagcatttgaagatttttgtgagagaactgatgaagtacttgcttttctcaaaataaataaataaataaatctttgaaaaacttaaagcgctgatttttaaaaggcatctcagacatttgtgtggtagctttttctaatttctgaatatgaagatgcctgttaatagcttccaaatggcaaagtgtgtgtgtatgtatgtgtgtgtgagcgtgtgtgtgtgtgagagagtgtgtgtgtgagagagagagagagagagtgtgtgtgtgtgtgtgtgtgtgtgtgtgtgtgcgtgcgcgcgcgcatgcatgtaaaggatgcacaggaaaataatttcttatccttggactttaaaacaaagcccttcctaattggcaaaatatggaaatcgttttggccaagaaataaactgtctttggtgtttacattttacaagaaaatttttttctaagctgtgttttgcctatcatctgcctcttggtcaaagtctgaggcatttgaatctcattcagaagcgtcattacctcttaaggaggttttaaatcaatcaaacctgtttcttttactgaattcatatgtatgtatgtgactgtgtgtgtgtgtgtgtgtgtgtgtgtgtgtgtgtgtgtgtgtgtgaacataagaaaaaatatacttttccaatttttgacaggcatgtttaaggcatagtcacatttgctaaagcaatcagaagcaaaaaatacaatcaaaattctcagacaccaagtttagaaaccaattaaatctagtcagtgttaagatttcaaattgacccaacaagaatttccttttctaaagcaatgctaaatgtattgtcataacaagggaaatataccccatgacagcaccaagtcattattttatttaaaaatcatttacatctagtttcctatattctgagcattttgcaaacgtgcacccaatcttgataacaatgatgtgagataggaactgttactgcccctgttttatttctgtgatacatgtgacattgaggcacagataccccaaggtcccacagcatatgaaaggggtggaccctagatatgaatttaggcaagcttctgtttacaacaattatttctgacagcatcaaaattcatgtacttaaccattatattcaactgccttaatcaaagtgtcaccctttgtactgaaagtgcttacaagtacagagcctcaggacttccagccacaattaaataatcctgaagaagaaaggtgagagctatatgactctgcattaattttttctgtcagatttcccaaagtacttaaaatgcatcgcatctcttataaagctttttcaaggggtgatggatttgatataatccttaaccaaagtaaggagaatataagagctattgtgggcataagtcttagtccacaaactcaaatgaagtagaaatattcttaagtgctccgtagcttaatttagtttctaatgcagagcttccctttgtggccctacactaggtttctgctctatccctagagtcttccacagtgtctggacattgggagggagaagggagatgggccatctgctctagtccctgtctcatacaagttgccaatgagatgactagttctgaatgcctcttcacgtcctcttagctttctgctactttgtgtcacctgtgagaaccaaaaaccttttgcaaggctgcatataatctgtctgcctggatctacctgtttggtgcttctccagtggtggtactcctgcatcagcccccagataataatatctctttcctccccctgctgcctttctctcttcttcttccttttcttctttttcttcttcttctcctcccacttcctcttatccttccccttctcctttcccctcccctctccctcatcctctccctcccccttactcttcccccttccccctccctctccttcccccttccccttttcctttccccccctcccttctccttccctcctccctcttccccttcccccctcctctccatctctctctcctccttcttcttcctcttcctcttcttcctctctctctctctcaatgtttgggaaagaatcctagcattttctccaattatctggtcataactccctgtcaatgccaatgaatatcctttacaaagaacttcagtggttagaatacaaaatcagagactctcagtttatttggggattctgtcctgccacacttttcctttgaagcgacaagcacaaagccaaatatctgctaatattggtgaaaggataaaggagaaatactaaccaaggcatacaatttcctctcaaaatggttgcccttctcttcaagaatgcatgaagaactttttctctaaggccaaactattagacgttaagttgaatgtgttttgtcttaacagatataaggaaagtgctctgaaaagaacagtatttatcttaatattagttgcactgtcaggtcagaaaacaatgctgtttaaaaaaagcactgctctatttatcaagccaaaattaaatggtatacccagtatgcagacctttctctctctaatgccattctcaaataaaaggagccagggctccttggagaaatggctgattctagatgtgcaacagggaatacacaaaataaacctggagcatctggtagtgtcagagaaataagaaagtactaaaacatgtacacaatcacacacacacgtgcatgtgcacacacacacaggaagatgggggtatgtcaaagggacattgcagccaaaagaaagggctctaaataaccaaagctaaaacaatttgagcaagaaaataaatagcatagtattagattataatctgaggtataaagtaaatatctctaagtctattctgatataagtaaatgattgaatacatgaattgatgggggaggatagacatatctcctgtgcagcagtattccaaataattgatgtagatattctgccctcaaggagataaggcatgactattcattcctttagtgtgggcttcccataatgacttctttccaaatagtacagtatggaagtgagggtgaaagagtaattttacagtggagaaacctgaaaaacatcactttagccagataactaaggatatatcaacaggggcaaatcatgttgaaagcatttactcttgatatgatgtgataagaatagcactttacctctgttgtctccctccccaaaacatagtaccctagtctgagcatgaggaaaaccgacaaacacaaatggagggatattctacaaaatatctgaccagtactgttcaaaactgcaaaggtcatcaaaagcaaggaaatctgagaaattatcatagtttagaggagcctggggagataggacaactaaatgtggtatcatggatgagaccctggaacataaaaagaatagtaggtaaaaactaaggaaatctgaataaaatatgccctttaattaataatcatgtatcgatattggttccttagctatgggaaacataccataccaatgtgagatgttaataatagaagaactggttgtgggtatatggcaactctctgtactttcttcaaaaccttttggtaaatgtcaaacagactttattttaagaaatacagtggtacccaaacaatctctggatggaatgaatcatgtcaccgagtttgccctgatctgttgccctgtctgcatccttcagctttcacatggtaatgggatgggaaggattctgtctgtgacaataattgaggcatgggcaaatgtaagaatgaaagctgtaacattttaagtttcttattgaatcatttgttggctccaatcaatatacagttagaaattagaaaagaaaatctagaatcagcatattttcttaaatgattattttgccttttaatttgtatttgtttgtttaaaagcctatagtcgcatacaacttgggagcttatggaaaaattgttaatactgttagtgtattttttttcaactcaggcatataaaagatactattgcacagttattaaaaacaaaagaaaaacaaacaataacaacaaaaaaagcagattgaattcagataaatgtattagacctaattagaaatagcattaaaaaacaaagacaaaacaactaagaaacaaaaagcctaagagaaaactttacacttcttagatggaatcacagctgtccaatgccaagacactaatgcattctgcatcaaacagattgcagaggaaaatacaatcttattttagatgcagttcaggttttgggaccatcccccaccttctgaggtcatttgctttttagttcatgacattacatagacattgctcatacctcattaaatgccaattgagtttaagtgaggtaataaaattcttttttatttttttattttttggaatgtctgtacagcacattgagaggcatttcatttcagagtttaaaatatttagtgagcaggtggctaactgccaactacaacttactacttaacagctctcagtgaaaaaactctgaagaaatcaacatcagcaactcttacagctccttcaggccaaggtttgtaggtttctaagtgtgttaggaaaagcctacggtatgtggcaaggaaatgacatgagtgagacgttaaagagcagatatcaagatctatgccagcatttgacctttcagcttgcacctttgactttttcttgtcaattaatactcttgctggttacagatcattttataacttgagatgcaactctagacttgttttagttccaagatgttgaggtattattattattattattattattattattaccattatcagtttgtttttattattagctttactagaagtgggactttgaggtcctctatttgaatttgctttgaaaaagtggctctagaggtatttttattcttaggatttctttggcatttttctatttgctatttgttgccgtgttaatagaaaagtgtaatatctgaaattgattggcagtgtttgaaattattatctgtaacaaatttctgaaactcagtaacttcaggaaaactactaagaatgacgctttacattcctttgtggaacaactgaaataagatatatattgccaaagaagatcctatatacaacccaaaaatgaattcacagattttgtaaactcttattaggagtaacactgggcgtttacaagagggcatctccattctgaaaaaagcacagcctcagattcctaaatttcatgctatgcactgttccatcttacatggagaaatcatgtcaaaaggaatgggggaaatgatcttaaagcaacatcttaattaaactgtttattagtcattgatttcctggcaggttagagttacttttttttttttttttttcacagtggaacacccaatgaaaagaaactatcttaagaattataataagtaggctaagataggaagaaaaaatattatttccaagtttcagttggcattaaatgactctggtaatacccttgggtcccagatgctacattattttttttaaatcagggaagaatggactacaaaatctctcccaggtctaaaattattttattccataaacacagatattattactctctacaaaattgtcagttaagaatagtctaagagtagttaaatcactgtctgtcattatcaatagaaaaaaaatgtgattcactttaatctatgacagtattaccattctctgcctgctaatacatccattggtcttaattctgtttttcaaatcttttacacagacttttatcaacattggaatttagatgcaaagtgtttcttgtttcagagattagtgagatattattttttaaaattctttttaccaggtttttgtattaaagcaagtcatgactaaatttgcatgcttgtaaaatttattttcactttaagaaatttgtttagatattcattaagagagaaactttgaaatctgtggatcctgagagacttgagtgtttctatagatcatgcatgcataacaggggtaatatttttcctaaggggcaaaaaacgtgtttttggcaggcgagggggaataaaaaaatcatagctattgcaatggtttgtggccttataaagagccttagtgcataaacaaatgtatgtatgactgtggcaaattttatagagattcaaaaaaatgttcaaaaagttttcttagaaagatgataataaaactccaaatcactgaaaaaccaaagcaatttaaatgtattacatagttttaaaccctcaaaaatttatctgggttagaaagcagagtgccaagtctcttcccaaagcaaattaaactggctgagttacaaacctctcaaaaattggatttataatgagtatgcaggcagatctttaactatagagactcctgagaagactgagctactctaacattctttgtgagcctaattgaaactgattgtggttggcaccttataataaactttagtttaaatgattttatcttggttctaaaaacagtttggccccatgtgtttctaaaatgtgcaataaaattcctttataattcaataaagataagagatctacaatgttggatttctactgtgttcaacgtccttttaaaatgcaaacatgaactcagccaaagtgtagaccacaaaagtcatgcctctccatcttcaccctatgtgagtgtgtgtgtatacttgggaatttctttgcttttgctttcttacgggcgaaatccttaagagaacattctttctttaattctgtatttaagcaaaaactaagggagaatatgacttgccatcctcaaaactgattttattttataaatactttcaagaaaattaagacttttctatacttaaaaatcatattctgccattcattattaccaggaaataatattggattctgttgaaaagaatgtgtgtccaatacgtgatcaagtagtttaatatggtagcaatttaccttcatgctatttattttacatgttttgctaataacaatggtgatcaactatactctataagaaatgtggtggctgggcgcggtggctcacgcctgtaatcccagcacttcgggaggccgaggcgggcggatcacgaggtcaggagattgagaccacggtgaaaccctgtctctactaaaaataccaaaaattagccgggcgtggtggtgggcgcctgtagtcccagctactcgggaggctgaggcaggagaatggcgtgaacccaggaggcggagcttgcagtgagccgagatcgtgccactgcactccagcctggacgacagagactgtgtttcaaaaaaaaaaaggaaatgtggtaagcaaatgatgataccaattatactaacaaagctgaaattttaacagcatcattgtaaaatgcttctattataatgaatctatcaagttccgatgatcatatgacttattttgccaacatcactccataagtcatagccatgaaagaataagaggcaaataaaatgtattttgcatctatgtgccatacattttgctaagagataatcacatccaaaaatatggggattgagtcacaaaataggaatttcagataatagagcaaatcactttagaaaaataatgaaaaagtattatagctcatgtttacaaccctgatattaagacttatatcacaattttttatttaaatgaaggtaaaaatatttcaagttttgactttttagtttaaacctagaaaaaagataaacctgttgaatttctgttcatgacttgcaaaaatggcatgcagaagaataaggaaaacaggtaaataagtatgaataaaaagataaactattaatacaaatatggacttcatattctattcacagttaataaaatcatcttttaaatctatgcaaggacagacctagaaaccatatgagaatcttgattttttggaatctccaagaaaataaaaattgtgcaattaactgtattataactaaataatcttataaaacattataaataatatttttatataaattgactaaaatttggtaacaaaatacctttgtaatgatataaccaatcgctatgataagaagaaaaacacaactaagtagttattaaaactgcagataattccacagaattttgctatgaaatctttattacctcaacagcttagcacaggctatagcaattttagatcagaaagtcagcagaactatgtcaggagcaccatactagagtcactggcataagtgtacttgctacatgcctgagtgacatctgtggcttgtttctttgtttttaaaggagatagttggactggatgcaagtttttgaaagctttagaccctggtcaactttgagaaaattataaaagctatggaactgctcctcagagaactctacatgtcctaaaatatttccatttcaggaacattctggatatccttgaagccactgtttagaatcctcaggaccattggttctatgaacttggggttcaacaaccttgaactgagattattttgaagattcatctatgcaatttatgcttctttgtttctacgccaagttcattctaagtaccatggattgcctgaccttatattttgaagcagagatcaaatggaatccttttacttaattatatttatgaaacacaaataggctccagcttactcaaggacaagtaaaccataaatatatataactatgttaaactctataactcttatatgattcaggatcacagattggaaagattgtgtaattatgacaatttaatttctggttttaaacttgaattttcttgatttataaaatagaatgtaaaaccaccaaggcaagatatatgtgagataactgaacacatgcatgcccacattcatatatatgtgtgtataaaagccctccaggacatggtttttcataggcaagagaatatatccataaatacatacttgtaaacatgcatgtatgaataaatgtatgtttataaatacacatgcatgcataaatatatacatgcatgtgtgtatgtcctgttgggggtgcaggacttagcataaatgcctgctattgaagttccctacataaggtagcttctgttgttttcagcaaagtccctgctagcatataaaacacattgtgcataataaaaaaaagagccccttctgagtgaatacaaaatacatcaaaagatatctgtttctcctagctgatacaggccagtaccaggggtcagaactggatttcagctcttactcatgccttgagctggccattaaaaaatagatctgcaaaacagtgagctactgttgctctggttcttgctatttcctacatcggtaatcctcaaaggatgggccaggaccagcagcagcatcacttggaaagttattagaaatgcagttctcaggctccacctgtcttactgaatcagaaacttggacagagcccagtaactgtgtttaagagaccctctaggtgattcaaacagctgctaaagtttaagaaccactgccctacatcacactccactccccattacaccaacaaatgataagtagttaatgaaagcagactctctccttcaccttcctcctcttccttcctactacctatatttctcattcaaaaaaaatttaccatgagctgctaaagagaggtggggatatatatgcattataaataaattataaataaatacatgttaaaatatagttaaaataaaatatgttttattatataaaatataacatgcgtctcagcttaatgttatatattttatttcttctaagttttacagcccctactgactacattagaatagtgatagctgattataatttcatggggacccctcagatgaccttctgaccctatgatttttatctgtgtctttctgagcccttctaataaagctctaccagtgtgcagcaggatccttactgtcaagttactcaaatccccatctatagagtaagtcatttaggtaggactgtaatttcaggttgatcccaaagtttcccttccatggtctggtgtcctgtgaggtgtacaggcaactaggttgatgtcttgaagacatgcaagaggtgtagtgaccaaggtcagggtgatgactgactgaaagccttcgaggtgtgaatttctttcataaagctgagtggaagagatgtgccttcgtcattgattctgaaacccctccatcctcaatgagccgactctaaagattgctgagtttcaatttgcattattgatgttagctcctatccagttttcttccctgtcatcctcatttgttataaagaatataaactaatacgagagtatagcttcaataacacaaaatgaaatagaatgaaacataaggagaatgctgtgttttttctaaaactcttgttggctgaaagaaacgtgacgtctgtctcctcaacaacagaatgttacaacagcaggatttcagaagaacccatttattaaatattttgtatattaaactaggattgtttataacatagaaatataaatgagaagtacacaaagcccttcgatagaaaaattgtgaaaaaaacctcttactcctttatttttaatgtatgaaatgtttctggcactgcttgtttttagtaagcgtttgtgtttcagatttctgtgtattattctgtattttggaatattgataatgggacttaccagttctctctactgttttattctaaaataactttttaaaagccaggcaatacaatgatatgagctacaaatatgtagtttaagtgcagtccattcttaatattgtctaatagtctagaaatatctgatgttttatgttactacaatcagtaagtttctgtttgaaaggatttgggaagctcttctttacagaatgctaaaaaggaaagcttattcctggcttcatcaccattcctgttgcctttcatatcccacccctcatgctgcttgttaattccacagagaacccattagggtgcctcactgtgcgcggccttcaggttcaacctctgctctgcccgttccctgaatctaccatcttcttatcctagccttcatgcatcttcagttttgattatgattctttaatttaagacagtggtttaaatgcatcagttttatcaaggtgataagtctttggtacgttaagtgtaaacagttggctcgagactgggttaaaagattcaccaggcacctccaagtagatttcaagcaaggtgtctcaccctaacctgggaagttaaggatgttaaattatttgataaattaagtcattagtacatcctggaaaaacttaatgtccattttcattaataatcagtatttttggtcagtgttcccagagttgtctaaatttctttatatatctagatgctgtgctttcaatgattctgttcactcagagtctctactcaaagagctgataatcttctcatttaccaaagttcctttaatgtatgaaaaaacatattgccaaacaaaaagatgagactccaattattattgaaatagcttttatctgattatagacacttagccatttggtccagtaaaagtcgctttatagaaaatttctgaactgttcaaatattaccattcctaaaatttcaacagcttaacttaggaagaactttaatatattaaccttcccaaatgacatgccattttaaaaagggattttaaatgaatgcctgagatgagaattgaagaccatgtggcaagtccataaggaatacgcatttgaatagttggactgcccattttccggcactcacagctgtaattgttagtaactttttataaaaaagtaatgtccatttttatcaaagggaaacactcacatccttgcctatcggtgatcattctctttttacctttatatttcttatttcctgtttagaagcaaatgaaggattatggagttttgcaatattaggactaggtgacagctcagaaaatatctgttccaagtgtattaagtcccaggggtgtattgcccatggtcagagaggaaattaagactgctgacatagcaccatatcttctccataggtccatttctctctcctttatactttgacaccttttaagttttattgaataaacatgaaaagccaagtgactttgtttttctaactttgaagagttattcagagtgatgtttgtttacgttcttggtgttaatgacaatgtcggataatactactctagaaattccctaagtaactttaccaccatatatagtgcattgtgcatcacttcagttgagagaaaagtatgactaatgcagcatgcatcaaaattaattctgtcaggaactactgtgtatgagtcacagaagccacaatactgtatttagaataataataagacaaggaataatggcatcctaaaatttaatgaggtagtttagtttaaatgtacactgttagtttgtgtcaacctactgcccattgcaagcagcacatttttttaacaaccttgtgcaatggggctgtaaattactataattaaattaagccataaccgtatccaggcaatatgaggtatttgtactttgtttctgtaatcatattatctgctcagaacagaaattacaatgaaaaaaagaaaacaaacattatcatccatgtcatttgtaatttttcaagaagaaagcaaagctatgtttgagattatccacccattttccaggtacatctatcacaaatcccttgccttatcatttaacttatcatttaacacatctttaactggttcttaaacttgtaagcaaagcacaatggtggagggaaggtttcttcaaataagcatatctatatgccatttgatttgcttccaatctcatgttgagatgatgagcagatggagagagattaatagtttgatttcttgggatggtagagattttgatagagaaaaccatgaatcctgcaagcaatataataaagctatcatcttcttgttattactgtcatagcttctctaaaatttgtgttgtgctgagactgttttatgtggattattttattgagtatgtgatggtttccccagggcattatcatggaaattagaaggaggtgctttttgaataaaatgggaagaggtattagtcatttgatcctttctattccttctatcttttgtaacatctgataacacatctgatatagtttaataaatattggtttcagccctgacttcccactagacaataaattcttgaaagttagagctacagtgtattccaagaaagtactaattgtctagaataatacaaggtaaaatataatcggagcttgataaatatttgtttaaagaatacaaaattaatgtaagagatgagatgtgttttgttcagacatattatgctttacaaactctaaactgtattttctcactttcaatccccctgtttacctctttgtgtgagctaaaggataaatggttggaaatgagaagtcatgaaacttgccatgtcatttgtagcttcaacaactattttcactgttaagaaaatatgaacctcaaatgtttatcaccttcaagatctggtttcctaattcatcactgttgccttccttgtctaattcacttatagctcatgttctttgacttacatggtagttacatcacaataactcatcataagttgaaaatgtatttaatatacctaacctatcaaacatcagagcttagcccagcctaccttaaatgtgctcaaaacacttatatcagcctacagttgggcaaaatcatctaacagaaacctattttataatgcagtgttgaatatctcatataatttattaaagacaattctgaaagtgaaaaacagcatggttgtatgggtactcaaagtacagtttctattgaatgcatattgcttttgcaccatcatgaagttgaaaaattataaattgaaccatagtaagttggagtccacttgtattgaaaatctggatgctggtgtcaccaaacatattcataatatattcactaaattttttaacatggtatataattgtgattactctaatttgtcccctatcctctttctccataagaaatagtaagtagggtccagttcatgacctgatcgtcattgcatttccctctttggtcatatgtagggctataattatacaagaactgaaatggacaatatcaatagcaagtgcacaggcatttctagaaagataattgaatgtttggtatggaattgtgaggggacttttatcagttaatattaatatatactgctcttacagccaagttacatttgctttgttagttgatcctgcctaaaccttgaccttattcagtagaacttcagatgcatagagttagttgtaaagagttgcagccagagtgttcatgaatcagccaagttccttgaaacattcaggaaagaaaaaaaaactaagccaattccctgtagggtatgttatcaccaccaattacagaatgtcaggatgtcatcaccaccaattagagaatgacaccaagtaaacactttctagatggaattacatgaatgtggcaaagggttgtggaatttccctcaaaggaaacagaccgtatagaatcatagaggttttttttttttttttttaagaattcttgttcatggttcactgtttccttgatatcacattaatagctaatggcttaaaatgtgaaaaatgcatttaaatacaaatacccaagtatttagtagaggagttatgttgctttgtacattattctttaatgtggtaaaatagcaaatagcaataccattaatttcagtcatgtgagctaaaatgaaccatgatatactatttatttttcttatcactgaatatatcaggcaggagtctacttagtttgaaaatctcatttagaatatcttctactttataatccctgagcatagaaattgatagtatttagtaaaagagaacacagtgtaatacaattagaaaataaatatttttatgtttatcttcctgtaaatgagagcagagggctagagtgcattttatctaatcactgtattattcaaaattgatgatgttttcaaagtcctgaagattttatcaaacatttagctgaactctaggcagaataatattttctagaaacaactcatttattttagaagcaacattattttctgttgttttcattagacacataccaagtatcagtacataattttctatatttataaatttctggttgcaagatttagataaatatttcttcagattaatatctttagagaaaatagatatcatttttaagagaattacacacctgcattctatatgccaagcacttgctaagtgctagcacatgtgccatctattcattgttttaaataacatttaaagagttaccattgtgcccattttgcagatgacatcagagtcacatgctagtgaatggtaaggaagggattagaacctgttagtatgactccgagagcttgagctctgctctactgtgctctctttaatctctaagttctttgttttgtccttggatctgctaccagtttattcactgaagagtaatttacctttgtgaatttcaattctctgattattaatatggatattttaattttgatcacttcagaaaataaatgtcattgaatgttgttgaggtagctatgagaaaggtactaccatgtaccttatttggaataaaaatgaacgcaacatttttaaagagcaatttggaaatatgaatcaaggctcttaaaagtatgtatgcccttttttagcttggcctcccacagctagttatgtgtcctgaaggtatagtcagaggtgtgaataatgatttatgtctagattatagctatctttgaagagaatgttcagcaaaatcaataaatctaaaatttgcaaattgctaggtaagttgatacgatgtggcggaaaatgttctcaattccaaaacatgcaggtagtaaagtctgtagttgaattagtgacagcctatgaaattcaaagtgttgaatattttaattggttgtatccagtaaactaaaaagttactttaagaaacagaaacaagagtagtatctgcatagggatatgcccacctttgtgtgagaaagtcctctagaatttaagcttacaacagaaatgcgttactcagtagtagcaaagagtcacagtggctgaaaccattgaagccaatgacaatggtgaatttaaaaagaatgagattcaaatcagtaaaattgtaagagaataaaggtaaaagaagacctattggctattattgtaatagctaatcttttacttgcatttatagctcacagaatattttattatattttcttcatcttcactaacctttctaaaaaatgatatttatttttctctaaagatattcgtttgaagaaatttttttctgaatatggcaaccagaaatttctaaatatagaaaattttgtgttgatacttggcatatgcctattgaaaacaacagaaaataatgttgcttctaaaatgaatgagttttttctagaaaacatcttcctgcctagagttcagtcaaatttcctacagttcagttaaatgttcctacggttcagttaaatgttagataaaatcttcaggatttagaaaatatcagctttgaataaaatggagtgaattatggcacctaataaaatagttgttacagtgattaaaatagtgtctcttagataatggttttattagcaccattaggactaaagtcagatttctcaggactagatagataatttataactgataaataatatgtttgttcagatatcttggtattatgctttggtatcttagattttaaatgaatgtattattataatgccattgattcttacaatagattttccttacaaactatgatatacttaatgtaaaataaccttatttaacaaatgctagattgaaataatttaagaaataatatttttaacatatatgcataaaatgtaacttgaaacttcgaagattaactcagataaaaacaaacatactgaaaattttgccactagtgaacttctgaaattctgtctctctggtttttttggaaacagcacaccatggtagtcaagaggtatattctggagtcaggcagaactgggtctgtgcactagttagatgagttcaggcaatacactagccactgtaagcctgtgtcttcatcaataaaatggaataagttatggcacctattaatacagttgttatagtgattagattagaaaataaatgtaaagggcttagcaccataattagcacacagtgagcactctcattaaatattagatattatttttattattaatatttgaagaattaaatctacacattatgatattacattggggctttattaaggcatcatgagctatatcagaaatacttgaaaacatatttagcctagatataatatcaggccttcagatgagttcaatgtcagtgaaattgacaactttagcctgtagaaatgtcatagagttatttctgctttgtaaaaaggacaatcataagaaatacactttgagcattatctcagttgggaaatactcctatgaattcagggtaatataaattgaaaatagattttatcatgaacatccaaaccatattagacgagctagcatataattgactgataatgaacaaatgaacaggaagtgtgtcctctgggtttagcctgctaacattacatgaactaatttctatagttaagaggtaattgtcagttgaaactatcttttctttgtacttcttgggaattatttgatcattacatacaggagccattattttatatctctacatctctccactgtatactgtcttctatgctagaatgttatctttctgcacaccaacccccccctccaaaaaaaaaaaaaaaaaaaaaaacagtcaacatcaccaattctgtgcactctcctggacaaaccttaccactgacactggccactcatcttccccattcccaaaacccacaactcatgactggttgacacgaccccttacttcaaaagaaaccaactcaagagcatcctccaaaatcaagctgaaacttattttcagagggagacttcatctttacttagcttccccatttctataatttttctcattgcctttcccctgagagcactttctcaggaaattattttctcaagaatttctgtctcagactctgctttcaaggactccaaccataacaaccttcctgattctccaaaccagttcttagacagcaaactccatcttgatatatctgttccgctacctctattgtaatgcaaaatgaatcgtattgcatggcttaggtgtctttcttccctacaaggctaatcttcttgagaaagggatgttgttttattgtctgtggattatgaaagtctttcacatagtgcctgacacatatcagatgctaaataaatgctgttgaacgaataattcaaaatatgctgctctgtattagcaccaagagtgagttttttaaaaatattctaatccaaatgcacaagaatattcacaaaaaagccctttaaagataagcggcagtatttcaaatataaggagattctagttttccaaaacatcttacactgcatcttaaaatcagaataattggcttttatcaaacctgtgtcattttaataagggctctcatgaacttaatatgattcttaatagaacactgcatgtgtaattagataaactgtaacagctaaagctttgtaaatatatttaaaatcataacagataaatgataacaaagtgaattgtgaattccactgaggtcaaaatacaatgaagagaccaagtaaatttaattttaaattgaactcctttagtattttctaaacaatgcaaacagtgttagtacctaaaagtcatttgattgccacctcagtgtctttgtttaagtcgatgcctatttatttttattagtggtgctttgattgaaaaattcctaattttgcaatccatatttaaacttcagaaaaaacgaaagcaagcattagtggtgataaaacaagaaagtaaggaactcatcatgtgaatacttttctgaggccattttgttctcactaatattgtgaaaaatactatacttaggattttaaattttctctataattgcaatagaattaatattctacagtcattggttaattctatgctttatgataatgttataataaatgcctattaactataattgactagaaaggagcaggcaaccagcatgtctaatgactaatttgggtattctgagcaagtacttatgcactttcagtaattctgtatccacatgacatttttggaaggaaatcaagtacattgactgtcaccttagggtaggggtttatttcctcttttgtttccatcttaattatgcagctttgatttctgcagttcttaaagacattttcaaatttaaaaaattttcttaagagtaattgaatgtgagatttttgcttctatatatttctaagctttttctaatcacagtgaggtgtgaaagggctttttgtttgtttgctttgttgttgttgttgttgttgttatgttttcccttgaccatcccaggcctaagggcagtgcctctcacagtctactatgcgtatgaatcacctaggatcttgttaaaatgcaaactctcactgagcaaatagggagtatggcctgagatcatgtaattctaagtagctccagcgtgatgccaagcagttggtctactgaccacactttgaggagcaaggtctgagctctgagctgcatatcctttgtagtcccagacttagtctttacactaagacattatactaattttcttcaaccaaagaaaattccaaaggattctaagagatgacatttcagagtaattgtcacattctacccagcttggaccttcaaacctgactgtcagcttcagcattccaggatccatctctgattcttttggctttccaccaggggtagagccaacccatagatgacttcagcagtgacattctagcacattagcactcagcagtggccttttgagatgttggtgaaattttctgcctaccaagaaagtggagttggcacgatgtacataaacttcatgatgacaagaaggcaggatagttagtggcagtttgacaagtctctctgcatgaaaacaaattaagatgccgtgacagctctgaaaaaaactgttctttttggcatttccttttttccaatgttctctgagcatgctatctcaatttattataaagctacacatacagcccaggaatttctttagcagccaagtcacacctcagagttctgtcagttgtgaataaccctcaagaatttttactccctcgtcaaatgtgcttgtgtagtattccagccatcagtcctttcatttcaataaaacttttacattcccaagtgctttcacatctttgatcttatttcatcttgccttccgactgagtaaaatagtatggataacctttttttaaattcattgacacaataaacattaattaaattcctgctacaggcaaggctatatgtatggtaggtaccaaggaagatataaagattaataagtcatggcactgccctcagagatcctgagcagagagttaaaatcatgtgcataaattgcaaggtagagaggcataagtgcttcagtgtgctgtagatcacatgggagaatttatcaaaacatgtgatgagttctagcccagagcagtgtgtgagaggcatagaaggcaccacagtatgataacttcataggtggcctttaataatgagtggaattttgaggtgaggtgtgggctgaagctatagcaacacatcacggagttcagaaacaagagatactgcttgaggaatacatagcatatcatctttgtgttgtgcatattgttatttttgtatttaaaatatgaagaaagtaggttgatgttgaaatatggaaagattatattgaaaagatagggtttagacttccattgacgcccctaaacatcctcttttacagattaacagtatgaggtatggaaatgagatgacagatcaagggtcagaaatctcataagtggcaatattgttgctaaaacctagtatctggacctgcggttctactctgaaggacagtgatattctgtatcctaatgccaccatctcactgcggccagaagcccactaaccactccggggtgcccagagggagggagaaaggttcacttcctaccccagggacaagaaggttgaaggcaacaagttacttgctttgatctgaaaacatataaaagatagaatttaatgctcatttagctttgctttaggaatttttgtactaaaatacctggatttttatgtgactttttttgatgcatttttacttttgtaaacattttatctatattcatgcttcatgtgcatgctttttacaagatgtatgacttgccactaaaaaataaaaatgtgtaaattgcattcggctagccatcatatttaatttttttcttaaactgtgttattacctcctaggcactttctgcagcacagttgttcaagatagataatacatcgctagggcttttcacagcgaagaaggggattttaatgaaaatgccacttttaataagaagcctcaataatatgtggtcttggttgttccagctgagatattaatgtctggcacttttttttccctataaatcagtaacaaaaagatggaaggaatttggtttgaaacacaatgctaaagaagttggaaaaataattatctttagaaaggacatatagcctatataaagtaaaattctcaatatttactacattatacactatttcttttatttttcatttctcattgctacaaagcctcaaagcttacataaaaaaaaactaggagttgtcaggcagattttaattaatgtatttctactttttcaaatttcacagttttagatttgtttctagagtaaggggtaaaaaaaaaaaaaaaaaaaaagacaaaaagatttaaagtgattcaaaatctccagaaaaagattcaaaattcttcaaagtgtttcattctgtaggggctttgatttcacactaagggaaacctgaccatgtctaaaatgtaaacataaaaaattattaaaatgcatatttctatatccttctctccccattcctaccaaatgcccaaatcaaccatttgggaagaatatatatagttgagaagaacagggtgagtaatacaccttctcattttttaagcccaaaagacgaagaaaatcgagaaagtttgaaatctgggaaagttatccaagagttacttattcattcctgcactcttgaatacgaactgtgagtcaggtgatgtgtagcagggagacccaggtggaaagattggcagggggcactcatgatgtgctttgtagccgagcaagcagatcggattttattttcagtctagagccctcagcgtacagaaatatccttgattatttgtaaaggaaagggcctggaaggaaaggacagggtggatgtaagcacagagatagcacaagcaactactgaagttagcaaaattgaggtgcagaactcggtgagggcttagctaactgttagcatacagaaacgttgtgaggttaaaggaaaggggctatgtctattttatttaatgtggccctgtctccattaaagcacatggagataattatatcagctagattatgacagaacccacagaaatacatcatacactgtgaaacagagcataattttcttagtgctgtgataatgcaaaacaataatttatcatgataaaaatcaaagaaaatgtgtcttcttggtgaaagatttttctattatgtctgagattatcttatccattcttattttcttttttcactgtatgtcattgcaagagggtcttgtattttacatcagtgggtagtattttgaatatatttggtaattaataaacattttaaagtcatttcgttgtccactaaagttctgctaaaacatattattcttaaaagggcactggacaaacggtagtaaaacaatatttatatctcttttttgtagttgttgttttgttttgttttgttttttgtagagatggggttttgctgtgttgcccaggctggtctcaaactcctgagctcaagtgatctgccggccgtggcctcccaaagtgctggtattacaggtgttagccaccttatccggccaatgtacttatcttttccgtaaactacctgtcagttgttaatccaatctcttcatgtaaaaagggattggattagatgattgctacaagttaatttaggtgtaatatttttctaatcctaatcacaaataaattcactatatttccaaactctttttgaattttttattttatatgtttacagttagacatatgccctgatacttatagacaggccctactggaaaatgttggtcctacagcctgtgcacagttataacagaaaaataaacaaaacccaagtttaaagagctccatatcttaaatagtcattctgggcttaagaaaagttaaatattgacctattattaagttaccaattcattaaaattctttttttctgataattattccagctatatgattgctcttgtttttctggatgaaataaagaccatattatctttggggcaactcagaaacataggtcagctcacacctattagagccaatagttgtatggtaggtgaagggtagaaccactcaactaaagcccaaagaaaatctttatgcattttcacaagactttgagatcccacaagataaaagagattagaaaaaatgggaggatccttggtctcagatttaagagtctctgtgatcatatccaaagctctgtgaggatttatatggcatcacttatatggaaggaagaaaggctgtctgagccaggaattcccaatactgcaatttattttaaaaatactctgctttcaagtttgggggcattaatgatacttcatattctgcctacttggagttggacaggaaaaaagtatgcaaatagaaatcagaggctgagtgtctttatgaatgtatctggatgagcttttcctccaaactatctttctgaaagtagtagtatacattatgcggaaaatagtccatgtgcaataaatattaccaatctattgctattactatgtttcactttttaaagggtgatggagatttgtgatgaaaccaaatatactgtagcctatctccctcctcattattggcatattaaagattctgaaaaaactatttaaatttgttcaactaaatattttccaaatgtaaacagaacttattttcatgaaatgagttaggagccaagttttggaaatatcagtctagcaatagcctgtgagtaaagccatttcagctaactgttaatgtactgacttccaaatgtgtgtccacattgcactaagaacagcagggtatacaaaaaaatgagatgacaaccctttttttttaatctaaaatgggaagatatggccaggtgcggtggctcgttactgtaatcccagcactttgggaggctgaggctggtggatcacttgaatccaggagtttgagactagcctggccaacatggtgaaaccccatctccactaacaaaaaagtacaaaaattagctgggcgcaattgctcatggctgtggtctcagctactctggatactgaggcaggagaattgcttgaacctgggaggcagagtttgatgtgagctgagatcacgccactgcactccagcctgcgtgacagagcaagactctgtctcaatcaatcaatcaaataaataaataaataaataataaaataaataaaataaaatgggaagatagggctaatgcacaaaaaataaagacaacaatgtatagtcacgtgctggattgtttgatactgaatgcaatagttagtgagacatggagaaaagggtttttagatcagtcagaggatttgacaaaaatggaagcagaaaaataaaaaagtttagactagaagtcagtcataagagctcatgaaaacagaggccttgtagaagaggttgaatttgagtatgcctaaaagactaggagacttaccacatgcaaagataagatgtagaaaagatgctaaataacagaagaaaacttctttaacaagcagtgcggagccattgtacaataaaaagcagagcggtgaggtaataaaagcaatgctttaggcagataactttggaaagagtatgaccattgggttgaatgtaggagtcatgggagtcagagaggatcattttgcctttgcaaatgttctggcccacagagaaccactgcacctctacagtgtttctggacacagataactgatcacactccacttccatgacttactgtgggaacttgagcaaattcttgaattttctctgacagttttttcattcaataaatgaggacaggaatgttatctatgtcatgaagtcattgcaagtcttaaataaagtgcatgaagccatgttagaacagtgcctgccacataattagtgtgcagcaaataagttagctcaaattagccgtaatggaagggaaagaaagaaaaaaaacaaaacaaaaacatttcgcggtgttaatggattttgtaacctactgtagcgtggaaggtagttcggtccactatccctcagcccctaactgttccaatgttgccatcttcccagccctttcattcagttttctacactgcagttagagttatctttttaagatgcaaatcagatgactccactgcccacttaaaccttttccatggctctctatagccctcaagtttatgtccaacttccttgatacattatagagccctgacccaccttcgcctctctagcattttgtctcatcgctccctttcccacagtctgaactcctaaaaatgcattagtttcccacctctgggacagcttccttatggtaatattctccttcccttctttgtctagtgtgcatattaacatagaacacataatacaaatttagaggtatggaaacattttcacaatgtatgaagattgtgaaaaccccatttccaattaaaacaaattacaaaaaatagctgggcatgatagctggtgcctgtagtcccagctacggaaggctgaaacaggaaaatcacttgaacccaggaggcggagtttggagtgagccgagatagcaccactgcactctagcccgggtgacagagcaagactgtctcaaataaataaatacaatacaatataatataatgggaagatagggataatgcacaaaaaataaagataacaatgtatagtcacatactgaatttcaagaggtaacttgaaagagatagtagcatgccaggagaggagtttttctttcagacttgggttatcttggttacactgaaaattaaacatgcaatcattccatgttatctcaaatgtgtatgtgcattttctcttaagttactttaaaaaataagtaatgtattcaaagaacaaaaggatgtacagtgaaaagtcttcctgccacttcttgagtgtcctgcaaccactcacgatcaatttcttgtgaattcttccacacatactttgtgtattttaagggaaatatatgtatatgcaaatctcccatgtgcaaaaatgtataatgtgttatgtaatcaaatttcccagtgttttctgagtaatggtttgtgtgtagactttatttactccaagattatagaaaagaattcatgatatcagctggtatatttacgagttattttttacatttaaatttttgatactggagtcagatgtgagataatgatcttccctcatttttttcagaagtctttttctatttctttattaatccattattttgctcttcatttgaaatgttcccagaatcacagactttaggcttgtgtgtactggggctacttatggactttatgtgctttcacagcaatctgtctattcatgtgtgtcatcactctttctatgatttgtgcatcatatctgctgaggatagtggtttcttgttatttacctgttccagaattgttctggcaattcttgtttcttgatttttctatataaattttagaatcatcttgcctgaattagaaaaaaatcacatggcatcatttaaatggcattgcatttactgattaattttgagactttcaatacctttatgatgtttaatctttgtatccaagaaaatagtacatctttcttgtttttttagtcttcactttacgttttctacacataaatgctgcacaagatagttggtattgttactaattttaatgaggcatttaataaattataacttttaactaatatttgtacattatattgaattttaactccgccccaaaaagcaaaagtaaaggaaagtctaaaagaaaaactagaggaatctaattcaagactactacttttaggaatataacttggaaaaagctcttccaggtacattcatagagacatctctgttacagtttctgtttggcacactctttttttcataatgtaaataggagtgttaaggttacttgtgctgatgtgaaatatagcccgaaagtagcttaaaatattttctacttacacaatattgagtcatgcaagacctttcacaaaacaaagactgggatggtgaagcagtctatataggttaaatattgaattagataggaaggggttcattaatttctaaatatttccttttagagttttatgccaattagaagttctgtttctctcttcaaagaatagttcttcaataggcagatatttaccaaacacctacaacctaccagtcactctctgaggtgctgaaggcacaaaaataaaactgactcagttattgccaatgagcattttgcattctaagaacaatagtctaagccttggaaattgttttaaaagatttctgtgtgctttttcaacatcaaagcagaacattgtggctcaaggaaatttgacactctaattgggaaggtaattttgtttgatttactatttactactgataagggcacagactatataaattacatattaatgtgagaagattgataatagcaagtgatattcatccggcagaaatgtaaatggtttctaataaaatcatagaaattgtagtgttattcttctgtagaacattagcctagtctgtatttaactgaataaacttatcccaccattctttacattccacttaggtgtatatatgtatacacatatatgaattcaaatatgtgtgtatatgtctattcacatgtacaccaacaatatacaccagtatagcagtcactaccagtttctcctaccctcttttgagccagctttaccattactgtgattccttcattaataaactaaataaatctttgctgtgttctcactatatttttgcataggagtgatgtttttaaccttattaaaattaaactttaacaacatctataaagtttcctttgttcttcttttccacacttgggctaatttccaatgccattgtgagacagtgatggccctttatttgaagaaacttgactttagctttgcattaaagtgattacaaaatactttaaaattctcttacttctttttgaatacaaatagatagtagaagaataactcatcaacagcatactcacattttattgtttctcaacactgaattctaaattctaaaacaagaccattttaaattattttgagcacaagctagtcatttttcaagtaatcaacaatgcctcatcggattagaatagaaaacattgaattgaagtaaattgaattgaaagtatcagcaggcattgaacacagcaagagtaagcaaatatttctacagtatgtatgtattagatcttttatactgggtttacactcagaaaagtttgaaagccggtggtttaaatattttttgctcagattttagaagatgagtcattgtggacatgtgagtttattctagaaagtatgaactaaatggtcatccatagtttaacattagaatactctgggaaaccagatatttgtagtagcagcagaggcaactgtacttctctctacattcttgtgtattcttcgtgcagacacatttcactacaggatgagactgttgctgaaggactgctttccaactcagttatgatgtgttgatcacagaaatgaaaagaaaggctttataaatccatccctaaaccctatcattacatatcagaatcaaattcatacaagataacatttagatctaaagcgaaaacaaaacctaggccaaagggttctgaaataagcattagagaaataaaaactaaaataaatccaatctcaggtgtgagatggaacaaatgcttttgcttatctatgttttatattcagtgagtgtagtgcagaatactctcctttatatcactttcttaacatatgcttgaggttcaagtgggcatttggccctcttcaatctcgagagctctgtgtagctcctctaacaaattcactgtatttaaatgaagctatgttataaagccgactaggaaaaagacatctaaatgcgttttaactccagaacctcttccatcaaatttccattcgtaactgtggcaccaaattttagtattgcagagaaagaagaagcttttgctgaaataattccatgctgagacagctctttaattgggaacttctgctaagctagaaaatatgttcgaaggtcagtacaaggttccagctggtaaatgatctgcatttttctaagtgactgatttttttaatcacaatactgcatctatctgatactattaaatacaaaaagaaggggcataagtttgggtcctcttttcatccagaacgcaattttattctattgtcactctctagattagtgactcaggatccagagagaagtattgtggatgcatgtgggtagagtgtcctttaattgagtgcctgcccccaacaggcaacaccacacctctaatgacagacttagtgagccactattaagattgtttcccgggccgggggcggtggctcaagcctgtaatcccagcactttgggaggccgaggcaggcagatcacgaggtcaagagaccgagaccatcctggctaacacggtgaaaccccgtctctactaaaaatacaaaaaataaaaaaaattactgggcatggtggcaggcgcctgtagtcccagctactcgggatgctgaggcaggagaatggcgtgaacccgggaggaggagcttgcagtgcgccgagatcacgccactgcactccagcctcggggacagagcaagactccgtctaaaaaaaaaagaaaaaaaaagattgtttccttcaggtgtatttaggtataaaacggaacctttcatttctctgatatggaaggtgttgaattcaaaagttattctggcctttttatattgccctatatctgaactacatccttgtcaagttcaaacttgaaagtggtcaaaagtagtgttctatgaagcattgctgttcagagtgcagagcaataagggctgatcaagagcaccttaaaacgcagtctctgcccaggagtgagaatggattgggctcatccccgaacggtcagtgagttgaagagctattaaatttgccagaatggccccaattgaggttttcataccttcctcctctcccagacagtagaatttaactcagtgatggcggccaggtttaagagtgtttttaggacaattgcaagtggaaactttcccagggcaaagaaataatgagcactaaagcccaagagacattgttttagtagaactattttctctgtaaactactggtatcagattttcacttaggaagaaaaaaaaaagagggagaaggttaagaaataaatgtacctacactagctagttagacttcttatgaacatggctaaagacataacttgagcctttgcaaggtgtctttggcagagatctaaaatgcattgctgatccccaccctcccctctagggaaatcgcttaggcattgtctgtgtagatatcacctggaagctagtcaaaaatgcagaatctcaggccctgtggcaagcctcctgaatcagaatctgcaatcctgacagaagctccaagtgactcatgggaacattaaagtctaagaagctctagttttagtgacatccctctcctattagaatacttgctcaagttaagagttccaaatttataataacaaagaagaaaggataagcatttttaaagttttttgcacagattaccaaatttcactttgggaaggttttactgacttttatttgtaccagcaaagtacgcgagggtttgtttcactgcacccttgaaaatgtggggcatattattctttgagttgtgaaatttgcatttgtagtctatgtgatgtgtgagataaagatctaggcttcctaacaaggaagcagttttctcagaacaagtaaatgactaaagcttcgtttctatattgaattgaaatgctaccttatcctatatttctattacagagctttagaacttcatatttttcccatcagtatgggaaaatttttattcttacatcaggaccatgatattttaattatggtggttttttgcttggtttaaatatatgcttttggtagtcagcgtatccatctttaattgcatctaaacatttctctctatcacaactatgatataaatccctgcagcattttgtgtatgttttcataatatagatgtacaggaggggcagctttacacatgactttttaatagacatgtaataataaaagaggacacttaatcctaatactcaaaatactacatttttctgccattctgttatgtgctgatttatctttacaatatttatgatatgaggttcagtgggacagcaagaactgttgagtccctgcattcagcatggtaccaaacccggggacataatagaaagacattagaaatgagaaaaagtaaagaaatagaattcaagggctccactcttaaagactacaatataagtgataatttatgtttaggaaacagactcaagaatttaagtttagaacacatactaacaaacaggtaaaaacacccaattaggccaggcacaatagcttacgcctgtaatccctacattttggcaggccaaggcagaaggatcacttgagtccaggagtttgagaccagcctgggcaatatggtgagaccccatctgtaccaaaagaaaaaaaaaaaaaaagctgggcacgatggcacacacctgtagtcctagctactagagaggctaaggtgggaagatcacttgagcttgggaggttaaggctgtagtgagcagtgatcatgccactgcactctagcctgagtgacagagtaagatccggcctcaaaaaaataaaaaccaaaaaacaaaaaacaaaaaacccactcaattagtcagagaaaatgaaatgagcttgtattagtcttttttttttcttttcttttcttttttgagatggagtctcgctctgtcacccaggctggagtgcagtggcttgatctcggctcgctgcaagctccgcctcccgggttcacgccattctcctgcctcagcctccctagtagctgggactacaggcgccaccatgcccggctaatttttttttgtatttttagtagagatggggtttcaccgtgttagccagaatggtctcgatctcttgacctcgtgatctgcccgcctcggcctcccaaagtgctgggattacaggtatgagccaccacgcctggccatgagcttgtattagtctttaggctgctgtaacaaagtaccacaagcttaaacaaccaaaaattattattatgcagttctggaggctagcagtgaaatcaaggtgttggaagagccgtattcctgctcctggcttctggttgttgcagacaatcttcgattttggtttgcagctgtaaaggaagctctgccttcatcatcacatgaccatcttctctctgtgcatctatctcatcatatagcattcttctctctgtgtgctttctccttgttttaaaaggacaccagtcatattggattaagggtccgtcctgttccagtatgacctcattttaattaattacaactgaaattatcctacctataaataaggttacattatgatgccctgcggcttaggacttcgatatatctttttaggaaacacaactcaattcataacagttatctttaagtcaaggggtgagtaaataacactgtagaagtagtgtgggatggaattccaatcgctgccttcccaacaagtaataagtgcacattcagtttagaggaagttatctttcactgggcaatcagctttgagacaattttatctgatgattaagattcaagagactatgccattatcaataggacttagaaagggtggatgaaggaaagaattcataattaactctgcaaagtttatgatcctagagaaccgaaagaagacaatgccagctacatgaatgagtagtacactttacccatgactttgctgcatatatactcggttttgttcttctatcagtattagtaatagactgccttattataggtcatcgttgggctaatgtaaattatttttcctgcagtttatcttgctagttagacgtctttatttcgttctaccacaacacttgcatctgtgaacaaaaagtgtttggtgagctcatgacttgtctgaccatctgccactcactcaggaaattgctgcatttatgcaaatacccacccagtaatttgtgagcaagaagccaaggtgtttgattaaagtaattaattttctcacgtcatccttaaaatgagcaagatgcagaaccaggtggtttggctagtaccttctaagttgaccctcacttttcttggtttgtttatctcatgcgattgaacacaattctaagaggcagcatattacaaaggctgtatatcataataaaatggtctttgagaagatatggccatataaatatagacattagttttatgcttatttcaaaatgaagacccaaataaatggaggtttggaatttgaaaatgttcctttcagtcagaagaaatattatctaactgcttacatatacacaaagggatgttattctaaatctattcaaaccaagagcctctttaacacatgaacaattcatttaatttctgttatttttcccactgttccctgactgggaacaatgtcctcacaggaataattaccatgatttttgaaatttaataaaatccttagtgctttgggaaaaaaaaaagataatatttatttttacatcgaatgttggatttcatagaaccttagagaccaagtctaaacactcttatttttaaaaattatggaaccttgttcctttaatttacttaaaaataaattttcattttttctttaagagaatttgaatgggatcttattttccatgctttaaaaattaatttgagaagatatttgactttttttctttaaacaaaacctttaatgctatgttagaatctgctgtatgacattttgactttcatatatgttcgatcaagaggggtccagtgtaatgcttaaatgcgtgctttctcataaatgttagtaagttacttaattttccccaaatgttggaatctgcatgccatctttataaagttaagagattcatgctgttctttatgcatttgatatttacagttgaaaggcctgtatcataagcaatctggttcacagttaggcgtttaacttgacattttataaagcatggacatttgagtcctcaatcctttcagcttgttttgagctaagtgtgaattaaatggtgggtgtagaggctgtgcatgatgttttaattaataacccttcttgttacaattatttttatctggctactcagaaaatgcattttattaaacaacaattctatttttactcacatgtagaaaatatatcaggtaataacttcccacaaaatatcaagggagaattctaacttcattttttctaacattacctacctatcagtaaacctatatatgtgtttttaaaatatacatttttatttggtgataaaacaatacattcatctcaatatacacatagtgtgttattggaagacctggaagcaaattgctgcatatattctgataactatgtgctacccaggacagaattgacattactagtttcaaatgagtcacaaccagcagtaatatgattgaaaaaaacagagaccaattatatatcctgagtccttggcaagaaaaatgtagttgacttataggttatttccagagattggttttaatctgcaaatttatatctattacatatcttgagcattttagttcagagattataaatgcagctttagatcaaatagagagaaaaacaggctaaagccattttttaaaaaatatgtaagcctgataaaaacatgatgaattctaccctagaggagttctgagagctgattgtgccctgggttcaggatgtttttcttcaaataggagaagaaatcataggtcactttgttccttcttccatggactgcccacacatgagagcacaaggcaattaaaaatagaaaaaattattccctttatcgagtttgtcttcagtttactgtgcttgtcatttctatacatttgtaactcttccttcagtcaaccttgccttcagattttctctacctgccattttcctacaacctgtcctgagaaaatatctgacgaaagtaatgtaaactaatacttaaatgcttaataagtcatcacttttctaggttgtggtttaatagagtaaagtctctatgtctttgtggatttcaggcattcatgttccaggtggaggaaatatttggggtgactaagggctcatctatccttgtgctccctaggtttcaccagtcaatttaaatcttgccctcttttcaagcttctggctctcctaacccagcagctgagtacgattaaaagagaggtgaatagtcatttgctcatttgacacacttatgcacccttgctgaccctcaaaaggcctcaccacttttgaagtggttctttcgatgtatttataaaactattcataaatatgagaaaaaagctatagaggtcaaatatcatttccttttgcttccctcactgattttattcttgaattttctccagagaagattaatgtcaagttctactttaatttaaatgggacataggtgatcatttggctaacacagttacataaaagcattttataaacacatattcctaaaatcatcctttggagactaatggaaaggatgtatatttgaaacatccacaaatcatggtacatgttgcagctacacaggaatcacaatggcacccaaatacaccatggggtgatgatcttcctattttatctctgccggaggctctacttcttcccaccaatttcccaaatccttgtctcttattggcaaatctgagaaggatttaagcaagagtagatgtcatttatgtttcaataagactaacattaaatgtaaaaggaggaaggaaaaagacccatatacatttatattgaatgatacacagttacttcaattatctgtattttaaagagtagaacagaaaaccaaccatgagtcacagaaaagtggtcatgaagaaaattaaaatagctctaaggacataaacactaaaagagcatcctcccaccgactaacaggtgcaggactcaactcaaagtagtcaggctgttgccatatggtgtccatttagagccacagcctgtctggcccacggctgtgcaacacagtataccaccacctgtacccagacctctgcaagaaaatgtggtctgtatctcattttgtgggggaatagaggaaatctttgggagaactatgagcaaatagatgatagttgaagggctaccctgataatttttctgggtttgtatattgtgtcattgttactgataggagggacggttagttagaagtgcagaaaaatggtagttccagacttgtaaatctacatgatgtttaaaaatagcaagacattatataaaatccaaaatagaaagaaagaaattatgacatcctgaggctgttgaaaaaaaaattaccaaaatgacaggtgtttttccaactgtgtttcctcttctgagaatgcagaaatgtcctctaggagataaaggcaaaatgaatcagtggaaaagactcacggactctttactgtggtactgaggccacacggactccttttcatcaacaaccaaaatattatgaaaaacattaaactaaaataatgtgaaaagtttctaatacgtgactaaaagcatgttggttcacacttatatatggaatttccatttcatattaaccttacttatattttctactattggataaaattaggactcttattaaaaaaggcgggttctcttgaatttttttcttacaatgtgcctatgtaagaaagtgcttcatttggtaaatgcaacaatatatagcaaatagaaaatcctcatccttgtgcataatacctaccattttgtggcaatattgtatccagaggctattaggatctctggaaactgcttttaactcttctatttagcccttggtagggatactctttttcttctgtttgaagtaatggtcttgtccaagaccattccaatgtaagcagcagtgtcatactatgtgggttatagcatcaagaaccatgcttatcaatagatagatttgggcaaaccatattgtacccccacctccaatggttttggtgggttaaatgaagtttgaaagccaatagtggaaatatgtaatagtaacagaatcaccaaaagtctatttgagaggcatatagaaagctgagaaccatttctgctttggtgagcttttgagctgattataaaaatagatgttgttttaagcagtgctaattctatatcctttaacctaaccggattccacatgaaatcataacccataatgtgggaaccatggatgttgtcatgaataatttaataaacataaaatgtgtgcttgatgttctgcaatgtgggactttgaggacgaaaatcttaggccttgatccaagcagtgcaaaatccagcaagggtgagaaatactagctatgctatatttgtgaagtgtatgaagagagatattcatgaaccaaatattatcaaaacacagaaaggactaaatttccctctagcaatcagaaacagttgaaaacacatcacacatgtgcacaaaactggcatgggagatgattctactggtcactcataatggatttttgactgttccagcctacagttctttcaaagtagttattctcgacctgggccactgttggaggttttgagtcccctaagatttagagaaatcagtttttgagattcactggagatccagaacaagaagtttgaagtaaggattggacaataccccactggatttcccgctgggctatcccagcaagcctgatgagatctatccccaaatccctttctctagggcagtgactctttcgtttacaattaaagcatctggacgtttattagaaagcaaattctcaggctccatcctagacctactgaattagaatctctaggaggggagccagggagttcacatttcaataagttcttcatgtgattcaaggtgtgctaaagttagagacatactgctagtatttagttatgcaacttcagtgttgggtagatggatctaccacaggtaatcattagcccccagattcagaagggttctccagtaagtagaaagtttcaaggactgacaaatcttaattcagtagttcagtaaatatggaattttcagtagttttccaacttggctgcatgttggaatcaacttgggtattgaaaaaaaaaaaaaaaagctcatgcctggatcttacccacggaattctcatttaactagtcagttttataagctacccagatcagtccaatctgcagtgaagtttgagactactgcatcagaaagtggtggttcactgacctttatccactaaaagcctatgggagatagcaaaggaaacaatttttgacagaaaagaacataaagggaaataaaatttttaaatatgtcaaactttattctaggtttaaatcacatttttgagattttctgtctaggaagacgttcttaaagaatcttcctaaataatgactgagtagcacagatatttcagagagactgcaggtcagaatagagaatctttattcacattatatttaaggatatcaacattttgaagcatcaaattaaaccatgccctctgtactttaaatcattctgccttggtcactttgtgttgctgtaaaggaataccttaggctgggtaatttataaagaaaagaggtctatttggctcataattctgatggccagaatgttcagaattaagtatttacatccggtgagggccacaggctgcttccactcatggcagaaggtgaaggggattctggttgtttaaaagagcctagcacctcccacctctctcctcctttctttctggccagtgtgtgcagagatcacatggccagagaggaagcaagagagaggtgagaggtgctagcgtcttttaaaaaaccaactctcggatgattcataagaatgagaacacactcaccagctccccccaggaagggcattaatctattcgtgacaaatctatccccatgacccaaagaccccccattaggctccacctacaacattagggatcagatttcaacatgaggtttggaaggacaaacatccaaactatagcacttccctacttcatttttcttcgctttctctccgtctcgctctgtcgcccaggctggagtgcagtggcgcgatctcggctcactgcaagctccgcctcccgggttcacgccattctcctgcctcagcctcccgagtagctgggactacaggctgttctcgtttttaatctcctgattgcctctacctttagcatctgataacctccttctaccatcaaaaaatgctttcatttagagtcttctgtatttaattaatgcacttttaaatatttactgagcaactgttttgggggtcacagcattttcatagttatgcgatgatttcttcaaattgttcaaaaatgtttattgcattcctactatcttcctcgcactattctaggtacatcacggagcaaaacatccaaaaatcttgccattgaaggagcttaattctagtggagcaaggaataaacaataagcaatatgtaagacagtagatagtgttctagaaaatagagactatgataagtgctataaaaagagaaagcagaatagagtaagggaaattgatagtgcagggctagggaatgagaattttacaaagagaaggcaacatttccatcgaaacttgaaagagatgaggttatttgagggtagaacatatcaattagtatgtttcatgaaatactagacaataacatttttaaaagattttgtgttattttttttcagttaaaagaagaaaaaaagcaacgctttctcctaaatcgagactgctctactttcatctttcagcctgtttcatgttaataggtgtttttagttaattaatttcttccttaggatattcatgtttgttcatgaagattgtaaaatcacaaagttcatgtgattattgttatgttattagggaattatctctctgcagacatttacatttgcctctcactaaacacatttgtgttcctcagcattccaaggttgtgtgtggatatgtctgcatgtgtattttagtcacacaacctgctgtgtatcttaatgagacctgtaccataaccaattagacacctgcagtagaatcacactgtgctcccaaatactcattttctctgctcgtcaaagagttcaaactgagtcaccttcacttcaagtctatgcagctttttactaaaatctcaaagttgcatgggggctttactcctttgctcaaaccaatttttgtgaatgttgggtacgtaaaaacatcttcaaagtaaacatttagtaattaatcaatgctataaatgtgtaatgagtctgttctgcaagggacatcttgttagcttttgagggcatataggatactatttgaattggagtaactttctgtatactctaaagaacagctgccaccctcagttctagatatgtcttgggaggcttatcgtgattagattttcacattatattttcttggtaattatatcttaaagcccttaagttcaaatgaaattcgaacaagtcacaggtgatgcaactaaattattggtcatgagcgtatatgtcacatccgaaataaatcttgttatatcctcggaaattagaagtggtccttcagggagtcactccaaaactgaagagggagcaatattataaaaccattgttagggcagaagaatagtttaatttatagttcttttttatttgatacaataactgatgagctctaaatctctcatacacaaaaatctgatcttttttccctgcaccaatttaacttttacttcccagatttgccctcaaagtactccacacagcagcttccataataatgccctccacctccatcaatgtgctaatcagtttccttactcaggctttaagggagacacagacccttcgaggcaaggcagacaggaagaatagcaaggcctctactctgctcctcctccttcttttcagtcctatcctttgcctcctagagagcccctagttgtcttgtaatattcaccaaaataagttataaccgtaaacttctatgttaaatttttttctgcagaagaaaataatcatattacaattgattctgagtttttaaaatgttaatatgactaattttaaagcaaaatgttgattgatatacaaataaatgttaaattcagatggttttattttctgttatatttccaagaacgtgctaattccaatatttactatcttccattaatttatattacataaagctttctaggagatgtaagtaacatttgatttgaagtaatttaaaccttcatgttacattgactacacttttgcattgtcaagtattttaatggagaaatattgaaataaatatactcaaaatttatcaacatttattttaggatttcaatgaatgtgatttaaaatacatatgttgaatttttatttctttcaaaaatttttattgtaccatgaaagctaagattttttaaaaaaaggaagaatttattttattatgccattacattcattacactatctgtaaaagcatgcgaaaattctctctgcacattttgttgagctagccatatttatataattggcaatatataaaagttcataaagcccacagatcattacagtagtaatcagtgctgattctagttaaaaaaaaaaaaaaagatagaaaaggaaagcaaaagaaaaaaagaggcatagtacaagtgtattagaccatttttgcattgctatagagaaatacctgagactgggtaatttattttaaaaagatgtttgattggcttagggttctgtaggctttacaggcagcattgtgctggcatctgcttgacttctagggagacctccagaggcttacaaggtgaagcaggaggaatcaaaagagagagtgaggaggtgccacacacttgtacataaccagatctcctgagaactcactcaccattgcaaagatagtaccaagccatgataggtctacccccatgactcaaacacttcccactagtcccctccagcattggggattacaatttaacatgagatttgggcagagacacatatccaaactctatcaacaagttacaacacaaatgagattaagattatccccattagtgttctgcatatgtacttctttctgccactgatcgttttgactatattcacatgagcaagaggaacaaattgaagggattttgaaagatatcatttgacttaatcgatgtaatgacatatacatttttgtgatcttaagtactttagaacatgtgaggtactttatagagcaccattcactccacaaacatttaggaattcctaaaagacagtgattctttctggaataagaagtacaagaaccaggatggacttgcctgatgagagcagctcatcaaggcagatgtggacagataattggctgacagtcaagttgggaaatagagcagagtgagtgaagttagatcactacttgtgagatcagttagaaaaaatcaggaaactcgttccatttcttgttcaaaattagctcaagatggggcaaagattgaacaaaacaggaatatgagagaaggggaacctgaccaaaaaacagtcatgaacaagaaccaaaagaagtgtaagagttgttataatatttttggtggataaactaagaagcacactggctggatggtctctcagtaaggtgtagttccaggctgaccatcaatgaggattgaccatgaattgacagaaattaatggaatttcacactggagttagaattccaagacaatgaaaatagcacacaagaattacactactggagaggatttgtgaaatttgtgtgtgtacaagctatgagttaaaatcttatattcgagatatagaaattataaccttactttctacagcacatttagaacaaggttactgtagctaagcaactcaaaatttccaagtgagcgtaatcatccctacagattttgaaagcttaatgcaagtttccagagtctgaattaaattaaggatggctacaatgttgaagaattaataaatacctattcagaagaagatgaattccatattcacaaatggaatgtttaagaattttaaaatttaagcagcagatttgaacattggcaattctattttaaaaaataaaaaacatgtaagaacagatctataatacactttaatcttaatacttgcatgtcttactacttagaccatcaaaagagacgaaattatgtgtaaaatatcgtgagcttttattatgtgcccagtaccgtaatagactctttacagtcatgatctcaattaatctatacagcacctctattggggtaactactgctatccattttagagataagaaacctaaggcaaacatgctcgagcaaggtcacagacaagtaagtatcaaggcacagatgcaagcctgtctgcctctggggtccaggcctttaactaccacattcagctgttgaggcggacagataaacagaaaggccaatacgaaaaggaatcttccctatgtactctcaaagtgtggaatttagcttctaggaagaaatgggaaaaaaaagaaaagaaaaagagagagaccataaagcaagctaaaccccttcttacttttgtttgttttttctcagtgatgcgtgtgatcctgttaacatcatacttgatttaaatgttttgttttactgttatatgtaatgaaagataaacttcttcccattggctatcatgagacccccagaagctgctgcacaagagaatattcttattaagaattttgagtaggctattaataatttctagtaattataaaattgtttaacatttataacattgaggaatttatttcaaaactgcaatattattatcaacattaacgactagtttcacggtcatttttaaaagatgacagtggagagcaagacctaaaatgtatttgccagctttaagaaggcacataagaaaaggaaacatgccaaagaatacagagattcgaatgagtaaaactgtattttaggctctggcactagttttgtgggcttgctaaatcactttaccctctgaattcttattcattatttacataaatggaaatccctatgtgctacaaatttctgtgactcgattatcatatttcaacccagaggaaactagaaattacatagtctgagcaatgactatatatgccctttgttggcatgacctgaattaaatcacttcaaactctcaggagaagataaaagggttttttaaatccagatcttaaatattcaacttctaattgttcattgctagtatatagaaaagcaatagatatttttatattgaacttgtaatctgggtccttgctaaactaatttattatttctagtagcttttttgttgttgttggcagaccctgtgggattttccttgtaaacaaatcatgaagtctgcaaatagagttttatttccccttttccaatttgtatgcttttttgttgttgttgcctcattgcactggctaggacctagtacaatgtcaagcaggagtagtgagagaagacatcgtcgccttgttcccatcactgttccccgtcttacaagagaagcattcatcgttttaccattagtatgatgttgactgtaggtgttttctatacatcttttattaagttaaagaagtttcttttttattcctagtttatggcaaattgcttttatgaagagatgtgaattttgtcaaatgctttttcaacactaattgagaagatcatatgatttttcttctttagtcatcatattttaattattcatgtgcattcatttatttaaatgttcctgtgtcatctagccttgtatttctcacagtgtctgaaatacagtatataattagtaaatatcttttcagggacaaatacgtgaatgctggatactgtgctaggtgctctactgttagaattttctatgttttatgctttatttctcttctctataagtacaattttcatttctgcaatatactttaggttgcaagaataatcgattcttttcatgcgtaattgatggtatgagtttactcttataaccctgaaatcaagaacaggtaaaatatttggggcatgtgctctattactcccttgatgtgttcagttgtaatgagtgaattatggacacagtatatctgtaatactaaaaactccatacagataaaacaccctttctcagcaaataaattttttagatatgtctgtttatgtctcggtgcatggatatatattttcctatccttaaaatcatttccaccctctttaatgatccatcttatgcttagtttcctaatcactaatagaaaatgaaaatgtatcttgcttagtgaaccatcctcagtactaaccctaccgggtatttgaactgcttcttggccttctactctctgtatttccccctctgtcttacaattcacttgcttgtgatggttttatctggaataatggattgttttgtagaattgctataatctattaaataaaattttctggaccagggttcggcacataaagccactaacatatatctgtaaagttatattctattctctgataagaatgatgctatgttcatgtaaaactgctttcatataatatagaatatgttactattcagcatgtatttcatataatatagaatatattaccactcaatcatgtacacactcttcgttatacacatcatgatatttggtgtaattcttataggactccttataggagaatttggtgaaattatagtggtgagcattccttcacgagtagatgtatcaataattagttttagatgaggctgtgtatgaaataaatataaaatgcctcagtgaatggatgttgccattgagcttattctccagctgggtactgtgattttcttgtcagcttattgtgtcacccacttacgtgacagaaaacctgtggtttcctcttatttgctattgcaaatagaaaactaggaagacacaaactgtccacagattttatcttatatatgagtttgcatttccataggactctagagttgatccacgttccaagttttcttttagtccatcactttaaaatagatgcttccacttaaatcaagatggaaaatctatattgataaaaccctatgttacatttcaggggagaaagggtatatatgttttatgaggtttttttgtaggttaagaaaaaaagatctttggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcgcgccacagcactcccgcctgggcgacagagcgagactccgtctcaaaaaaaaaaaaagaaaaaagatctttaactgaattttttttctatctaactattcatttcccgaatcctcttatttgttaagatagccagcttctataccatgagttcagaattatgttcatatgttttacctgcctcatcaaaatgaatggaatttgtccttccatattgtctggtatacgaggatgtttatcactatactcctttgttctcattccttaggccatgatttttcggcaaattatccttgggaggagccatgttgagtgtggctatacttatcagaattttctgtgtaagatgccattttcgcacttttccccaaggattcaccgagaaaaatcaaaagtgaatcacaatggaaagtaggagagaaatgaaataaatatcacagacacaatggcatcttatcactttatcaatgaaaattacttatggtgagttagatcttggcaaaattaaaaactttaataaaactttatcattttgacgtatgaaagggagactaccaaagggatatatgtagagaggggaaactatgctctgtcctctcttcatgaagcctggccaactaacaaagacccagaaagctaaaggagaggaggagaaggaacaatgctcctaaggttttaagcatggactatggagaccttcttatctcaatcagaaggtcttcaaagaagacacaaatcttcatttattacctatatttaaaatatcctattttaatatacctatagtattgtatgccagaaacaatactctggttactaccaatggattagtttctcagcttcagaacacatcagtaggggataagtgagtgaatagaactctattgaaagtctaagaatggcatgctttgattagaatgtcctggaaatgactaccaatttaaaagagcttagtatttccactaagaaattactactttttcagatgttgtatgtggaagaactgagtctgtcttgacaatgttgtattgatctggatgaaacaagatcaacaggcattagttactcagtgactaggctattaaaaaataaatttgaaattatttttctggcaaacaaacacaaatttataagaaatgcacaaatttgtttatatgttatagtatgtttattgttcatttgcaaataaaaatagtcctttcctcatcttgcaaatttatttatcaagtgctatcattatatagttgctaactattactaaatatgctgaatatatagttgctaaatattaaccttatgtaattcatttactataccttcagtttgcttagcatatcaaactttattgttattttaacaaaaataatgagaatagtaacatgttcatagtctttttatttaatttttaccatccatacttgtttctagctactaatatatgttttccaaatattttcacatgcattgttgcatttgcactccagaaaacccttaagaaaaaagtagggcatatgttgttagccccttgtctgatgaataaatttagatgataaaaattcaaggaaatatcccaaactgacagagccagctggtgacaaaagtagactcctgtttcaattttttgaatttgcatgtgcttgtctaactcgctaacttctaacatatcccttttatcaagatagttctctgtgcttttgaatcaatatgcttttttcacataaaactgattaccataggcaattttgacattattacaagtggtctgtaggtgtaagatgtaaaggaactagatataccttccgtatatgtagatgtcagataaaatccccacggaaacaagatggcactgctgaacacccgtacagccagggaagattcctcagcatggaatgcacaattttctacactgggaagataagaactgcagtaaagcgatacaattggtttctgaagaaaaaagccaagcttctttttagctctgtgggtgtcttttgtagctcagtgaaccgttgacagaaactgagacaatagcttagggagagataggaaaaaagatttgaagggagtatattaatatgaaaggtcaccaacgagacctgtgcactgtatgtgtgtctctctttggacttagaattgttttttccaaattcagtttttaattataactgtctatcttatataggcagcgggagtttaacctttttttttcttagatgatgtaaaagcaataccaaatgaggtattgataaaatttgtatctattattaacggtagaaaagttttatgagtgcagtacttgcgattttcatgtaacgtaatgaagacagcaagactagaatctagctagaatgtgaaattagctctttatataacttttaatttaatgattctaacaaattcataagtcataataacttagtaaggggcagaagcaatgatggaaaaaaacttatatgggacaggacgttttactttacattatcccattttataaacaatggattatggtattatcccctgtcataataatgtataaatagagattaattttaatttcttcacaacaatgtagagttatagaatgaatataattcagaattgtattgttgttttgttttatactattaaattacatatgtagaaaagacaggattaagagtgagggctttagaaagcaccacattattggaagtgttctgagaatgaaaaaatgttaaggacgtagaatctgtgattccaaacctgagaagccttttaaaaaagacatattgagaagataaaataagcaaacagaaaatggccttaagaaaacttaccaagcttcatatcagcaagtgcatatcaacatagcacaaaataaattccagcatgtttacagcgtgcagagatacagtagttaaaaaatgtatattgatgatgagatggatcaggcttacctgagaggtaaatttcaattcaaattttgaggagggcaatgcatatgaagtagaatatgcaatgggaatcttctagatagaagaaatgatcatatatataaaggtgcaaaagcaagacatggcaagcaatatgaatgagatcaacaaaagaagctggaatagaggagtggttctaagaaagaggtagaggtacagaaggcaagtgcatttagcagggcaggaggtggggagaatagcagctggccacatataggatggataaggagtttggagttaatgtggtaggcaagaagaagcacttaaaaagccttccacatagcaactacatgggttaaatatatcttacaggttaaaaaatgtactgggtaaattgaagcccacatgaggttatttctttctgccaaatgaaaatggtgaatgcttccaggtcttccacatgttaattgctactggggtataagagggccaacccccaccctcagatagaaagatatgtatctcagagacaatcatcctgaaaaaaagataatagaacttaatcatgggttatctctcatggactcagagaaaagagaactgtaaagaaagaaaatgaatccataatttttgagcccagggaaccaggaggaagctgcaagtgaaaatgaccagaaattataactctcttaactagtgagtttttattgagcaccatcttgtaaaaggcatagtcccaaatcccaaacattatttatgagtcaaagaaatgtcgaagctagtgttattttttttacatcactatcagggcagtgggagtagtggggtagtgtatgtgatgagtttatatgttaatatatagtaataaactgccaatacaagagccaaaaagatctatctccaggaccagctttctggtctgaatcattttttttccttattagcctcagctattgtaggaataggttttgtgtactttgtgtcttaagtaccacagtacttaactactatgttacctagaaacctggaaaccaacaccataccataccttcttattgaaaaagtacccaactcagagtgatccactgtataacccccactgtgatgtaattagagcaaagaggcaaatcaatgcaagtcttgtgtttacaaaatcactggatgcatagtcaatatggtgcctatggaataagggaataacaagccacaaagatatatatactccgtaacttggattattgttcctttgtgcttactctggcaaaacaccacataacatttaagaatgtcaggaaaaatattatttcaccccctgccattacgtttttattttaagccctgttcaaaacaactgctctgaaataactgaagtgttactagttctactttccaaaacacactatactttttctgaacatctctaaataataaatatttctgaacgtgtatcattaatattagaatttgttcttgactttagtctcatgttacacactttcttattgtgggggtcaaagtgatgaattctgcattcatctgctctgtgaaaaacttggtaagatcaaattattcatttatgcataaattttgctaatggttgagcacctacaataactcacataatatagagtcatgtgcttatatgggagagacaaccaagtaagcaacatgataaagcatgataaatgttagactgaggtgaatagagagctattgggacacttggatgcaaatctcctggtctgagtcagtggaaatttgcagagtcggtggaaatttgcctgtgtgacccaaatttgggtcatacaggataagtggaggttgcataggtgaagggagttgaaaaggcattctagaaagagagaagagcatgtgcaaatataagaagtctagttagataacttcacaattactttggtatacttggcacctagaacataaggcagagagtggcaaataatgaagttggaggactcaggaaccagcagatgattaataccttgcattccatacaaaggagttgaaactctatctgaaggtccttggtgatatgattagctctgtgctgtggaagatcagcagcaatgtgagattcacttggaggcaataaagactggagtagtgggatccatttaagaggctattaaggcaacctagagagagatgctggtcgcaaactaagggagtaccaatgggattgaaacagaaagatgtattcaaaagctgtaagaaatgagaatcaaaggaatctagtttctgccttggaaaacattatgttctccatttaacttcagcactttgttttgccctaaggttctcttatttatgctgattgacatattttctgtttttattaaccagtgggtcacatactgtagtgcagtgttttgtctttttaagtaaacattcacaagaggtttgacagcttgcagaaatgtgttaagtatttgcccacctaatgcagttccttgaagataattgactgtcattggatcattttagctcattgttctacaaaaaactagcttataatagtttcaaaaactgagattaccacatatagagaaatatgatcaagtccttggtgtagcaattttcttcagaatcagtgcttggagcaatatgaaactatctaatttggggagaattaataacactgctgcatctttaaagaaaaaacaagtatgtaaaaatccttaaagtgaaacaatatattttaaaacatatcatttcaactgtacctattacttaaacaagtgaaaagataaactgattttcaatatgcagaacctagcaatgaaaatcaacaaagccagataagattatttttaaagcaattaagagatgccataaaggataaactaagattgcatactcttagaattttacaactagaagggactcctgaaatcaaggtttcagttagaaacatttatttaggaataaagctacagcttctttgaattttaaggtctagacaacccagagaacatatccccctctatactaaaacatgtggcttgaggcatgtttcaatataacattataattttctttgactcaatataaatatcatgacaatagtcaattatgtagtccttccaggtaaagaaataatttcttatgtcttttactaacattagtttctagcatcatcttccaccttaacatttgacattgatgtatacagaacagaaacctcactcaaactaagatgagcaaccaaacaaaagtaggggcaggggatagaatgaatgataacgttactaaaaggtacggggcccaccctgatgtaggctgggcctaaacaatgtcaccaagacttcccttctctttctgtttgtgcattggcttcacttaggcagattttctcttcagttgatcagctcaataacccagcgaacaaaaaccagcttctctttctcagtagtcacagaaaacccttataatttagtctcattggggtgactagagttatatttcatttccctttagtccagtactcagtccactttgcatggtggttcggtctcctcgactaagcattgtggtctgaaggaaggaaaaccctgctttggccaggtcggatcacatgcacactactggtcagcagcccagaatcacctggcccgaggcttaggagaaggtggttcccaagagggagctgtggtggtctttgcagaaaaaggaggaggacaggatgaggcctagtcaagaatagcagatgttttctactcttgaatttcataattctcttactttcttacttttactactcatgttataattttttccactcatgtaaccattagagacaaagagtctctgtgccaactcttatcaaattataatgggctgaatgtttgtatccctccaaaatgcatacgttgaaactgtaatccaaatgtgatggacatttgggagtaattggtcatgacggaggtaattaagtcataatcactgaagaatgggaatagtcctctcataagaagaggccagagagctagctagttttcttttccccatgtgaagatatgtattagtgacagttcttcagagaaccagaaccaataggatatacacagttgacccttgaacaatgcaggggccctgcactgtcaaaaatccacatataacttttaacttccccagaaacttaactactaatagcctactgatgaccaggaaccttacagacaatataaacagtcagttaatgcatattttctatatgtgttatatactgtttgcttacaataaagtaatccagagaaaagccaacattattaagaaaatcataaagaagagaaaatatatttactattcgctaagtggaagtgaatcaccataaaggccttcatccttgtcatcttcacatcgattaggttgagacggaggaggaaaaggaggtggtcttcctgtctcagggtggcagaggcagaaggggtagagcaggtagaatgggaggcaggagaggtagggacattcaatggaactcttactgaaaaaagtctgcacataaatggacccaaatcattcaaaaccgagctgtgcaagggtcaactgtgtgtagacatataaggagagctattatgggaaattgcttatttggttatgaaggtcaagtcccaccatttactctctgtaagctggagacccagaaaatctgataggtgtaatttagtcttagtttgaaggcctgaaaatggtgggagctgccgtataactcctagtttaacaccgaagtctgagaatagggattggtgggggtagggcaggtcgctgttataatttttagagtccaaagctccaagaaccatgaactcttcatcgaagggtcgaagaaaatgaatgtcctagctccagaagaaagaatgaattagcccttcttccatctttttgttctatctgggccctcagtggattggatgatggctgtccacgttggtacaggcagattttctttactcagtccaaagctaatctcttccataaatacccccatagacatatccagatataatgatttaccagctatctggatatcccttaatctagtcaaactgacacataaaattcaccaccacatgatacaaagaaaagtcagcagcctgtgactcagaagaggaacctcattagaacctgaccatgctggtactctgttctcagccttccagtctctagaactgtgagaaataaatgtttgttgcttaagccacccagtctgtagtattttgttatgaaagcctgagcagactaagatgcaaactaggcctcaaaacagactttttttttggttagaccttttctaaccaaaacttattccttgttgaaaaatgtgcctcttggcctaaccctctttgcatccatggggtggatgcaaatcatacttgatcatagtgaataatcattttaatgtactatttaattcagtttggtaatgttttgttgagattttttacatctgtattcatcaaggatattgttctgtgttttccttttttgtagtgttcttgcctgactttgatatcagagtaatgctggccttgtaaaaatgaatttggaagtattctctctttttcaatttttctggaagaatttgagctcactttgaacttggggagataggcagtgaatatttgaaagtttttaagtcattttttctttctttctgtttttttccaagacggagtctcactctgttgcgcaggctggagtgcagtggtatgatctccatggccacctccgcctccctggttcaagcgattctcgtgccttggccttccaattagctgggactacaggcatgcgccaccatgcccagctaatttttgtattttttgtacagacggggtttcaccatgttggcaaagctgttgttgaactcctggcctcaggcaatacacctgccttgtcctcccaaagtgctggggttacaggcgtgaaccacccagcctggcctataagtcacttttaaagtctctggtctagaagactcaggagtgcagggctcagtctacacccagagctgtctgatttagtagccagtccctcaggtgaaggatgtaaacgttggggtgcttgatgtgtgcagaaactgcttccagggagaatgtacagatctagatttattgctggaacaagccgtggaagaaggtgcagggagtgcctactctctcgttctagaaagcagaacttttacaccctgttagcagggacagacttacaatgtggagttaacactgaagcaagctagggaggaaggcatagggagtgttcactctcctgttcaagcaagcaaagtctcatacccttcttgcaaggggaggcttcttttctggaattatggctgaagcaagctgtgaaagaagatgcagggagtgcccctctccttttcaggcacagagaggtcccccaacctccccctagtgaaagattgcagaaatttatctcatctcatatccagagcaagccaggaagacagtgggggaagtaccatccagtctactcttattgacagagaccttcaacctctttccatgaagagatgacaaagctgggattgtcacaggagcaagccagggaagaaggaatgggtagtatggtcccgcctatttaggctccaggaggctaattcgttattttccatgtagactcccagatgctggctcgtcagaggccagaactacaggaaactgctggaaaagcttgcagccaaacctttcctgtaagttggagactaggctgatcctgggagctacagctgctgggaatgctcccatggttccaacgtcctctttgttttttgtgcttgggggaaatcctctgatgctgtgttcctgctgttcctcacctgggtgttttaagagccaagctctccagtagagtctggaaaagttgggaactatatgtgtataagagtagccccttactcttcaggaaaaagataggagctgggtttgcttcctggtgatgaggcgctgtgctcagggtggggttagtgtctgagtgcatctccaattttcctacccgttttgatgtaggtgttttctaggttgtttgttgtgtaggaggatttcagttggtttctagctttctcttggagaaactgatctactattttttatctaggacagtagttaccacgtttacttggtgtgtctgtgataaaaggaagaggcaggagcctcctactctgccatattctcacatcaccccagaaaaatggtaatttaaaaattcctgctgcttggagatcgagaccatcctgactaacacggtgaaaccccgtctgtactaaaaatacaaaaaaattagccgggcatggtggtgggcccctgtagtcccagctactggggaggctgaggcaggagaatggcgtgaacccgggaggtggagctagcagtgagccgagattgcaccactgcactccagcctgggtgacagagcaagactctgtctcaaaaaaaaaaaaaaaaaaaatcctgctgattgataatccttccttggggcaggggagatgacgggcaggatttatgtcctcttccacctctctgtctatatgacacataaatatctcaggatctttatctgcaagtggatctaataagagtacctaactcagaatgtgaagaataaatattatacatgaagtacttagcccaacattcagcatacagatgttcattcctatatttatgggttgtctaggtatgcttaggctgctctaacaaattactatggaatgagtggcctaagtaacaaacctttatttcccacagtttgggaagctgagaagtccaacatgaaagtccccgcagatctggtctagtgaagggcctattacaagttcatagacaaccatcttccctctgtgtcctcacacgtatgaaggactgagaggctctctggagtctcctttataaaggcactactcccattcatgaggatttcaccatcatgacctgatcacctcccaaagatccacttcctgatgccatcaaattagaggttaggatttcaacgtatgaatttggaagggacacaaatatttaatctgtcacatgacccattataacttaaatgtatgactgctagtgcctccacagtgtatgagtagttttgttttctttttttttttccttttttggggggcattgggggacagagtctcattctgttgcccagactggagtgcagtgacacaattttggctcagtgaacttctgccttccaggctcaagctttgcttatgcctcagcctcttgagtagctgagattacaggagtgcaccaccacaaccagctaattgttgtatttttagtagagacaaggttttgccatgttggccagactggtcttgaactcctggcctcaagtgatctgcctgccttggcctcccaaagtgctggaattacaggtgtgagccaccatgccaagcttagtagttttgttttctataacaaattttttaagttgaaactagcccaacgccttgtggggatcaatgctggttactaaatgcacatgataccaaaagttgatatgtatgtttgagtatgacagatagtcggttcgaatttcagaatactttagtgtttcatccaaggaagcaaactttgggatatgtaagaatggtgcttggacttcattgatcttattacttctgcccagagtcttctgccttctttccttagcttgtttcatttggcctctctttttatggctaactccttcatgaagctttctcttttccaacccacattaatatctctcaacacttatgcacttgaaaatctgaccataaggtctgtttttaaatttttttttctaagactttacatgtacagttgtcccttggcatctgtgggagattggttccaggaccctcataaatacaaaatctataaatgctcaagtcccttatataaaatggtatagtatttgcgtataaccttcatatatcctcctgcatagtttaaatcatttctagataggttataatacataatacaatgtaaatgctataaaaataattgtcatactatcttctttatggaataatggcaagaaaaagtctgtgcgcattcaatacagatgcaaccatatttttttttctattttcaatccacagttgattgcacccatagatgtggaagccatggataaggagggccaactacacttattgtatctttccaattagattttaagctgccttaaggcaaggatcatattcaatctatttttttatctaggacagtagttagcacattgctgagttcacaagaggctttgagaaaaagactggttgattggctcactaattaagtcacattgaatttttaaatttgtagttcaatttactagtttatttgtagtctggcactcaaatcagtagttttctttttcagtattacaccactggcctttaaagcatgacaattatgttatagaatgtcagctatggtgtggaatctctgaattgtttattgggatgaaagagtaaacaaagccaacgacttcctttaattagaaggcttttgaaattacagtgcatgaattgccaggttgcccttaagaaatactggatttttttgccatttaaatgctccaaaaccaatacttcattagacttactgtcacttccatgtgtctgtttacactgaaaagtacaatgatagcaccagtgacctgaaataattgccatgtaagtttgattctgatgaaagttcaatttttgctgagagatgcctggagctcaactcactgcactgacagcagcctgtaagtttctctctttttctgaccttgtaaagagggagcaggagcagttcaggaagacagacctgtgaattccctcccttcctcctcactgcttccctcaggcgtgaagcaacagttctggcttcagaatgaaatgaatcattattctacttttcgtgataaggtatgggatgccgatgagcaatctgctgccgatgggcagctagccatggcaggtcagagagcaggcctgcggagactgcccttccgtggagccacgcagaagaggccatccctggactttacaagcagaaaataactactgaactagaaatcgctcaaaaaattcaaacgcccaagtaatgactattgaacacaagaaacacataacaggagaaatgagaaagaattgtaaaaatgtagacatgaaatggtttctctttagcaaggcttcttaactattttctgccctgaagctctttgcaactgagtctttattgagtatgatttatttatttgtttaccccttcagcaggccagccctaggcaaaactcctaaagtagaaataatcgcctcctatgtcctccccagaacctctatctggtctcatattaagcttcctccatgacctcttgttgtccactggataaccaaaccctgcatagggattttccacagatgttctagggggtctcatgccctcagtctttgctacctcctgaccccttccaagcagggcaatccccttcccttgcctgaattacttaagtaattcccttgcctgaattacttaagactcgcccaattgctactaacagaaaaattcatgagctagctaacccaaaaggagaatttatcgtaaggatgcaggggtgtttcatgcacttcaagggctagaggctgctaggcttcaaacacagactggaattacagatgatcagaacctctctcacgcttctttgctgcttctcaacggattttgagtttcagttttttctctctttgactctaagaaatgccttccattctgtggggttcatgtggcaaacaaacaaataaacaataaggcaaaacatgtgaaacaaaaagcaaataagcatgactcacagcaaaagtccacacgacacagccagcaatctggagcaagatttgcttatgtgaaatttcagctttatgggaaaaagttgtatggactagctttaacaacatggataacccaacccaactaatgtaaacacagctgcctgccaccctgtgaccacgtggaagggaagaagcagttcctagaaaatgggggcaaaaagccagtaggtgtccacttttctaccatcgtcttcaaagacaccatgcagtttctcttccccaggcatgaactctatgagctcacagctgcttcactcctgttaacaaaccatatctcagaagaaaaattggaaaattctcctaaactgagaattagaatggtggaagaggaaattaaagttcctcaaatcacagcaagaagctggagagttaatctgatgaccctgaacttagcttgttctacatgtgatgaaattgattttaagtaataaacttccacaaagtcattattgtcctctccttggtgaaagctggttgttagtgtccccagttatagcaccacaagttgttttcctttttcctggaactctgttgcttgctttagtaaatgttttatttatacttttaaaagtatacatatttactttattgtttgcagtatttttataaacacacacagtatatatctatgtctatctctttaggtgttaaaacaggtttgttgtttaaatctgtatgtttactatcttttgtgtatgcttgatttatcagtttctgacactatcattgtgaacttgtcaattgctttgtcaaattctgctggattctgcttccctttcatgcgtgctctctctctctcctctcatctttgtatattaggctacattgttagaaataagctcatgattatctgtgccttttgaatattttcttttgttcatatgtagtatgtgcttttatgccagttgatgctttttgcttaaattctgtatttactgagtttcacactgctacatcttaagggtcattgtcatagttactagtatttgcctagtaaatctttttaattacctttaatattttcatgtaattttgtttttagataaatattttctaagcagtaagtgtggaatgatatctcatttatttgtccattctcataatctctcattttaaatgtgagcctaatccaattattcattgtcattatggctgtattttcactaattctaaatagtttattcaatacattcagtttcctatccttttatagtcaatagttagtttaattttgtatgttccttctttttgtcttacagtccatcttttcctctgtgtctgtttttcatctcggtaaattcaccttttaatttattattattattttttttggtaagtatctgtagggaagactaccttagttattttctgagggtgtctttatttggcctttattctaataacagtttagcttggtagaaatgtcttggttttcttggcagtaggaaaacatctttttcttctaaggtcacttgttgcacgtgaaagaatctgctctccatccgattggtattcctttgtaaatagttggctctttccatctaagagctttatttatttatgtttgtttgcttatttatttatttaatcctaaaagtcattctgatatgtttacatgcagcattcacctaatgcttgaaaagcacttttcaatttaagaacatacccattttgaaaattttcaactattattcagatagtttatctgccattgcctccatcatcttcagtgagaactcactgttttatctctgaaaaacccctcaaactaataattgtgtcctttatctgacttttagtataactttaaagattaaatcgttgggtgctgcactctgaatttatattgcagggctatattctagtatactaattttctcattcgctcggtttaactagactttacccatattttttccccttttatttaatgattgtatttttcgttttcaaaatatgtaattgcatatgttcatagtcagttactcttgttttatttctgcttgctattgttttgtaaacttgctcttttttaatggaaagtattccttcatctatcacatcaaacttcttaaacatacttttacataatctttgtcagactcatccatggaattaatttcatttgaaatgaatggtaaggcaagaattatgtctatccatacattcctaatgtgtagcacatatttgacactaagtagagattcagaaaaatgtttaatgaatgaatatgtcagtgttcactttttgtataatcagagatatttaatggtcatctagagtttagaggttatatgtagttcactactactcttgtccaatgatgagagaactgaaactcagaaaaatattatcacttctctaattaaacaaacactcctttggaaaccaccagtggacctcaggttgcataatatctctcctgctgccttcattctattccatctcaaaatactctctcttttttttttcattcagtcatttacttattcattcatacatgtatgctctcacttaattttaggattttccttttgcatgtatacaagttaatcaaattaatcctcaggaataaatttttcactcaggatggtattttataacgtgcaataaattcagacaatgtttgtattactataaataaaaacctcgttaaaaacaagtaagaagaattttattacattttagttaatttatttaacaaatatttttaatagtgattaaagaaaggaaatggcaagatccattatagatttttaagccatgttgtaatcaaccttaaatatatattttttgtttgttcatttgtttgtttgtttggagacagagtctcgctttgttgcccaggctggagtgcagtggcgtgatctcgtctcactgcaacctccgcctcctgggttcaagcaattctcctgcctcagcctcccgagtagctgggactacaagtgtatgccgctatgcccagctaattttttgtattttagtagagatggggtttcactgtgttgcccaggctggtctcgaactcctgagctcaggcaatctgcccacctcggcctcccaaagtgctaggattataggcgtgagccaccacgcccagccaaagatgtatttaaacaccaaagttttaaaatatttatgcattaaatatgcttagtgtcttctgtagcagaaaggatgtggattttacattttgatttctaagcaaattaatgatgtagccataaagcatagcaggatatagtgggctataaagaaaccaatttaagtaatttgtgcaaatactttaaagttttatgaattaaatttcaaacaaattctctatgacaaggcaacttcctcatagagcacagctctagtcattttgatgtacagataggaaattaaaaaattcaaattaagaaattaagtctcatgggtctacatcagctgatttgtaatttgctttatctttaaaaacagttttcttgaatttaatatgccagcagttataaagctatctttctctctgctatctactgataattttgcgtatctgtaatgatctatgttctttttattttaaggaaatatagttcaccaggatggttgagaacaaaagtattgtggtgaaacaaacctaggttttaaccccactgtagccatgtactactatgcaatagcatgcaagttacatcacctctgtaagactcagttaacaggtctgcgaaactgggataagaatatacagacagttcctgacttacaatgatttgaattatgattttttgactgtacaatggtgagaaagtatggtttcagtagaaactgtacttcaagtactcatacaattattcggtttttcactttcattataatatttaataaattacatgagatattcaacactttattataaaataggctttgtgttagatgattttgcccaactgcaggctaatgtaagttttctgagcacatttaaggtaggctaggctaaactatggtgtttggtaggttaggtgtattaactgcatttctgcttaaaatatccccttttcaacttatcatgggcttatcaggacataaacttgtaaatggaggagcatctgtatatgccacagttttcctctgaaaagaaaatgagataatgtgttataaactatttagtactcagtaaatgttacacagttcttactagagttatttccatttttacatacacacatatacacacacacacctccctctgtcagccagtatttctaaaatatttctactgttattattgatcatttaaagtactttttactgattcattaaaaatctccccagtggggaactgtgcaatattttagggtggtagtctctatattattgaagttaaaatattgagtgttttggtcagataagcaagggtgagacacaaaatagcatgagcagctaacttctctaaactccagtttccccattcatacaacaaaaaggataatagcactatataagttgctgagcgtataatttatatagagggttagtccattgtatggaacatattaagtactcagttaatataacctataattatggccataataataaaatacaatttggagcatgtacacagaaagacagatttgaggaaaagtatgtgctttccttggtgttagagcattggcaaatgtctttaatactgtgacattcaactgtgaaaaccaattattacacaattagaagcatcctcaattagggaaagattaggtcatgtttttaaaacacccaccaatattttctgtcaatcccatctgtgacacgaataagagagaccccagttagcagttgtttaaatcattttcctaatgctggcatccgtctccttggagacatccatcagagacttgtgttaacatctttcaagttgcatctggataggaccagtatgtgatcagtgtattggtacatttcactgacagacaatacaacatttgctttcattctatctttaaacttgtttgtaatatataaatacttcataatatatatgcctatttttattggtgtaaccataaggacacagcatgttgattatcaaaagaaactaccatatatttagcaacttatcttctggatgtaagaaatttatttaaaaattaaattttagtacatgaaactggctatgaatttcaaaaagtaagggaaatagataaatgctataatgtacatttaaggtaaaaggaaaatgggatgctatcaaaaatctttattatctatatttttatatctgtttataatttaaatatgttgcattttacaactataccattcattctgagctaaataaaactggaatttaagaagacaaaatactctagaaatgcttgttatctcttaggatcaaggaagagaaagtctggtgatgggtgggaggaaaacataaaaaataaaatacttaacactgacatccaattctgtagttttaatgtaaattatttcattctttgaatattttgtatttttagcctcaactaaataaacagattcgaataggtgtcttggacaactgctaagtgggcagttgtctagagccaagacacataggcagaaacagagaagaaagactaactcagatcttctgattacaagcactgtttgaagacctccacaactgcctaggaaaaattaaaaagaacaaggtacagctttaagtttaggttaggtaaagacatttctcttaaaatcctcaaagccataacaacactgatggtctaaaatgctaaaggcaggagatgagattggatgatctttaaaggctctttacagacccaagattccatatagcacctgttggcttcagaattgtttatcataagctcatggtcatcaatataatgcaatagttactaaaatttgcacgttcagtaatgaataaactaaataaaaacctggttagaaaaagataatattcataacatttcgaacattaaaagaatgaaaagaagaattaacaaataaggaaaaatttgtgttcaccaaacattttgatgaatagatagtctgaatttctaaatacaatactactagattggtcccctttctgtaagtatttcacagcacttgataaacattaaattagagctttgttcagcatggctgcttggtgaatattaaataataaaaaaaatcaaaacaccactatgaagtcgaagggaatattccttttttctggatattttccttcatgtttacaactttaataaaatttaagtggtatatgctatgcctaccaactgcttaaaaattaaaaaatgtggttgatgttttgtcatcttaatcaaaatttgcattccagtttccttgggaaactccacatgctgttatacaactaatccttccactacctagccaaataattaatacctttacaagcacatcataaaatatagattagtaaataactcattatacacttaatttcgatactaattgcctacaggcttaatgagctcttcattgtaataagaaaactgatgtttatttttattagatataacttctaaacaaaacacactgtatcaatctatgacccaatttgatgtttaattcttacggggaaaatcttaccattgactagtgttaaaagatttaaattattattgtataataaggtgttaaattagaaattttgactgacacaccacaacacaaaagatgatgaattctaaaatggtgcaagattaaatttacacacacacaaaaaaagcagggtaaaactagttcagcttaagtggataagagaatatgattgtgggagctgagaagagaaagtgaaggagatataagtggaaaaccacagacaggagtagagtgggttgtggcatcctccaaaacgagaagggccttcagctgggccactttgaaaacctgaactatgagctctgagatcactggccacaatgggctaatatctgacttgcctataagtataaaaggtagggacaagccaggtagtgcagaccaggtaatgagagaagttactattacatttgaatcagcctgtttcccactgtttgtcaggacaaaacttgttcatcaaggagcagatgcaggctatccctgagagagctatccaaagatcatgttagaatctgtcaaataatgcctcctaaaggttaatagttctcggtagagaagaaactacatgtaggccattaggtttctgagatgaagtggagttcatttgctctagtcaagtgaactttcttgtgagagacccagcagggactgggatccctgaagaaccttcagggagccaatcagctccaaatacctgtcaggcttggagagcaggagccaaccagggacattacagtcgagaaggaaattttcagcctcccaacttcttttccctccacccccacctcccaactagatctccaaccacagaagcctcagaactctttgcaagatggaggagaaggagctgtggaatactggccttcagctctccaccttaccagcataggtcctcccctttagcaggtacagctgtagaaactggaagcaacagcaattttggataaatgtggagcttttgaaaatgacatgaaactaggccttctagttatagaattaaatttgtgttttaccacttagagtgagcttttcagaggttaacaaagagcagaaatgtcacagaatagcctaggttctaaactaggggcaaggaatgtttcccgaacctcaatgcatttgaagtgacactgggaggaaaaaaaaaaagatgatgtctgattaaatacaatgagttctgtctgttcaacataatagttagacatgtttttaaattttaaaaattggtattgataatttgaaatgccccaaaacttgagatccctagcttttaaattaaggaaaatgaggcaatagacctaactttttaaaaaatgcactttaaattttagaacttccccggaaaatttttttggggatctctagatgaaggtaaatataatttgatgataaaaagtcacatgggcagatccttctaaatttgtaaatggcaaatcaagcaaattatggaagaatcaatgattcttctctgggcagtgacctaaaactcttctctgggcgatgccttaaaactcttttcttattaggaaaccgtaaggcctcacttcatttaaagggagagggaaagtattcaaattttacctcaactgaattgcctccagagatctgggattgaattctattcactaaggcacattttgtgcagaattgcttcaatgcctgccctgaaaatagcttaattttaagtcatttgctctttaaatggaagctggaagctttttgacttgaaaataatatcaaacacgtagaaaggagagctagtttcctgattagaaacaatgaaaaaaatcatttgagactgtctcccttttctccctattaaaactataataatccctttgcccataaagacaagccatagatcaaatccagacaagagataagtcattggcaaggtagcatcaaaaacattttggtaacatagctagtttatattaaccaaatcttatggtgagaatctttggatgactatgacaatttacagcataggttattttgtcccttctaagtgtttattatttgaccaacataatcttaaatcaacttatgtatctttttctccattttccaagtttaaaataaataatgcagaaagaatatatgtctaggaatatatatatatgtatgtaatatatatataatatttattattgtagcttattccttgcctttgtgtgcacccatgaaatgctaactactttacttgatgacaccgatatagttgtttatgtgcagtgtactaaatgatggtaatataattggtaaaattggctttcacttacccacaatgcaactacaaaatgaaatgacacaaacattagtctcaggaattctgccatgaaatctgattatttgattctgtgttagtgacagatactgtatactctaatgacacattagaagtaagtagcaacattcagagactgctgtctctgcttcaacttttttaatgttttattttgaacaagctctcctagaaaaaaaaaaaacagtgaagaaaaacaccagttttgtttccgtatttctttttaatcctaatttatggttaaagttccgatgttgttatcgacaaaaaataatatatggactaatgtgcaagttatattgttaacctcacgtacatttctgatttactgtgccaagaatctagaacttaatagaagcaatgttaatagaacaggagtggaggggcataccctgtggctttattagtttcttaatttcctttagttcccagatatggtccctcagttcccaaacatggaaagcagttgctggtgacatgctccatgcagatattgtccacccagagttagaaaaactgctgagtacttgttgaataattgctctttatacgtcatcaaaaaggacatgtcctcaaagttagtgctcaagtgtccttgaacataaacctctgggattcattcacctcctgcttcagagatgcttagcatggtgcctgaaatattatctatccatatattacatatataagatataatattatctattaagatagatagatagagataaaaatagatttatatatatatatctcccctacctcatcgaatatatactgagcctgtctttgtttattgaatttgttgggacactacaaaggtacatcaaaagtagatatgcttccccctcaagaaattttataaagtcttaggagaaagtggaaggacttattataactcaagaaatcaagtcatccacaagcaggaaatatttaaactgggttttagagaagtaatgcttttggttgtgaaagtaggcacggacattggaagtgatagtgaataggagaagaacatctcaggcagagagataaacagagagaaagcagatggcccattacaaaagtgtctgaaaacatgttctcagcatcacagtcctgatacgttgagcactaaagtttctgaatgtgaagtgcacagtcaacctttcctttcctaatgggcaagtcaggtaaactcagtacacagaatagctgaatataaatgaatctctggcaagttatagaactactataaatgaacatcaaggttttttttttcacatttcctttggacacatattaaacagttccttttggaattaattatgtaaagaaaaaagtattttcttttacattttaaagacaaagtgagaaacggttattcattgcaaatggtgttagagaaaattaaatgtctaaaatgcatttgcacaaggatgctataaactgttaaaatatcaccaggttttttttttagcctttgctaaaattcttgatttattagcagttcaagtaaaatagaaagagcattctattgttttttgatggaactaaataatcaccacaaactaattgaatgatatgaagtattcagggtctctaaattatgttttactgtaacattttaaatatgtaataacattaacaagacttgaccattcaattataaatacatacagaaattactttaaagtctagaacattacaaaacaattatcctttacatttgttcagccagcagcttaaaagcaaacctatttggaacagctggagcctaaaactgacatttgaaatcacagaggcagtgttttaaaaactgtacttaaagaagccccagttttatactatttcttcatcaactaccctgtttaatgtttttgtctcctgaaaatgtgggtcagaatttttctttaagaattaaataaggggccaaggtcaatctgggtgattaatttcagatagtaggagtagtgtaatatatctgaagcatttgttcctattttttcctgtttatggtgccaccagtccaattctaacactattgcctaaactaattgcttcttattcctcttccccccaccaccctacacacacgtcaatacaagcaaatttgtagccattcaggtcagtgcaaaataatgaattttgtttcaatactgtcatacatctgtttctaatatgtctcggattcagtattattgttgtgtgaaatttgcagtaaaatcttaaaatggaacctccttgcctgggatatgaaccgtgtagtatttcttttctcttatgaaagcagaaggtgttaatatattgccacaattcttaagcaaaactcaccaaggaattgatctagtccagtctgtagtatatctgtaaatcatcacttgaggaataaagtataaataatctcatccttgaaataaaaattcatttgttaaggaattctactaacttatgcttttagtatgtgtggcttcctaaatatattagctaggaaaatgtttctttgaattttaaatatagtaacaggaagaaataacataatttaccatttgaaagtcttaattggaatgggcagataacataattaagattttgcaatggcatataaaattcttagtggatcaaatcacccttttcaccaaaagggaagcgtggtgcatgatattccagtgatatagccagaaaacccagatgctcctctgtccttatccagcactcattgcgaaggagaaaactaggatccttcaggcaagcgaagagtgttaccttcagagagggaagaggaaaggtcttcacaggtgaagcttgtgtacaccttttaaaacaagagtagtggataattaaatggagagattacagagaaaagaagacagtcaaggactaaattttgaaacttctgaatttacagagaaggaaaaaatgcattctaggagatggggaaggagcacacagtaaatcacatagaaaatcaggaatgtgtggtgattaaggaagccgagagaagataatgtttcatggaagagggagttactgactttgtaaagtacactgagaggtggaggtagattaggacaaagaaggaaccatccattttgccaacatgaaactgaaactgattggtgacagtttttgagaaagagtagaaactaaagcctaactaaagtggtgtggaaaatggaaggtgaggagctggagtcagaaaccacagacaactcttttgagaaactttgatgcatggtagctagaaggagaaatgaggtcaaaggtggcttttaaggccaggcgcgatggctcacacctgtaatcccagcactttgggaggccgaggcaggtggatcatgaggtcaggagttcaaggccagcctgaccaacatagtaaaaccccgtctctactaaaaatacaaaataaattagccaggtgtggtggcctgtgcctgtaatcccagctactcaggaggctgaggcaggagaattgcttgaacccgggatgcggaggttgcagtgagcggagactgtaccactgcactccagcctgggtgacagagtgagactccatctcaaaataaataaataagtaaatagtggctttttaatttttttgaggtaattttaggtttttcaaagaatcacagaaatagtacagagttcccatattccttttgcccatcttccccttatgttaatatcttacttaactatagagcatttatcaaaactaaaaatcaacctttgtacaacactattaaatagagcacagaacttattcagtgttttcactactgcatttttccttgtcccaggatcccacatctcgtttagttgtcatgatgccttctctcctcgaatctgagacaggttttcagtctttccttgcttttcaagactttgaacgtttgaagaatacaagtcagttattttgcagaatgctccttggattgggttagtctgatgttttttcatggctagacagagggtatatgttattgaaaaggatatcacagaagctatgtaccctacctcagtgcttcatatcagggggtatgtggcattgaaatgaattcttggtaatgttgaccatgattatttggttaaggtggtgtcttccatgagtctccgtggtagagttactgtttttcctattgtagttactaaccgttttggaggagatactttgagaccacgcaagtttctgctttctctttatgcttttgcccatgaagcttacctccattggtggatcttgtctggggcaaatatgactgtggcattctaatgctaatttctactttcctcttcattatacatttcttacttgaaagtaaagaagagatatcatttctctcctgtttatttagttagcaaataatttattcagttatttaattacctatttatatcagtaagaactccagggtatttcttggtattcttttgtttataatccaatactatctttatttattctcttgctcaggttgctttaactttggctattgggagctctttcaggtttcctcctatgaccttttcatatgccttcttttaatttttcttctttttgttttctattcttttttttcctgtgtatattcttgtatgtgtatacatttccttactttctggcaccacagatgctcatcttctatcttccctgacccagccctgggttcaaacagttctccaaagggccctggttacttttattggaaaatggtatttagaaactgccatctggcccctggtgtgctcgttactagggcagtgtcagtgcttccagccacaggggttgacttttaagatgaaaggtaaggattttgtatgatagtgatgaggatttcaaagagagtgaaaaattgactatgcaggaatagtgatgcttttaggaacacagttattgagaaggaagtggtaataggttccagggcacaagtggaggggctgtgctttgatagaaacttgagacactattcattgtaacagggaaaaagagagaacatggctcagattcaaatagattttgatttcggtagaaaatgaggaagtttctgtttgtttccctggtgttgttaatgagtgttagtcaagatattagctaagagtgaagggaataaaactgatggaagtttgaagatagagatgatattagagagtagaattcaacctaatagtagaattgcaaggctttatggattggcatttgggaaattcgggggtcataaatataaaatgtgacagcatgcttttctggtgcagatgtggagtaggcagatgtatttgaccaacctagaactgcagttttgccagctgactataattgagaagaaagtgagcaagagaaataaaagtatttgtcagtgttttagtgatgtaatggtgggccataaaattaaactggataagggaacacacaggggaaatggtgttagcattattagtctattgtcatagaaaaatataattgagtttggtttatggtttcaaattcatttatataacttagggatattgcaactgcagctgagaaatgtagagaacttgtagagcattattttgtgttcctttaaatcgagtccacaccagtggtgttgccatcttctctacgtttttcttccctgactttttcagttgacctcctacctcttatacatgtcttggtctctaataccctttttctctcatcgcccttcttttctaccaaatcccaatatttcaagaccacttctaaggtgggaacatctgataatttcttaagcagttaagcaagcaaaaaaaaaatgtcattactgcttttgtcagggaaaaggtgatttttaagcttaaggggtcaaagtgagcttccacaaggtcactaaaataacaaatttgagaatcactgacagcatcattgtcaatcttttatctgaaaacatttcctgtatcccaatcaaggtcagataaatgaagccagaaaagtaaaaataaaacctattctgtaggagactccattaacttatctgaaaacaaattgatgcagggatgtggtttaatttttcactggtcagagtcattactttgtgagacatgtttggtcacctttgatgtgtcagctaaatgactgtttctaaaattactttgaccattattcatgagagtgttagtaattactcagtggttaatgaagttggtttccagttgataatcgttagaaactgagcatgacccgttgcacaacagcatactgaacagaagtctcagatgtggcttccctctgcacggtggacttggttctgacctaaaagcactgataacagctctgaaaagagaacattttctaaacaagacattccttgacatgcagaaactctcatttcaatgacctactatgatactatgagtatcatcctcaagctctctctgtgctccaactaaattgtatacaaacatgagggtaattattagatttacatgtgcctctcaactaaattcaaagcctatggcagggatagaagatggcttgccttggaatcccaaagtctggccgatgctggacacagagcaggcactgaaatctgaatgaggcaggcaagcatctctctggcatccaaagtgagtgaagttggagcaatcttcagctcatatcctttataatccagtagctggtggccaactctgaccgtttctttcgccacatagactggtctatggagattcatggtgttttagatgtagaagagacatcgaagtccatctaatctggcatattctcttatataaaggaataaaaaaactctcccaaaaggttaaatgaatttcccaatattacacagctagtgtagccaagccaatgaagtcactgagttaaatatttaagcaggaaaaaatcttttcaatgtctgcttgttgaacagggggaacaaagctctcagaatcaatgtctaagggttaaaatattagcttgttgggaaaaataattaatcactcagttcccagtctacagagcagagcctgagtatctcagtcgttaaatttaaggataattggtctccaaactagtacacaactagtaattcaaaataatttaaaagaaatgctgctttggcaccattatttaaacacttttattttttgttgtcgtgtactccaaaccgctcaaataacaattatactttaacaggcaaacaaaaggtttttttaatccaatttttcctgtttcttgatttaaagggaaaaacaaaactttcctatggaatttgtttaaggagacagaaatgtctatacaattcttagtccttcttttgtgctcaaaaatgtttaatagcttgtggatgaaaaatttcaaaattggagttgcttgggtaaaatatttttatgtttagcaatgaatcgttattggaattcctcaaaacatttcagatttattgccacaacattagccaattttatattatggtagataaaagggacagaactagcatttattaaacatctactatgtgccaaacgtatacaggatttttattttttggtttttgtttttgagacagagtttcgctcttgttgctcaggctggagtgcaatggcacaatctcagctcactgcaacctccgcctcccaggttcaagcgattctcctgcctcagcctcccgagtagctgggattacaggcaggcgccaccacagccatgtaattttgtacttttagtagagatggggtttctccatgttggtcaggctggtctccaactcccgacctcagatgatccacctgcctcgacctcccaaagtgctggaattaaaggcatgagccaccacaccaggccacatatagaggttttcatatatttttctcacttggtcttcacagaaacccgaggaagtattggaacattaaccccatttttcagctatatttacatcagagaagtaacttgaaaaatgtcatacagcagcgtttaattgaatcctagtctgtccaactccaaagctttacctgcatttggtagaaataaatttagattcagcaaacattgttttcctgggggttgtttgaggaagggaacatatcttgacaggtgctttctataacattattttatttaatcacccgaagcccatcttctctttatcacacacttttaataagctgataatttttatgtgagtcttgagtatgcccttttacaacagaaaagtgggaagataagtgttcacctttatgccaataacaaaatgttattatcataaaccagaagcgttccccagaggcagtcagtcttagtatatagctacaaacagatatattagctcaactttaattcatgcaaaactaagattattgtctttgctaaactttcttcaaaattcagttggtcagttccaaataactctgtcaagcaagtgaattcattctctttcctggaggtacgtttcacagctaactattcttggcagacacactgagaatcaatgctgctttaaatcagacatttcgtagaagacttgctacagtttttctgctgccagtgtgggggactgttctcccggtgtgaaatgtttttaagccaaaaccttttctattgcattctgtggtataatgtgaagtttcagtaaaatgtttatcaaagagcctaaacatatctaaccttcttcctgcagaaggacccaaggttgcttctaagtagcctggctgcgtgcagcagcatagaagatgaaaagagcatttcttccaccggaaatgagaactactgtttagtcttcttgacttctctgagtccataatttatccacacaactcacatgttttaaggagatgaacatttattattttttataattgatcccaactttccttatgagtctcatcacaatgggaagttaatttaaaattgcaataaatggtgtcttgttttggttaaaaagctttggatttggtacaacttttgtcatttcaaaatttaaatcaggaccagcactttttcctttttgttctttcttcttccgagatgtttctgagcatcagggagggaaagtgtgaggttttcaggcatgccaacaagcccgtggggaatctggtttgacactggtctgtgagctacaaggctgaagtgtggcctttctgtgcaacctgctggcatctgctgctgaatccctccagctaatataacccagagcctcctctctgtcttcagggactttggccatcatctcttgtttcctgcactccagatgcccttgggtttgattcccactaggaccctcggacaactccagttaaaccttcagacccaagaccacttttctggcaggacctctagcatgtttcccagccagaatctcaacttctttctaggcccttcctgggctacatgggaatctctagattacttccatgctgggcacagtctgttggtgcaaggttatgccaggtggagtggcaattggtccctgatgccaagcagagaacatggcaaaagttcctctgctcccagctttccactgagcctatcaaacacctatcacatctggaatttgaagcatgaatgacagcctcctgactgtgtctcacaatccccagagctgaagaagttgactttatcccccgttccccaattcctctatgacaagaacttacaacattccctctaactatagcatacaataaaactctatgatatacttggcaaagtctcactcttagtatgaaaatagatgattaaaacaattagaatatcatgttcccttatgttccctttctctaaattatggatttgaaaactagatattcttgtgactcacgaatcctgttttgtatacccaactcttattaccctttctttgtttctcattgtacttctgcttcaagtatcccagtttttcaaaggcaaatggatgatcctgattgattagaagacaaatacagtaaaatacaaaaaatatatatggagatattcaagagattattacacttgcattatcaagatagccctatctaaccttatttccagattatatggacaaatatgctcttactagggtaacaaaaacttatcttctctttagctcatgtcaaaagcagactgagaaggaactctttatccaagttaagtgaaggttggtgtcaccacacctctagtctttatctaaagtgttaagtcatcaggaagttgaatcacacttagtttaacctttactgagttattgaaatggtgcccttggcttttatcaatagaaaagccacataaaaacttcttccaattctccttcaattattttgcccattatattatagagtttgctatgcaaaaaaaaaaaaaaaaaatgaagaatctgatagtaggaaaacatctgtagctttcaagaactcagcctacttttatcctactttctccttatcctgttagactgtataatttttcctatttccatttttgtcctgtcatttacatctttctttggaagatgtattcatattattctgtgtatatccttcttatccactgcaaactcttgacatatagatagggtgctgtggtttaaatgtctcttctacaactcatgttgaaatgtaattgccattgtgatggtattaagaagtggcacttttagaggtgattaggtcatgagggctttgacctcgtaaatggatcaatgttattatctcaggagtaggttggctatcacaggagtgggttcctgataaaaggataagttcagccctcatatgctctgtcttatgttcttgcttctcctttctgccttccaccattggatgatgctcactagatgctggcaccatgctctcagacttcccagcccctagaaacatgagccaactaaatctcttctattcataaatcacccagtattttgctaaagcagcagaaaacagactaagacagtagggtataattaatgtaaaattagtccccacaaaactgtatgagttagttattacatgttttacagctgataaaactgaaatttatgtggtttcatactttgttgaagtcctaaactagtcctataattggtgaggccagggtaagaatccaactttcagactaaatcaaatgctccttcagctccaccaagaacatttccattttaagacaaattaaatccctatttaatcaagtaaacattagctgtttaatttgtaatgtaaaaagtagtactgagaagtgattttgaaaataaagcattttatataatgtaaaactgtctaaaccaatgcattagttaataataagctttgataaacaccagaacaaaaattttgtcactattattttagatgtcaatgcaatgtgcctattattgaacacaaagatgcagaatatttgcatataacattaacataggcaaatattgatgattgttattatgatattatagattgtttctaaaaaataacggtgagaataattctattatggagaaatgcttctacttcttgactcatcaaacagtgtatagtgaaaatataatgttaacattgggaaatttcgtattcaaagtacaaaaaagtagagatttttctaaagatgacttgcctttccctaaaaaaaaactctttgagttacatgttgctttatagccctgcgctaaaaaggcacaattttcctctttcaaggtaatcctacttttccaattgtgtttgtggaaaatgctcccttttgattcaagtaactttgctgattaaggaaaacaaaacaaaaaaagtccctaaactactgtaactgagttttttttaacaaattagtactgtccctatagacaatacagaacctgaaaggaaaagaaagaggaattaagcataccagtgactgttccccacgttttcacagaattctgtttaatctgagtttttattatttactttgcttctcctttgagataatcctgccttatttgaggtcagacagaaagcataatttacgatgcctgactgctttaagaaaaccagaagcttcctacattgttctttcctgtacaattggcttaaagaagaggttttctggttagaaaggctttacttcatgttttactaacagcgcatcactttgacttaatactattaggtttctaaagtgactcattcagatgaaaaataaaggtgctgtgattttaaattatcatagaaatgtgagtttaaatattagtaattacctcaaacttgcacatgacctagtaacccatgtattacatgatatacaatgcattgctttttagatcaaacaaaagagagtgtgttatgttttgcactttaaaatccattaactgttctctctcaggagaatgtagactaaatctcaacctttctctctgcagtttatgatggtgatagcagctagatgggggaaaaacaataggtgatgaagttattttaaaaaggccagacagaatgctttttttccttgtatcaggtttcagtctccttcatgatttatgtgtagcatccatggtttctgtgaaggtattcaggacatcatgggcatcaaatacataattaagacataatggaaggtcttggattgaatgggtgaatgtgagccaaggcttgtggcaacatttatagattctaggttagtcagtctcacccccggactcttctttctactccattttttttcatcgttgttttccttttgaaaaagctaccttcagactttctaagtctctctttctataaaaccaggaagggtttactttgattgtaatttatgttgataaggtaacactcctggccatttgtatctttattcctttaaggtctatttttggaatgaaagcctgatctgcttttcaagatgccctaagagttggtgggcaggaaggagaaagaaacttttctttgcctcaataattatgccagacctcagctggatgtggtggctcaagcccgtaatcccagcactttgggaggccaaggcgggtggatcacttgaggtcagtagtttgagaccagcctggctaacatggtgaaaccccatttctactaaaaatacaaaaaattagccgggcatggtggtgtgtgcctgtaatcccagctacccgggaggctgaggcaggagaattgcttgaactggggaggtggaggttgcagtgagccaagatcataccattgcgctccagcttgggcaacaggagtgaaactccatctcaaacaaacaaacaaacaaacaaacaaaagaaatcatgctaggccttacactgagaggatggttctatttaatcatttaaggtacctaatggaaactggctcagaaagccagtgtataccaggtatagattcgttttcctgtttactcctcgtattctaatacatattttctgccttaataaatatttattggactgatatgaatcttgaagtagcaaggtggggtggaggatggttgaatacagcagtgtcaaagaataaaccaatacacgtttattctctgccttcatggataatatataaaatcctgtgcagaatagaatagataatggccaatataataagtgagaggaatggagactcaggggttttgagagtgtgtagcagggcttttagctgagttttgagtggacatacaagttgtctcaaagaagtgacgagctgaggctaagtgactcatttgtcatggatcaatgttcctagccttcagcgatagacgattccttaccgtctcaactacgcacttctcaacattatggctgaccctgctgggatagtcctgaggactgcttctatatatcccaactttcccttcattctagacaaggagatgaattgtactttcatgccacctcagagttaagttgggcaatgtgattctctttggctaacagaatgtaagagaaatgatatatatcatctctaggcagaacttttaataactggctaatgctctgtcacattttttcctccttctatcatgccacatagaggggatgccacgtcctgggtcatcctgggttctggtctgaggactacagaaagtggagcagagccccctcagctaggcaatgatagatgtggaaggcgagtaagaaataaaccatttttttttttttttttttttttttttgctttaagccatcaagatcatgagatggttcacttccacaagataacctagactattctgactgatgcatctgcccacacttcggcttatgttatctcacattcgccagcacaacgttaacacccagtcaaagcacctttaggtcaaaatatgagattagttcctgtatatggtattaaaatgtggcattatgtttttgaggtttgtattatttatcgacaaggaaatatatagcattgatatggcttggctgtgtccccacccaaatctcattttgacttgtagttcccataattcacacatctcatggaggaaccaggtgggaggtaattaaatcatgggggcagttacctccatgcttctctcatgatagtgagtcagttctcttgagatttgatggttttataagggacttttccccttttgcttggcacttctcctttctgccaccatgtgaagaaggactgtttgcttccccttctgccatgattgtaagtttcctgaggcctccccagccatgctgaactgtgagtcaattaaaactctttcctttataaattacacagcctcaggtatgtctttgttttgcagtgcaagaacgaactaatacaagcatcataattaaaagcatgtaatctttgccattctgggtttgaatcttggatcttctacttattacctatgtagccctagtaaagttatttaacttttctgtttctcactttcttcatctttcaaatgaatacaacgatgaggctaccctgtatgtatactataagaattaaatgagaacagtgcctggcacatagtaagcatgatataaagatgagcaattattatcataatcctaagattctatgtgaaaaaattcaccttcttagcgagttttgttgcttaccacattatatctcagaggaaaagttgaaataatctactttaaatattattttttgtttaaatcaaaacctgaaaaatgaccaagagtgagtttatcattactatagtgcccagatcatttgaaaactttcacctcctaaatgtgactttgcttcctggaagatgctgcagaggtaggcagatgattaaggcaccagacattctagtgaagcccagcaatcttctagacccagaggtgatagaaaagcaggaatttctgggcaggtcacctaggaaaagaggccaagtcctcagcagtgccctcatcagccctgatgtgagtcactgtcttgtttcagggcacagagcaacagtgatgtaaacagaatgattactgaggggaaaagtccgaagcaggagaagtgatgccactgtaggagaccttaggatcccagatgcctacaatacaaaaagccacatttcatccaaatctgtagctaaaataatcagttttaacacatttccttcaagcagtttcgtcaacatatctatacagtgtatataaatatcccacagccattcatcatctctttcccatgacatttgcaatctcgtgttttatgcagccagctattatgttaaacctggccaattttgcatttaggcagcattgtgaagtgtcatagcatttgatggaatggcaagattgtaaattgcaatctggtctgtgggaaaaaatattttaaaaacattaaatttgttttagttgcttagctttctccctccccaacccaccacctcaattcttcatataacaagacttaatgagaggaagatcgcagtgcttaagatgtattgttttctttccttttcttcttcttcttttttttcatctataactggaaaaagaagagtagcagattcaccttccaagctggggtggatgggagacagtctttgcataattccattgcattactttaatggtaaatatatcctaaaagaagaccagccttatactgtgttcggctgaaatagcccgttttgaaaatatactgggtggctcctttgcacttgtggactattaacagtgggaagatccatctgcagctgtcagctctctggatagcagtcaacaaatgcatggccatgaattctctacataagtcaaagcaatgcatatggtaccttacattcaagtgaactgacttcaatctgggcagatctcatattttatctctgtgctgttttagcgtctgtcattgtggagaaatttaccattaagatttaagtctccgaaatctggtgcctttgggagttttgtgaaagctcagttcatagtcatgtaaatgtgtagtgacttttcaagttacttttgagaatctaacaatcaacataaattcctttaaatttcaggacttgaaaattcatataatactgtggaataaatgctgtatatgctacgtcaccaaaaagagaaatttaccattgtaaaaagagtaaaaaggtttcttcctccacactagtgccattgagacaccatctcattcaaataaaaaaatgaagtgcaaattcaccagtatattcagactctcttagatcaacagacttggcctgcctgcaatagctaaggcatacatgtgaaactaattttttcctgtggtttagtttatttttcatagaagaaaataaacagatagtgtcaaatattgaaagctttatctggctagaacagaggttcttaaactttttgttctcaaaacttctttactgtcttgaaaattattaaggttctcaaagaattttggtttatgtttgttatatctattgattaccatattaaaaattaaaacttaaaatgttcaaaatttttatttatcaattcatttaagaacaaaaataaacctactacaagttactgtaagcaaaatattttcatgaaaaataactatttttccaaagcaaaaaacttccatggaaggagtgccatttgttttaccttttgcaagtctccttactctgatttaatagaagatagctcatttgaatatctacttgtgcattcaacctgttgtaatatcatatgccatatagcttcggaaaatgccgctgtatactcaaggagaaaacaggaaaaggaaaatgaaatgttagtattttttgtttcttttttttttttttttttgagacagagtctcacactgccaccctggctggactgcaatggcgcgatctcagctcactgcaaaatccgcctcctaggttcaagcgattctcctgcctcagcctcccgagtagctgggattaagacgctctctaccatgcccggctaatttttttgtatttttagtagagacggggtttcactgtgttggccaggctggtctcaaactcctgaccttgtaatctgccccccttggcctcccaatgtgctgggattacaggcgtgagccactgcgcccggccaaaaatagttttgcatagagttactggcttacactttgagacttctgaactcaactctgtacagatttccaaaaagatctgaatacctggataatttttgaacattagtattattttgattagttgtaaactgagacctaaaacaatcgtagcactaatcaaatactttcaaatattttatttctaattaatttatagtttaaataaatttgcattcaaatgtccgctgctactgtcagtttacctttgcttctttgcgcctcttctcagattgctttcttttggttcaggctctccttttgtactttccaggacaaccctgctatttccatgtccacagggtctttcacaattaaatgcaatcaaggttgtgttccctgtaaaaccagggttcgtttgcctggaaagcagcaaacaactgtccatgagaatgcaggttttaattagtaggagtatttgattgtttgtttctgagatggagtctcactctgtcacccaggctagagtgcagtggtgcgattgcgatctcagctcactccaacctctgcctcccaggttcaagcaattctggattctcgcgcctcagcctccggagtagctgggagtatctccaaagtggtgtctccccgagggaaagtgacagtagggcttcactgggcaatgaagaggggacagggtgtatcatcacatgtagaggaggggtcccagtggcgggaatgcagcgagtcattatgccagcacataggtcgcatgttatggtaatgatgctatagtttctctcagggtggagactttagcatggtaattaggaaagatcactcagtttcatctataaagttcctagggtctgtcaggagctgcttcaaactaaaaaagtaaccacattccacactgggtttgaggaagtgaccggtgaagccagctggacttcctgggtggagtggggacttggagaacttttctgtctagctagaggattgtaaacacgccaatcagcgctctgtgtctagctaaaggattgtaaatgcaccaatcagcactctgtaaaaatgcagcaatcagcactctgtgtctagctaaaggattataaatgcaccaatcagcactctgtgtctagtaaaggattataaatgcaacagtcagcactctgtaaaatggaccaatcagcactctataaaatggaccaatcaatgctctgtataatggatcaatcagcgctctgtaaaatggaccaatcagttggacatgggtggggacaaataagagaataaaagctggccaacccccccctcccccaccagccagcaggagcaacctgctcgggtcccattacacggaagctttgctctttcactcttcacaataaatcttgctgctgcttactctttgtgtccttgccacttttaagagctgtaacactcaccgcgaaggtctgcagcttcattcttgaagtcagcaagaccaagaacccaccggagggaaccaatcctggacacagaagaacaggctgcagggcaggaggctgtaaaagaggatgattgcacaagttgattaaattcctataagccctggaaacactccctgtatgtttacagttgatgtgtttattatcagcaaaatagttgcagaaaggcaagacccgaatcatcttagagaatgattctctactttaaataaacgtaaggtaaatcagacctaaatatttccactccagttactgtttccccttccatttttttttcaggcttttattgtttaacaactaataaaaacttttcacatttcaccactcagttttatcagtgtatgttaaagcttctacctttcccatttttctaactgttgccattagagcaagagcaagagatttgtctgggattggggaggtggcggtgaggggaaaggggtgttgttgaactcagggagagtctcacagggcaatagaggtatcatagccaaggtcttaacccttaactttgcatatccagaaacttgattcttagtgctcaggcagaatgagcacaaactaattggaatgttttattctaacctccccaaagagattggacaacaaccacaatgtcagtgcattacattttacttggtaatatgacttccaaagagacttcaataatttcattaactggttggtacatttgctcaccttaatataattcatatgagagggcaaaatataatccaaacaaaggaaatcagtgggatggtctaaatagacattttatcagactattgtaatgtgatatgtcgattgccattctaaatagctattttatctcaatatggggttaagaccagttttccctggatagtgccagagacgtaatctcctccttttggattcactttccccctgattccgtgcgaaacaccacttagagttccttgattttataaagtggtttcatgcctctgcacctttacagatttaggcactgaccccggatgatttggccttgtgtgggctcttttaggtaaatttaagtaaccaataaagaaatctgaggtgagtgagacaggaaatcgttctaataatggctggatgcaggatttctatgcaagggtcttagaagcttcgatccaagggataagtccttcatatcttatttacagaaggatgggaagtgtttctaacatgttttagccaatcttgaatacatttaatttcactgagagcctctctttcacattcctcatgataaataaaaaccactaaattcaatactaaacgtagatttgctgtgctaagcagtagggcttatagctttgaccaagttacagataatggaagacttagtggccacctctggaatgaggcctttcacatgaaatgctaaccaccactggaaagagatttgcaccaattccgattacctccagaactgaaacttaagccaactggcaattactattactctgtctgtgttcaattattttaaagtcaactacagacatggcaaactaattttagtgttactttcctctaaaagcgttttcttatctttcttttagctccaccataccccaaccacaaaatctggtagagatattggtctacttcctgggagagaagtcagtatgggcctttatttgtcctcaccattccttgtgataatttttcatttgtttgtatctctgtctctctagttagctgtgagtagaggtgatgtcttattccacttcacattcaacggtgagtggcaggtagcaggggcccagaaaatgttggatacatgagtcagtgaatggattgccctgggtctcctcttttagattccatgaatgcttttttcctccttttgacacactgtttcctcagctacattaatacaattaattagcttacaccactgtttactaaaatgtttttctctgcaggatattaatgggcactatgcaataaaagattttggtactcaaaaagtctgtgaaatgctgagttaagcaaagtttcataagactctactgtggacttcttaattttaatatactaatatgcactttaaatattcaagaattaaactaagatgagctcctagggtgacataattgagtactaaaaaaaccttaatttagtatttcacacacacacacaaagatcttccaagaaatgtgtatactgtaacattcagaaagaaagaaatcagaggaggctagagagagaatgaaagagagaaagaaagaaaagagaatgtccataattaagtttgtaaaacactcatcaatgcagacatatgttctgaccacaaactcaaattgttctggcttcgatgtaaaccgcgcttattcaacctgttctttaaattctttagtacttttcagcctctgaccttttaacattttcccaattgaatgtctcttcttggggctcagattccattcatatcgcaaaaactcttgacagtatgctaagttattgtatcgtctggttctgttatcatacccttgctataaaattcaatcctggatgaaaccaataatgtgctttcacccttctacctacccagactgcttacaactatagtgtaaacggcacacaggacgcatgactattattctaaattcatgatcaccaataattgggctttcaactctgtccagtaattctactatgtatttctaatcatttcactctctattcatttcagttactatttcaaacaaacgatttccatttttaacctcctatctcccttatctgtgttcatcgcatttatcttgaatttacccatttgtatttagcagctctccgtctcctcaaccaaaatgtgagctccgtgagggtagggaccatctatattttctctcagcgtttctaacactcagcttttgccacaataatgctgcaaaaacaattaaccatagtgagatacaacaataagcatttagttctctcatgactggaagttggcaggagcagctctgctgatctcagtgaggatcactcatggtctgctggttgtctggatgttggtgatttagaccaagggtctgcaaaccttttggttttaattcagaaagtaaatatgttgggctttgcaggccatatgcagtctttgccgcatatacttctcttttttttaatttttaacaactcttttaaaacacaaaaacttagcttgtgagccatacaaaaacaatcacaagctggattttacccacagcccatagttggctatctcctgatctagcgtgtgttgactgggtccctctgcttcaagctgtgggtctaatcgagcttgactgttagatgcaggtgaggttctagtcatttgagctctggagccagggcaagctctactagtgacaatataaaaagcagaagagagcatatgatgcttatgtttcttaaggcttaggtttggaactgggtcactgacacttcagcccaccttttgttagccaaagcaagccaagtggctgaccccaaagcctcagtggagaggttcactttgccttttgtagaaagcacagaaagatacatagcaaaaagtatgaacatagtgaatagtaaagaattgaaaccaataattcaatctcccatatcattatatattgggtatttagacgagcaattagtgcccactaggcccttacaaatttaacaaatgaagggaggattactgcaataattacaaaattaacaacaggcgtgatatagagaacatgtactcagttccaggagccatgctaaacattttacatatatcatatttttcaattcttacatccgtttaggatggctaatattattttcatttatagatgaaaaaactgagtctcatataaggtaagtaacttccctggggtcaattaatattaagttagacctctttctttcactctccaatttctgggttcaggttattctagccattgatatactgaatttatcattgttaatacaagtcaagtttatcacttctagctggccaccatgaaatccatcagtatagctcattacaaatgtagggtggtcatctagtggtgaaagaggaattctataggctgtccactaaagaaaaagtcaataaaaatgaggaaaaaagactctggttcagcttttgttttccattattattgctagaaaagcactgtggcaaaaaaaaaaaaaaaaaaaaaaaaggaactgcctggaaaatctttattagaagaaactcatacatgtttaagcacttttaaagggtgaatatttctgaccaccatctgttaatctgttctgtcctccctttcctaacatttacacaatttcccatttttggctttattcccatctctattggttttggaatcctaaattaatcctgtcaatattgccctcactggcagtctagagtctcccacttatttgataatccatggcagttcctaccatactactcaaggtgacaaaacgttttgaataatttcaataaactgtatatgagaacacaagtaattcacactaacaagtcttaaattggccttctttcctgctttctatcttggaattcttttctcactaattccttgtaaaatatcctcctgttttatctcctgattgagatagatgccatctgatgccacctctcacagatttttttctacctaaaaaccagaagaaagttcttacttccctatttttccttatttttgcttaaattactttttttcttccctaacagcttataatgtgttctacttgcatcttctgtacaccctccacttttgatatggtttggctgtgtccccacccaaatctcacttagaattgtatctcccagaattcccagttgtgggagggacccagcgggaggtaattgaatcatggggactggtctttcccatgctattcccgtgaccgtgaataaggctcgtgagatctgatgggtttatcagaggtttctgcttttgcttcttcctcattctctcttgttgccaccatgtaagaagtacctttcaccctctgccatgattctgagacctccccagccatgtagaactgtgagtccaattaaatctctttttcttcccagtatcaggtatgtctttatcaacagcataaatatggactaatacagtaaattggtactgagagtagggtgttgctgaaaagataaatgaaaatatggaaacaactttggaactgggtaacaggcagaggttggaatagtttggaggactcagaagaagacaagaaaatgtgggaaggtttggaacttcctagagacttgttgaatggctttgcccaaaatgctgatagtgatatgaacagtaagttccaggctgaggtggtctcagatggagatgaggaactagttgggaactggagcgaaggtgactcttgttatattttagcaaagagacaggtggcaatttagcccctgccctagagatttgtggaactttgaacatgagagcgttgatttagggtacctggcagaagaaatttctaagcagcaaagcattcaaaagctgacttgggtgctgttaaaagtattccattttaaaagggaaacagagcataaaagttcagaaaatttgcaatctgaggatgcagtagtaaagaaaagcccattttttgaggagaaattcaagctggctgcagacatttgcttaagtagcaaggagcataatgttaatccccaagaccatggggaagatgtcaccaggccacgtcagagaccttcacagcaacccctcccatcacagtcctggaggcccaggaggaaaaaatagttttgtgggcttggccctgggtccctgcgctgtgtgcagccctgtgtctcatctgctccagccatggttgaaaggggccaatgtacagctcagactgtggctttagagggtggaagccccaggcattggcagcttctacgtggtgttgaacctgcaggtgcacagaagtcaataattgaggttcgagaaccttcgcctagatttcagaagatgagtggaaaagcctggatgcccaggcaaaagtttgctgcaggggcagggccctcatggagaacctctgctagggcagtatggaagggaaatgtggggttatggggttggagctcccatacagagtccctacttgggcactgtctattggaactgtgagaagagggccaccatcctccagaccccataatggtagctccactggcagcttgcatcatgctcctggaaaagctgcagacactcaacaccagcctgtgaaagcagccaggagggatgttataccctgcaaagccacagaggcagagctgcccaagaccatggaaatccacattttgcatcagtgtgacctggatgtgagacctggggtcaaaggacatcattttggagctttaaaatttgactggctcactggattttggacttgcatgggccctgtagcccctttgttttggccaattgcttccatctggaacagctgtatttacccaatacccgtaccgccattgtatctaggaagtaactagcattgcttttgattttacaggttcataggtggaagggatttgccttgtctcacatgagactttggactgtggacttttgggttagtgctgaaataagttaagactttgggggactgttgggaaggcatgactggttttaaaaagtgaggacatgagattcggaggggccaggcgtggaatgataaggtttgtctgtgtccccacccaaatctcaacttgaatttatctcccagaattcccacgtgttgtgggagggacccagaaggaggtaactgaatcatggcggcctgtctgtcccctgttttcatgatagtgagtaagtctcatgagatctgatggatttatcaggggtttctgcttttgcttcttcctcatactctcttgttgccaccatgtaagaagtgcctttcatcctgggccatgattctgatgcctcctcagccacgtggaactgtaagcccagttaaccctctttttcttcccagtcttgggtatgtctttatcagcagcacgaatacggactaatacaccttcctcacatatgcttaattttagccacgcctctccagctctagagatttccatcaacaattcatttttcttacattccattctctctcctttggcttcttttcttttgcctataaacattcaggtgtatttttaatctagaacaacataattcttcacctcatcactcccacaagctactgactcagaatttctcaatacacttctcaaaggcagatcatttatttcttattcctctcttcttctcccactcactctgcccttccaatttggcttttgtctctagcactctattttatctgttcttttgaaattgatcagtgactatcccatcaccaagtccagagacattttcggagtcctctacccagtggcatagattctaatctgggtctgaaagtctaacaaccaggccttaatatcccagttcatgccatcaagctgagagtgaattcatccttcctccatctttgttctatttaggctcttaacttattgaatgatgctcactcacattggggagggccacctgctacagtcagtccaccaattaaaatgctaatttcttccaatatcctcacagattcatccagaaataatgttcaaccagtatgtagacataccctgctccagtcaagttgatagttaacataaagttagccatcatactaaatgtactaaattatcgtgagaagaaatataatgaaccataactgagcaaaaacaaattagaaatttcctctcaataaatacttctcaaaaaatgttgaatcccagttaatctttccggtaaattatttattttcagagagcagcaaatactgatttcttttgcaacggtagagttcaagtatccaaaatgacaagggtggcgcacacaaaaaagagaagctgcctatcatatgaatagtcacacaaagatatctataaagtcttaccaaatgttatccaattatattagaaggagccataatttatcatgactgtatagagttcatcccagaaacataagtttagatcaatatcaagatattttataaaaagaggttaaattaaataattatatcaattaattccatataaatatttcatacaatttaattctcatttctccaaaaagttatatttgttattttatttatttatttatttttgagatggagtcttgctctgttgcccaagctggagtgctgggggtgatctctgctcactgcgtcctccgcctccccagttcaagcaattctcatgcctcagcctcccaagtagctgggattacaggcgcgtgacaccatgcccggctaatttttgtatttttagtagagatggggtttcactccgttggccaagctggtctcaaactcctgacctcaggtgatccgcccaccccggcctcccaaagtgctgggattacaagcgtgagccaccacgcccggccaaaaagttatttttgaactgtgaatagaaagcatattggttaagcccctgacagtggaacaccatacacaaaagcatgaagcagtacatttgcatgtgctttcactgttatacaatgttgtttggatgttcaggcagcagcatacgcctttccttcactacttcctattggggtggtggaaccgagagctagaagaccaggcaatcttactcaattatttcttccttattttacgcaccaagacctgctgattccctctctcctgatcttctcactattcacttctctcttttgcattcttgttgaactgttgagactaattcctcatatcttatctctttttctgggtattttaagtggtcttcttggtggtggagccttatctccatctaattattaaattcttcacaaattatttttctaaaatgcaaacctgctcataattttcttctcattttaaatctttttacagcctcacattaaattttttttaagatgcaatttaaggcagaataatgtagcgcagcccccactttcagatctgaagctgaagccaggcataatatgtaaagcacccagcatagtataacatggactacatatatatgaatgatgtatagcagactagtgatatatagaagatgttgcacttacgttaaaatctccttttaggtaaaatgcttcactcaaatcctctgagagtgcaactgactttattcagagtcaggctgcgtggaaaaaccacttgtgtattccagtttggataatcaagaaagaggcttatttgctctgctaacagaggcttttccactcatgtgcacttaaagctacaaaaggtagatataaccagaagcagttccttctgcttggataaaaattggaaaagctctgtgcattgacatgcacaatcttaggcattgggggcaatttttaaaaaaagaagtggaaaaagcaagtagcagatgttggactcgcagtggcatgtagtggaggcagctgcagggcaactgttttctatctggagagccctttggaagagcttttgaggttcttcaaatatttgattagaatttcatggatgccaatgctatatgagaaagcttaacattttagtgttctgcctaaagttttattgaaaataaaatcctgctaaggcaaacaaacagaaaaagttaaaaaaaaaaaaataccagtgaggttgggcacagtggctcacacctgtaatcccagctctttgggaggccaaggcaggctgatcacctgaggtcaggagtttgagaccagcctggccaacgtggcgaaaccctgtctctactaaaaatacaaaaattagctgggcatagtagtgcatggctgtaatcccagctactcataaagctgaggcagggagagtcacttaaacccgggatgcagaggttgcagtgagctgagatcgccccagtgcactccagcctgggcgacagagcaagactctgtctcaaaataaaaaacaaaaacaacaatgaacaaacaaacaaaaacaccagtgaaaatggcaaatctatggacttcagagtctgacagacctggtttaattccaggctccaattgcaagtgccatcttgggctacttaacgtttcattgcctgaattttctcatctataaaattgaacacttatccccactaatttttccaagtatacagaatgcctagtacctaggaaagggtgctagtcttttctctactcctcaactgttaccatcgtaaaacatgtaagatgtactgggttatacattcattcagaatatctctcaaaggcagaaggactagaattttttctgtgaggatgaacatatcagagtgccttgataccagtgtataaaaatctaccacaggtttatcttagagatacaagatttaaatgccaaaatatttctgtgtttaaatcacctgtagttaaatctcaaaattctttttctgaaaagaatcaaggaaagcaacttccttttgtaagctttttgtttaaaattggactcctaacctttaggggagatggtggcccttaatttatcctgtcctgcaggatttggagacctcctcagcactggcaaggtctgtcccctatccctttcattatatattctcttagctgtctgaaaatcctctatgtacaatgtatgttatttcaggtatggacaattgtcatactttggataaaataataaattaatcccagcagactgtcttctcttttataatgacatttataaattgctgcctcgttgcaacatttagaaacccacaatggtgcaagcctagttctcaagtcactccaaaggtgtttggccttctgaaacctccttacttttcattatgaagcttctttactttccattttcctttgagtcacaaatttctgccaccctgcttctgcatgaagtgtgtgctctgtctagtgacatagctctgctaacccttataagcaggcattttcagtcttgtgccaccaggcctgcatcctgtgccttctaccggggaattgcttaggccagtgaaaactgacttctaaggaaggttttttccttggctatattttttttcatggactcaagaaatgaagctccaggtgatgttttgaaagctagtactgcttctctcttaatctccttactttttcaatatctcaaagtgtggtccatgaacccctggaagtccctgagacctatttaggaggtctgtgaggttaaaaaatattttctttataatgttaagatgtgacttatctttttcacagtgttgacatgtgcattgaaagtgcaaaagcaatgatgagttaaagtgttgacaccttaacacaaatcaagacagtggcactaaactgaactgttgaggtagaaattgtgttctttaccaacatggattcacatgaaggaaaaagaaagccagttccacttaaaaataaccttaatcaagcattaaaaattactgattttattaaatttcaacccctaatgatacacatttttatgatttcgagtgacaaattgggaagtatgcataaagcatttctgttccatactgaagtatgatggttgtctgtaaagaaaacatttgtgtgattgaattgcaaactgaactagtaacttttttcatggaaagtggtatttaccttaaagaacaactgtcagataaactatggttttacagatttcaatatttggcagatttttttgtgaaaatggacaaatgcgcctgtcatttcaagcggtagaactcaaatttgatgccagtggtcacacttgaacttctaagcaaaagttagaattttggaaaagtcatgcgaaccacactgggctggacagcttacaaatatatgaagatattttatgtgattcttagcactattaagaatcgttttatattttataaagtagtggggcagcgtgttaacatttggaaaatctgcacagctcagtgaaccaatattttccaaatgagtaatacataatttcaaaatatcatgccttggcaaaacaattatgccagatagaccaataaatttcaatgtaaaaaaaaacaatgaaaagttcactgatagggttgtaaatattggcacgttccaaatactctttaagaaacgcacttgtagacttttgtatagtgtcaaaaaagatccatacctcaaactgtatacaaaaattaagttaaaatgaatcatagacctaaatgtaaacccaaagctataaaactgctagaacaaaacagagaagaaaacttcatgactctggttaggcaaagacctcttaaataagacaccaaaagcacaatccgtttgttaaaatgatacattgggatttgtaagaactgaaacctctgcttttttgaaacatgggtaaggaaatgaaagataaatattttcaaattatatacctgataatgggcttaccatcagactatatcaagtattttcaaaactcaaaggaaaaatattcagttaaaaaatgagcaagaaaggagatggagcaagatggctgaatagaagccttcaccagtcatcctccctgcaggaacaccaaattgaacaactatccacacacaaaaattaccttcataagaaccaaaatcaggtgagtgatcactgtacctggttttatgctcatattactgaaaaaggcaaggaagaggaaaggaaagacagtcttgaattgctgtcaccacccctcctgcaccccccagcagcagctgcatagtgtggagcaagaatctgtgtgcttgggggacagaaggcacagtgattgtgagattttccattagaacttggtgctgccctgtcacagtggaaaacaaccctggccagaactcagccagcactcacagaggaagcatttagaccagccctcaccagaaagaaattgcccttcccagacgtcagaacctgaattctggtaagcctcaccaatgcaagctaaagtgctcttggattctaaataaacttgaaaggcagtgtaggccacaaggactgcaattcctgggcaagttctggtgctgtgcttcgctcacagccagtggatttaggggtatgcaacctaatgagataatagctggggcagccaagggagtacttgcaccacccctcccaccacctcaggcagtgcagctcacagctctaggagagactctttccctctccttgaggagaggacaaggaaaagtaaagaggactttatcttgcaacttagataccacctcagccacagtaggacagagcaccaggcagaatcctgaggcccgcattccaggccgtaccttctagacaacatttctagacatgtactaggccagaagggaacctgctatcttgaagtaaagtacttagtcctggcaggattcatcagctgctgattaaagagcccttgggccctgaatagtcaacagtggtagccaggaagtactcaccatgggccttgggtaagactcagagacaagctggcttcaagcatgacctagcatattccaagccatagtggctacagggagagcaaccttctgcttgagaaaaggggagggaagagtgaaggagactttgtcttgcagcttccttaccagctctgtcacagttaggtagagtaccaagcaggatcttggggtccctgattctaggccttagctcttggaaagaatttctggacctgctctgctctgggtcagagagcatcctactgtcctgaagggagagtctcagacctggtagcattcagcacaagctgactaaagagcccttgggccttgagtgaacattggcagtagccaggcagtacttgctatgggcctggatctatgccagccacagagagagactcctctgcttgtggaaaagagaggaaagagtgggaaggacttcatcttgtggcttggatgccagttcagcctcagtagaatagagcaacaggtagatttctaagggtttcaactctgggccctgctcctgtatggcatctctgaacctactggggccaggggcaactcatcaccctgaagggaagaaaacggcatggctagttttgccacctgctaattatagaaccctagggccttgagtgaacgtaagtggtagccaggcaggccttgggtgagactcagtgctgtgctggcttcaggtctgacccagcacagtcccagtggtggtggccagagggtgcttttgtcacccctcccccagctccaggcagctcagcgcagaaagagacagaaagagagatagcagggtggagagagagagactctttgtttaggagaaaataagggaagagaataagagtctgtgcctggtattctagagaattattctagatcttaactaagaccatcagggcagcatctctatgagtttgcgcaagccacagcattattgagcttggggtactccctaatgcaaatatggctgcagtgatcaaaaacttagattacaacacccaaatccctatgaatacctggaaagccttcccaagaagggtgagtacaaacaagctcagactgtaaagaccagtaaatacctaactcttcaatgcccagacactggagaacatccacaagcatcatgaccatcgaggaaaacagaatttcaccaaagcacttaaataaggcaccaggggccaatactggagagacagagatatgtgacctttcaggcataatttgaaatggctgttttgaggaaactcagtgaaatgcaagataacacaaagaaggaattaagaattctatctaacaaatttaacaaagacattgaaataattaaaaacaatcaagaaattctgcagctgaaaaatgcatactgaagaatgcatcagagtctcttaagagcagaattgatcaagcacaagaaataaatagtgaacttgaagacaggctatttgaaaatacacagagcagacaaaagaattaagcccacccaccagatctagaaaatatcctcaaaagtgcaaatctaagagttattggccttaaagagaggtagagagagagataggggtagaaagtttcctcaaatgataataacagagaacttcccaaacttagagaaagaccaatattcaaatgcacaaaggttgttgaacagcaagcatatttaacccaaataagactaccttaagacatttaataatcaaactaccaaaggtcaaggataaagaaagaaccttaaaagcagcaagagaaaagaaattaataacatacaatggcgctccaatacatctggcagcaggttttcagtggaaactttacagggcaggagagagtggcatcacatatttaaagtgctgaaggaaaaagaaaaacttttatcctagaataatatattcagcaaaaaatatccttcaaacactcaacagaaataaagaccttcctagacaaacaaaagctgagggacttcatcaacaccagacctgccctacaagaaatgctaaatggagttctgcaatatgagagaaaaagacattagtgagcaataagaaatcatctgaaggtgcaagacttgcttgtaatagtaagtacacagaaaaccaaaaacacagaatactgtaacagtatacttgtagcatgtaaactacccatatcttgagtagaaagactataaagtaagccaattaaaaatagtaactacaacaactcttcaagacatagacaatacaataagatataagtagaaacaacaaaaaattaaaatgtggggaacaaattcaagtgtgaagtttttattcattttcttttttgttcatctattagttgttagcttatgtaatcaatattaagttgtcaccaggttaaaataaaggattacaagaaatcctttgcaagcctcatggtaactgtaaatcaaaaaacatacaacagatgcacaaaaaattaaaagcaagaaattaaaacataccaccagagaaaattaccttcactaaaaggaagacaggaaagaaggaagataagaccacaaaccaaccagaaaacaaataacaaaatggcaggagtaagtccttacctcttatcaataacatcgaatataaaagaactaaactcttcaatcaaaagatgtatagtggctgaatggatttaaaaaacaagacgcagtggtttgttgcctatagaaacacattttacctataaagacaaatatagactgaaaataaagggatggaaaaagttattccatggaaatggaaacaaaccaaacaactaaacaaacgaacacaaaacaaaaacaaaacagaaatagctatacttagacgaaatagatttaaaaacaaaaactataaaaatagacaaagaaggtcattatataatgataaaggagccaattcaacaagatgatataacagtttaaatatatatgcacacaacactggagcacccacatatgcaaagcaaatattattagagctaaagagagagatagaccccaatgcaataatagctggagttttcagcaccctactttcagcattagacagttcatccagacagaaaatcaataaagaaacattgggccgggcgcggtggctcacgcctgtaatcccagcactttgggaggccgaggcgggtggatcatgaggtcacgagatcgagaccatcctggctaacaaggtgaaaccccgtctctactaaaaatacaaaaaattagccaggcgcggtggcgggcgcctgtagtcccagctactcgggaggctgaggcaggagaatggcgtgaacccgggaagcggagcttgcagtgagccgagattgcgccactgcagtccgcagtccggcctgggcaacagagcgagactccgtctcaaaaaaaaaaaaaaaaaaaaaaaaagaaacattggacttaatctgaattatagaccaaataaaactagtagatatttacagaacagttcatccagtggctgcagaatacatattcttcacctcagcacatggaccattctcaaggatataccatatgttaagccacaaaaaaatcttaaaaatgtcaaaaaatatcaaattatatcagctaacttctctgactacagtagaataaaactagaaatcaacaacaagagaaattttggaaaggatacaaacatatgtaaattaaacaatatgctcctgagtgacctctgggtcaatgaagaaattaagcagataattgtaaaacttcttgaaacaaatgacaacggaaacacaacacaccaaaacctgtaaaacataccaaaaaccagtgaaagcagtactaagaggaaagtttatagctatacgtgcctacatttaaaaagaaaataaacttcaaaaagacaacctaacaatgcatcttaaataaatagaacagaaaagcaaaccaaacccaaaattggtaacagaaaagaaataatagagatcagaacagaaataaatgaaactgaagagaagacaataaaaaaagtcaatgaaatgaaaagttggttttttttttgcgacgataaacaaaatcaacaaacctttagccagactgagaagaaagcaaggaagatacaaataaataaaaccagagataaaaaaggagacattactactaataccagaaaaactcaaaggatcattaggagatcattagtagctcattagtagactcattagtagcttctaatgatcctttgaatttttgtgatattagttgtaatgtgtcctttttatatgagcaactgtatgccaataacttgctcatataaactggaatatttagaagaaacaggttaattcctagacacttgcaacctaccaagattgaaccaggaagaaatccaaaacgtgcagaccactaacgaatgacaagagtgaagctgtaataaaaattctcccagcaatgaaaagctcaggacctgatagcttcactgctgaattttaccaaacatttaaagaagaactaatatcaatgctactcaaagtattctgaaaaaaatagaggagggggaattcctccaaactcattctacaaggctagtattgtcttgataccaaaatcagacatgggcacattaaaaaaagaaaagaaaagaaaactacaggccaatatgcctgatgaatgtttatgcaaaactcctcagcaaaatactaggaaaccaaattcaataacacattaagcaaatcattcatcatgatcgagtgggatttatcccagggatgcaaaaatggtttgacatatgcaaatcaatcatgtggtacaccatatcaatagaatgaaggacaaaaaccacatgattatttcaattgatgctgaaaaagcacttgataaaattcaacatccctctattataaaaaccctaaaaaactaggtatagaaggataatacctcaacacactaaaagacatatacaaaaggctcacagctagtatcatactgaatggggaaaaaccaaaatcccttcttctaagaactagaaaataacaagaatatccattcttgccactattattcaacataataatggaagtcctaactagagaaatcagacgaaagaaataaaggtgtccaaattggaaaggaagaagtcaagttatctttgtttgcatatggtatgatcttataattggtaaaacctaaagactccaccaaaaaaaaaaaaaacattaaaattgataaacacattcagtaatgtggcaggatacaaaatcaacatataaaaatcagtagcatttatatagccaacaacaaacaacctgaaaaacaaatcaaaaaagtaatccaatttacagtagctataaataaaaataaatacctaggaattgacttaaccaaagaaatgaaaggcttacacaatgaaaactataaaatattgccaaaataaattgaaaagaatacaaaaatcaaaagatattctatgatcatgtattggaaaaatcaatattattaattatctatactacataaagcgatctagagtttcaatgtgatccctttcaaaataccagtgacattcttcacaggaatagaaaatacaattctaaactaagtgtccatcagcagacatatggtatatggaaccacaatcgacctagaacagccaaagctatcctgagaaaaaggaacaaaactggaagaatcacattatttgatctcaaattatactacagagctaatagtaactaaagcagcatagcactggcatgaaaacagacacatagaccaatggaacagcatagagaacccagaatcaaatccatacatctacagtgaattcattttccataaaggtgccaagaacatacattgaagaaaggacagtgtctttgataaatgatgctgggaaaactggatattcatatgcagaagaatgaaactagacccctatctctcaccacataaaaaaatcaaaccaaaatggattacagtcttaaatctgagatatcaaactatgaaactactaaaataaaacattgaggaaactctctaggacattggcctaggcaaagatttcttgagtaatactgcagaagcacaggcaacccaagcaaaaatggacaaatgggatcacatcaagtaaaaaatcttctgcactgcaaaggaaaccatcaacaatgggaagagacaacccacagaacaagagaaaacatttgcaaactacccatctgagaaggaattggtaatcagaatatataagaaactaaaaaaattaaataggaaaatatctaataatttgattaagaaatgggcaaaagatctgaatagacatttctcaaaagaagacatataaggccaggcatggtggcttacatttctaatcccaacactttgggaggctgaggcacatggatcacctgaggtcaggagttcgagatcagcctggccaacattgtggaaccccatctctactgaaaatacaaaaaattagccaggtatggttgtgggtgcctataaacccagattctctggaggttgaggcaggagaatcgcttgaaccggagaggtggaggttgcagtgagccgagatcgtgtcattgcactccagcctgggcaacaagagcgaaactccatctcagaaaaaaaaaaaaaaaaaagacatacaaatggtaaacaggcatatgaaaaggtgttgaacatcactgatcatcagagaaatgcaaataaaaactacaatgggatatcatctcctacttaaaatggattttatccaaaacacaggaaataacaaatgctggtgattatgtggagaaaggtgaaccctcatactctattgttgggaatataaattcataccatcactatggagaacagtttggaagttcctcaaaaaactaaaaacagagctaccatatgatctagcaatcccactgctatgtatataccccctcccctaaagggaatcagcatactgaaaagatatctgcactcccatgtttattacagcactatttgcaataaccaatattttgaagcaacctaagtgtccatcagcagacaaatgggtaaagaaaagtggtatttatacacgatggagtactgttcagccacaaaaaagaataagatcctatcgttggcaaaaacatggataaaactggaggtcattataataagtaaaatatgcaggcacagaaaggcacacttcacatgttgtcacttatttgccaatgctaaaaattgaaacaattgcactcatggggatagagagtagaacaatggttaccagaggctgggaaaggtagctggggggagagggttagtggaggtggttaataggtacaaaaatacggtgagatagaatgaataagatctagtgtttgacagcacaacaggttactacagtcaacaataatttatggtacatttaaaaataactaaaagagtataattggattatgtcaacattgaggtgatggatttactctgatgtgattattatgcattgtctgcctacatcaaaatatctcatgtactctgtaaatatatgcatcaaacatgtactcacgaagattgaaaatgtttttaaataataaaaataaatgagcaaaacatctgatcagacattttttcaaggaagagacacctgtgacaaattagcatataaaagatgtccaaaattattaatcattagggaaatataaaaagcataagttattattacacacttattaaattttttgttcttttaaatgtattactaaagtataatttacatacagcaaaatttaccctttttagtgaacaactatgtgagttttgacaagcagaggtttaagtttggacaaaattcaatttatcactttttaaaagtgggttgtgctttcattgtctaattatttaaaagatctttgcctaaagaagaggcatgaagcttttctcctatgtattcttccatcggttctatagctttaggttttacatttaagtctatgatttattttagcttaatgtttctattcacttctatctattgtcttcaagtcaatagatagaagatttccatcgcctgccccaaaattcccctgtatctctttgtcaaattccttcttccatcatagcccctggaaactatggatctgtgtttttgccttgtagttttgcctttccagaatgtcatataaatagtaccacatatatagctaaaatgtttaaaataaagaagaaaagacaacagtgacaggtactggtaagtatgcaaagcaaatggaactctcatacatcagaatgcatattggtacagccactttgaaacatgtttgttgtaggaacagaaaaccaagtgctgcctgctcttacttataactgagagctcaacatagagtacacacagacacaaaagaacaatagacactggggcctacttgagggcgtaggctggaaggagggtgaggatcaaacaactgcctatcgggtactaggcttattacctgggtgacaaaataatccgcacaccaaaccctcagagacacccgattttcccatgtaacaaatctgcacaggggccttctgaacctaaaataaaagttggaaagaaaaaaaaaaaacagtttgagagtttcttaaaaaaaagttcagtacatagctaccatatgacccagcaattccactcctagatattttcctaagtgaaataaaagactatggccacacaaaagtctgtgtgtaaatatttatagcagctttatttgtggtcatcaaaactgaaactcaaatttcctttaactggtgagtggataaatcgtgatacctctatacaatggaacattactcagaaataaaaagggacaaactgatatatgcagcaacatggatgtctctcaagtgtattatgctgagtgagagaagccacactaaaaggagaatggtcccatttatacaactcctcttatattacattttggaaaaggcaaaacttcaaggtaggaaacagatccctagtttccagggactggggtgagaggaggagttcaacaaggggaatggggaatttgggagaataatggaactcttctattaacttgagtaccacatgcacttgccaaaacactaaaaaaggtaaactttggtagatgtaaattatgccttactaaagatgttaaaaagaaccaaaactttttttgttaaaaaaggaggggtaaagtagaggtaggatccaaactcctctttttttttgagatggagtctcgctgtgtctcccaggctggagtgcagggtgctatctcggctcaatgcaacctccgcctcctgggttcaagcgattctcctcctgagtagctggaattacaggcgcatgccaccacgcccggctaatttttgtatttttagtagagatggggtttcaccatgttagtcaggctggtctcgaactcctgacctcgtgatccgcctggtttggcctcccaaagagcagggattacagatgtaagccactgcacccagcccaaactcctcttttttttacagctgaaactgataccagataatgtagtgtccctttgtggagaagttattgaagttagagactgtgcccaacaagagctggccccaggcccagggccaggtttccatatctaagcttactgcatggtgagaccagtctgaacaatgctctctgcaggtagaccacaagagacgggtgatggaagaagctgagctacaggtattctggtcctctcccaaaccctccaatcaggcaattcactccacttccgtcagaggagtagtggtgggttttcaataaatctctccttgtagaaaacagaaatgggaaagaaaatgtgtctgctcatattgccaatcaacatttctttcatgaaaaatttaagcatattggaagctaacaaagtgtaactacaggattttttttaaatttattttccagcaagtgcccaatcctcctaaatcaccatctctagaaaactcatttttctgcaagaaatcatcaaatgagcatgttccactgcttatacatgttctaaatagatgatataggttccgctgcaatattcacttgactctgtgtcatttaagtctccgtgactttttataggtacagattttatagcagccagggatcatgtctgtttaattattgatgcatagtgcctaacatagcatcgtggagatataatcagttaaatattacttctgattgatatgacgatgtgtacacatcactttaagtatgaattttttgtaatttagtttattcatccatcatctctctgctctcaagaatttttctttactaaaattctcataatttaatgcaatttttatttaaaaaatatccatgcacaactagaacctgaaaaaattgactgtaataattttaaaatttgaggcctgcgttaacatgtttttcggtaatgatcatacacttattcacctaacctatttatgttttctttggattcactatttttgaattcttgctaccattttaaatggtatattaggttctaaaatgaacctgtaggagaggtcagttcaataaatgaaattcgctttcaattatatatattaataatttggtgagctatggtaaattatttgggaatttgggtctatatattcttctcagaaagtaagcccagagatactcagaggtgctaccaattggggattgtaatggagctcttgattctattacatgcatcacagactttctggtgtacccccaactgaaagttcctttaaaataagcctcagggaccatagagagattgatcatttatctgaaataatgttatttctgtggtttagtctgtttgtgcaacctctggaaaatattttctatcttatcttataataaaaatgtattgttcaccattggaggaatctattttagtgacctattttgggtattttcccgttatggcaaataatatacttttaatgtattttttataatgatgctattctttattcatttttataaggaagtacataatctagtacataatcatttaaaagcaaaaggcaaaagattagcttatgaaccagaaaagtatatacttatatagttacatatagtacgctaacattttataaatcaatatgaaagaaacagaaattgtgcaaaaaatatgtatgctttaacagaatataggccgtttggcagagtgttttctttttacttgttaaaggagtacactgaagcactaggttttattcatcatcaagcctcatttttctgctattgtatgagaattcaataagtgaattttccagataactgaagtataattttaatattcttcactgtacttatttaccgttctaccctcaatgggaagtactctaatattcgttaaatattatatgaccttcctaataaaacactttgaacacaatataaacttttcttgataacgtggggtcactattaaaaccatgttacctcaattgtaagacttcttcctattagggaacaccactgctacaaaaataagacttccagggaaaaaaataaagcaatattaaatatactaattgacaagatacatacatctcaattgcaaaacattaaaatgtgggcgagaagaaattacatattcaaatgtagaaactgtgttgatattaattttgtttttttattttactttaagttctgggatacatgtgcagaatgtgcaggtctgttacataggtatacatgtgccatggtggtttgctgcacctatcaactcgtcatctaggttttaagccctgcatgcattaggtattatcttaatgctctccctccttttgccccccaccccccaacaagccctggcatatgatgttccccttcctgtgtccatgtgttctcattattcacctcccacttatgagtgagaacatgcagtgtttggttttctgttcttattaattattaaaatgttccctcaatatgcagcaaaattcttttgctgttgggtcctctcctcattgctggcagactctgttatcacttttcacccacatcacttccagtgtcaactcctgtccattcctttctattgtgctgctgccctgagctgctggctgtgagttgtggaaacccaaagagcaagctagtcactaattatgttaaataatgctgaataatggcagtaagattcttcccttaggccctaaggccgtactttagtgctgaggttttgcaacaactgctactgtgctcagaggtggtgcctcacatctagtgtcaggtctgtgttgtaatgaaccggaattgccaggaacttgtactttggatgaatgatgtgtcaagtgcattaagaatcttgaaatgcatcctatatagactacttactaaaattccacaatcttgcattctcatagcttgaaagaaatatacaaaatgcagatactaccacaccctcatttcagagctgactttatcaggaaacatactgagatctcaaagacaaggggatgtggcgttgaaacgggaacatgagagccgatggatactgccctttgctttgctgtaagggccagtggccttgaggccccaggcacagtcacccacatctgtggcaagcatcatggtggcatttccaggtgagtaggagagagtgagaaataagtcagagaagaaatccaagtcttaggtgactgtcagtcatgaagagaacactggcaagagttcttcataacaggaactcagttacaggcttcgcaggggtttgaagaaaaacgggaccttctgtaagcccaaaggaagtatatggcaactggcccatgtcttaaagctccagaggagcaggctggagttccagctgataattggagtggctgaagggaaactctgggaaggcccagatttcaaagtggatcaacgggaaataagtagagaatacaatcactcaaggggtacatgatgtttggatttctcccttctatgagagagacaccatgtatatcaggaacaaagatcaactgcagccatcaccaacaggtggggtttaggagcccgatttgctttttgtgagggacctggtaagtctgagcctgaagatcatgaacacatatgccaacttcccttgtgagaaattaggaaattctagagaagtcaagaagtgacaaacacttcattgttttgagcatttgtggtgccacgaattggaatgtaccatcacatgatttagccaaaagtctgtttaaaagtcaactatttgccactcaagactcttctggcccgagacaagaaattcttgggagaaagtggacagaaatgtacatgtgatagacaggaaatgaactgatcggaataagtgtgaggagtggagaagaaaattctatggaaaatgtgaaattgtatggggagaggatgcagaaaatatggattgagaaactgtgagagccaagccttcaaaccagtatgttcttttggggatatttcaaagcctagagccatttctactccctccctccctttgcttccaatgccattgatttatctgcttgctttccatttcaatacttgccactgtccactgcaaaaaaataatttttttgtacctctcttctggtatcaaagcaatttgaaagggttctattgttcatatagtttttgatgctgttgtcaaagatatcagtacaaataatagagagaaccagtaaggtaatacatattttcttctttcccttctccccatcattgtatattccacagttctttcacatattctgtgaataatatactctgccaagctttgagatttaaaaaaaggaaacgtggttatagtgtcctcttggagcttacagtcaggacagagacatgaacaggaagaaaatcttgtccttagagggagtggagcagtagagagaagaggaaagaattgagcaggatgtggtctcaggtagtcctaaccacttaagaaattatagcttagagttttagtaacctgcctaaggtcacatagttaataaagagtaaagttaatgttaggtattgatgaattaaaaattcatacactttctataccaactttttttctgcagagaatagacctaagagactcaagattttatacttactcaactatgttgatgatgaagggccattctaatgaggatgtccttgactttagagtttgagctaaacttggagtttgatagaggttatattcattagctttgaggacaaaacaaaagaaacaacaacaaaaaatacttgaggttattagctagttttcagaattttagataattgtttttatatgatcatgtattcatgcacataatattttcttcactggtatctattacaagcgagaagatatttcagagggggtttacattaatacacggcttgtgtcatcaggaaatgaaagaattgaggaaccccttaaccctggaaatttacaggccactatttaaactatagtagagtcattttgcttaatcttttgcataattattttgattcctaacacttcactgttgaaagggcatagaatgggaaagctaaagtatgcctgggctataaagctttagaaatctctcctttagataattttaaatagatctaattcaccttctgtattcatccaaagtgaataactgtagaggcagtgaaagtatttattcatcaacatttggacccaaaccatgctaacaacaagccgcttcacaatacagtcctcttatcatgtagtggttaagttgacacttggagctgctgttgtgtagctatgtaaattaggcatgatcctctgctttggttttcttgcctataaaataggagcatagtattccgtgtagagtccttgcacaagtgctgggcatggaatatgaactcaaaaatgctaagtatcatgattgctttgaacttcacgctagctgtttttccattgcagttcaaaatgcaagtctctccaaacctctctactttcttaatattctgtcaacaaatcattgtaatcttccccctactaacattctcccactgttgcccattgcccccatcctattccctttgctctttgaaacttcggtttcaattgtaaacaaacacttgtaaacctttaatatttcccctgacaatttttctacctcaatttcttgtcttaattgaaatttagatttactctaatgggaatgctttctgttcagccattcaaaggagatgagagttttgtgtgtgtgtgtgtgtgtgtttgtgtgcgtgtgcacctcatgatcaaaagacaaaatatgaataaagaattggagagttttcagcattcttcttattctgcattactcttctttcaccttacctaaaaactttttttaaaacaattatgtcatctggctggaccgctatgcatatatcctaattcttagcatattctggtcttttccctaagttcaccaattagtttgaaaggagaaagtgggcagtggaagcagaaggcacagtcttccttctcctcccctccatagggctgaggtttacagtgtgtggacctttagggatgctgaaagaggaagcgatacttccttccaaagtgagaaaattggctgagaaataggaagagatcagttcatgaatggacttcttaagcaaagaaatttgaactttatcctaaaagctacaggaacctactcaaggattttgagtaccagagagaataatcagatttgaatttccgatcactgtagctgcattttgaaagcttttgctagacatgacataaggctatatccaaccagattaggtaaaggaaggatttaaaacatattatggaagtagattaactgggacttggggaatgtttagggtaatagtgggaggggagcctgaagaggcctccaggcttctgttttggcaactaggtaaatttggatactattctatattgtcataattagaattcctaatgtatgaggttatcttaaagattaaatgacttaatacgtttaaagtcccgtaaaccattgctgatatgaactcttttatttgcagaggcactgactgtagaaatgagtttaagtacaatgtgaaggaggagaggagaggtgactaacgatcattagtttagttttaaagttgagttaggagtgggtccactgtaggacatccatttagagatacagaactcagcactcaacacaatactttagcttgcagctatgaactgaagggtcttaagtacagtgaaagtcatgaattttaagtcattaaatttattcaaatgtaacttctgtaaatagagtgcaatgatgatcgaatcaaaaaacaaatccctgagcaagtctgttttaggaaagaggcagagacagagaggggagcctaggaatgatgaaacttggtagacagaaattcaggggacatccacagacattaaaagagttgaaaaaaggagggaatgtcagcactgtaaaatgttgccaaaagttcattcaatataataagtgaagttcaattagaataagcactgaaatatggattaagtcataaagaggatgttggttaatgtgtctagggatatttccataaagtagtaagagttgattcctgacttacaggtgtgacatctgcagaaatgaagaaatgagagaatgagacctctttttccaaagtttggttgggagaggaatgagacagagatgaatgtaccgagagtgaaatgtaaccttcttattaattatcattaggtggatgtactggagtatacttatatatggaggagcaagagagaggacagtgaggggatccaggcatggaggagaggagggaaataactgacttagcaaggtatctcaaaagtggggcatgctgggatcagaggaaatgggttacattagacaggaagaatgcatccttcctgtcacaggagggaaggtggaaagataggcacaggcagtgataggaaagtgtttctaagggacaaaattgaggtaatttctccctgaagggctcagtgaagtgggagtcagagtcatttactgagagacagaggaaaagaggttgtgttggaagtttaaagggaaatctaaaagtttgaaataaaagcagaataaaagagctgtctaggtctatgtaagaaggtgtggggaccaccccaaggccctacctgagattagaaatcatgaattcctggtggcttgttttcacaaggctggttgttactccgtaagaatcttctcactgcaaacgtcccatgatcgttgctcagatgtcttgcctagatgctgatctctgcacttctccatttcaccttcagcactccctttgactgatcccagactcacagatctgaactcttcttcaacactgcttcaaagtgggactccagaccccttatctggccattttcacagaccctgcctgctcggtccttgggctaacattgcagaacctgacttctgatgcacctgacattctgacaactgcaggaaagcttttacttggtagccaggcttccaattttaatcttacttgaagatctggatttgaaagaacaaccgctttatgagcaagtgattaccaaacctgatttggtggaagcccagcttgtctctagatatcctcagggaacttgttgaaattattttttgccaagacaatgtaaaattcactttaacatatataccttgggcaaagggatgggaaattaaaaaccatagggaactcagcttctaataaaactgaccctctttttggtaatagaacattgtgaattacttattgagatattctccacccctacaaatattaagtagtgcagcgattacagcagagacagcatactttaagaatgaagatgttactgagttctgcagagctaattacacataaggtctatttcttaacctgcagttgccagggtttgcagcaactagtaaggccaaactgatttggcagctggggcttggggagcacgggtaggggatgggagtctgcagagttctccatttagtagagtgccacattgccgaagagcgactctcctctcacattacctcctggaggctggactggatgttctccttgaagagaaaaaaaagtaaattggaaccccaacagaattattaagaatgttcaggttgtctataagaaggaaacactgatgccttggtcttcatgttgatatttacttagcaggacctgcagggtctgccgaggtactgtctgaatgttggggtggggaacactgggaaggtacttagggggcatcagggattacccctggggctcccagtgctggaggtggatgtgaggtgagtactgccatgtgggccctgaatcaggtcccagagtgtggataagatccagagttgcagaattgcagtggaaaagaaaggctcacacatgagaggaatactgtgtgagagccccacagggccgccaactctagatgtggctgagggtcagaagggaccgcctgtgcttaggaaggttgcatgaattaccccagcagcagaatagcttgagatctccatccacccacaactagtcgatacataataagtgaaattagcagaacagatcaatagagggcacagaagctttgtgatcatcaattatatcaacagtggagatttctcttgttttatccatctgtattattcaggattctccagagaaacagaacaaataaaccatagggtgtgtgtgtgtgtgtgtgtgtgtgtgtgtgtgtgtgtaagtgtgtgtaatgtatatacaaataaatataaatctatatatacatgtatatacacagaggtatatatgtatgtatatctctatataagagatttattataaggaattgcctcgtggttatagaggctgacaagtcaagacccagagagccaatggtagagttccagttccagtacaaatgtccaaaggcctgagaagcaggagagctgatggtataaattccagcctgagtttaagtccaaaggcaggagaagaccgatgtcccaacttcaagatagtcatgaagagaaagtgaattctccctttctcagccttttggttctaatcaggcattcagtggattggatgaggtccactcacattggagagggcaatctactttattcagtcttctgactcaaatgttaatctcatccagagacactctcacagacacacctacaaatcatgcctaaccaaatatctgggcacttcatggccagtcaagttgacacataaaattaatcattgcaccatcccaatatgagacatttaaaaataaacaggatttctctttataattaggttgaaactttatatagctgtcaatgactaaaaacgcatttaatcaggccaaaatgttaagggagccatgcaatatttgggacacacttatactaaaatattaatattaatatactaatataaagtattaataaataatattatttatctgaaatccaaatttcagtaggcatcctctatcttatctggcaaacctactaccttcccctataccagaataagtaataatttcagttaggaaattggagagacataattgatttcattcttttgacacactatatatgaaaaataccatttcatttgctgcaatggaaaatgccttgggaatagcaaccagtaaaacatgttagtgtgttgacatttgaaaagaaagttataggattctttaactctctacctctaagccactcacagaattccaagggacctgatacccacatttctagttcagaggaaaattatagaattcaacttctggcttcctctaaccctgaacaaatggtttcagcttgtaaaaaccatggagttttagagctgtaagtgatattagagatcttcatttgattaaaaccattcttgtacttttaaatgaaaagttactggttttaaagaagtgaagttatttggatgatctttcagttctgctgcctgacattcaataaagcagaacatctaagtcttactatcaaacagctatcactgtgctgtcaagtacaactttttaaacctgtcaaacagtcattagtcttcccttcttaaaacatctaactttgaagctgtctaaccttttcctgagaaaattcaagcataagttcatttcaagaaaaatttcctagatggataatttcttcctctaaaaatacttctgagaaactacagttggaaccattttaattattacatttctaggaaaaactagttgtgaatcttgctgattagaatgcctctatgttttttagttatatcccccaaataactgtttaaaattgtaattatcatctttctctctcataagggatcaagagcataaaacttgtttggttttatcatgatccataaaagtgtcagctctatatcacttcatgaattaataaatgtccaaagtaccagtaagtttaaaactcatgagaccaatgggctttgttggcatcttttcacttcatagttaataccctcatactgtgatatatggttcttgatgcagaggaaaagggagttaatggtagaaccatgcaatgggtcttaaagtttctgctggatacagcacatatcacttccacttgcatgctattgcccaaagccacagctaacttcagtaagcttggaagtacacccctttcatggggaaagccaccgaggagggccctggataggtgagcccaatagagaagtacagtgaagattttgaaaaaaaaaaaaaaattatactatttcacatagaacactaaagcccatagcacttaagaacctaaaccacatgaccaacttcacaagttgattattaacaaagccatggttggaacatagcctcctaattatcttttcatagatattctgtgtatttgtacttggcctccttttatggatatatgcccatgtgttcctaaatgcaatgccttctcaagtttctatcttagagcccctacctcatcttttgttcagaaagaaactgagtcaaatatttcatcactttaagggtactaatattccaattcatagaccagtaaaggtaatgaggtacacaaatctatttttttttttttttgccatacaacctgatttcccactgtagttttttcaaaaaccgaaaatatcatcacagggagtgaaaacagcctcttgccaaactgcgatctcttcttggaaaacctaatgattacttcctgtctttggtgcctcatcaaacccttaaagtcctggaagtttcatcttactctttttttatttcaatgtagataatactgaaaaataaaaactcaaaaaaaaagcaataagataaaccaagattaaatcaggtaaaataggttgatgtatgaaagataataactgattttgaaatatggagatcctctgtttaaaaaaaaatctgtttacagctaaagtgattgtggattttggcaaaatgtttaattggagcaagacatcttagttgcatttagtctattccctaagcctcactatgagattccacagaaatcacctgctgaaaaagagcacaccgtgctgaagctccaaatagaaggtacttttaatctgcgtgtgagggcaaagatatagccgtgatccttgtaccctgagtacccttcaaaactgagcatctcttaagatggtggatacttcttgggtgaaggctagaaataagaaaagttagagtagttgaaatgtcgtttttataaaaggtgctctttgctcttctgtgaatatcattgaatggctaagaaatgatccacaatgcattaagtaactttcttttgcagcccaaaggaagcccagctgtgaatagcagagcacatctacctctcttgttcttttagccgtgcatgaccaagggtgatgataaatgacatccctggggtatgatgaaatggaacaaaaggcaatggaatatatgaggcctgctctgtttgtgtcagaggctctgtctaaatcaaaagtggtgcagagcatcaaatagcctgtcaagggtctggcagcatggcttctcaaatctatgccagttaaggtttccagagctcccaaatggatttcattatcttgggaaagaggtgtgaaagcagaaagtctgggccactgagagggaaccatgctacagtgagtaaaagagaatgttaataatcacttcagtgaaccaagcagctgcaatatgactgcacaccatcactacagttccgggtgttgtttatgggaaaacataataaatgactgcttatggacacccacagatatattgaacattttgaggttaacattggctaagttctaaatgccatccttgtaagtagctttttcaagtggaaacaactatttttcaaggcaagccataaaaacatgtgaaaccaacagcatatttatatgctcttataatatagaagcggtcaatctgattgaacctaaattttatttttacaaataaaatgtatttttgaattatgatttatatcgtatgaaacattttatgtgacagtgagctggcccagaaccctactaaaaatatctgttttcagggattcatgtttataatttatttcttatattcgcttctttatgcttagttctttaaaagaagataatttgctttgaaagtatttcagtattggaggaatccatgggtagcagcaaagagaatccaaagggttaaatttctctaacatatatttgatatttggaattttacaattgcagaatactttgatggattctgttttatttgtcacagaaaaatgtcatgtaaacctcctatagataaaagtcagttatagtttttttggaaaacaaacatttttatggttaaaaattgccttagggtagaagagtaaaaggtattctctcagttttgaccagaaaaacttttaatgcataacagcactctgcacttaataggccttctcgattttttaaaaaagaattgatcaagaagacttatcagacaaaatgatctagataaaagatcccaaatgccattactactggtgtctgaatcacagagtgaaagcactgaccttctgctgcaggtgctattttttaagtctccattgagtttcagtttgaaggacaaaattatcatagagataggaaggataatattgtactcatttacactagaggaaagagaagaaatttaagttgctctgatcaagctctatgcataaggctgtgtcaatagacacaacatgaggtagatccagttgaatgctaatccttccactttaaaaaggttacaagtatgttagcttcacggcttccattaaagccaatgggagttgtaccattaccatgctttggaaagaatgccctctaatgctattgattttgatcttttgaactcaagctctgatacctgtgttcgttgacaactactctgcctattgcgtacacaattctgtgctactgaagtactggattagcaagtcagctccttttttcaaattaatcagcttgtctgagacaaatgtttttatcttaatactcttagaaatgccacatatcaagcttatttcccatagttagagcatatagttcaaaagtgccactgatgggttttgtggaagtaaatgaaaggcccagcccaggaagaggaggccattgtgatatggtcagatttttactgtaggaagtgcattgtgtctgaagagtgccttatatgattaggaaatgtgtaccagcagggcaagacatgaaaccaagagactagtaagaagtctgctgaacatatccaggctgtagaaaatgcaaataatggactagggtataaacaacaaatatgtaggaaaaatgaagaaattccagtgattcctgggttgtagaatttacatgagccaggcttcttaagcaaatgagtgagaagggtgtcattagcaatcatccactgggaatttgtgggctatatagcaaactggagagcctaaccaatgtccagtaacttaggtccaaccatttatttccaagctgtcagtctttttcttttcttttttaagtgtacacttggatattgatgttaatctccccaatttttagatattataatcattgtgtaggcatcacaggacatatctgaaggctaaatctgtccattagctaccctttcgggctccctacatttttccctagcacatgattaggactcaataaatctaaatgtatgttggatggattaatgaataaattaatgaagggaatatagtggccttaaggttttacatggcctcaattggtttgtaattttaaacagagcttctatcagtccagtccatgcttcctactaactgcatttgagagaaaaattcctatttgtaagtgtgaagactaactcatcttatagcattttttacatgaaagtcccatttgtattttgtatttaaaattttttattcgggttcatttatccagttttttatttggaacaagtataaacgatgattatttaacagctagttcttttgaaaataactttcctttataatctgttataaatcatgtttggaaggactttgagaattgaaacaaaggcataggtaaaatgagtgtcgtgcatcagaaataaatgcaaattgtggatggggggacaaaaaaagagatggaaagacaaaatacttgaaggggaaagaaacgaaaaagctaaggaaaagaccagcaactatgaacgtgaatacttggttttattttacttttttcttttgttctttgttctacttttaactttctactttggaaactcaggaattgttgatccagatttctttttctaatgtatgcatttgaggtcaaacagtatacttgtatgttcttctttacctttctcacccacattctggaatgtagaactttcgttttccacaagtagcatgagaacaaacccccttgcatccccactatgtccaccatgaccttatctgcaataattgtttgctgctgaagatatttgatctaaaacctggccacctaaacagaatctccaaataccatcacatctcattaaaagatctcacctaatgacaaaaaacacagtcataagagcacatgaagattacacagcctcatgctttgcaaccagaatttatagagcatttataatatgtgctacattatttcacttgcataattcaattagcacaacaaagctgttaggagatattatccccattatacagaagaagagaaaaaaacataaaaacaaaatgagtagcccaaagccatacagcttttattcacaagatcttataacttcatgcatcctagtattttccctgttccctgctactgaaaatgattctgtatggtaacatgccatgtctgtttttaaagtaaaatcatcaaagtatatatattctcatatttctactgtcatttgaaatggttttgttgatattcagctttgatactaatatagtattccttaaattcctgcatttctattttcatcatatacatttagttaacaagtttcagttctctttggaaaaataaatcaagaattacttgcttcacctatcaggagcccatgtaattaaaattaaggaattacttccttaatttaactctttttctttgtctatatgtcagttcaaaatgattaaagttacaaaatagtagaacatttgattaactaagctgcctcagaatttactattcctcatggagctgctccacaaattagagtttttgcagttcagtttgccttctgttatatgtaaatagggtgaccatataatttattacccaaactgatacactgagagttaaagggacaagaaagtgggaaatagggctaaccagactgtcccgggaaaacccagatgtgtagtcaccctagattgaagtcacgttagaccaaataaatatggtcatttgcctttacctgagctgaaaagaactgtcaatccaagatagttctcagcaaggttggtctcaggacatgaaatgtcacaaaactgtaacttcaaggggttttgtcatcttctcaagactgtctcagctatttgggttttgctgccatcagagaacagcaatgtcacaattatagctttgagagtataaaaggacacagttttctttgagaatcaagaagatattaatagctttctcccggagggctagacaggagcaaagtattaagcagtgtttcttgaagctctcatagcggaggatgactgtgtgattgtcaacctctaacacatacccactgagttagaaactcctggacaaggcctacaaacacgaaatttcaaccaaatccataagtgaatcatatacacactacattttaaattttacccactgatttaaattaaataggaatactaaaataatgtgatataattgctaactgctcccttccttatttgctccctttccttagcttatttgctattttaataggtgtcaaaaacatctgctaatttatgttttatctacatatttgggttgacttaaagcattttcagggttttaaaaattatttctttcccagtgtctctgtctctctccctcacatcttttctattctccttttacttctttttgtgtcttcttcctcacctcatcagaatagatgaatttattagatctttctctctatgcttgataattcttcctcattatctccaccagaaaaaataaaaaatgtatttttaataaatattaatatttaataaaattaataaaatggaaaatggaaaagtgacaatacaaaatccgttccctcaattaaaaggtacttctctagcattttacctatttgagtggagcaatgaaatccacgctcccagttactttattctttgcatgtaatgctgtaggaaatctgttggttacagatttgtaagctctaggctcagtggccttaccacctggctttgacattattccctacaacaaagcatcgtaagacttgagggcaagatctctgctgattcattgctccatcccaaatagctcctggcagaatgtcttgtacaggaaagacacccattaatatttgtcaaataaatgaacagaggaaaagaaaaacccgggcttcctctaaacttgtcacactaagctcatgattgaatcaaacacataaagaaaccctttcatgatataaatgagaatactaacccctgctctgtgtggctttgtaacaatatttttaacaactaagttcaatcttttgtcagtgttatgactctgaaaattaaagaaaatgttttgtagaaacaaataattagaaatattgccaggaaacttctgtactggttgttgttacttttattcgctgggtctgtgagaaggttggtggtatagagagagttgtaagaggcatgattaacaagggcttattgagcccttactgtttgcataggcactattttcaaacggtgtagcaaatataaaagatacaaagtatatgacattttcttcctctgtagcatgcaagcttggtggaagacaagattcggagcacaattagagaacaatatgagactatgtacaatgaagtggtaaattgaatataattaagcacattttccataattccaaactgaaaaagtcagaggggaaaagaccgatgttggttgccagtataataaaatatgtcaaaattaacagaagatggaatacatagaatttcaaattctattgtgatgaatattatggggtatctccgcagtatatgtttacttcaagttttcctacataaaataatgagaaaatgtaattttatgtcagaatttcccatcgtagatgatcttgaagaactctcattttataaatttaggacaggctgccatggctacctaaaaggaggacaaaactttgtattatgcaaaataatttcctttaaagatatctgtgtttgctgacaatgtttgtactgtatctgtcccttcagtttacagatattagggagcagggggacagtctttttagtggaattactatagcagagagcgcaaggccacctgtgcctccaatggttttgtttctgtgcaatgttcttaaagttgacatattttcctcagtttaactcctttgggatataaaggcatttgaaagataagggtttggactttaggaaagactttaaaagtaaagatctgaagttgaggttggtgccattttttgtcacttacactttatatgaattttaaatttcaatttggcctcattttaaatcctctcaaagtgatagtacctctcctcacctctcacaattctgtattcataaatattctattatttcttggaaatatcttgatctcagagaaaaaaaaaatagcatcccagggctgacttttctcaggagacttctccttttttttgcttttttcaaatttcatgtcaaccacatttttttcccaaaggagaatgtctttttacagagagaaagagtagaagtgaatggttgaataagtttacaatcacacctctatctgctcattgcacttatttagtaatatctcagtgctatagtctttaatagtatatatatttttaaaatacaattggtaaaggagttttgctttgaagtattaaaaacatcacaacatttatctgcaacttcttttattgtacatccattagaaatatccaaatgaaagataatttttaattgaagaaaattacaatttcacaatttctagtatttaatgtaagtgataaatggagaataataataatagaaatgatatatgcattaaaaatactttattgatgaaatcactgcaattaggaaaagtaaaaggaaagagaacaggatgacagtctatcttcattaagtagcatctatactgatgcatcggtttagtaaatgagtgaacttgtcatctggatcactctgttcacatcatcagcccattcttgctccttccaaagaaggggttagaatccatgtttataattttgaattaaatttcaagaaaggaccacaattaaacagaacaacagttggttcacataaataggagattaataactttctaagcagatggctcagtaaggtcattcatcaatgtgagtaaagatgaactgtcagcaatgaagagaattgaaaatatggagtggatagtttagtttgttggacatggagttgttgctggaaaacaaattcaaggaaatctagaaggagaaataaacttggaatgctataaatacctattgtcaaacttagaatttatactggttttggaataatttaatcagtctctgtaaagacactagacttcaaagctcattttaaatactaataaagtgtgatttaactatatattatttaaagaaatattttagacaaattaaatttagtgagagtttatttgagcaataaactcttcatggattgggcagcatcagaaccagaagaggttcagagagctccacccagaagtgtgagcagtgagctttaacaggccaaacatagaagcaaagcaggaaagtaatctgattggctacagctaggtgtctgccttatttgggcatgatacaatgagttgtttgcctgctattggggctgttcactcctaaattagatttcaatttgtttacctactgttaggttgcagttcattgtgtcaaaactcaaaatatagagatagtctcaagctaatggcctattgcttatttaacaatatctatgatattcaccttatcattgcccctactgtattgcaaaacttatccatcttcgttatacacacacacaaacatatatatatgtgtgtgtttatatatgaatatatatgcatatatataaactgttcacaacttacaatggttcaacctatgattttttacctttacaatggtacaaaaatgatatgtattcagtagaaactgtactttgaatacccatacaaccattctatctttcactttcaatatagtattccgtaaattatataagacatttctttattacaatataggctttttgttagatgattttgcccaactgtaggtgaatgtaagtgttctgagcatgtttaaggtaggctacgctaagctatgatgttaggtatgttaggtatatcgaatgcattttcaacttaaatactttcaacttatgataggtttattgagctataaccccatcataagttgaaaagtgtctgtacaaagatagatttattgatagatacatatatcttgctcacaaaccgaagccaaaaagaactagcagtgatgacatccatgttttcataccaaatgaaccaaactttttggctttaccattgtctcttacccatgttgtttgtttttcttctaccattaatctgtatgctcttttagggtaaagaatactttttactcatggtgactccctctgcctccagcactttccatgttatcaatgcagaccgggcactccataagtgtttcataaattgaactgaattgtcttccttatcatccccttcaacaagatagaggtagtaaatggcaatatatttggagggagggaggtataactatctaaagcctcaaaagcaacaaaggacaataattcaaatatctgctagatcaggctacatggtcatgaggtgggacactggtgaagtgaagggagtgtgccctccctacagcagtgctgtggccactcaaatccaataatttcctgcagaacatgagccaaatctctatcttgtcaaatcttccaagttttaagaagctagaaactcaaatattgatgtggaaacttctgattttataatgctggcaaacgattggaagtatttttttaaacactgcacctgacaaataaaatatttctgtgggtcacatccctggagctcacaattttcgacctcactcggggcaacagaaaagctgaccaagaaggtcaagatgttaattaggcagctctgttgaccacaggcagatgcctgtggactataattctccacctcaatgtcacttggctacagggtggtagtgttaatgacattcgaggtaggcaatatatgtatccatgaaggtttgtcaatctgcggtgtatacacataatggctgaaaatcagctgtctcttatttgttgcggtttgtttggtgagactctgtgggagtatttgtggcttaagagcttggaaacctcagtgtccatgaacataggaattgttcagggaggagatgtaacaggtgaggcaagaaaccagaatgccacctttaatttcagttgttgtctggaatgcaaacaatgctcctagttacctgaccaatatttcccctcaatgtaaatgatttggtgaaaaatgatactctttctcacagccccaagaggaggttaaaatcctcttacagccttatttgaaaagtaaaatttcaaaagaaaaggaaagaaagacagccaaagcaatcattataaagcttgaggctaaagtcagttttactttattttttcatcactcaccctggaattgtttgataggatggtttgaaagaattcgggatgaagtgtagcatctccaaatgttagaaaatgtatactagaatatttataaatcttgttccattttacgcaccctagatgtcacgatatatgggaaatttaaaaaagtatcagaaaaactcggcatgggggatgagagtaacgagtgaagatgatgaacatgtgtctgatcgatgtgtctcccactctgtcctccacctgcctctcacctcctcccctgcctctcccactagcttgcccccctccggaagccccacacatttttttttcacttttacatgaacgcaacatgccacttttgaactcacagacttcacatctacctggaaattctgttctttttctttcaaaattcatctccaaaaggtaccgtaaatagacagagtggggtagtgatagagagctacgacgccggggccagactgcctgaatttgctctctattgtcatctcttttctagctgtgtaagcttgtgtctcctttcctttgtctttgcaatagagacaataatagtaatctaccttaaaaacgaggtttgatgtttaaatgaattagtaaatatacagttcattggagagttgtaactatatagtaaacacagtgtagtgttaattattttattatcactcacgacctcctcctctgtgaagtcatacctgagctggaggctaaagaagtgtcatggcaccttcaagcacctactctgtaaaacattctgctacatttgacttttattcacaaatgcttatgacaatgtattataattattgattgataggatatgtaatattgtatctacttacatatacatctaagctgtaggctactcaggggcacaaacaagatcacattattttgattatatggtattatctagaacttatcccagtacttaacacataaccgtcagtcaaaatatgtcaatttcctgaatgaataaggatgtgcatgggagtttatcctagtactatttcatgacttgtatctggattaaatatgcattggaaaaagtactgtatttttgtgcttttgacttaatatttgtcatagcaaagggagaactaatatctttttcagagtgatactgtctatgctggttaatatattaatttatgctaccacttctctctgcttacattagtaaagcctgactctctcaattttaaatacagaattatcatacactttgctagacacgcttcatatttctgggtttgacactagttttctggagtacaagagtgtcattatgtccttatgtctcaaatgcaatcttgccccatctggattcatgttagaagaggaagcagataacaacttttcctacttcacacctgtgagatcagtaaatttgaccacagattagaaattttaaaatgaataaaattttaagtggcacttctgatgcagtgtattttatgacttttttttaaagaaatgtacttgaccaccaatatattatttataattcaaaaaatctgactcagaacaagttctattgtaaccttatgcatcatcattatcctattctagtaagtataagggatagaatttccttaccgctactgaatgcttgacttcaatctaaaacactcttaatttgcattaaattaaaggccacttagaaaaatttagagaacacttttttgtgtgtgcagaaaacattaatcaagcagttttcctctgacttttttaactggaaatagctcatttaaatattatccaaactctacttcttttaaaataattttttcttagtattttattactggtattagtgtagtcatcttctttagtgatgttaaagcatcagggttaaagggctagaaatttagcttaagacataaattaaaggtgtgggaattatttactttggagaagaaagagattaagaaaataaatgttattaaaacaaaataaaaggtaaacgccattttattttgtttgtttgtttgtttgtttatattactttaagttctgggatacgtgtgtagaatgtgcaggtttgttacataggtatacatgtgccatggtggtttgctgtacctgtcaacccatcatctaagttttaagccctgcatgcattaagtatttgtcctaatgctctcccttcgcttgcccccacctcccgacaggccctggtgtgtaatgttcccctccctctgtccatgtgttctcgttgctcaactcccacttatgagtgaaaacatgcagtgtttggttttctgttcctgtggtaaacaccactttaaattatagacagatttggtggattagaataaaatagttgttactgtgtgtgtgtgtttgtgtaagaaaagaggtaagtgtttactagaagatattagatgatcccctagatgtttataatataaggagtctttgctaagatcgcttaagtgtgactccgccttgaggtatacatgtcggctagaccagacctgccactaggactcaagctggggagaattttgagcactttgttgtcagcaccatttagaagacaattttttttatcagctttatattctacaatatgtgtagacatcactgaatttcaatctcatttgcagctgaataaacaaacggtaggtatttccagttttttttaagccctcttacttagaattaccactcattctcatatactaagattatatcatttatgtttttaaataaatatccaacccctccccagactatataggtattttgggctgattatataatattatataatatatgctgagtttttatttgaatcactctatgtttttggaatagaaaaaaatcttaaatacaggaacagagtttttatgtgaaaactgctagggggaaaaaaaaataaaaactgctagggggaaaaaaagcaaaaacagttgctttgcattaataaaaacataaagcctccttttttattatttgtgatacagcaccaatttatcttacataaattaaactcatataactaatagtaatataggctagcttgcattaattttttatatgcattgcactatggtagaagtatttaaaaaagagaaatattcaaagatggagttactagcctgaagaatacaggggaactctatgtggagatctaattcttgaagtcttatacctgtaaggtggcagaaaataggggaggctgaaagtcagtgaaccccaacttcagtttccacaatgtacaacttacatattgtatggctcaaaaatctctggagcagcactttctttgcctataaaatgaaactattgaatcaaatgatccctaaggtcacttctaagctttatgaatatatagattaaaacttagaaataagaatcctaggaaagatataatcacaatacccaaaactaagtagaaatcttaaagagcaaatagtttcaaatcatttccaactatgtatccttatatgatatatgatgattactgatgtggttattatctattatttgcatgagagagtttggaggaacatctgacattggggaacaccaactctgaaaataagggaaataagatagtcttttgggaattacactgttaaactgacatgctcaagagccaagaaatacaaagtcaactaaaagagagcaagtgactctcatgccagcaggactagaatgtcactttttgaatgtttcaatatacccaaagcatgaacgtgttgaacagtagtggaattaatcagccttggaagaatagaaaaagaagagtttgtgcacaaatgatagcagagctcttgcaagcagagtccaatgggaagtgaggctgagtgatttaggtatttccatatcaatagcaagaccactgtgagctgaatacatcaggttatcttaccctgatgctattagacagtccattcattcaactccccttgttctgacttcctgctcaccaagctaccttccgaccataatctagcctttcatgcatgtcttcctactgagagaaagtacactgaggatatccactttgaataaatatctcctgttcctaaagcagtgattttttgtggagaatcaatatgggtttctgattatgatttggcttcccatgtgctggatcacagggaagagattgtgccagtgtgactattctaatctagatattgtttcttatggtaaattaataaatacatgccctagtctcatatgccatttagaacataaatcagcacttagggcaggaaaaagccatggatgccaagaaatgtctggtccttcaaagcagagggtcaaatttacagatggggcagttaataaaagcgctacctagtgagttcttaccttcatcaagctaacctttccttacatgacactctattcctcaacctataataaatattcaatttctttttttcattcccacatgaatgcaagattcagaaaggcaaaggcttggttgccttcatcactctttgtctagtgcttagtaccctgcctgaaacctagaagatgccattaaatatatgtggaataatgaagcttattcacactagctaccatttcagtctttcaacttcattgctatagtaattttaagcaagtaaccacaattcacattccagtaaaatgatcaggtcatttcagcctgagtaccttaattctcaaatcctacacctcaagaattcattgaattatgattttccctaccaaattttttctcctctcttatttttaaaaatgaatcatctgactgggcacggtggctcatgcctgtaatcccagcactttgggaggccaagaagggtggataacttgaggtcaggagttcgagaccagcctggccaacatggtgaagccccatctctactaaaaatacaaaaattagcctggcgtggtggcacgtgcctgtaatcctagctactggggtggctgaggcacgagaattgcttgaacctgggagatggaggttgcagtgaggcgagatggtgccactgcactccagcctgggcaacagagcgagactctgtctcgaaaaaaattaatcatccacccatatcctttgtcatatctctatttttccttagtcaaccatttttctttatatcttaaatctcttagtctctatagaactttctccttagtttacatgctcaagtatcttgtaaactcacaaaataattccctgcatgtgaatattattttaatcccttctctcttttccaaagccttcaatctctgaaacacagctcttccccaaggctggatggttgtctttattcactcctcactctactctttcctttaatgaagatgttggtcccaaagacccccccaatttcttctctggcccctccattcctcctgaagtcagatttgcatttctaacagcctcctgaaaatctgagagtatgtcacagagatatagctcagaacctcacatatagcgtgtccacagctgccttctttcaaaaactgctcttcgtttcattccctaatttggtaaagaataacatcattttatcatttgcttagtttagaaaatgtgaagattttccctttttacaaagcaccttgaagtcagggcctctatcacactcacagttgtttacggtgctgaacagtgtcttcggtccatcttcaattgattgaattgattaaaagaattgttttaaaattccatttcatttatctgttggatttctgccttctactccttcgcactaatttctatacttgtttctgcctatatatgtatttgttacttttcacagtctgtcatgtatcacgtcacataaaacgttatcttacatccataaagatccattgcccatatatccccctttataaaatagataccatgtgtattttagttacacatgttacaagcctcaaaacacaattttaaaatttgacttaaaaatcataaactatttagaaaaatttcagctactgagcaaagcgcaatatttgatttgtagtttgatgccaacaaagttaattgtgtactaaaactaacaagcaaatttaaaaaatactcttcagaatacgataacagaatcctgagtctctacaatataaaaatgacaatatcaaggtaaagtccttaataaatgcacatacaaagatttcggaaaatatgactcattcttaacagaaaaacaagcaaccaaaatcagtcctgtagtaactcacattttggaactagcatacaggattttaaagcagttcttataaacatgcttaatgatgggaatgaaaatatgctcagaataaaataaaagatataaaattttagccattatttcttcaaatattttttctgaccctttctgtctttcctcttcttttgggattgcaattacatagatattacaccttttgatattgtcctacagattcctgaaataatggtcatttttatattttaattatttctgttcagattgaatgctttgcattagtctcttttcatgttcaatgacttgtttctctgccatcttcaatctgctattgtgttcagtaattttttttggatattacggttgtagttccagaattttaatttctcttatagtttctactactctgctaaaattttctaaatatgccacatacacagtagctcaaatccccatttgtttttttaattcttaattctgctgcttagagttttttctgtgcatgtgggtataatttggggatatttctctatagctgtctcctttttcttttgtattcttcccttacttctcaacacctgtagtttccccaaactctatcctcttcttctggctggaaactctgcatgttttatacactacatgcagcattcccttcttgtaagtgtcatctcctccactttctgcctgtgtttgttccctgttcaatgccttcaggctttttgcatttcacctaaagtttatagttgttatttgcaggaagtgttggtctggcagtagctcacttggccatatgagaagctgaaatctattgataattttttaatttaaagtattttatactacttttgttttgttcttattatttttttcttttttctttttcttttctttcttttttttttttttttttttttttttttttttttttttttttttttttttttttgtgagctctgtcacccaccctggagtgcagtggtgcgatctcggctcactgaaagctccgcctcccaggttcacgccattctcctgcctcagcctcccgagtagctgggactacagccgcccgccaccacgcccggctaattttttgtatttttagtagagacggggtttcaccctgttagccaggatggtcttgatctcctgacctcgtgatctacccgcctcggcctcccaaatgttcttattatttctataatatattctctgctgccatctttctgggtaaaacttttcttactccatgttgaaatttattgaagccccttgcttgccatcccgcatagcactgatagtgctatgcatacatagctctgtatcttgacatatgcgtggttatcctatttcctaaagattgtataaaagaatgactccagtcatgatatgcccttcctcagaagtgttcaacagctctctgcttcctaaacaataaagtcccagaaatgtgttataatggaagaagacagcctttggagccaggttagtttgagttcaagatctgtcactgaccagctttataaacttaggcaagatgtttatctgaatattagttttattatttgttaaatagggagaataatatctgtctcaaagaatcattgtaagaattgatagataagttacaaatagttgctcttttagggcttagtacttagtgctcagcaactggtagctgttttaaaataagggacataaaaacaacagctctttctccgagattcaaagtcttccttcatctggttccaaatcagttttctatctattctcgcatttttcttattcatcaacaccattcaaatcacactgttctctaaaacccatgcatgtctcatgcttgcccatgacaatggccttgctcaaatcattctttctttttcttgtttctgcttgatgaatttctaaatattcctcaaggaccagcttaaatagcatatccacaaagaatccttctatgatcttccttccttgtaaaattctttagcaaagttttacctgtttatgcatctatcaggttccagctcatattatggtatttcctaggcatacattagctgccttatttgctgaattatcagctccttcagtgcaaggactcactcatatccaatatgcttgctgtatgaatggacaaatacactgcttataaaaatcgtgactgggattatgaattctaaaaccttactgtggtcagacaaatagttactaccatagctctctatgatttgagtattacgtattagaagcattgtatagaggtaacatattaattaaaattagtttgataaaatattatttttttcatttttataactaggaataattcaaataaccagttgaatctagaccgtcaaagatagaattctaagggatacctgggcttgcttaaggaacagtttaatttagacagctttggagtgagaaaggcaggtgaagcaattgttttttgcagttgcacaaatgaatacaaaagcgatattttattcaaaaataaacgctctgtttaatacaatgcaatttctgtgcaaatttataatagcaatagcaactgttctaaaatcactaattctataataatttttagttaaccactctggtagtaagcttatttataccttattttgaattacttgaataaagaacaaattctggctgggcgtggtggctcacacctgtaatcccagcactttgggaggctgagccgggtggatcacctgaggtcaggagttcaagaccagcctggccaaaagggtgaaaccccatctctactaaaaatacagaaattagctgggcatggtggtgggtgcctgtaatcccacttactcaggaggctgaggcaggagaatcgcttgaaccagggaggcggaggttgcagtgagccaagattgtgccattgtactgcaacctaggtgacaagagtgaaactctgtctcaaaaataaataaataaataaataaaaattctgttttgcatttttctacaaatgactttcttacattcatatttagatacctgaaagttcctgctagtatagtttgctttgtaaggttgttctccaaatgaaaagagccattacatctaaaatcctcttaatgatggacctaaattttgaatggaacaatatatgctacagttctaaaagacaaagatatttagcaggagaaacttaccggcaatgagaaccatattcatagattattttaatgcctttatgagtgagatgaaaaatagttaatggaaagatagttttgagattgtggcatgtcaagaaggtatctcattaaatatggaaggaggcagacataaaagaggttcatatgttatattcacaaaccatttcttctcaatagtttgttttggcattattaacatgataatcctcttctgggccaggtgtttctgtgtaaatgagttttttatataagacaccagtttcctttggatgaatttaaaataagacactaaatctaaggtttccacaaaattgaaaaaaaaaatcactctcctcccaaaagttcctggaaacatttccacattaatcatcatatttaaggaagagaattacattacataattagaacatgaagaccaaattattttcaatttgtttcattacctaagaatcaaagagacataataggtatgtgatttcagggggaaaaaatgcatttccttagctttgcaaagatgctcagcctatgtcatggaagcatgatagttaaaatggaaaaggaagttttctattaaatatttttctatgatccttggaggccaataggattacttggagccggtaggtaaaggaatggctttcactaattctgagagatatcacattcctaagtctcaaatatatttgttgaaaaactataaaataataaaatattttattttaacagatggcctctgaaacaaatttaatagatattaaagcattcagtcctttgacctggcaatttcatttcacttgaagaaaaaacaaaagttataaaacaagtatttgtgctcagaaactagaatacttacatgtttgtaaagtcctgcccttttacagagcccagttctctgaaaagccactactctggtgatgacagcatcatagagatgctaagatcatgacaaatgatttggctaggggaacaaggaatctttgaattataccttctacacttgccatataaaaataattagtaatgtaatcattacaaaaatatgtaatgattatcagtgtctcctatttccttttagatgaaaaactatctttctgttagaactagaaatcagtgtgacatcactgaagaacacatggctatggagttagacttgattttaaattttagctctgccgcttatttgcaatgtagccttacatttcttaatatctttgtgccatgggttcctcacctgcttgttgtgaggattaaataagacagtgcctggtacctatcaggtactcaaatacaacatgttaaattagtaaattatgttttaaagctacctggctcattatagatgcctgtaaatatcagagtcctttccctttgatgtaactgacatagaacagaaacagatgcacagttccatagacccagatgatttctgtagctttctgatttttctctggtccatgaggtgtgctttttagataagtattacttctttagtgtttattgcaccatctttactcttcaaatgatgcaggcaaaattcacatacagggtaatcttatttttccaaaaattctaacatacttgtatttttattttggtttacaaacctcatctatgcaagtaatcatagtttatgtattgtgtatgatttttagacaaaacatttgctccattttacaaatgagaaaaactgaagctcacacgatgaacacagctattcaatggcaaggacttcttttatgactctagatacaatgctaacttcaaccatatgctaacttcaaattcccactgttttaggaattaccagagattgtcagaagtggctttcattgttatatgattgtagagtatgagacccaataaatccattacacacaatttaacattggctattaatgtaacactagtacctttcataagctaaggttagggtttaaagattacactgtccgttggcctgtctcatatggaacactaagctttttaacagtgtgtatggtcaggataaatttattagttcctaataaaataacaagctcaaaagcttggaggggttttcacagagtaagaataaatgagcacagcctacccaagctaaaaagatattctcttaactcctgctaaagaaaacttgcaacaatttgccagagggaacaaaaacaagattagaaactgtctccacagaagtagtaaacttcaaaatcttgacacaataaataggcaatacttagggttgctatttaaagtaaaagttgcttttttctctctcactcactacaaatcctgtttgtgtgttagtcctaaacagtgattctcagctttggctgcacattggaatcacctggggacctttaagaacgtagcgaggcctgagtctcattcccagagattctgactcaattggtaaggaatactactgggcagcagcagtttaacaaagctgtttaggtaattctaacatgtatccaaggtagaaaaaccactactctaaggcaatttatttgggactacgctgatggaatttcagcttcataggatactaatatttataaagtatacactgcatttctggaattatactaagtgccttccgtagtgtatcaagacactttgggttaactgtcttggacaaaatgtaatttattgactcttgtaactaaaaagtctgggggatacagcacagctgaattcagtctttcttctctcctactcttggtttcaacattgcctccattctaagactaggtgtcttttcagagtcagaaaataagtcagcaactccagaccctacattctcctcacattcaaatccataaaaggagagctagggtttctttctcagactctggccaaaagtgtcatgtggctctgctcaggtcagagactgtctgtgatccctgagctgggctgaagctgtcatttgtccccaggcctgtccaattacagggtccatgcaccttttaacgcctccaaggaaagattaccagtttgattggaagaaaatgtttctctcccaatagagaatttgacaaatttaactatctctaaataagagttttcttacctttgaaaatctctcccaactctgcagctggaggcacttcctttcctcactgctttggatctagttgtccttccctccccttgcaatacaaccagttttctccaaggcaggccaggcctgtgtcccaggctgggaatctcagtgacaaaaatctatatattccttggttctgaatgtgaataattaatctcacatttaagttttataatgcctaattttctgtgcctgctataacaaattaccatgcactttgtggcttaaaaggacataaactttttctctcacaattctagaggtcagaagttcaaaccaaggtatgtgcagaggcatgatccctctaggactttagggaagaatccttccttgcttcttctagctttgatggctccaagaattcctttagtcttggcacagttccgatctctgcctccatctttgcatggctttctctttgtgtcttctcttcttccggtttttataagaatacttaccactggatgcagaccctatgtgaaaaattcagtgggagagttccctcacaggatatgcgacaggggtgtgactcacctattcatctgcttgcctcagctgctcaaactccttgtaggaggtgcagagaccaggtcaagtgctttggtctccatccccgtagtagtgtctaggggtggatgcctgcagccccagtgttacaatgctctcttagccttgctgtcagcagacagctttaagagttaactagctcagtgggcactctgcctttttgcaagggcagagggccagtgtgacagctttctgtatcccaagttactgcccagcgtctgggaagaattggatcacattcgggcttaaaggatgaatgcgagatattattgagtagtagaggtggctctcagcagggtggatggggagctggaaggggagatggagtgggaaggtggtcttcccccggagttgagccatccagcagccaaactcctctccgacaacccccagctgaaattctatcagcattcagatgtttctcctcttctctctttctctgccgcatcgctctgctgttcatctgcttatctcatctcctcatctgctggcctgctctggagcctggagttcagggtttatatgggtacaggatagggggtgtggtggaccaaaaggcaactttttggtgtgaaaacaggaatgcctgtactcattttgggccacaggtatccaggcttgaggatggggcttttgccgggtaactgccctcttctacccagcatttccctgcctcctgtctgtatcaatctcaccttgagatccttaacttaattacatatgcaaagacccttttttctaagtaaaatcacattcacgggttctgggattcaattatggagataattggggaggcatcattcaacccactgtaatactcattgccctttagtttctgaccattttatcttaaatatattttaagtgatatcattcacctcagaactattctttgactcatcacatgtatgatggggctgcaaaggaaagaccacagtggacatttcatttgtaaagaaaaggaatactaaattatgagagcaggaaactctctatgcatgtgtggcttatcagtagaaaactaaaattaatttcttagggcacaacacctagtattgaacttaaaaatgtaagtatgaaaataaacagaaaagaaaaggcatagttccacagatcttaaagttgtagggaaagatgaccatttgtaataacaagtacagttagttgtagaaaatttgaagatgcaagcatagtatgaaattgtattaaaactctaaattcaagtgacagaaacccaactcaagctttgttaagaacatagcttggttcatgctctggaaagtctaaggaggtgtgttaaattcaggatcagcagaattcaaggatataaacaatgtgcaaccatcaggaatttggtttttcttttcttccttgtcttcctggtttgttttccatgggtactgtttcacgcccagacatgcttcctgatgtagaaggagagatggcagtagatctttgcaggttttcctggcctttggtacattcagtctcaaaaacacagacactcttttctgagattcatttcagtccccagaaatggatcttgactggccctacttgaaatagatcttttcccttttacaaatctctgtgtctaggggaagaatgtactgtgattggttagcttgacatcatgtggaaagatagctcctaagacaaaagtagtattcctgttattagaagaaagaaatggagacaccagacaggtaacaactcatgcccacttacatgctcttaagaaggaagagcttcctgggacccttatgttaagtaaagacatcagtctaagggatcagaagtaatcagtcagcatgcttgcatatagcgaatcccagatgctgaagaaaggaagagaaatgggagggcattttgcttgaataatgatctctgtgaggccaataggatatgagtgcattatttgtccactctagaagaataagagcataaaaaggaacactggggtaagatctgggagattgggaacctccatcaggttctgctatttaccagccaatattacaacttctgagaccctttgtggctttaaggccctaaggattacaccaattaaagtgatggagcatgagttcagttgtaatgtttaaataccagttttcttatgctgtcatgaggtggtgggacagtttgaagtgaaagtatgtgaatttaacaaaagatatcatagataaacatttatttttcaaaatcctaaatgtaaggaagccttccaaattatgaccagaatatgatttattttctgcaccttccccaaaagcaggaaacagaattacactttttaggataagactcttaattctggcaacatgttgttctcaagaagtttaagaacaagattaaatactctaacacaagtctatttgtggtttgtgtttgtcttgaattagagtatgtacctgttaaaattattagaagtttgaatctgaaaaatatcgcttgagcaaatggttataagttatttaaataaaaaataaaatgcatcattgtgttttctcactggttcttttaaatagactaaagtgtctcattttttcttgctaaatttatccaactttctaatcttctagctttagcaaatctagctttcctgcatttatttagttctatactaagataattaaatatttaagctgcatcattcatatatctaaaatactaagtaggaagaacaagtcattttcttgaacatcctcctcaatattgatctgtgtttgccccctgtcttcctgacactagagttttcttcattccatttaagcacttaattacaataattatcaaagaaagaatatgaacataaattgtgaagtgatagttgagtataatttcctttttccctgggacatattttctctacaaaaaaaacaaaaatcttactttcaaacgacataggcagctgtggtatgggaggcttgattacatgtcagtttcttaaataaagtgtctctcactgccacagcaggggagccaggtacccagaggagatgccgctcttcacttatgctgtgactctactgaccagggcaggacaatgcgagagcttatgattcaaaggtgggaaatcatagtcctttgtttcatttttatctggggaaagtcagttgcttaaaatgagagcaggtgggatatagcaattagtatgataataataatagggttagataaaaaccagtggtgcagcaagagtatttttcaaactcttaaatagcttatcttacttcactttttacaatgtaaaaagttattatgaaaggaggagagaagttattttcatgagcacctactttgtgctgaagatgctttatttatttatttatttatttatttattttttggtcttttacagaaaatcttcaaagtgctatgtacattttaaagagaacagtatggttaaataactgggctaaggtcacaaagttagaagtcatcaaatgccagagtcaaacagtgtgtttcgttccaaagcttctactctttctcctctaacaaacaaacatattgtgttcctttaaaaaaattatgaccagtttttgtttttttaaaaattttattattattatactttaagttttagggtacatgtgcacaatatgcaggtttgttacatatgtatacatgtgccatgttggtgtgctgcacccattaactcgtcatttagcattaggtatatctcctaatgctatccctccccactccccacaccccacaacagtccccagggtgaccagttttaatgtatttgtatcaccactttaaaatagaaaactgaatctttctttgcttcttgtatcagtatctaaggaggaagtaattgccatggtctgaacttagtggaaatatagtaagtggggtaaatcaaaggtgaggggccagattcccaaagtcctattcaaacagctttttcctgcatttgtggagtgttgggatcagctttgagttgatgaaattctgaaacttctgacaaaatatgccatcaatgaatcacagagacatgatataatcgtaacaagaagcaggtcctgtgatacctaaactgttattatcagctttatacaatgcagattcatgggccaaaatgcagcattcacacagagaggtatgtaaatccatctatttagtacacatttaaggatgcattcaacatccaggaaatccattatgtgtaatgactcatgctttattaaatgcttcccacatgcaagtagtagtcaaaaagggaattactgatatcaagacaactgaaagccgccctctattattctgtgaaatgcagtattttaaaagtgtgctagatgacgttagtgttgggggtatattcagggccaccacatacacactttggtgcacaaaatgagttctgccccgaagcaccttcctgaaggggtaagtgggggcttaaaaacagacctagttttacttatcaagacctatgttcttattcaaagttgagtcaggccagagcccttccagaggagaatgaagccccttttttgccgtgttatgtgaagatttttaaatttgtattagaaaagtgtaaccactgcatcaactaatgattttattttcctttttaaaattattaaactagaccaggcatggtggctcacaccagtaatcctgacattttgggaggacaaggtgggtggataacttgagtccagatgttggagaccagcctggccatgatggcaaaattccgtctctactaaaaatacaaaaattaggtgggcatgatggtgcgcagctgtaatcccagctactcaggaagctgaggcacgagaatcacttgaacatgggaggcggaggttgcagtgaaccaagatcacatcactgcactccagcctgggtgacagagcaagacacggtctcaaaaaaaaaattaaactacagtgtgattaaatcataagtgtgtttaactatgagaaatgcatttttaaaactactacaagaggtgataaaacaaatcaaggaagaaagtatgcaaataattaaaatttggaaattactggtcctggggaaataccataagctttggagtaagacaaataataggatgttcaagcctgctcctgttgtgctttagcaagtcacttggttgttcagcttcagtgttctctcattctatgtaagaatgttctctccaaaggactgtagtgagaatgaaatgagatgtctatgaagttgtcaacagaccttacttttccatccttcatttttctttgtgcaagtctgaattcttagtcatcctagctggcttccttgacggtgttaactcaaaattctgagttcttgtgggtatcatactcagaaggataccatactggtcctaaggtactcagtcgtcttagttatttcagctttagtgccccatgattttcatctttcctattgcacatcccactcacctcaccacccccacggcgacattccagggagcaggtataaatacacacagtcagtcacactcacatgcattcacaggttcacacacattcacatactcacatacactctcatgtacactcatctgttcacacacattcacataaccactcacgcacaaactcacatgcatttttcacttacattcacatacatacacacgtgttcacacacacattcgcatattcatacattcacactttcacacacatacacatacatgagaaacactgcagccacacagagctactcaccatttcctgtttcccttctgtattcctttgttcattattgtacctttgtccacaattccctcttacatctccttctacttaaatctttccgttcctttaggtttagttaacaaatcaactcccctgttaagtcttacatgatcactcaaccagacatgaccttacctttaagtatttttttttaaatctttcctaaggttgtagatatattctaccctaagatgtaattacttatgttgtttgactaaatatcagactgtaaagtttttgaaggctatgatcatgtcttagttatttcatcccccacaatgattgtcttcattatgttgaagaaatataatcttagttaactttaatgaaatagactctttcaggttccaagcaatggagatgtatttaaaatagttaagtcacttggggatagatgttttagtgatatacaacttattttatctggatttactattgtcaatcaaggcaaaagagaaatctgactggttctgttgatccatctagtataaggtttacattcataatctaattagtaataaacagatatttcatgtcccaaattcagcattcctcaaaagtgggaaatagatatgctgggtccttgaaatattacagatttctctccagttccttccttgggccacttgtttccatacctcttcttcaggtcagtattatttagcttccaggcataaattctgttgagttgtatatctttttataaggaatagcaatataaaataataaacatatctttataaaatagctgtacaaatattactacaaaaaagatatagtatgtgtctatgtgtctgtttctaccccaaggagtgtgagcattctacagatcagctagctcaaaagtaagagggaaagtgtgaatgagctgagtgtgcccagtcgtttttgcacttatccatcaagtcagtcatgcattgtggagttggtggggctaagtgatgggaaagagaaaagcaggaggtatatttctcccatctttttccctgaggaggaatgaaatggaaattctttctcatctctgaaaaacctgaagagtgagaaataagtaccttttcatttcccctcatctattgagtctaagaattaaaccccaggggtataattatcctgcagaggtgaggggattagaagtgaaccaggacagtccttcttccactttcaggtacttctgcaccaaaaacttacttttgcaatgcagttttaggtactttcctagcccaatgattgacagacagtttagctgttgcctttagaaggctctgaaattatttctcttggaatccactagcccccagatttatactcaaaactatttcccatctaaaattaggcccccaaaaaactagtatatcaagattttggaaggaggcccctggggaggaataatttatcgatgcacacaggagaaatattgttgtctctttacgttgaggaagaaaataagtgcttttgagcttaagagaagtaaaactattttagaatacaagttttttattcaattcttttagccactctttgtttatagtttaaatctgatatccaccaaaacattttcccaatgtagagatactataaaaaataatttgctttccagaagcccattttagtcaaaaagaaacgttaaaccaatttaggaaggggcagagctcatatgaccacagtacttttattttaagtgtataaatcctattaacttgacaaatgtcaattgagaagctctactagatacttgtcatatccaagagatacttatgctagtaaacggttgttgaatatatttagactttaggttctatgctggtgtgcacttggccatggaaagtggttgggtagcgaaggactacaaggcccaggatctgaagccaaatcacaatggcactaagttacaggcaggaatacagttggcataggaagaggtattacataggtactgcaattgcatgggaagtgtctggggtgttgagtagagtggagagaagaaggtttaaagtaaagcaggtaagccagtattggtatttagaagtatatacgggcaaataaatccaggctccatacacttcaggattggggagtgaggggaatactgtgataaagttataaagcagagtggctaagaaacaagatctgggcaataatactaatgtcctcagtcaaaggaaggattattcagataaaaaatggctaatcattacacatggtcacaaatctcattaagattcttcagagctttggcactaagaccaaattcatcgtattaaaggtaaggatttcccttttacttctctggtactcaattacttggaaaaggatggtcattaacttctctgtaatacagaatgaaaaagcaatatagagaattatggccatggtaatgagcttaagtcttctcactcactcatagtcttttacttttcccaccagtcctactgtcttagtttgcactgtaaaatagagcagagaaattacataattacctgaattatttagactaaaaaaaagtgattgctatgaattacaggagctctttcaaaatttcctcaacatgaaatatttttactcttttttcttatttttagtgattttagacaggctcatacatctctctttatggaaaatgattaacatggactcaactggggagaaatcaaattatacagttaataaaaactaaaccttcagtccacgcgaagtaacaatgtagcaccagggaaaattaattactgcattttagagtgaaaggagtcagacatgtcaagtttgaatttagccttaggagctacaacaaattttagttcttttgtgactgaatttttatagtacaaaattactcaaaataatgtagccgtattctacaaatgtaactagctttttaaaattttctaatgattaatgcttaaattgcttgaattttttgtaggaatcttttcagattcattgtgtaaatttgagtcattcctttggttctagctgtgaacaatcactgatcggtgaaaaattattaaaattgctccatttcacgagagtgtttaagtgtttttgatacttctaaagagattctcaaagtgccttgatgctgagaatttatatgtaatcattctcaaatacagcatagtgcagtatttaagagctcaaatgagtagttgtcaatggaggcagattactaacaaacaattgggaataaaccagtaatttatagacttaaaattatagtgtatttttctgttattttgtgtgaactagatagactgatatcctgagaagtttacattttcctgtctatttaagtggtactgaataaacctaggcaacaaaaaaattatataatatgtgattgttagtctctgtcttataatcaccagatcattttgaaggaagaggttatacaggtctttgagtgcaggcttctctcttgtaggaccattcagcctttgcttgaacacaagctgaatgaattcactactcagcacaccgctttttctaccagggagcagctctaatgcttggtgactggtctgacttaccgtccagataaagtcctcagcttgactctttggcaaactcccaggagttaactataaaggagtctgatccctcagacttttgatgtctctttaattatgaggatcccacttatttctttcttcaccagacagtccaacataaatgctctcgaggttccccatttaacataatttttagatctcacaactaccccggacacagagtcaggatgtagtttaatcagtgtctgatttcaaataaaaactccgaaagagtctgatcagacaactgtaaaagatcccttaagtaagtgtatgagatttggtatcacacaattccttatgtccactgcaggaaaataggtggttactttattatttcttcattgaggtaggttaacaaaattgacatataaattaaaattatatcacaatatttttctccatgtgatttccaatttcatattggtgataatgacatacgtttaaatagtgtaaattcagatagctaatttgattacagctgtgaacacacatcttaattaaaattattaaggtaattcttttcacaagacttctcaaatcactttctatacgcttaaggcaaggatcatcaatacacaggaaaaacatattgatagataatgatcactttgtatagacaaaatgaaataaaaatgagtaggaaggaagtgtatattttaaataagaaggcataagttatggctaatgctgctgcagtatcagcaccattactgttagagaatgagctgctattttgcccagcacccccatccctaccctcatcttgctaccattgcaacgaaatgattgaattgtttgtttctttcccaatatttgtgccttaaacttctaattctatttttccttatacttcttgagtgaataccccctcctcttaaaagtgttccttaaaactgataatgagtacttttctttgtttcttaacattctttttgtacagtgacctttccaccagtagcctcttggctttgtatgttataaaagctgcaaagagctttcctttggaaacaatccaaatgaaatagatacatatacttaaaagtgttttatttagacttagaagtttatatttgtccccacaaattctaagcagtattgatctatgtccttgccaggctaaaaccagacaggagacaaatcttactttaaaaaattctcttgtaagaataaagtacaactaaaatatctttaaaagcttcttcatccaaatgcatgacaaatgtaactctattgtaaatgcaaggtacaattaattttggcttagaattggaaaactacctaagaggacacatcaaggtcttttatggtgctgggtaggtttctaaagagcattaaatttttttttgaagttaattatgtgaattatgtgcccaccattttctattctagtgcttcttcctaaaagaaattctgcaaaataccaaatatagtgatttggcaatgattgatagggtgacaaagggaatttccttgagaggcaagaaagtacagtgggaagtcagagaataatcgatttgaaatctagtcttatccttaataaaaataacttgatgcagttatatgtgcactctcatcttctgttaaataagaataataatctctacctcctaattttgttgtagcatacactaggtaatgaatacataaattttatttcttttgtagtacacattgcctcaaagttaacaataagttgcagacttataatgaagtaggagatacacttgtaatctttaaaatgaaaagatttatagagattttacaaatttattgctaattagtatttcatttcttctccaattatagccattcttaataactaaaaagtgaccatgaaattcatcatcaataacatcaacacttggttcatctctatcttgttattaccatcttgtggtcatgtttccataaattattctcttccagagaatataataaacatggaaaaggtcataaaactttattagcatctctggaaacaaactgaaccaagagacattttaaactgtgtatcaaaatgagatcaggtttcaattcaattttattgacaagttaaaatctttggagcccagtacccgtgcacaccacattacaactgatggcacctagagcccgaggaccagtcctctgagggcctacctctactaccaccagcaaccttgcttcctccactggtagagtcactgcacaaccatgcatgtgcctcaggctcttgagagccagctttttcagcaacgcttccccagcaaagatatgccacagcctccacaaacagccacagcttaggccacagaagcactttcaaacaccactaacattgattacagccaaagaaatcataaggagattatactactgtgcccacacagaacaaaagccaaagcactctacccaatgaacaccatagatacatctacaggggaaaaaaaaaaaatttcctagaaaaggttctccatacaactggaaaaaataacggtttcaccagatgtgcagatatcaatgtatagacacaagaaacataaacaagcaagtaaacatgatacctccaaagaaacacagccactaacagacctcaagtaaaagaaaatatattgaaatgcctaaaatgtaattcaaaataattatcttaagggaactcagtgagatacatgagaacactgatagacaattaaacaaaattaggcaagcaattcatgatctgactgagaaattcaacagaaatagatctaataataaaaaaccaaacagaaatcatatttgaagatttttgtgaataaaattaaaagtacaattgagcacttcaataatagactagatcaagcaatgaaggaatttttgaacttgaaaaggagtcttttgaaataagccagtcacacacacaaaaaaagaataataaaagcctatgttacatgtgggatacaattaagtaaacaaatatttgcattttgggaattctagaaaaataaaagattggaaaagccatagaaaacctatttaatgaaataataactaaaaattttccaagttttagaagagatatagacatccagatccaagaagctgaatgattcccaaatataatcaacccaaaagtgttctctatgaggtatattataatcaaattctcaaaagccaaagagagaattctaaaaacagcaaaaacaaacaaacaaacaaacaaaattcaagtcacatataagggaatccccttcagactaacaggagatcttttagcagaaattttacaggtcagaagaatagtatgaggtaatatattcaaagtgctgaaagagaaagaaagaaagagaaagaagagagaaagaaaaaagaaaagaaaaagacaaggtaaggaaaggaagaagaggaaggaaggaaggaaagagagaaagaaagagaaaaaagacaaagaaagaaagagaaagaaagagaaagaaagagctagccaagaatactatgcacagcatggctattcttcagaattgaaggttaaagttttactcagagaagcaaaaactgaataattcattaccatcagaccagccatacaaaaaaatgcttaagggagttctttatcttaaagttaaaggataatatctatcattatgaaaacatacaaaagtatataaaactcactggtagaacagatatacaaataagacagagaaaagaatcaaatgatatcactacagaaaaccagcaaatggcaaagataaagaataagagaggaagaaagagtaaagaatatacaaaactaccagaaaacaattaataaatgatgggagtaactcctcacctattaataacaaccttgactgtaaacagtttaggtttcccaattaagagacatagacaagattcaactatctgctgcctacaagaaactaacttcaactgtaaagacacacatagattctaagtgaataaatggaaaaaatacattctatggaaaccaaaagcatgcaggagttgctatatttggacaaaatagacagtaagtaaaaatcataaaatattataaagaaggtcattgtatcataataaaggggtcaattcagcaaaaggacatatcaattataaatagacatgcacccaacaatggagcacccagatacataaagcaaatattattagtgccaaagagagaagtagactccaataaaataatagttggagacttcaaaataccacatttggccttggacagattatcccgatagaaaatcaacaaagaaacattggacttgaactgcactatacagcaaataggcataatagacatttgcaggacatttcatgtaataactacagaatacatattcttctcatcaggacatgaaacattctccaggatagagcatatgttgggccacgaaacaagtctcagcaaatttttaaaaatttaaatcatgtcaagtatcttctcagaccacaatagaataaaactagaaataaataacaaaaaaaaggaactttggaaaccacacatgtccatgaaaactgaacaacattttgctgaatgaccaatgagtcaatgaagaaaaaaaaaatcttgaaacaaatgaaaatggaaacacaacatacaaaaacctatgggttacagaaaacgcaatactaagtagaaagtttatagcaataaatggctatctcaaaagaagagaaagttttcaaataacccatgtacctcgagcatccagggaagcaaggaaaactaaacccaaggttagtaggagaaaagaaatgaagatcagaacagaactaaatgaaataaatacaaaatacaaaagatcaacaaaatgaaaagttgctctcttgagaagaaaaacaaaatcaataatccatgatgcagactaagagaaaaggggagaagacccaaataaataaaattagaaatgaaaaagaagacattacaactgataccacaaaaatacaaaggagacagactattatgaaaaactctatgccaacaaattgaaaaacctagaggaaacagatacagttctagacatatataacctaccaaaattgaacaagaaagaaatagaaaacctaaacagacccataaaaagtaatacgattgatcaataataaagtcacccaacaaagtaaagccaggcttcactgctgaattctaccaaacttttaaagaactaaaaccaattatcaaactatttcacaaaaactgaaaaggaaggaattctttctagctaattatacaaggccagcattaccctggtaccaaaactagaaaatgacacaaaaatatgttcatctatgcatttatgtgcatctggtgaacatggatgcaaacgtcctcaacaaaatactaggaaactgaatataacattacattaaaagataatagatgataatcaagtaagatttatctcagggatgctaggaaatttcaacatatgtagattaataaatgtgatgcattatatcaacagaagtaaggacaagaaccacgcgattctctcagtaggtgcagaaaaagtatctgatcatattcagcatagcttaatgataaaacaactttcaacaaattaggtataaaagaaacataccttgacagaatgaaggcaatataagacaaaactacaaataacatcacacctaattgggaaaagctaaaagcctttcctctaaaaaactgaaacaagatatgaatgcccatttttacctctcttattcaatatagtactaaaatgtctagcaattagataagagaaagaaaaagagggcatccaaattggaaaaaaaggaagtcaaattgtccctctttgcaaataacatttttgtgttattttttatttagaaaataaatttttgcattattttttctttagaaaaacctaaagattccaccacatgtctcttagaataaatttactaaagttacaagatataaaatcaacatacaaaaattagtagtgtttctaaacaacaagaacaaagtaggtaagaaagaaattatgaacacaatccatttaaaatagctacaaaaataaatacctagaaataaattcagccaaaagatgaaagatctctacaatgaaacagtaaaacaccgatttaaaaaattaaagaggacccccaaaaataaaaagacattccatactcatggattggaagaattaatatggctaaaatgaccatcatatccaaagcaatctataaattcaatccaattcctatcaaaatatcaatgacattcttcaaacagcaaaaacaattctaatacttgtatggaaccacaaaagacctcaagtattcaaagcaattctggggaaaacaaacaaactgaaggcatcatactatctaacttaaaaaatatatatgctacagtatagtaaccaaaaccaaaacatagtattggttcaagaactggcacatagaccagtggaacagaatagagaacccagaaaaaaaatccatgtattcacagctgacagatttttgccaaaggttccaagaacatacattggagaaagaatcggctcttcaatacatagtgctgggaaaactggataactgtatgcagaagaatgaaactagacccctctctctcaccatatccaaaaatcaactcaaaatgggtgaaagacttaaatgtaacacctgaaactataaaactattagaaaaacatagggaaaatgtttcatgacataggtcaaggcaaatattttatgggtaagacttcaaatgcacagtcaatgatatcaaaagtagacaaatgggagtatgtcagactaaaagccttctgaacagcaaaggaaacaaccaaaagagtgaagagataaccagtagatgggagaaaatatttgtaaactattcgtacaagagattaataaccaaaatgtacaaagaactcaaatgactcagcaacaacaacaacaacagcaaaaaacatataattcaattaaaagataagcaaagagggccgggcgcggtggctcacgcctgtaatctcagcactttgagagcccaaggtgggtggatcacaaggtcaggagatcgagaccatcctggctaacgtggtgaaaccccatctctaataaaaatacaaaaagccagacgtggtagtggacgcctgtagtcccagctactcgggaggctggggcaggagaatcacttgaacctgggaggtggatgttgcagtgagctgagattgcaccactgcactccagcctgggggcagagtgagactctgtcaaaaaaaaaaaaaaaaaaaaaagataagcaaagaatctgaatagaaactttttaaaagaagatatacaattggcccataagcatatgaaaaaataatcagcaccactaataatcagggaaaagtgaatcaaaaccacaatgaaatatcaccacacccctagttagaatgactattatcaaaaaggtaaaaagtaaatgctggtgaggattcaaagaaaaaggaactcttatacaccattggtgggaagtaaattagtacagccattgtggaaaaaccatgtagtttcctcaaaaaactaaccatagaactaccaacaattcttctactgggtattaccaaaaggaaaggaaattagtatatcaaagagatatctgcacccccatgtttatttcagtactatccacaatagtggagatacagaatcaacctaaatgcctattaaaagattaatagataagaaaatacggtgtatataggctgggagtgcgatggctcatgcctgtaaatcccagcactttgggaggccaacgtgtgtgggagttccagaccagtctgaccaatatggtgaaaccccatctctgctaaacatacaaaaattagccaggcatggtggcgtgtgcctgtagtcccagctactcaggaggctgagacaggagaattgcttgaacccaggaggcagaggttgcagtaagccgagatcacggcactgcattccagcctgggcaacagagtgagactccgtaaagaaaaaaaaaagtatatataatatataccacgaaatactattcagtacaaaaagaatgaaaccttgtcattcatgaaaacatggatgagtttgcagtgaaagttaaatgctacttgttctcactcgtatgtgcgagctgaacaagttgatctcatagaagtggagagtagagttgcaattattagacactgagaagagtcgggagagaaggatagggagaggttggttaatgaattaaaatttacagctagttgggaggaataaattttagtgttctatagcattgcagggtgactttagttaacaatcatttattgtatattttcaaatagctagaagagaggattttgaatgtctccaacacaaaggataaatattgaggtgatggatatgctaatgattctgatttgatacatgaatcaaaatatcactctgtatcctataaacacatacaattactacgtgtcaaccgaaaatagaagcaaaactaatttctggagccaagcacagacactatacgagtcataatttctgactatcgaaaaatgataatgacagtaccaggggtgggtttcctattcagggacaatagtgactggcagtaatggtggggaactattgaggaggacattgccttgtttcttaaatgtctctaagccttcaatatcttcagcatgtctgtgccttcatgctaattaaaaattcacataaatatgcttttaaaattagtaaaattgtggcctcaggtgagttcttaaatggcagtaatatctctggaaatacttaacctgttcattgaaaactgagcctctagagtgaatgcagctaacttttcaaagctcttagggaaaggaacactcacaatatgggaaaagatacctgtggggagggaacaaacaggaaagtgagaaaacagcaggaaaagctctgccaaaaaaggattcagtacattggaaactataaagtcagtgagaagttgatctttcattatcgtaaccagctgagaaaattctgcctctagcatctgctagtaaaggcgtgaaagagagaagactcattttgccaaacttagatcccactcatagctgatgagttctaactttagaggtggaaaataaaattgagattttgagcctggaagttcgatgaactttaacatagcatggagatttgcttattgaattttttcccgtttcctattttttcttttcatttccatccttccctccttccctctcatccttcctttcttctttccttccatctttcttccttgttttccttttttacctttcagtgaattacaaggatcaccttaaaacaaaattctttgtattctagcagcaaactttcttctgcagttgagagttgatatgcacttcttgagaaggaactgtgaacatatcgggtttaacatgttcctgtacccttaagaaaaaagcaactgactaagacaatgttgctattcgtacatataaagaggtaccaggtctaacactgtgaggtttgaaaaggaatggaattaatcaggaaaagctgttgagaaggggtaactcaaagtattaattcaaacgaagagagatacgcagaatgttaataggaagttataaggaggctttcataaaaatgcaatatttgtagcaatactcagaatgcaaaaagaatagaccaatgacagacaacataaaacatttatctggaccaagaaggcagtcgcgataagacttggaaaaaagaaataatggcctttgttggtacatggacatgagaaacctgttttcaggcaagaaataattaaaacatataatagcaatgaactttaaatattttacattatatctttagtgaatctttccacataatcagaagaaatacattttgttgttaaaacactagctttttttttttttttttttttttttttttttttttttttgagacagtgtcttgctctgttgcccaggctggagtgcagtggcaagatctcagctccctgcaacctccgcctcctgggctaaagcgattctcctgcttcagcctcatgagtagctgggactacaggtgtgcaccaccatgccagccttatttattttattttgtatttttagtagagatgggatttcaccactgtggccaggctggtctcaaactcccaaggtgatccacctgccttagcctcccaaagtgctggatttacaggtgtgagccactgcacccagccaaaagattagcttttagaaagacaaataccactggcctttacttatatgtttttagagcaatggttgtaatgttttccatgctcacagaaatattttataaactctttcctgaataactaatgtcaggaaccaagagctggagttaaccctagctatggtgtcatattgaattatgatatataatcaaccagatcccaaagttacccatagttgaagactctaacaaagtaggaacaggagtatatatctgatcgcccttcataatatagtggaatgaatcacacctttgaattttttagtgggtagatataaattttttgtgttctgggctgcatttctataaaggcagctttcattcaacctgttaaataaacatatttgtaattttggttatcttctcaaaaccatactttctcagctgttcttcctcgcatcttgaacaatataatttgctttcactgcttttcatatgctaccaggataactttagcattgggggttttatatgtagaagtggatttgcatagatctatacaagtattaccagaaaaatgctatacttagaatgataaattcaccagcagaaaacaagccatgactaataacaattttaaagaatttttcagggttttctatgagtgagtgtccacatgtagatattggcagtgcaatacagaacagtgctttctgatgataacttaaaatttaatccagtatatgttgattgtaaataaataagagttcatgaaaatacgtgattcttcatgtcaaatacagcctcccccactattccatctcctgcatcctttgctaattacaggatgttattcatcatggattttcctatttctctcagttgtaaagatgaaatgcatatagttttgttaatgtaaatattgatacttcccagggtatgttttgtttgttaaaatttgcttttttcccttaaatgtacttgcttggcattcctctaatgtcatcaacataaatatgttttaaggtaaggagaatgctgacttggtcccattcttaactctgaaaatattaaaagcactgctcctggtcatagtttctgcttctctgtatccttgtagaactcaggagagtagtctgggtataattaaggtcaagcactcagaatttataataatggcatctgtgttaccaacttcctcatgactactattaaatacagcacctgtactggttgcaccacatatctcctgcacagcccacccaatcctacaagagaaggattagttttattgtaataactcttggcttatatttaatggtgcttgtggtctcttactgatcaaaaacctttcaataagcaggatttattgatctggcacttaggtccctcttcaatctagccgcagtttatctttccaatgctattctatactactactaacaaaatcccatctcataagtataaggctacatattgctacttagaaatacaagttgtatatctatagttttgattattgtttcactttacttaaaattgtcttttttcccctggctgtgggtctatctaagcctggctctttcaggttccagctagagttcccaggcaccataccatttgaattcttggacatagattgtccacatcacttattaagtacttatcaaatactttcttatatcggtatattttatttttatacctagtttcccaaaagagacaatagccccatgatgtcatatatgctatcttactatcttatatagattcacatcacatcattatggcctggtaaggtgatttacatatggtataggaattattaatatttgtgtaactaacttgataactctaggcttattgccatttcataaggagtgcatttctagccttttagtaaccacactgcctagaaatgagaagttatccatttttaatattattctaaaagaagaaggtaatagaaaactccagaaatctaagaaaatatttcatatttttaaattgcaactctcacactccatcttcaaatctctgtaatctagcccccattacttactatcataacagttatatgcatgtgtgctttgctcttcaaataccataagctggaaaagtaaattttagctctttattgaaattctgaaatgtcattagtatcattttctcatttacttatcaattctttttttaatcaaatgcttattatttgttgagcaattaggcttcttacattgacctgaatacatacaggccctgtcagaaacaaattttagtgctaataacagctttcatgtaacacatcatcagaccttgttattttgaagaaatgacatgactaaaaatggggtcctttaatctgaactttctgaagatttactaggagagatgaataaataaattaacaccaagattttttatcactatgctgatgagaacatataattatgaaagttttctttagatttaaaagttttatcatgttaacaattctgagtccctttttcatgtttttcctatgaatacatcccgaatgcatccagagtgtaaaagattttgtttgtgcttttcttttcttttttttttttttgagacatagtctcgctcttttgcccaggctggagggtagtggcacgatttcggcttactgaaacctccgcctcccgggttcaagcgattctcctgcctcagccttcggagtagctgggactacaggcatgtggcaccacgcccagctaactttttgtatatttagtagagacggggtttcaccatgttagccaggatggtcttgatctcctgaccttgtgatccgcctgcctcggcccccccaaagtgctgggattatatggcatgagccaccatgcccagcttgtttgtggttttctaccttattttgtgacattgagacttgtggtttgtgtcaaaagtcataattttgagctgaaaattacaaagcatacaggaattaaataacctgctgatatacatggcacagatcacactgaggaattcctgttatatttaaaaggggacttcaagaaaacccttatgttgtctgttttacaagaagaaatttatattttgtagttaaaacattgaatatgtgcacatacacacagagacttcttgtttaaatgtctacaggaaaatagatgaaagtataaaataataccagaaattttccatttaatgatagctggttgaagatatacacttacttatattttatcctaaaataccaacaaattgatgttaaagaattaacagtgagacaagaagtttcagcaatttttagaagattgaaagtagatagaggattggcaagtgagcagaaaggaaaacccaaaaacttatgaacatgcagaggaggattccaaagtacaaatttggcaggtaacatcctctaacaacaggatttggaagtggaaggaatgtgtgaggtagaggaccaaaaactggaataggttgaacaatctgtttaaggaacaggtagcttgccttagcctcttccaatggtctccacatcaggcttctcccccaaacaggcaagcctcttgaggcacaggtcagcatcagcagtttctaaacagaagattaaattaaaatttgcatactgaaaaattaaaaactgcatactatgcagcaagaccaccagctccttcccagttcagccccaaaatgctgtggtttggtgcctaataataagaagacttgcagacccaaagcaaaatcctacagactcctatacatagagcatttggaaggcactgccccatcatcttatgtgagagacaacaaatgaccagcacactaatgtataacaaagcaccaatcaagttttagctcctcctatttaatatgaaaagacaaccagggatcaccagacttttaaggaaggctccaacatgaaagttaaagataagaataaacataatagaaaatctttaagtcatcctcactggctgttcccagtgttgggaattctctttctcatctttgctctgttcactccttcacttcattcactggctgctgttcaaatgtaagatactgagatatcttttcttaccattacatctagaatagtgttacccactgcctcaccctcacccagttcttggtcattctatttatttacttgaatttattttccttattatattaatcactgcacagatattttggtatatttatatatttgttgtccatctcctccattacaaaataaacattcataaggggaaggaatattgtttatagacaataattgtttttaatatttacttatttatttagtgaagatgagtaacttgaataaagcaaaagcaatgtagaaaatataattttaaaactctgataattcagagaactaagaaaacttatagccaagacacaattaaaataagagctatataaaaagaacaattagagaataattagctcttggaagttcaaaacgttaaaaattttaaaatagttcactattagactcgcaagacttggtaaagaaaatctcagagagtaaagagaaatgagaaatatgaacagtgggaaagaaaagataagaaggtgagagatcagtcctggaagtcaactgtctgactaacagaatttcctgtagtaatagaaagagtggaagggaggaaaaaattaaggatataatgcaataatattgtctagactataattaaagggcccatatattgaaaggcccaaagatgctctacaagctaaatgaaaaacagcaacaacaacaacaaaaacacccagttacttcctttagagaatttcagaactgggagctgaatgtatttcctacataaaggaacctcaggctaggtgcagtggctcacacctgtaatcccagcagtttgggaagccgaggcgagtagatcacttgaggccaggagtttgagaccagcctggctaacatggtgaaacctcatctctactaaaaatacaaaaattagccaggtgtggtggtgcatgcctgtaaaccatgatactcaggaggctgaggcagaagaattgcttgaagttgggaggcggaggttgtagtgagctgagatcatgccactgcactccagtctgggtgacagaggaagactccgtctcaaaaaacaaaaacaaaaacaaaaacaaaacaaaaaaagcaagaaacctcaaatatattaaaggaaaccaaaataaggtgtagagtatatatatatgtcttaaaacctaaaaaatacccctagtattttatattattaatgggtatggatatgtaaatatttaggaaaactgtaaaaaaaaagtcacgtgaacactaattctaaaatcatgatagtaattatccctgaagaagaagtgaagaaagtaatatttaggagaagtacagagaaggcatcatttatattgtataaaatattctattaaaaatgacttcagtctgggtgtggtggcttacacctgtaatcctagcactttggaaggctgaggcaggcagaccacttgaggtcaggagttcaagaccagactggccaacataatgaaaccctgtctctactaaaaatagaaaaattagccagacgtgctcacttgaacccaggaggtggagggtctagtaagccaagattgtgccactgcactccagcctgggcgacagagcgagactctgtcaaaaaaaaaaaaaaaaaaaaaaaagacttcaagcaaatatagcctaaggattaatgaaactgggtggtgggtataatgacgttattataatatcctttatactcttcaatggttttggaactatatcattgcttttttaaaaacagatgcaaaataccaaaagaaagaaagaatggaaacaggttacattttttaaaaatgtagggaagcaaaatgatattggacttctcaactgcaaaaacagaaactagaaaataacggagaaatttccacatgattctgagagaaaatcgtatttaaccaagcagtataaatgtgtccatccaaaatatcagtcaattaatataaaaatgtaatgaaagcacattcatcagacttaagaaactagtgactaacatgctctgtaaaacaagagaagaaaccaattaagagaaagacacgagaaatgttaaagagaaattataccaatacttgttaagaatggcaagatggattttatttgaactactgtagtagggaagagagacttcaatattgaactgacatcatctccaagtaaaacaaacaaagaacactttactcaagaccattgcaatgggagagaagaccactgcagaagagagacagactgaactcagctccactgaaaagaaagcagaaggattattaaatgctgacatgaaccagtagggagtacattagtggggaagttggtgaatgtgtttaggccatctgagtttgctaaatgtcacttacctgagttaggctcctactctcctacacagattgaaatagaggtgctatcatttttcacaattacatttcaaagggatatctctcatgtccttgagaaagacattcctgagttgtagaaaatttacatctcaaaaatagggagaaaaaattgataattgcaaaatttctaaagtaaatgctctaagaaaagggaagttagaggcccatattgaggaagaaatctctttaaagtttagtcgagctgataggaacattaaggtcatgttggtcagatccaggaaactgggggttcaacatgcaagagaactgatgatattgggtggaggcctacattaaattatgtgcatcaagttcatggagtgtgatggaagccaaagcctggaggattccaagtcatagttcacctgaaaaagaacaaacaaaaaaggcattaaatgatcctgaagtattggaccatgtagaaatgaatattgaatgagtccttacagttctattggtcaatttgaaaataattagtggtagatatgccacaaagagatgatgaaaatctacccaaaaaatgtgaagaaatcaaaaaaacaaagatagctggaaaatcccaaaatacatggagattaaacaacacattctaaatagcacatgggtcaagaataaatctcaagacaaattgtaaaatattttgaactaaatggaaattaaaatatcactttttaaattttgtagaatgtagtgaaagcactgctttgagggaaatttatagcattgaatgcatattaaaacaatctaaaatcaataagctaaccttccaatttatcactctaggaaaaaaaagagcaaaggaaatccaaactaagcagaaggaaagacctactacaaattagaaaataaatcaataaaattaaaaataagaaatcagtagtgaaaaccaacaaaactataaactgcttatttgaaatgattaataaatcattaggcctttaggctaagaacaaaagagggaagttaagaattactaatattatcaatgaaagcaggaatataactacagatatctggacaagaaaggataataatggtatattgttaacaattctatatctacaaatttaacaacaaagataaaatggaacaatttttgaaagatgcagtctaaaaaaacttgtagaaatagacaaattgaataggcttttatctattaaaaaattgaatcagcaattattaactttttaaagcagaaagcaccagacctagataggttcactggtggattctaccaaacacgtaaagaagacattataccaattctctaccatctttttcagaagatagaagcagagacactaacttcgtaacacagtctatgatgctagcatcaccgtaataccaaaaccagacaaaggcagcacaaaaaaagaaaactgtagtccaatatccctcatgaacacagatgcaaagactttcaacatataacagtcagtatagcaaattgaatcagagaatgtataaaaaaaattatacaccacaacaaactgtgatttgtcccaggtatgcaaagctggttcaaaattcatgtaatacatcacatccacaaactaaagaagaaaaattacaatatctatagatgtacatcgtatcaatagatgtacctcacatcagtagatgtataaaaagcatttggcaaaatccagcatccattcatgataaaaacaaacaaaaaaactctcagtaaactaagacagagaaacttcctccactggataaagagtacctataaaaaaatctatagctaacatcctaacagtgagaactagaagcttttctactaagatcaggaacaaagcagggttattccctctcactacacctcttaatattttactggaagttgtagctaacacaagacaagagaaggaaataaagttacacagattaggaaggaagagataaaactatttttgctcacagataaaatgattgtctgtgtagaaaatctgcaggtattggcccccaaaatactcctgtagctagtaagcagttacagcaaagtttcagggtacaaggttaatatgcaaaagccaattggtttcctttgtactaccagtaaacagaatttgaaatttaaaatacaataccatttatattaccacacacacacaaaaggaaatatataggtatcaatttgtcttcaactattttgtgctgctgtaacaaaatactacagactaagtaatatataattttataatttataattgtgcatttaggctgcatcataatatggcaaaaggtatcatatggcagaaaggcaaaaagacagggagatatatgaggggaaagagaacaaaaagaaggccaaactcacccttctgtagcaaacccactcccatggtggcaacattagctcattcatgacagtggagcaacgcatggcctaatcacctcttgttatgccccacctcccaacactgttgcactgggtattaaattcacatgcttttggggtgacatactcaaaccatagcacttctggtccgccagaatctatgttcacctcacatgcaaaatatattcatttgatttcaataacaccaatgtcttaacttgttctagcaccaactcaaaagtccaaagtcaagagattcatctaaatcagatatggatgagactcaaagcacaattcttcctgaggcaaattccctctagcttgagcctatgaaatcaaaacaagttatctatttccaaaatacaatggtgggacagacataaggtagacattcccattccaaaagggcgaaataggtaagaaaagaggggtgacttgtctcaataaagtccaaaacccaatagggcaaacaacattaaatcttaaagctggagaataatctctgttttgaccctatgtcccatctttttagtacactgaggtaggagttaagccgccaaggctttaggcagccccacctctattgctttgctgggctcagcctgtatagcagctctcacaggatagggtgtcatgactacagctctccgggtggttgttgcagactggtagctctgcagttctgaggtcttggggatggccccactactgtggctccatcagaccttgccctagggaggactctctgcagtagcctcactacctgtattccactaatcattgcttagtgactctgccccgaagcaggtttctgcctgggccccaggctgcctaatgtattctttgattagtggatgctgccataactccatagctcatgaacttggcacgtctgcagagtcagcaccacataaatgcctcaaggcttactgcttgagccctcaggaacagtggcccgagctgtacttgaggctgcttaagccacagctgtgggagacaaggagacaagcttcttgaatgtggggaacagagttataaacacagggaacagaggcccaaagtggccctagtcaaggagcttgtggagggcatcctagacctgtctcccaaaatcattctgccctcctacagctctgggtctatgataagagggaaagtctcaaagatcacagaaatgccttcagaatcattttccattatcttgatgaataacacctgtctttcttctagccatactgatctccttatcaaatgtgtacttggccatacccttggatttctttcctaaaaaaggtcttttattctgtaccatatggtcaaggctgaaactcctttaaatccctaagtgtgtttccctttaaatcattttatttaaatctagttttgtctttaaataatttatttcttcttggattttactgtatgaagttaaaagaagccacacaactcctgtaatattttgcttagaaatttcttctgccagatatcctggatcatcactcttaaattccatcttccataaagccctggggcatggatacaattcagcaaagttctctgccactttatatcaaggatggcctttactccagtttccaaaaagatgtttcccatctccatctgagacctcatcagaatggcctctactgcccatatttctaccagcattcctatcataaccacttaagtaatctatatgaagtttcagactttccctgtagctctccttcttctgagttttcaccagaatcgtctgtaatcctccatttatagcaatacaagctttttctagcattcatttcaaaactgtttcagcctctactcattacctagctctcaatcgtttccacattttcgggtattcgttatagtaccactcaattcctctggtaccagttttctatcttagtttgttttgggctactatgacaaaacaccccagactgggtaatttacaataaacaagaatttattttctcacaattctggaggctgggcactctaaaatcaaggggccggcatccatcaaagtccttcttgttgtgttataatatggcagaaggcatcaccaggtagaagggcacagagagtgcaagagaggaagtgaaaaaaaggccagtctcacccttttataacaaacccacttgcatgataatgaagccccacacactccagtcatagcagcattagtccattggtgagcctggagtcctcatgacctaatcatgtctcattaggcttcacttcccaacactattgctttgggggatgtttcctacacacaattttgggggatacattcaaactacagcaaaatctagcaaaatatgtacaagatctatatgaggaaaattgcaaacttcttttaaaaggaatcaaataaataatcgtgtgaaattcaatgtttatggatagaaagactcaagattttcaagatttcagttaatcccagcttgatcgatagattcatcacaatccagcaagtaattttatggatgttggcaaactgattctaaagtatatagagagaggtgaaagatccagaatagacgaaactatattgaaggaaaacgataaaatttgaggaccaataacacctaacctcaagagttaatataaagttacagtaattaaaacagtgtggtattggcaaaagaagagacaaatagatcaatggaacagaatagagaacctagaagtccacccacacaaatatagtcaactgttttttgcaagagaggaaaggcaatgcaaaggggaagacagtcctttcaataaatggtgctggaataattgcacatccacatgcaaaaaaaaaaaaaaaaaaaaaaaatctagacacaaaccttgtgtccttgacaaaaattaactcaaaatgggtcaaagacctaaatgtaaaatgcaaaactgtaaaactcctagaaaatgacacaggagaaaatctagatgaacttggatttggcaatgacttttaaaatatgacaccaaaggcatgatccatgaaaaaaagcattaacaagctgtccttagttaaaatttaaaaacttctttctgaaagtattatcaaaagaatgaaaagacaagccatagactggtagaaaatattgcaaaagacatatatgataaaagactaccaggtatggtattttaatctatattttaacaatataatttttatctttttgagtctgaaataggcaaagaactcttaaaactcaatgatgaaaagcaaacaacccaatttaaaaatgagccaaagatcttagcagacatctcactgtagaagataaacagatggcaaataagtatatgaaaatagtctcaacatcgtatgtcatcagggaaatgcaaattttgtaatattcatacaaccaaattttagagaaaattatacagaatggtgaggaatagaaagggaatatttctaaaaatgttacttcacacatttcatactagaaataggagataatacttaaatgataaatgaataatgtcaacatgagcatgatatttacaaaacaaaagtaaatacttaaagaaacagttataaaaaatgaaagtggttgcctttcaatagggtactatgaaatggaaagaaccgtggacaagaaatgctatttttggctacagctttatggtaaatgtaattatttaaaatatatgtagttaattgattttctaagtaataaataatatagaaagcatataaataaatgtatgaagtaataaaatattttacttgtcatccagacaataggttcaaatgacctttagaaatctcaaacgtaagttaaaagagaaaataccaaaaaagtaaataaatttaacaaaagagaaaacttagaactgaccctctggagaaatgaaaaataaaataaaaaagagagagagaaattagagtttggtgttaccatttggattatgcctgctcccctaaacttatgtttatggcctaacccccagtacctcagaatgtgacttcatgtggaaaaaggatcatttcagatgtgactacttaatgaggtcattagagtgggctctaggccaatacaactggaggccttatattttaaaaacagaaatttggatacagcttggcacccggggaagttgctatgtggaatgaaggcagagattagggtgatggttctacaagccacagaatgccaaatattaccagcacaccatcagaggcatgcaatggatccttcttcacagaaagccccttgaaagaaccttacttacaccaggatcttagaattttggcctctagaactgtgagaaaataagtttcttcttaagccaccctatttgtggtactttgttatggcagccctagcaaactaatatagttactgtattagaaagaggagctaaagatggctcagatgtctgttaaatccagcataattcgctgccagtattcttgaaattatggaagaaaaatcaattaacgataccatccaatatattataaatattttatatgaaatatttatataattgttaattcctcttaagaaattagtattaggaaagaagagattgtctttcttggggccatggtattcttcattcttttagatgatgatagctgtgttcccattgtgtctccattattaccaacaagtcagttctgaattgagtatccaagtgaggcacttactcatgtcttggtttcctggctcactagctatcatctccatttttttggttcttattttttacccttgttttaatggtatatgtttgctttattatgacaagactcttttttttggcagtagttaggatataaataattagtaaataaatgatcacttctgattaccatagctctagtggccaacaaactcaactaacatcaatgctttttaaaaacttgtctctgcagctatggtgactaactgtcctggtgtgcttgggactaaggggcttccaaggacaagggactttcattgcaaaattcatgacagtcccgggcataatgggatagttacctatctgaaccacttctgtgtctaacagctcacaagcatgttttcactgtcactgctttgggctctggtccctgtttgcaattatgattacccctaataaactcatacatagttgagttgattattgaatcatcttgctttgtatgataaattttgcttcaaccaatgagaagcaataatgcaaataaccaagttctaagtctcagaaaatcctccttaccattgtttcaaatggaaacttgtggttggtcttgacttcctgtgagagagggaggtttaccgagaccttgagctatggatattagatatcaccagggattagggaactggattgtgttcttgctgggctgtccaagcctggctgccctcatggcttagtctcttgttggttgcccttttgaatggttttctcttttctcttaggccctggggatttatccagtttgctttggtaaccaaacattaaatgatcatgattttgagaaaaataacataaaaaacattcctttctcatgatttcccccacagggctccccatggacctgattcttctgctaccattggataaaataaatagcagatctcctacttttgtggttacttccagataataacaagttatccaaagtcactatagtttccaaagaagtctgtgttcagaaattaatgtctgacattataataaaaaatccaaattgtattcaaaattaaacttcttccttcctgtagggaaagttgtatgctttgtgtttcacttcgatctttactaactaaccccatccctatctcacaactattatctgagatctcagaccccaccatgcttggagtatagcaatggagaggagataagggagcaggagagatatctaggctaacagaatttggtggctaatgagattgaaaagtgtctcgagacacttttctggggttttcagagaccctgcattgcattaaatatctcatctgtaggtacatgatttagttggtgtctcttccatacttactatattttaacactccctccctcatgccctaagaataggtgatggtaaagattcagccatcacccccctacccaccagtcttcttagaaatccttggaagaaaacccacgttagctctctctcatgacagcccacatctgctaccaaggatcattactttagatccatgatatgtagcagtgcactttcctttctcatactgcctaatttttgtttgaccacttctcaggtagctctagccacagactctattttgagatttatcaggcctgagtcagacactagctgctgtgtttcctaggttccaaagatactttgaagcttttctcaacaggcttgcaaaaaaaagagatcacccctaccccacccaaccaccaccatggagatgatgacattcatagcacacctttttccaaagaagttctacttgcaatctccaaattccctggccatttcaactcaacctttccatatgttcaatgtgagtgtgtggctccacgtcacaaacgatgacttaagacgttatctgtacagggtctgcctagtccatcagaacctcactttggagtgagtagttggcacctattatcttgtggccataactatcactgaaactgatagagtgcaatttcccataactgacctttttttcttagaacttatcttccttcatgacttgctgaataataaaatgcttttgatgcatttcctttagccgttctttccctggaagacaacatttgcccatgtgccattgatagctccaagttggcataggtgattgcaagctctctgagtgcaaaattctacttttattccatttacagctgggtatcacctaacatggtgaacttcatctaaatagttgatttattatctccaccctacaagaatttgataataatatttcctaaaaaatatttacttcttaattcttaagaaacattatgaccaatttcacaaaaagtgataagattgaagagacactgatttgcccaaataacaggaagagggggaagcaagtaatattatgttttcttaagtaagggtcttacaaattcaagcattagccacaatattatgttaaatgttgcagaattgaagtatagctttaagatttaaaatgtgtgaaaagtaaacattttgagagaaaaaaataaagcagatttagaatagcatgaacttcacttgataaaagtttaaatccttccctttgtaatgggaaagacccttgaaaggtaaagactcttcagtgttacaatgaatataaatcattagtaatataaatcactaggaatttctccaataaaataatttgatctatattattatagtcaggaaaaaccttcataagtaggatgaatccatagatgcataattaatttagctgtgtcctcgcttcctgtaaaatacagcatggggtaggaaaaaaaaaacaaacaaacccacatttccaaatgggaaagtcaaagcaagtcagtcccaagtaagctgactaacatttataaagtaattctcatccttgtaaattgccttcttgcaggaaacagaccttatcctgacttttaatatatcaatgcaccgatcttggtggatggagaatggaccaggatgtacggtgacgtcagtgacacctgccccagactgggccccagaagaccatcgctacatcacggtctcagggtgtttgctggagtaccagtacatagaagtggctcatagttccctccagattgtcctcgcagtaagtgttggcagccaaccgctccttctagtgcctctggggttgttttatttctgtgcgaactcagtgcacacaaatggaatctgtgggtaaagtgtggcctttttgctttttcctcattaatgcgacttttaacaggaaatcctcaggttaaactaaaccatcctctggacttagtgtgctgattttcttcgacaattagtaaataccctttgttatcatcagcattttacataggaaatccaatcagtcaagatgtgattacgtgacttttggtagacttttccaaggattctgaagggatgatcagagatttttttcataacgttctacagtactcaaaattataagatttccataagtgttttctcttttagtgcttcttttggctgtgctgctagccctgggatttctctttttcatttgccctatctccttcttccttcctagatttctcccaggcaccatccatcacctttaatctcccactttttttccagaaaaaatcacattttctatagattctaattctaagacattcatgcccccatttttcatagtactgtaacaataaaaaaaaaaaaaaacctccttctaccaggaggcagtagcacttacaaataacatatgtgtacaacatatgcctattttatataaaatacatgatttaacattgtattactatgacaaagagataaattaaaacacctctttctcaagaaggccaactgcataatatcatgagatgtataaagttaaggcaactttatgacacatgaatccatttattcattacagatcttaaatgcagaactgcatagatttttcttagattctatgtggatgtgcaattgatgtgcatagtattaaaattgttagcaacaaatgatgcaagcagaatctgctttttacctctttagttaattattttggaaatgatattgactcacagttcttggataacaataaataatagtttctgggtagagtggcatacaattcagagaaacataaaattcttctggaattaaaaaaaaaaactatgtgagtgtgtcagtgttagatgatataactaatatatccttgttatatttttaatggaatgtgtgtgcttatgtgtgtgtgtgtgtgttgtgatagactaaggaagctaagtatgctatgttagtaaacacttccaaattctctgtaaataaaagtcatgaaggtttcttcttgtgtgtcagcaggaggctccactgatcactgtcagtaaggaaacaaggctagttgagtagccagtatctccatcatcatgggttactgtgccagaaagtaataatagctgtggagggtctacatgggcacacacatgcttctgcttgggaggaaggctcattgttcacagttcattgtgcggaattggtcacacagtcccacccaatcacagaatggacagtaaagaggaagggctgtttatttggaaatcagcataaatgatgtccagaacatttgaattatgttctttgctaaaacactaagtaatatcccttgaatatgttcaaccatagacactccttccaattaacaaactcttctgtaatagttttaaatctaaaagtgcttactttgcttatcctgaagtaaaaataagttagacttgacaggatggaagtagccatttcattctttaaaatccatttaaatcaagtaatcattatcacatgagaaaagtgaaatatttctgtgatttggggtcagataaaatatctttatatatgtattaaaaggaggttttaaacaaaatattccttctgtagaactgcctatctttactgtacccacaaaattttggaaaatttccacctatgttttaaggatgaagtgaagatacagtttatgtgcatggatatttatatatgactatttatagagttttttgaattagtttatgtgtgtatgtgtgcgtaaaatagattcacagatttattaaatgccacataaaatgctgacacatagggaatgtgctaaaaaaatacatttggacgtgggggcatatgttgaagttgacatacatacccaaagaaaagataattttccttaagtagaaaccatctgtaacagcaaggtggctagagtgcaaagaagatggatgggttattgctaagaacagatgtgaccaatatttcatgctactggctcttgtttctcctgtctgcattccccccagtggagtgaaggaatagtttgagtaaaccatcctaggatgtgacatcttcacctctaccttttccacctgttctttccaggggtgtactacttttgcaatgttgactgtggaacaccagagttagcaatggcacagccacggcattacttggagaaatttcaacacattttctacttttgagcttgctcttatctagccagctttgggttgaatgtgtctgctatacagaaaacttagcaaatttgaactcgagttttataatgcaaatcaaaaaggcttatctttaacaacttgctctgcaaacaaaatttcctatcttcattctgatcactgatgtaatgattaattgatgaaatagtgtcttaaatctctgtccctccccttttgtgttacccagatcatctccttgacaatcaaatgttccattaaatcagtctagtggaaaattcctcagtgcttgtctccttctggcatctagagaagcaaaggtgtcaggacctctgaccttgaggctgtcacagtcaaatatacagcaacgttccccaaagcacaaacgaggtgcaaacaggcacatttgggggatgtggtagacaaagaatatggcttatgcagtttaaggcataatcttggcttcttagctccatgcagttttgtaaagtcagctgaactctcactcttctcactgttttcatccaagtctttgaaactgccctctcttccagcatatctggcttagatctgctttcataaactgctgctttctcagccactgctcttgattaactccaaatctctccagctctttgtctccaccctcattcagcctttctttcacagattcctgaaccctggcaagcctgtcaccctgttgttcggttttctgccaatcaactcctggctgattctgaaattagcattcacaaagcccacatttgcatcacacatacataagatatctccaatctacagccaaaggaagacaagtataatatccatataattgggacgaggggctattaatcacacagcttccagccgtgcagaaaagactgccagaacaccataatgatgagccaggtgtgatatttcgagctttctccttctccagccatattttcttctggttagcatcagatagcacattcaaaaagaatacagatgtgcacagatttaataaaaccaaaaattaaaaaaatccacattttcaaaatagataaaataaatgtatgtggggagagccaaggaggagatcaattggggagatattattgttcacgttacagaaaaattaatcggatcctttcaatgtgtgattggaacagcatggattataaaatatgttcacatgaattaaatcttttgattgtgtaacagtcctctgagggcagcagaataggttaaaagctcttcctaagatattttagctaataaatagggacaatgaacatgctgtcatagcaaggttgggaaatagtcttcaatctgaatgccagcagcagctgatggataatggattcccggagtgtaaaaattcagggttcttgagcagcaaaggatgccatgattgattagctatgtctgccacaggtgaggggaatgaagagggatgtgcctcacatttattatgcacatattatactttacttcctgtgataaaaacaatgaacagggagtgtgttttacaaacaaatgtgcagaaagaataatttatatatatatatatatgtaagctttctgttttcccacagccattagtgttgacttagaaacagtgtacaaatgagcagggaagccatggatgacattagaaaaggttctaatatctggtacctggttcatagctaaaaatagtttaaagtcaagttctccttcggttatatctattccctattcagaaaactctctactttgtagagtgcatgaaatggtaaaaattatttttcaacagattgaggaaaaaaatgtagataaaatgcatacattggggtcagtaaagtcacagatgtgtttagttatgttgttaataatttatgtttgccatttgtctggctaagacttactgaggataccgttagtgaagaagttttccaaactttgaaactctttatccaagtggacttgaggttgtgttgggaatggcacatgggtgtttctttggatgtagctgatatgtatgttgtatgcatgggagtggccttattgtgcatgttgctgtttgatgcctcttttaatctggaaacattcacaaagattttatttttaagatttgaattctgacttccacgtcacctagaatattgccattcacgttttacatgttaaatctaagttgtgaacttgtgtagtttgaaagggatgagtgggaagtgatatgagctgatactagctactcagcagtcagaagtggtgtggttgccatggccatgggactatcctttgttacatttatttgaattaaaaaataaaacagtattttaaaggaaaaattagtttgatttgaattgattcacagtagataatgatttcatcatttaaaagttatagattttggccaggtgtggtggctcacgcctgtaatcccagcagtttgggaggccgaggccactggatcacgaggtcaggagttcgagaccagcctgatcaacatggtgaaacccatctctactaaaaatacacacacaaaaaaatagccaggtgtggtggtgcacacctgtaatccccgctactcaggaggctaaggcaggagaatcgcttgaaactgggaggtggaggttgcagtgagccgagatcatgctactgcactccaacctgggctacagagcaagactccatctcaaaaaaaaaaaagttacatattatgccatttttcaaaaactaaattagccagatctgcagcttcacagtttgacaaaaaatatacccaaaacgcatgacttcttaaacagatagaaaatattatttcaaaaaacatatattgaaattaaataacatttcagtatttcccaaactgttattatatacatcagtttgaactaggtgactataggagaaagaagtaggaatataattaataattgtttgttatgtcttggtagtatttttggtgtacttcccagaaattactgttgcaaattgggcaattttcaattctttgctttcattaaaattgaaggaagacctaatagatttgtcagttggtagactatctgaaataaattttgttataaataattatgtaaactgtggcatgcaaaaagttgctgccgttgagtgtcatcattataatgaaaagccttcaatgcttctctatttagagaacaagatttttcaatgcttaaaccttaaggagaaaaaaaacctagaaattgaatcgtccttaattctgtctcattctagtgctaatgcttggtggctcatgcctataatgccagcacattgggaggctgaggagggtggatcacttgaggtcaggagtttgaaagcagcctggccaacatgctgaaaccccgtctctactaaaaatacaaaaatttgctggacatggtggcggatgcatgtcatcccagctactcgggaggctgaggcaggagaattgcctggacccgggaggcggaggttgcagtgatctgagatcataccatttcactccagcctgggcgagacagcaagactctgtctcaaaaaaaagaaagaaaaaaaaaagaaattcatatcaaataaaattttattttatacctagtagttttaatcaatatttataataatgttgttttgatcaattttatataacaataattgtgttgataaacaagaatacattttcaacacaatgccttatggacatgggaaaaaatcaaatttaagcttatacatatttaacatatatacaaatttatacctatacatagatattttctgcaaagaagtgtgatagaattatcaatataaaaatttcttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaaaaaaatttcaagttaaaaaacattagcacaagcagtggagttcacaaagagaagaaattacataaaatgtttgatctttaaacaagaatgtatacgtgtatctttaaataaaagaaggtgaatttcaaatcacagtggtattcaaatttcattggatttatttaaaagaaaaatgtagtaggtccctttaacatctattagtattgataatgtgccaaaataaacagaccttttgcagccaattattctagtccatactacccaaagaaatctacagattcaatgcaatgtttattaaaaatctgaatagcatttctacagaaatagaaaaaaaaatcctacaattcatatggaaccacaaaacaccagaataatcaaaacaatcttgtgaaagaacaaagctagaagtatcacacttcctgatttcaaaatattaaaaaagctgcagtaattgaaacagtatggtattggcataaagacaaacatatagaccaaaggaacagaatagagtccagaaataaatccacatgtaatggtcagctgatcttcaacaaggtaggcatttaaataatgtttaaaaatatcaagcatcaattccaaatgtacatagttttcaagtgtttaattctttccaaatatatgggagcagaagggggcagtactctaagtcagtagttctctatactggctgagaataggaatttcctattcagttgtttaaaggattaccatgatatgacctactcatggaagtttgttttccttaggcttgatgtagggactacatggtacacttttcaaatttttcatcagaaatattagtgccttccctttctcttcactactgattcttctatgtcctaaattgctcagaaacacctggtgtctactcaggaaagatgattctctaataccagaatggcatcacagctctgattgctccattgactcctttttaggccctgagagtcatttcctttctgagactgcaggatcaagcctttcacacaactagccttttatcagataatgagtctgtgtatctatactgtgcgtaccgtacttctcagtaaatcgtgagttggtgtagatctggaattgaaaactaagtcttccagattcttcctagtccagtatcaaagactctacaactgttttcttaggacaaactgtcttgtgcctgcaatagaaaatagacagaatgactagccctgggcttctttccctgttcccatggtggttcaatagctttgttacatggcttcagttatgcctactactccaactctagttctcctgtgtaccagaaacacaaacctgcttgtcaaaagatagtaatccagtaaacaaaataaatgtgtttgtttttctgtaacatcagaatagtttataaaaatagtcacaaaaatatgggaagaagaagcaaataccaatgtaaatagagagttttccctatggcaatgttactgaaataggagaatgaaggtggtaagtagaacagggaaaggacatttctgggcacagctcagagttgcaaagcatggataaataagcgaagtcccacagactaatttcagaaccttgactggatccatccctgaatagtaaaaaatattattattactgaatagtaagaagtaagttgttgttacttctgaaatgggcacaaatttaactttccaatctattctctattcctctaaataataataaattcatgtgaatatcatcccctttggagtgtaacaccttgattgtaatgtcaatcaagttttggttaaagtcaacagtatacaattatcatgttctaaattttatttcactttactactgaaaagtgcagttgtaaattggtgagtggttctgtgagcaaagtgcaagaacttaaacagcctctaaagtcagattacgtttaagatttttttttgcttttaatattctcaggtattccctatatgcaaatttagtaatataaggtaaaatattcacagtctgggagcaagaatccttaaatcttatacccagttgtataacaagctgttttgtaattatgaactaaatgagataatgtttaagaaattgccttgaaaacaataaaggtaatgttatttattttctctttagctcagtttcttccactgctcattgagaatactattagcttttcaggccaactcacagtgacatacaaaaattaactaaatcctactaaatttacttactccccagatagaactgtgattcttaaagctagtgtaataatatttagtgtagttcaccactatcctacacagcagcaaattttatcccatatcaaccattattatcaggatgcaatatatttttctatgtgtactgtttgaagcatatcacattctaaggaaatgtttggaaacatcagggaataaaaatgccaacacatttaagatagtagtaaggattatatgttgcaaaaaaaatcaccaataattgtgttttcttagtaatgtgagatttaaaagttgaaattgtttgcatacaatgttgtgcaataaacaatgtatgatcccatttttatatttgattttataatcataaaattatttcaggaagaagtgaagtacattaaattataagttatttcagaaataagtaaagtatatgaagatatattaaaatacagtattttttgaaagacattacaagtttttggccttgaataaaaggtcagcatccttcttcataatactgtatataatattattgccttttaggatgattttccagtcatgatcagttattatgatacaaatttcttaaaaatatatctttgatggcaattttctcttcatgagaacttctaaacatggtgataggacaataatagtaggatatgttagtgttttcaaataagagcaaggaattctcaaaggaagggtataaagatgacagctataagatgagggataatttattgttcagtatgttatacttgagggaaaaagaatttaaaatatgggcagacacacttaagctaaataatttttacacagtaaaaaaagagccattggtgacattccttctgtaccttttgcttttaccaatcttataaataggatcgaaaactctactgttcccaacccacacattcttctatataacaagatatctgattcctagttcttattattctcttgccttttcctctcctcatggcactgtggctgcttctgtcctgactgccatttgtttctctctgacacttgtcccgactgccgttcattttgttagactcctatcaagcagtggccctgagagtcaaggccataactttttatatacatatgtttactacgtgtaatcttctaacttagttcatactattacactttattatactcaaggaagcagttatttgtcacgtgattattttggttagtgctaattgcaaatatggctctagagtcatggactgaagtagagtgtcctgtcttcaaggatattttgagtttctttatctcctcttatatcctgaaatttatgagttattccattctcctttattgatttccaatagctctacctcttaagtttgattagcttatcatcaacaacgttataaatagagactattcctttttcctctcacgacctagtgtcttctagcaattcgtctttactttccctaccccctgttccataacctaattgatttcttcatcagagaataatagcaggttctattttattttttaatgtcttagtttttcaactcatacgcattctaatttcatgccatcttcttagtttaatgccatgtttaggttgattcagtcctaccatacgatatgttagcataaaaacaatttttcctgaaattatactgtgaggtacggaaaacttccatgtcagtgattcaataattgttcacgtatttctcttcagcaatgtcttttttcgcaaacagaaatgtctgtgttgcttacaatttaaaaattagaggcaggttgtcaaaggaagcttgataataaaaatatagtaaagaagtcaccaaaatagatgacaaaatgtgtttggccacatctttattgtcctttaattgtgactctgggatctgaattgatatgacatagccatgtggtactcacatgttctttggttcaaacttgtggccttaaaagcttcaaagttgctgtgatcatttatctgggctgatttggaagacccacatcccggcagtagtatggatttttcttctgggcaatatattgtggcaatataatagggtgcacatgacaacttatcaccaggatagtatatggagtaatggatcatagttgctgtcttggaatacaggcagaaacttcattagagtctggatttaggataaccaatggcattgtattcttccatactgttcaactgcttagagttagaaacaggtttacattcattcagtcactcaacagatattcactgagtgcctctgccctgcattggtatgaagcactgtacatacaggggtgagtcaaagtctttgctgtcaggtaaattaaattcttgtaaggagacgcaaatgaatatctatagtatgttcagtagggtagctgctctgctgatgaataaaataggataaggtaaaaaagagccaaaagagaatggccagggaaggccattctgtgataggtgactttagagctaaaatctgactgcagtgaggactggcccatgtggatatttgcggaaggagtattataggtaggagaacattcagggtagggaactctactcaggccagcattatctggagctctgaccaggtatagcctagtctgcagtcagtaaatacatattactattcttaaaaggaagctagcttacatatatttttcttcttccctctttctgacttcttaaattctcctctttcattaaaagattccccacattctttcagaatctaatcattctctccacctccgtttctcacattttttggcattacatttatttttcaactttttctatccacctcaccatattccatttatctgtttccttctgcctgacaagcctgacattgagcgtactgctccccctctcaagtcttcccctttctgtcctcctctccatcactgtcaggataaatatcatcatccccatttctgaagactggaatcatgctgtcatcttcactctgttttctatctcctcccatgtaggttggtgcaaaagtaatcgcagttttgccatttgaaagtaatggcaaaaaccacaattatttttgtaccaactccaaaataatccaaatgcattactatgtaactaaattttagagaaatgttagttacttgattgctagaagccaatatttttccaagtgtttctagaaaatcactgttgttactcatccattcgattataaaacctattctccagaatcttgttgatgttaagtaacatttttatggtagacaatgccttgccaaaggttgattggcatgactcattatcatcactcttccctctgtacagatgagttcatataaacattggaattttcaagagtgtttttaaaagattcattcagtgagaaaagtatagaataatattaataaaatttgattttgtatagcattattttaaacatagtttatagaaatcttcacatacaaattattgtgatgtgttcaacaactccataagtgagattaaatctgagtgccatgagcatgtgtctggaaaaattatttgatcatttaagttataaattaagaatcactgaaagcacaattaaatatatctgcaagaacatttacctgagattaatctttgctttctgtgtgtgtgtgtgtgtgtgtgtgtgtgtgtgtgttgcataatagattttttcttttatatcccatatgcttacagatgttaatctccagagaagaacaataattctctcaagaaaggtggtttgttgcctggctttgtttcactgacacccagttggaagctctgatgacaaatagtctgcccatcagctttgcttcatgaatccaaagaaaatggaacttatcagaagctgagcctcaagctttacctgtgcctgttatttgggccttttcacgctaggtttggcaggggtcttagtctttcatcatttggttcaccaatagaaagagaagggagcagttgcacttttaggtaccactctgcagactgctatattgcaaaataaacaaacaatatatttttagggcaccacctgcagcaagcagctgtaccaaacagagcagaaccacgaaggatgtgatttgttccatttaacacgaagccttaaggtttgagaagagagggaggagaaggttctatgtatacaacccacacatcacaatttaaactgaagctgattttctctcttttttagattggaattgaggtatcattatatctctcctcctttcccaccccacaacctctggttgaaaacaattctattattgaggttataacgttaactgagaaaattatttttctctgccagcaaactttcttttccattcaagggcaattttctctcatagcaaactatacttaaatgccaacatctgctacatctaagctgtatataaaatgatgtctggcatttacatgatgccaatgacatggttagagaaactcatacacttggcttacacaggattttcttctcatctatagctttcctctatttctgtccttccttaggatctgtctgcctctctaaatgtgccacacaagttcaaaatactctgaaagctgaaccttcagctcttattctgatcaacaatctgtttttgccttaatccatttctttccaggcataaaaactatatagagcctcatgataaaaatttcaccatccctgcactctctgagtatatagcagctgatgcaagacatattttaggtacttggttttttcttggatttaaaaatctcttcgttctcttaatggctattgattctggcctcacaaaccaaaatcaccatttcattttcagttctaggtgagctgggataaatataattaaattatagatgactctggaggcaatccagttagttacaaattgaggtcattctaagtacagaatggggcagttagctttaatattagattggccaccaagaaccatacaatattttaatgtttttcctgtcaatgagcccattttaaaaaacaaaaaagagagaagaaactgttctaaatatttatgaagtgaactagaatgccattcttaagtcttctaccacttactagattgttagtctggggagaaaattacatttcatagtactttcagatattgctctaggactcagagaagtgagatgaaagaattataagtctgcaatgatgcctccagataacagaggaaatcaaatcttgtgagccgggaagcaaagttgccttcactgtcatcatcaaggggatgatttgtaagaatattgggcatgaaataaattcttgccaaagttgtctacaggagtgtccaatgtgggaattgttgtcatctctttcacccttctaacattaaaaggaacttactgaaaaagttctcagactggattttgctaaattgtgtctgctttggaatctttgtccatcagtcaagtctctatgactattggatagtgcttttaactctgtgtggtcaaaactttggaagaagtaagagaaatatctttcattccaaagaacaaaagaggaccattagtcagagcatctttatttttcataaaaagaaaagtcagttagattgatcattcatgaatatttataatatatcagatattctttggggctctctggaaaaaagtagtaagcctttgacaatgaggctgtgtggaataagggaaaggaatagatataactgatattaaataaagttaaaaaatggcttgacaaagaagaggattcaacatctcagattattgaaaccctatgtaaaagatacagagacaaaggttaggcatcttctctaagcctcagtttcctcatctgtaataggcataactactctctaactcatttggtatttttaattgttgtaaaaaacacatgacctgaaatccaccttctcaacaaatttttaagtgtccaagacactgctgctgactgtatgcacattgttgtaaagcagatctccagaactttacatcttgcatggctgaaaatatacactcattgaacagcaactcctcattttctcccttccccaagcttctggcacccaccatcatactctctgcttctgtgagtctcactactttagataactcttgttaagtggaatcatgtagtatctgtccttctgtgatgtgcttgtctcattaagcatgatatcctctaagttcatctatattgttgcctataataggatgttcttctttttaatgctgaataacattccatgatatgtatataccacattttctctatccattcacctgtcagcagatatttaggttgatttcatatcttgcctactgtgaatagtgctgcagtgaacatgggaatgcagatgttcgttcaagattcaattttcagtcctttggctaaatatccaaaagtgaaattgttgaatgatatgatcattttacttttaattttttgagaactgtatactgttacaccattttacatttcaagcatcagtacactagggttccagtttctccacatcgttgtcaacacttgttattttctgtttggttgttgttgttgtttaataatggccatcctaacaagtatgaggtgatatctcactgtggttttgatttgtatttcccggatgattagtgatgttgaacttttttcatatacctgttggccatttgaatgtcttttttgaagaaatatttacttaagttctttgcccattttttaattgggtttttttttcactattaaattttagaggtttatcatatattttagatattaacctattatcagatatatggtttaccaatattttccactattccctaggttgccttttcagtctgtttattatttcctttgctgtgcagaaacttttattttaaagtctaacttgtctattttttgtggttgcttgtgctttttatttcatatcaaagaaatcattaccaaaaccaatgctatgaagttttccacctatatatcttctaggagttttacagcttcttaagcctttcttccattttgatttggtttttgtatatattagttcagtttctttcttttgcatgtggatatttacttaacatcatttgttgtgaagactatcatctcaccattgtgtagtcttgacaaccttgtcaaaaatcatttgactgtatatgcataggcttctttggcttattttggggctctctactctgtttcattagtctatatgtatctgttgttatgccagtaccatactgttttgattattgtagctttgtaatatgttttgaagtcaggacgtgtgaggcttctgctttgtttttctttctcaagattgtttgggctgttggggtctttttggttccatatgactattagaatattttttctatttctgcaaaaaagagccattgtgcttttgatagagatttcattgaatctgtagattgtttccggtactattaacatttttaagaatagtaagttctttcaatccatgaacatgaatgtctttccatttatttatatcttctttaattacttagcaatgttttatagttttcagggtacaagcctttcatatcatttgttaagtttattcttaagtattttattcctttagatgtgattataagtgagattttcttaatttctttttcagattatttgctgttaatgtatagaaatacaactgatttttttgtgttgctttaatatcctgcaatgtttgtgaatttgtttctaacaggtttttttgtgagacctttagtgtttgatatgggttttacagattatgtcatctgagaacagaaatattattctttcttcttttctgatttggataccttttatttctttctcttgcctaatttatcttggtgaggacttccaatacaatgttgaataaaagtggcaagagtgggcatccttgccttgttcctgatcttcaagaaaaaactctccatttttcaccattaagcatgaggttagctgtgagtgagcttttcatatatggttcttgttttactggcataatttccttctattcatagtttgttgagtgtttttatcatgaaaaagaggtgaattttgtcaaatgcttttttctgcatccattgatctgatcttgagatttttaaattccttcattctgttaatgtggtatgttacattaattgatttttgtatgttgaaccatctttacatcccagggataaattctacttgattatagcctatggtcctgttaaggtgttgttaagtttagtttgctagtatttgttgaagatgtttttgttttgctagtatttgttgaagatgtaaacatcgatgttcatcaggtatattgacctatagttttctttcttgtagtgtctttttgtggttctgatatcaggacaatgttggccatataaaatgagcttgtaagtgttctctcttctttaatttttttgaaaaagtttgagaggcattggcatgaatagttccttaaatgtttggtagagttaatcagtgaaactgcttgttcttggacttatgagttattgctcagttcagattttctatttcttgataattaagtcttgatagattatatacttttaggaatttattcatgtcttccaagttatctaatttgttgctgtataattattcatggtagtctcttataatcctttgtatttctatcacattcataatgtctccattttcgtttctgattttgagtcttcttttttcttttttatcctaagtgaatgtttgttaatattgttgatcttttcaaaaaacagttgttagtttttttgtttttttaatatttttttccattctctatctcatttaatgtttactacttccttccttctgttcaaaattgggcttattttttccttctttttctggttctttgagttgtaaagttacattgtttgtttaatatctttcttcttttttaatgtatgcatttaccactgtaaactgctttcttcatactgcttagctgcatctcataagtgttgatacgttttgtttttatttttgtttctcaaaacattttataatttcccttttgatttttcctttgtcccgttggttgttcgagaatgtattgcttaattctcacttattcatgaattctcctatgtttcttttgctgttgatttctagcttcattccattgtggtcagaaaatatttttggtatgatttcaatcttcttaaatctgtcatgacttattttgtgacctaacatgtgattcatttggagaatgttgtgtgtgtgcttgagaagaatgtatattctgctgctgttggacagaatgttctgtatatgtcttttagctccattttgtctatattgttgttctagtcctctttttcttatcgactttctatctgggtgttctatccattattgaatgtggggtattgaaatctcctactatcatttaattgctgtttatttctcccttcagttcgtcagtaactgcttcatatatttgagtgctctgatgttggatgcataaatatctataattgttatatcttcctcatgagttcaccctattatccctatatagtccttctttgtctcttgtgactatttattatttatttatttttagagacagagtctcactctgttgcccagcctagaatgcagtggcacaatcatagcttactgcagcctcaaaatcgtgagctgaaatgatctcccaccttagtctcccaaagtactgggattataggcatgagccaccacaactagccttcttgtgacaatttatttaaagtctattttgtattctataagtatggcccacccctacacttttttggttaatatttgcatggagtatctttttccatcctttcacatttagcccatgtgaatacttaaacctaaaataagtctcttgttatctcaagatccagcattaaattggatcttgtggggtttgttgttgttgtcgttgttgttgttttggggtggaggacagtgtctcgctctgtcgcccagactggagtccagtggcgtgatctcggctcactgcaacctctgcctcctgggttcaagcaattctcctgcctcagcctcccaagtagctgggattgcaggtccacgccaccacacccagctaatttttgtatttttagtagtgacaaggtttcaccatgttggccaggctggtctcgaactcctgacctgaagtgatccacctgccttggccctccaaagtgctgggattacaggcgtgagccaccgggtctggccagatcttgtgtttttattcattcagtcatttcccatattttcaaaaaggagtttaatctgtttatatttaaagtaatttctgaaaaggaagggcttactattgccattttgttaattgttttctcttggtcttgtaggtttttttcatcttctttcactcttacagtctatctttatgtttcattgactttttttagtggcatactttgacttatttctcctttgtgtgccttcaatattttctttatggttactatgagatttatttaaaacatcatataggtaaaacaatctattataaactaatcacaacttcaatcaaatacaaaaactactttttcatcacatacacattatgttactgatgtcataaattacatctttttatactgtgtatctattaacatatttttatagtaatagttatttttgtaattttgtattttacttctatgtcagaattaaaattgatttatgtaccattacagttttacagtattctgtatttatcccttatgtatttacatttacccatgatctttctattttcatatgcttttgtgttgttatctagcatcctttcatttccacttaaaggacttcctttaacctttctttttaaggcaggtctagtggccataaactccttcagtttttctttatccaggaatgtcttctttttccttcatttttgaatgacagttttgtcagatttagcattttttgctggtagtgttttttttctttcagcactttgaatatattatcccactcccttctgagttgcaagatattttttagaaatccacttacagtcttatagaaactaccttgtatgtgatgtctcttttttcgtgctactttcaaaattctgtcttcatttgacttttaacaatttaattatcatgtgtctcaatgtggatttatttacattaattgtagttggaactacagctttttgaatctgggtgtccatttccttacctagatttagggagtttgggggcactattttttcaaataagcttacttttcctttctctctctagtctcctcctgaaactctcataatatatacattggttcacttaatgatgtaccataagttccttaagctttcttcaactttcttcattctttttttattttctcctctttctggataatttcaaataaccactctttgagtttgctgattgattttttttctcatacctgatcaagtctgctgttgtagctttctagtgaatttttcaattcagttattatatgcttcaggtctaaaattcatttggttcgttttaatatttttcatctctttgttaataatctcattttgttcacccattgttttcctgaaatactgagcatctttatgacagttattttgaattctttgtcagaaattttatataccaccatagtttggagttcatttgtggaaattttcttttgctcttttgattgtgccatgtttccctgtttcttcatgtgccttgtaacttttgttcggattcacacatttgtcaaagtagccacttctcccaaactttaaaaactggctttgtacagggaaagatctttgttaatcaacccacctacagactctgacaacttctcaaaccttttctatggatgaatcttctctggactagtgtgtgtaaatttcaaatcagagcgatttactagtttcattttttccagcagtttgtgttctttcactcccttggtgcatgtcagaagtaccaaaggttctccggagtgatcatcagatgcctagctgttttattctctgtggtccacaggcttctcgagtatactaggtctcattaggactccaagacagtcaagagagaagccagtccctggacagcccacccccaaaaaataatcctgaatattgcaaacacatttcaactctttccctcccctggaagaagccatgtcttggggttttctcttgcccattctaccctgaacccgggacaagggtgggactatgatgcataagggtgtgctagtcctaagcatcacttttttttcagtgacgctcaaattggtgcccttttctgtcagtacttacatttagacaagacagaaaccagtgccttgggcagccctccaaaaagtatgaatgtcggacatatttcagctttctccttccctacctaggaagaagccaggagctggaggtattttcccaatcatactatactgagccaagtggaaggactgtgatgaatgagtgccatcgatttttctggctttgatgcagctagttttgcaatcacctggggtttagcagtctcttaactggtttgttgattactcacagaaagaatggatccatgtgttagtcattttctccacagaggaaagagagcctgagaatttttattctaccatctgatgatgtcactatccctaattcattgtattttgtgggtgagaataaaataaataatggtttttaaaagtctctatttttttcacagaataggtcttcagtaaatattagttgttttgttgtaattattgttaataatgtgtgacaggaactaggcaggtttatatggaaaaagtagaagtagtgaccattcaggatttttacatgagagctgggctattcaaagttgtcagttgataaatgagtctgaaatttaggcaaaatttttaaatgtgatgtgaaagataacagaaaccactgtaagtgtctaaatagataagaaagcaagagatatcattatttattacgatgagccaccaaaattttcttataattctcttatgtgctatattttctattaggcaataataacaaattgttgtttctactatactgaaaattcctccataataatctggttgtaaagtaacctaaggaagaaccaaaacttgacggctatttgaatatgggaccttaagaaagaataaatcaatcaataataatgtttaaaatttaaggaatgtgtttcccttaaagatttactgcagacctccttataaaggagaagccaagagatgctgtggcagttgatgatttgatgagtcaaagacagaatcagtatatatctatgagtggaattgacatctagttttagtgtcaaataattagatagcttctcatgaactcattcaaagctggttgagagccttttaacatagaacactccgttttaaaaatgtttacctgagaataaatgttttgcatccgtctttacagtccacctaggaactggcataaatgtcagagttcctacatacaggaaccaaagtcttagattttatgtcttagtggtatttggctatcaggtggctctccctgaacatacaaattaaaatatatttattgattcaaatactgtatatatgcatatgaaaaataatgcaaataataagggaattacaagacagcccaggattttttcttgcttttacttcatactctcaatggacaaaataaaggttaaatataacaaattacttgaccactgcagataatatttgcgctgagacagaattgtaagcaaattttaaagtgaccgtcctttcccttaaatgttcaatgagatacctaactttaattagataatattcataaaataaatgagaaagaaaggaaaaactaggcatatttaaaatatacttctacttagtacttttcttaatatataaataaaaaataatccaaaatatgcaactagatagtagcatatgagaaatgattctagttaatcccattctaaatattactttcaggatgcaaaaactgagaacagtccatagagattatttagtataatttctttgttttatagatgagaacactgagtcatacagctgaatccttccagggttaggacgataagcactttacagatctatattcttcccatatcaatcattgtattgactctagtgttcacatattattttattagcatctaagaaatataacctagggctctacttatatatttaatttcaagtccacctataaaacagcaggaatttattttaactttttttaacatctgtcttctatcctttctacctcccactaagaatatcatcttctttgatataaatcacacatctaactgtcttccacttctttgggggtaaatgttattaaaaataaacaaacaaacccctgattgaatataaattatatgttgttcaaaatctctaagttcagagaataattaatagcttgatgtatcatcttggtgtatgattaatcttgttacttaattgctattttcagataaatatctttgtaccctttgacttatgcttgctgcagaatgatgtagttttcagaggggtgattatttattgttatgccattctggttactttgcttattgccaaagtatatgcatagtgtatgtgctctgctgctatagataggaatgaagattggagattgagacatatggggatagagaaagtgaatgtttgggaaatctaaaattggatataatatagaatcttactggcttctatgtgagaaaatcttctatgtttctgataattctatccttctaagcaccctcacctataaacaggtgggaaaccagaaatagaaataaaaatttaagagatcatttaaatgcagaactgataccttgagcaccagtgaagcaaatttgcaaagaaaccatgaaagaaaggaacagagggagaagaaaatattacaggaaaggcaagagaagggtgagaaaaatagaaagagtagagcaaatactggggataaaaatgtaatgtacatatttttcaaagaatcagagatttacttcaagttccaaaaatatttctgaacatatataaatccaagcttttcattttcaccagtaaaaaatgttttttttttacaaataaaaattattagtaacacagttaaatgaaatggtgaacagatttaggggacaaataaatgatcatgaaatggctaatctttaaacagccagagagctatgatcagagaactaccaaattttaatgactagttcccattataggaaggatgaccttgtagtcataagttagaaaacttcaaaaagcttatctgaaaaagatgctggcactatataattgaaaaaggtcatggtattaatctgttaaaacattcatattctgtaggagggtcacaatgtttgagtaggagcataagattaaaaatattttattagcttttagattttgtgacgtgaagtactgacagtagagccagtgtttttgtaagaactcacaaccacaggatatcattattttaactcagtattaagtctcaaaaagaattgtataagtaaaatagtatctaacatcaacttcaatccggaaggaaaatgctaccaatatttgtgataaaatacaaacaaaatgtgctgaacttgagtaaatttttccacttgatctacatttcaggacagtatcaattaatgctctccaatattaagattgatatattggaacttaaaaaaactcatcagagaattataaactctataaaacaacgtcttttttttattttgtgagtagagattaatggaatcacttcaatcaccctacatatggaaggcccagctaaaaagattacctctttgctttactcaggttctcacttgacatatcaaaccacgtctgacgaggaagtggctcccacagctctcctgtcatgcttccgaagtcgtgggcagtgataagttttgactgtgcagccagcatatgtcatgataaattttcaactctctaaataaagaaaatacacactgttcttggatcaagattaggcttggttttccacccacctttgtcctcaaacacatttgtaacaaacataagtaaatacttgacaggtgaatatcaccggtgccattaactgaaataaaatgaaccatgagtagaaagtgttaattcactatttcaatcacatcccattcgcagaaaaaggatcacagattctcaaccctttaaatgtaaccatggagagcagaaaattccgttcctgtgggcaacaagataagtctatgtgatgccattagggactttttaatgagactttctctatattgctatgtgttgtcaaacgtctacgtttatctaaatgatctccttggccagacttaaattcctacattatttctctgctgcccacatgtcaaaatctcctccactcagagaagttgcttttcctgcacacagtttactggaattagggaggttgataatgcatctaccaagtagagtccatgtgaagggctcagagaaatagaaaccccatatagaggagaagattctgcaaggctgagcagcacattacatgctttcatcagcctccagggtgcgtgcttgaccagtgtgcgtgcttgactagtgtgcaagcaccttgtttgatcccccccaccctgctttagcacatgaagagccaacaccgacctctctattcactcactcaagcataagcattggcttcaaatgcagagacaaaaggggcagctgttcttattcacagcaagtaggaaaaacatcactatgcagagagatttgggacttggcagtaatggcgagcccacatggttctggctagtgtgtataggattcagcatattgtggaaagttgaggctccctgcaaaccaataagtctcactggatttctaaaggagaacaggttctttacatgtgagtccccataagaaaccattaagtttcaaaacaataacaacacataaaccagtaaattaggggtgagcatttacatcataaaattaattctttcttgaggattcagctaaagattttttcttagtgatataatatggaatttaacatacaacagttttaggcatgtaccaattccataacattggttacacctgcaatctggtatcttcaaaggcaataggaaaataaatacatgtctgctcgaaattttgtgtttgcatgaatctgttgaagatattttccattttttaaaagacataacagcagttaacagcctaatgacttgtagtggagtttagtaaatagagatttgttaaagtgtagttcttagaccaggagcaacagcagcaccagggatattgctaaaaatgcaaattctcaggctccaccccagactcctatcagaaactgtgtgatgcagttcagcaatatttttaaacaacttctccagataattctgatgcaaattaaactttgatgtccactaccttagcaaaagaaaaatgttagtaaacaatttatactacatattattctaaaacatttgctgggattaggggagtgaatagagagaagtctcataaaacatataaaaacccattaaaatctgacaaatttaatcattgtaatgggtttcttctagccaagaggatgaaagcataagttccttagtctgacacagagtctttacacaatgtttgccgtctatctctgcagcctcattcattagttcagccattcagtcacttaactagaattcattgagtgcttactacatctggacaccgagtaagtaaatagggaaatgccaataacaatagcaaaccaccctaacccccaaatacctaacatccagccccaggcattccattccctgccctttgggaattctgaaatgtgaacatgcttttcctgttctaaaatactatcctattcctccttcttgtttccttatcagaaagattcttatccatcccataagatccagctcatattgataaagtcttccctgacttcctgggtaaggttagttactttatatattggggtctcacagaaatacattcatactactatttttgcacttatcacatggtattggaagtcatttgtttacatattttaaatccaattctgaggatcagagactgacaaattcagtaagtaggaatttgagatatttctcatatgatacacaagtggcttgaagtaaacatgtggaaggtcactatagaaaatggagtaacattaaaaaaattttctacctattttagtttctgtgaaaaggtgaacaattctactttaaactaaaaaggcagagaataacaataattagtagtgaaggatgcattaaatttgaaatgtaattgcttaatgtagtggtttctcaaaatttgatccacttttcattgctcaagactgaccactaacaatttgccaatgatattacatatgagattatttgcaagaagttgtacaaagaaaatcctccaactttggtatttttatgaggataacaataaagaattttgggatatcaatgtgacagttaatgaaaaagtgattatctttgtgtctagcacacgataaaatgcacaatgaaaaaaattctatattggctatattatgaaatgctatcctaagaacccttcatctagatccaattctggtcagaaaaggcatgagagacattctagtccaactttctcatgttatgagtaaaacaaatcaagactcagaatgataaaaatatcttgactacgaaaattcagttctgctttcactaggctagaaacttcttcaccatatcttcatgtctgtattagttatctattgctgctatatcaattaagagtaacttagcagcttaaaacaacacacattcattatgtcacagtttctatggaaaagaatttcaagcccagcttagctgaattatctgcttcagtgtttctcacaagatgataatcaaagttttggccagggctgtgttctcagctgaggcttggctggggaaggattaaattccaagctcactgagattgttggcagaattcagttctgtgtgcatgtaggactgggggctttggtttctggttggctgtcaaccagcagactctttcagctcctataggctgcctgtagttcatggtcttgtggacttcctaacataggcagtccacaatattgcagcttgtttcttgacatctgcaagcaagggaaagactcccgcaaggcaggccttacatacaacctgtattagtctgttctctcgctgctataaggaaatacctgaggctgggtaatttataaagaaaaaaggtttaactggctcacagttccacagactgtgcaggaagcatgacagcttctgctcagcttctggaaaggcctcaggaaacttatgatcatggcagaaggcaaaaagggagcaaacacccgacatgaccagagcaggaggaaaggggaggggtgctacacacctttaaacaaccagatctcatagaaccctataacaagaacagcactaggggaacagcactaaaccattcatgaaaaaccaccaccatgatccaatcacctcctaccaggcctcacctccaacattgggtattacaattttacatgatatttgggtagggatacagatccaaaccatatcataatcttatgcaggtaatcctgtatatgcatcacatacatcctatccccttttctgtgttctgttggttaaaagcaagtcatatggccatacctgtgatggttaatactgagtgtaaacttgactggattgaagcatacaaagtattgatcctgggtgtgtctgtgagggtgatgccaaaggagattaacatttgagtcagtgggctgggaaaggcagacacacccttcatctgatgggaccatctaataagctgccagcaaatagaaagcaggcagaaaaacatgaaaaggtgagataggcctaggcttccagcctacatctttctcctgtgctggatacttcctgcccttgaacatcagactccaagttcttcaggtttgaggctggaattggctcttcttgctcctcaagcatgcagacagcctattgtgggaccttgtgaacatgtaagttaatacttaataagctcccttaaatatatatatatatggaatataaatattctctatatatattccatatacatatatacatatggaatgtatatatgtgtatatatgtggaatatatatagagagaatatatatattacctatatatattctctctatatatagagagagaatatatatattctatatatagagaatatatatgtaatatatatattccatacatatacatataatatatatattccatacatacacatacatggaatatatatattccatgtatgtgtatgtatggaatatatatattccatgtataccatatacatacatggtatatattccatatatacacatacatggaatatatatattccatacatatacatacatggtatatattccatacatatacatacatggtatatattccatacatatacatacatggtatatataatatatatttataatataaatatatattatgtatatatatttatatgtgtgtatgtatttatatatggaatatatatagagagagaatataccatatatatatttgggctatatatatgaatatagtgaatatatgaatataatatatataatataaatatatatgatatatacacacacacacacacacacacacacacacacacacacatactgttctattagttctgtccctctagagaaccctgactaatacaatacccatacttataaagtatgcaatactggagagaggaatcatgggggccctcctagagtctgtctgccacaggatctgatagaacttccatttatttaaacatcctgcctttttatcactgattaattcttcttcattttttgcttccagcaaccagctattatgcttttgaaaaacaatttactaaccatcattattcatcacaggtcaatttttttctaccctgaggatgagtgtcatttggatagaaaacatttctaatctcccaaatttgatgataacactgagtttctgttaatttactttttttctgctgttctgcaagcgttaacaaatataacagtataactaagtgttaatccgttaccacattcagtgctttacctcaccagattttatatttgtatcatgtactctgtcttgaaatctgaatgtatctttttgagccattcctttttctgattctcccaggcctgttttttcttattaaatacatttttagagccattttagattaatagcaaaattgaagaaaggtacagagagttcccaagtacccctgcccctccacatgcacagcctcccccattatcagcatcctccaccagagtgatacatttgttacaattgatgaatctgcattgagacatcattatcacccagagtctatagtttacattgtggttcactgttagtgttgtacattcttttggtttgtaataataacatgtatctaccattgtagcatcatatatggtattttcactgccctaaaaattcaccatgctatgtctacccagccctccccctccatcctttctaacctctagcaactactgttccttttactgtctctatacttctgtcttttccagaatgtcatatagttgaagttatatgttgtcttttcacattggcttcttttactcagtaatgtaaatataagttttctccatatcttttcatggcttgataattcatttctttgtatcactgaacaataatccattgtctggatgaaccacagtttatatatccacttacctcctaaagaacaacttggttgcttccaaatttgggcaattatgaataaagctgctataaaggtctgtgcacagattgtggtgtggatttaagttttcaactcatttgagtaaataccaaggagcacaattgctagttcatttggtaagagtgtatttagttttctaagaaactgccaaactgtcttccaaaattgctataccattttgcattttcactggcaatagatgatagttcctcttcctccacatccttgccagcatttgatgctgtcactgttctggattttgggcattgtaaaaagcgtgtagagctatgttatttttgtttcagcctacatctccctgatgacatatgatgttggacaccttttttatctacttatttgacatctggatgtcttctttggtgaggtgtctgctaaaatctttggcccatttttaccattgagttttaagagttcattgtgtattttggattgcagtcctttatcatatatgtttttggaaaatgttttcttccatactgttgcttttcttttcattctcttgacagtatttttcacagagcacaaagttttaattttaatgaaaagcatcttgttaattctttctttcatagattgtgcaaagacagtgtcatgtctaaaaagtcatcaccaaaccaatgtcatctagattttctcttatgtcaccttctagaagctttatagttttgcatttttacatttaaatcttgatttattttgagttaatttttgtgaaaagtaccaggtctatgtttagattcattctagattcatgtggatgtccaattgttccaaatccatttgtggaaaagactattcttcccctattgcttcgtctttgtttctgtaacaaagattagtttgactatattatgtggctctatttctggactctttattctgttccattgatctacttatctaatctttcactagtaccacactatcttaatcaatgagagtaagtcttgaggttatagtgtgtcactgctccaactttggtcttttcctccaatattgtgttgtctgttctgagtcttttcctctccatataaagatttgaatctgtttgttgacattcacaaaataatgtgctggcatttctatttgaattgcattgaattcatagatcaagttcagaagaacagatatcttgaaatattgaataatcttatccatgaacatggcatatttctccatttatttacttctttgacattttaacagagttttgtaatttttctcatataaatcttgtacatattttgatggatttattcctatgtatttcatttttgtggtgccaatgtgaatactattgtgcttttaatttcaaattttacttgttaattgctggtatataggaaaacaattgacttctgtttattaatcttatatcctgcaaccttgctacaattgctatgagttcccaaagttttttgctgatttctttagattttctacatagagaatcgtatggtttgcaaagacagttttatttcttccttctcaatcagcataccttcagtttccttttcttgtctcatttcattatgacttccagtaaaatgttgaaaagaagtgttgaaaggggacatatttatattcctggtcttaggaattttctagtttctcaccattaaatatgatgtagctttttctagatattctttatcaagttgaacagtttaacttacatttctagtttaatgcctcaggattttttacccataggagaaattgttcttttcatgtcatttttttgccacagtttggctcttagtacgtattctttctctacactgtatctcagatggaatcttcctccctactgccaccactgctgtctcatcacatctcacctgaatagcatagcagctttctcctcaattcaattgaatgcacttcctctctcttctgttctgttgttccacacattaaagtcacactttcctcctaaagcactggatttattttgtcacatggctttcttttgcctgtcatattagaattaaatatttaggatctgttatccattctctccaatctaccctcccagcttttcaatgtgcctggagtaagtgtttaagatttgtaggaaggaaggaatgaaggaggaaggagggggaaaaacagaatgcaaggaaggcaggaggttaaaagttgtaactttttatatttgttttatctccacctatgctttccaaattgtgcgatagaaaacactgcttttattccaagcatgtcattacacttgtttttacctccattattttcctatgccacatttggattattcaacaatactggatcacttctgctaagaaaactaaaaatcacctctctatccccattgaccagatggcaatctctgctctaatcactacactcctggaccacttcaacctaatttccatttaacctcactactctcagtctatgtcctttctaatcagcagaaaatactgctgccaaaaccagctttattgcctgccagtcctcaaaccctgtgtttgctccctgtcactactgtacaaaattcaaattcttcataattgattttctggctcttcagatgagttcctctgccgagaattcaggcaaactaaggtccattaccgccccccgccccacgtgttgtctccacttttattgtcaggttgaatagccactggttcccaaattaatttacagctttacatttttatttttcttctgaattatccaagtttactttcatttatacctctttaaaagtctactctggccaaataagaatggaaaaagtcatccacccaggattatccttagaaaaaaatgacctatttgatttttccattccaagattatcaccttactggtaacaggtgaggccctctctcacaccacctcctcctacaacacagaataagcatagccaggaaattaaaaaagaaacaaacacacggtaataaactgaaatatactttacaatatagttttttttgacgataggtcttaagaaaatcacatcacttctttctaacttctttcctgtgtcagtacactgtgatttcttcatgatcatcaaatgataaaagtgcattgttatattttgttaaaggataaaaatataaaatgcgatattcgaataaaactgaatatttggctatctttctattaaaagggcctaaaatcacttctattataaaatgtattactacatgtattaatatgttttacctttgtttaaatactggtttaactcctattagaactcataagctgtaattcacaatgcatcagaaaagaaatattccactactattttttaaataaatattttcataacggctaaaagtaggatggaagtaataaacaaaaataactttgctgtttttctcagctcttcataaatttgcatcagagtttgtagatgatacaaaaatcattgagacaaagtattctcataaaaacactatttctcaccctcccgttttgttatataaaaataaacaaagctctgtgagataaatgagcacaaaataaattgcctttaaataaggtagttatttttttcacagtcactcagaagttttattattttaatgaaggtcattatcacttcacatataaaaattacgtaacatgagggccgggtgcggtggttcacacctgtaatcgcagcactttgggagcctgaggtgggtggatcaccaggtcaggagatccagaccatcctggctaacacagtgaaaccctgtctctactaaaaatacaaaaaattagccgggcatggtggcaggcgcctgttgtcccagctactcaaaaggctgaggcaggaaaagcacttgaacctgggaggcggaggttgcagtgagccgagatcacaccactgcacacccagcctaggcgacagagcaaggctgtctcaaaagaaaaaaaaaaatatatgtaacatgaaaaagtcagttatgtgatgccagctccagtagtatcacaagacgaactatgcatttgatacaggaaacatttttatggttttaaatgcccaacctattgttggagcatttagtataatttgaactcatcacagtgaacattatgcatcacaatgcagatgttaaagaaacctgatctggccagtatttacactgaacttctatctcaaatcacattctttaaaattatccattcagaagtgtgctaagtaaaaacagggtcgtttgtatagaattctcctgccttggggagtacatttatgagccacatgacattttggtcaaccacagaccacatatacaatgttggtcccatagattataatactgtttttttctgtatgttttctaggtttagacatgtttagatacacaaatagcactttgttacaattgcctacaccattcagtacagtaacattttgcacaggtttgtagtctaggagtgataggctataccacatagcttaggtgtgtagtgacctataccatcaaggtttgtataagtacactctgtgatgttcaacactgacaaaattacctatggatccgtttctcagaaccatcgctaaatgattcacgactgtttactgtaggttggagagaggcatttaaaccaaatattccaaggtgatgtggtaggtagtgttatcgaaaaaagcccagataatagggtgactcagataaggaacacttaactcacccttggaagatgagagaaggcaaggtgaaggtgaggtacttctgtctgagccttgaaggctgaggagttattcggagtagtaggtgaaggggagaagggaaagggcaggcatttcaatcaaacacagtttggcatttgtgtggctggagcacagggagtgtcataccagaggaagccaaagaggttccagatgctggatgtggatgcattagcacactgttctttacatctccagttagttagacccttcctgtcttaagacccatagagaaaatgcaccttatgaatccaagcgggaacagtatacaatataaagtcctctaaattgcatctgtttcagtcctgcctacttgcttgtaaactgtaagaaaaataaaggtccatttttaaaataatttgtaaaacacatttttataaaagctgtccttgccataaaaatcagtaacccaagtcaattaccctaaatctgcatcttgtacacccacattccaagtgtttaaggcatttgtttaaaagcacgtttgcatatatgaatatttaacatagagtatgtaattaaacaagtctatgtgtgtgtgtatatatatttactgagcattatctttagcagaaaataatggaatgttcttcaccctggcattcatgattctgttgtcctggcacatatggtgagtaggaatagtacttgaggctcactcaagcagtcgctttaatgaaaccatcacaatcaggcactctgcaaagcagtattctgttcctctgttcattaaatccaccccccaaccctttcaactttgcataaattgcataggcagtgttatttaccaattggaaccggcaggagtaaattagcaccggctgattgagagacttttgcccagtgaactttatgttcccccattgaatccatttattgttgccattcctgctttggaatatgacttccctagaaagcatttcttcattcagcctctgtgctggaaacagacaacagcttgaatccagcagctgctcttgaacaaagcaggtagagaggcaagaaaggctgttgaataagcgcatcatgacataattacagtaaatctccagagtgacctgcacacattcaatgccatatggttatttttggtgctagaaacgtgtagctggaagccatagtttaatctagtcactttctgaagcttcctgctagcatgaaattgatttttttacctagaaaattaacatgaatatttattgacagaagtgaagactatatttgcacagtcagctaagagtgccagtaaatttaataaaaatatttgggttttgttttacccaaaagtatacaaataggtgatagaaggttttgttttcttttgttatggagttattgactttgtttgttttgtttttcaagctctagcagtacctttataatatgtcatatatgcccttaaaccatctcctcttcctcttcctccttgtttttttattggatagtgttttttcagtagtgcatggaaagactgttctttgcttcttttaatgtcttcatttgtctttaactaggtaaacaggatttactgctactgtagcctacccagaaaaaaaaaaaaaaagtagaacctcagaacagattttcaatatggatgataccttgtggtccatcagggattaataaacaaccctttctgcctctgcttctgaaaatactttagactgcagaagatttagatacaaacgtatatgtcagagagattgaccagctcagaacaccagccatcaaaactcatttaagggtttcttagggcaaatctattcttaccaggacaatagcatgaatctcagacaaatattttaaagatctcataactctcttgcaagaattttccttgaactccacttattgatttgattctgagagctttatgaaggttaaatattgttctgtgcattcacataatgcaatggtcttatattgataacagtagcctgagtaaccaaattttaagccatgtctattttaaaacgagagttctggcagatatgaagaaatctgctttgtgacttgaaaggacatttattttcagaggactatgttgcattaaaaaatatttcattttcctattaccttaagtgaaaaaggaaatggaatgcaaactcggctaaagtaggagggttcaaagaacacataggttcatataggaaggagggctgcaggaacagaaagatgtgctatcttttctcacccatcataagggccatggccaacactcctctaagtaaagactggttaacaagagaaaggcataacaaatttatttaagcaaaattttatgtagcatgatggcattcaaaatgaagacccaaagatgcaggggaaactgcttttgtgcttaggttccttgaagaatggacagccttgtagacatgtgattggacataatggtgggatctaatggcaatagactgagagggcaaactcatctgtctgttcagattcttcttggtctctctgtgtagcatttcatcctctcaggtaggaggaaggacctctgtgagagtcttcagggagaaggtaaagagtgatctttctagatttgattgcttgctttggaggagaggggttctagcttccatgacctaccttggagaagatgaattctggtttgtatgaatcactttgcatgcgaatgtgaagtgggagacaggaggaaaggagaagctcagagagagagtttgcttctgaggctgcttctgaggttttccaatttcctttcattaaaagtactcagtatgcctaagtgccatattttggggcatcattttccgagccccaaaagggccacatacaaactggttttgcttcagagttttctccctgccgcaagccacctcccatgccctgagacctgcgggattgaaaataggcctccagatttgctgtctaccggacaaaaaatggatgttcctcttataagcctgatattgcctcatagctggtctttcttgtgctatcatcatgggaaaacacataaatccctcataacagaagcaaatacttagctatctgtgtcaccctgacaagttaaattgctgaaacctcaagcatgtttaggtgtcttcttgagaatcaaacccaattgatatgttgttttctgcgcttgattgtataaatttacaaaaaagtaaaaggatctattttttttttttttttgcaggaaaataagtagctgtataggtcaagaagattgaaataacagaatttagggaacttgttccacagttgaaacaatcagtacttatttaggctactgtaatttgtttgacacttgcatgaataggggttccaaacaaggtcacttgcgatttagtaagtgcctcagtagcaaagaaaactaaaagatggatttttttctattgactccctgcatgaccttcaatgagttatttgcgcatagcttttgttacctccattataaaataaaaatcataatattaatcgtttttccccagggttttctttaaatcttgaaaagtttttaaaaattaaagtgcagtataatcattaagggtctaagagtcagaacacataacctgggcatctgcagaatccctaggtcttaaaattcccaaaacaaatcaactagattttcacaatgtaaaggtaatgaatatgacaacagtagtggtgaggtgagatgtaggaatcagaagaagaaggaaaagatgtcttgtgttgaaaaacacaattaaattaattagatgatggtgtttctggcttaatccttggttactcaacagattttttaatctagtggctcattaaccatgtaatacctaacttatattctaagattttcatcacaatttgtttcttcatataaaacatctattattttttcatatcgcagttatgagtacacttctgtgtctttatcacactagagctctcctaaatgataaacattatgacaatttaatatttactctgtataagctatgcttttataaagtccagcagaaactgatgcaggatttcagcctgcaaaataagtgtaggttaataggcatttgttttttacttgcagcacttcagctaacttttccagtctatattgtttctgtttcaaatgctacattttattattcctataaagcaaacattaggtaatatttctattgtatactaacagggatcagcaaaagatgtatgtactagaatatattctctaagaagaattcagggtttcatttagtcctgccgctaaaactcctatatcttacacactggcaccacatagacttgaaatccatcttggtggctggtctgtctaaatgagtcagcaaggatggtgtgtatcttacattcagaagtcttagtttgatggggttgtacgatccctgacttcattacaagtacacctgtgactgaacaggtgatgaaacatggagcaaatacacagagacagatggattcagactggcataattgtagtcttacttcattattattttcccaggctccaggtgatttctatttttctttatagcatcacttgtctcaggaagtcccagtggaccttgaaacagaagagaaagatgcatcctggtttttatctaagccagtttgcagtgtgggcacttcagagggttgtgctatgaaaaagcaattagcttcttgagtctagggtgccatttaaaatatctaagctactgtgcttcatcataaaattgacctttttaattttttatgttagaaatctccactaaaagtgttagcataaaaaaatgtgcagctccagggaaaatatgaaaggcttgggaaggagtagtgaaagtctgtgttaccctgaagaaaatttgaaatcagctccacttggatataataaataccatgtcatgaagtaccctgtgcttaatttttaaataattggtatcattaagtaacataacaatgacatagcaacaccagttttgcataagtaggcaggcagtgtatcttagatttacaaccgacttacaatcttgcaggataattactttgctctctagaaaagaagtccttttctcattacctttgactgtcattcctatgccataatcatcttaatgtgattgtaatttatgtattgtgtttttcaaagctatatcagatttgccattttaattttcctgtccaactccaaagtttcagtgggaaaaagtcaacgtcaatttacaaaacgtagggggaagttatttaggaacaagagaatttccacagaaggtcatcatattcatttatgcatcccatagttttgtcactgccagtaataacacagaatgttttctagaggggtgtagaggttagtgcagggtaaaggttgagagttaaattacttgtgatccaggcctagcaattccactcattaactgtagggcttttggcaaattatttaaccttttggtccttcagcttccctgtctataaaatgagattgcaatctagttagttgtagttgtagatccaccccaaagcttagtggcttaaagcaataatttagtaattacctctcagagttctgtaggttaaccaagtttggctatgtggttctggcttgaggaactcagtcacatgatgtctgggcctgaggggaagtcatgtggactgagcattcaaggtggctcacagttgatgctagccattgttgaagcttagctggaatgtgaaccagagtgcctcctgatggccctgccatatacttcagcttctcatagcatggcagctcagtttggagggggacggcaacccaggaaagtgccttcctagtgacccaagaggaggctgcaaggcctttatgaaccagccttgttatacggttttgatctctgtccctgaccaaatctcacgtcaaattgtaatccccagtgttggaggtggggcctggtgggaggtgattggattacagaggcagtttctcataaatggtttagtgccattcccttggtgctgttcttgtaatagagagttctcatgacatctggttttttaaaagtgtggagcaccttccccactctcttgctgctgctccagccatgtaagacatgcctgcttccctttgccttccaacatgattacaagtttcctgaggtctccccagaagcagagaagatgccagcatcatgcttcctgtacagcctgcagagtcgtgagccaattaaacctattttctttataaattacccagtttcaggtatttctttatagcaatgcaaaaacggactaatacaccttggaagtcacagattcatgtaatgggaaattagactctacattctgatgggaagggtggcaagatcacattgagaagagcatatggaatgggagaaatcattatttttgtcaacaaacaaatgggggaacaattacatttccttttctttttctttctttcagttaagtaagatttagaatccagcagaattctctgctcagaaaaaatacataaagaagtgtgtatttataaagatgatttatcgatatatttttaatttcacattttgatgacttccaacacacctcattactaatattcagaacaacctgcttaagtgagtgactctaattattgttctacacatgaatattatgggagttagatgaaaaatcaggcaaaatcttagaagtcacaagggaaaataactcatgcattaaatattttaataggatctcaccaagatgtgggaaagaacatttaaaaatacacttccctctgaattgattagtattacttctgttcgctcagaatctcattaatgaaaactcaaagtgttgagttacatcagcaactttttgccaaagcaagaggttcataacaactgagaagtttattatagtcacagttagaagactttatgtccaaaacacagttcagtcccttgtaaatgtcagattacaaacctcagtttgcaaatgggtaacagtattttatttctgccagctttcttcaaaaatgaactaataattaaagataaatgatagaagctataactgaccaaagacaggaagttgtgcccccaaaacagttactagccagctcactgattttaacctagaggctaacttaacttataagcatttagagcaagaggaacataaaatttctgacatgaacctagagagaaaaatacacctaaaaaaattgagtgccctaatacagaagctcattttccaacctcagataacagattagggtgctttccttaaattccaataaaaaggaatctactaggctcttcatatagaaattgtctctttcctgacacacacacacacacacacacacacactctctcatcatgaaagagacaatttctatgtatgcgtgaatatagaaaatacacacacatataaatattgtaattagaacattttaaaataatgccctagaattctgaaattttggagactaagttctgtaacacttccaaaactaagcttattataaaatattttatttattcatacactgtgatcatctagaatttttggcataaaaattctagttgataaaactaaggagagagatacacacacacacacgcacacacacacacacacacacacaccggatgacatacatataaaaaactgagctaaaactttggaatttcatttctttttttataatgttttaccttctcttgattatttctgttgtaatactataagaaaggatgttaaattgtgtgatctttcaaagtctttcttaaggacaattaattaatggtgactttctttgtttgagctgctcaacttaaacatctgtccatatgagttttatacataatgttgaaaaatatactcagaagagtattaagtatgtatttttgcgatttgttctctgtcaactaaaaagttgatatagctttataaaaattaaacaatacaaactggcacaataaataataaactgaaaacaactaattaaaggaagcagagaagtaagtgataaagtgagttaactgggatctattacctataacactgatataataattgtttctcaggagaaaaagaagcatgacaatagatataaagaaaattttatttttctaatcaacaggagcgtacatacatttacatgtgtttctcttctttgtgtcattatcaaagtttgagtcttagtattttttacattaagaacctagaaattttttggaactacttttggtcagaaccagttttgccataaggatcaatcacttcatttttttatttatcaagattattgcatggcctaatagaacatgttttaataaagacatcacaaatttttaggatattttgagagtaagattagtcctgtccctccatcccaggttgggctgggcatttgtgctaacctctggaactacagtgagcccataaaggagaactatgcagattcaaagactttggacatggctacagtttgaactattggtatgttcaaaacattcctcatggaagaatagtttgaagttgggttacattgaactgacagatacaacaatttcaaatactgctatatatatatttgcctatcaaatatgcatgataaaaatgacaaaatatcaaaaccaggcatgggaagcattccaactccattagaatcctttttgaatatttgatattcatttttttgtgtggataaatagatcatattttgaatttcatgaaaatgccaaccttataaatcataaatatgaaaccttgtaaatcataaatccaaaacttttttgagtgtgatatatttacagttaaatataaggacaaagagcaaaaagatatttatattgacttgaatgatgagtaagcattgtgaattgtctccatgaattccatatctggctgagatgaacagccagcaaattcttgccaacacggttttcattttctttcttaatggggcttttttagatacattacagtgtttaagtaaagtgtcagaagaagtcaatttgtggccaagaaaacgtagaggagggggagaaaagaaatagtctcatgatgcttgtttcccacttccatactcatcacactccccatttccccaccttgatgctagtattgttctttctccattaaatcatcaatgcttattagccttctgagagccacagaatgtaaaattttgaaagcccaactgccagcacaaatgccctgacatcggtcattacaattccacgccctaaaggcaatcagagcttttttagtcattaaaaatgcaaacatagcattgaaactacagcgacattatttcaatgctatgtgggtaattttccaaatggaatatattccttaaatatatggtttcataaagttaaatttggctcactgctttattcacatgataacatttttatttgaaaacaaattaaaagtaaactctgtgggcttaaaagtcatcttgagctcatgtgctggatagagtaaaagttgcatgcaaaaaaagggcattactacttgtttccatcattctactgggtatatttaaattcagattcatccagtactttgtcagcaaagtcataaaccttttacaaatgtattgtcaccaaaagacaaaaactacaatctggaacaaaccaatgatccttcaagactacctctgactggatttactctgggaattttcaaaagtaggtatgatatgtcctccaaagtgggaaagactaaaggaaaaaaaaacaacaaaaaaacaaagacctacatgagaaattttcttccagaccttagagaatcaacataaactttaaatcatgagtactgattaccgcttagcattgtttccttacttgggcaactttggaaggtgcctatgatgattgtatatagcacaaaattctgatatttagtttggctatttaattcacacatttcttgattttcatataatgtttcaataattacattaatccatgcattcaactgtactttttagtctgtggtactgtagacaagagaacaagagaaggaaaaaaagatacccagaagattgtacagactaaacactggaagctctgacaagtgtgtggaaaacacttatcagtcccacgagcacaagcctagtcataaaggttgatgccttttgctaagaagtaaagaagtgactccgtgctggctctgacatatctgttaggaaataaacaatcttctcagaatacaagtgtgagacataattgagcatctgccaagaaatataaaatttaccaacagatagggatttgtgccagtttgtgggtgaatctggaatatgccagcagagatctggaatatatgtttagtaaattcaatgtcatataggacataaaaaggctttttcatgtatatctgccatctgaaatgtatgtctctagaaaaaaaaataaaaatagaaataaagaactaactaaatttatggtaccgaagagtagtatttgttttccagaatcataattgcatgtataccaaaatgggagttctggaaaaacgttggtgtagatcatgagaaaggcccaaaaggcaagtcacaatgacaaaagaactatttataagaagaggctcactaacacattgattgagagaaaaaatgcactgaggtaaaaccaatttgaaatgtgtcatagattgaagaataaaaattaatatattcattaaacatttcttgaaacaataccatgtagcagacactctgtttagagcttcctagaaaaaaaaatcacaaaagactatagaaagaagaaatacagagcattggtcacaaatgttataatttctatactcaaattcacagcaactaaataaacaatgtaagttgaaatttaagtacagggttacaattaaaatcccacaggtacttatacccaagacagaccaagatggctgatgaattctgaatagcagtggaaggctaacttgttccaaataataataataaaaaaacatgttggagaagagcatatgtcacaaatacatacctataaggaaaaaccataaccctactgggagaaaataatagacaatgtttgactggaaacaaaaagtgagagagagaggagtgagaaagagacagagagagagagagagagacgtgcatatgatacaccctcctggttggatgtttgcattatcctaacaccaattaaaggcaatataccttaattctgagagactttcattatctgaaaatctactatgatttatatcctgatagaaccagagcgtctaatacactctctacttaacttcctggtgattttacctctcagcaggaaatggaaacaacagagggagtgctatctgcatttaatttttaccacccaagaaaaaccaattaacaataaaatggaaaaatggaaactttctgtgaatatatttatttaatacttataatgaccataggaagaaataatttatttaattacaaatctaccctcttttctttaaaaaaagtttctgctaaaagatagatgtcatccaatggccaaaagctcttaaaaggaatatggcttggaaagaaactagatgcttccaagaacaagatcatgatcacacaaagacaaatgtgataaatagtactaggaaggaataactaagtagataaatgaatctggatgcacagagttttctataagctcttaatgaaaaggaatacatataaaagattgggagtcctttagttattattaagcagtgcaagctgaggcctgtgaaaaataaacagaataataaaaatgactttttagtatgttcagaacaagataaaaataagagaggaataatctgctgttagatggcttataaaatgataccacatgacacagaaaatgcagaaattcccagctgctttcttgttgttgtctgtcacagactgatgtggggatagtgaacattgtaagaaagaattgaaccctaagtggagaaaagaagagtgcctgccatgggtacaagtctcctgtttggtaaaaattgcatcccagggtatttaaaaagtttgtgaataagatggttgagatgttatcagtagcatttggggaattatgaagatggagtcattgggagactagaaacaggcaaattatgtcctgattttcaaaatctataaaaacaagctttctgaagggaacgagtttttttgtagagtcacagtaaaatcataagacatactgttaaaccctgaattttgagcacctaatgcagagagcagtcactaaggctcaaaatagtacgggttagaaaagagtttatggaaataactcaattaagcatatgttattttaaaacagacagtcaaagaagtagcatgaagagctctgaagcagcagaggaaagcctagagagaatgtagacttcaccaaattgagggacccacaaatcctccacacatactgttggtgaccattatgttttttgagagattgataatgatgacaacaaagagaaggttatcatgactatggcgaccttgatgatcacaatgataatgattgtaggatctctggagcgttaagttcccgaaaacaagaaccacatttggtttttccattggtctgttccagtacctagtacctaggaggatatccacttgttttaattgaattgaatgataattaataataataatactcaacaaatgtctaaacatcttatgagtctttacttcactttattattacaacaagcctatgaggcctaggtaatattattatctctatcttacagatgaagaaatgagccttaggcaggtccttagccaagattactcctaataaatgagaaagttctagttcaaatccaagcctatctgattaaagggctcttcattgctgttattatatattgaattaaaataagcgacatttccttctggctgaaatatgattctatgtcagctgagacagtttcttgctccatggaggtcctcaaaaaaaacaaaaaaaagattgaatcaagtccaggcagagctatcagaaaatctagaaaatttagagaacaaaatgaataaactgagaagttccaaacagggcagactcaaagagctgaatccaggaataaaagatgtgaaagcagatagaaaagtctcagtataaataagtggtcaaagagcagcaagtcacttagaacatggatgccacaacaacatggcacctaatcgtcatttgactccactgcttaatctggcatgtaatgactgtccaactgaaaaactaaaataaaataaaacagactgaatgcattaaaggatgttttctttatttatagttggttttattttttttttattatactttaagttttagggtacatgtacacattgtgcaggttagttacatatgtatacatgtgccatgctggtgcgctgcacccactaactcgtcatctagcattagtatatctcccaatgctatccgtcccccctccccccaccccaccacagtccccaaagtgtgatactccccttcctgtgtccatgtgatctcattgttcaattcccacctatgagtgagaatatgcggtgtttggttttttgttcttgcgatagtttactgagaatgatgatttctaatttcatccatgtccctacaaaggacatgaactcatcatattttatggctgcatagtattccatggtgtatatgtgccacattttcttaatccagtctatcattgttggacatttgggttggttccaagtctttgctactgtgaatactgccgcaataaacatacgtgtgcatgtgtctttatagcagaatgatttatagtcctttgggtatatacccagtaatgggatggctgggtcaaatggtatttccagttctagatccctgaggaatggccacactgacttccacaatggttgaactagtttacagtcccaccaacagtgtaaaggtgttcctatttctccacatcctctccagcacctgttgtttcctgactttttaatgattgccattttaactggtgtgagatgctatctcattgtggttttgatttgcatttctctgatggccagtgatggtgagcattttttcatgtgttttttggctgcataaatgtcttcttttgagaagtgtctgttcatgtccttggcccactttttgatggggttgtttgtttttttcttgtaaatttgtttgagtccattgtagattctggatattagccctttgtcagatgagtaggttgcaaaaattttctcccattgtgtaggttgcctgttcactctgatggtagtttcttttgctgtgcagaagctctttagtttcattagatcccatctgtgaattttgtcttttgttgctattgcttttggtgttttggacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattatatagggaatcctttccccattgcttgtttttctcaggtttgtcaaagatcagatagttgtagatatgcggcattatttctgagggctctgttctgttccattgatctatatctctgttttggtaccaataccatgctgttttggttactgtagccttgtagtatagtttgaagtcaggtagtgtgatgcctccagctttgttcttttggcttaggattgccttggtgaagcgggctcttttttggttccatatgaactttaaagtagttttttccaattctgtgaagaaagtcattggtagcttgatggggatggcattgaatctgtaaattaccttgggcagtatggccattttcaggatattgattcttcctacccatgagcatggaattttcttccatttgtttgtatcctcttttatttcactgagcagtggtttgtagttctccttgaagaggtccttcacatcccttgtaagttggattcctaggtattttattctctttgaagcaattgtgaatgggagttcactcatgatttggctctctgtctgttgttggtgtataagaatgcttgtgatttttgtacattgattttgtatcctgagactttgctgaagttgcttatcagcttaagaagagtttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttctgcccattcagtatgatattggctgtgggtttgtcatagatagctcttatgattttgagatacgtcccgtcaatacctaatttattgagagtttttagcattaagggttgttgaattttgtcaaaggctttttctgcatctattgagataatcatgtggtttttgtctttggctctgtttatatgctggattacatttattgatttgtgtatattgaaccagccttgcatcccagggatgaagcccacttgatcatggtggataagctttttgatgtgctgctggatttgttttgccagtattttattgaggatttttgcatcaatgttcatcaaggatattggtctaaaattctcttttttggttgtgtctctgccaggctttggtatcagaatgatgctggcctcataaaatgagttagggaggatttcctctttttctattgattggaatagtttcagaaggaatggtaccagttcctccttgtacctctggtagaattcggctgtgaatccatctggtcctggactctttatggttggtaagctattgattattgccacaatttcagctcctgttattggtctattcagagattcaacttcttcctggtttagtcttgggagagtgtatgtgttgaggaatttatccatttcttctagattttctagtttatttgcgtagaggtatttgtagtattctctgatggtagtttgtatttctgtgggatcggtggtgatatcccctttatcattttttattgcgtctatttgattcttctcttttttctttattgccagcagtctatcaattttattgatcctttcaaaaaaccagctcctggattcattaattttttgaagggttttttgtgtctctatttccttcagttctgctctgattttagttatttcttgccttctgctagcttttgaatgtgtttgctcttgcttttctaattcttttaattgtaatgttagggtgtcaattttggatctttcctgctttctcttgtgggcatttagtgctataaatttccctctacacactgcttcaaatgtgtcccagagattctggtatgttgtgtctttgttctcgttggtttcaaagaacatctttatttctgccttcattttgttatgtacccagtagtcattcaggagcaggttgttcagtttccatgtagttgagcggttttgagtgagattcttaatcctgagttctagtttgattgcactgtggtctgagagatagtttgttataatctctgttcttttacatttgctgaggagagctttacttccaagtatgtggtcaattttggaataggtgtggtgtggtgctgaaaaaatgtatattctgttgatttggggtggagagttctgtagatgtctattaggtcttcttggtgcagagctgagttcaattcctgggtatccttgttgactttctgtctcgttgatctgtctaatgttgacagtggggtgttaaagtctcccattattaatgcgtgggagtctaagtctctttgtaggtcactcaggacttgctttatgaatctgggtgctcctgtattgggtgcgtatatatttaggttagttagctcttcttgttgaattgatccctttaccattatgtaatggccttctttgtctcttttgatctttgttggtttaaagtctgttttatcagaaactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctgcttattttgctcgttagttgatgcagtttcttcctagtctcgatggtctttacgttttggcatgattttgcagtggctggtacgggttgttcctttccatgtttagcgcttccttcaggagctcttttagggcaggcctggtggtgacaaaatctcttagcatttgcttgtctgtaaagtattttatttctccttcacttatgaagcttagtttggctggatatgaaattctgggttgaaaattcttttctttaagaatgttgaatattggcccccactctcttctggcttgtagcgtttctgctgagagatccgctgttagtctgatgggcttccctttgagggtaacccgacctttctctctggctgcgcttaacattttttccttcatttcaaccttgatgaatctgacaattatgtgtcttctcgaggagtatctttgtggcgttctctgtatttcctgaatctgaacgttggcctgccttgctagattggggaagttctcctggataatatcctgcagagtgttttctaacttggttccattctccccatcactttcaggtacaccagtcagacacagatttggtcttttcacatagtcccatatgtcttggagtcttctctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcatttctctgtattggttattctagttatacattcttctaattttttttcaaagttttcgacttatttgcctttggtttgaatgtcctcccatagctcagagtaatttgattgtctgaagccttcttctctcagctcgtcaaagtcattctccatcaagctttgttccattgctggtgaggaactgtgttcctttggaggaggagaggcactctgcgttttagagtttccagtttttctgttctgttttttccccatctttgtggttttatctacttttggtctttgacgatggtgatgtacagatgggtttttggtgtggatgttctttctgtttgttagttttccttctaacagcaggaccctcagctgcaggtctgttggaataccctgccgtgtgaggtgtcagtgtgcccctgctggggggtgcctcccagttaggctgctcgggggtcgggcgtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccgcccagttggagctttctggctgctttgtttacctaatcaagcctgggcaatggcgggcgcccctcccccaggctcgctgccgccttgcagtttgatctcagactgctgtgctagcaatcagcgagactccgtgggcgtaggaccctccaagccaggtgcaggatataatctggtggtgtgccgttttttaagcccgtcggaaaagcgcagtattcgggtgggagtgacccgattttccaggtgcgtccgtcacccctttctttgagtcggaaagggaactccctgaccccttgcgcttcccaagtgaggcaatgcctggccctgcttcggctcgtgcacggtgtgcgcacccactgaccggcactccctagtgagatgaacctggtacctcagatggaaatgcagaaatcacctgtcctctgcgccactcatgctgggagctgtagaccggagctgttcctattcggccatcttggctcctccccctaaactctagttggttttattttaagaagctctatttcttaagcagaataacattgcatctcactatataatagagatcaggttttatgttacatagtgaaaagaggcttaggtcttaaattatagagttttttttctcagttatagtcaagatatttatctctgccttgtatacagaaatagtacagatgaaaggagagcataactaatatgttgaatgacagagtaaacatttaaaataataataataatatcatacatttatggagtgttgcctacatataaagcaccacaaaaaaataactttacataactcattaatcttcacagcaatcctatgatataggattatgcttcctgttacatagatgaataaagtaagactcaacaagattaaattctttgtacctggtcatagctatcaagtagaggagcaaatattcgaatccataaaatatttttcttaatcaccataataaaccagcaataagcatggttccttcctaagaaagcctgtaagaatggcctgaattatagtacagagtagggtggtatgatttaacagatactggaagataaagcttcagagatttctagttgacagcaagtccactatcagtcaacgctgtgctaaaactttccaataaagacaagacaagcttaaagttgcattaaaggatctaagaattccaaataatggagggggtagagcttacatttccatactcgtagctttgtggtttcattttaggaaatgaaaatgcacccaaaaaacggagatgggagaaaggttttagagccattgtgcataaaaaatcagagctttgagcaaacttagggtgttagggtggctgtcttcacatgttagaaaagcagtcttttagaagaggaataagtttactctctataactctagaaataggagggtaaaataaagaggcagaattttactctaagaaatatttccaattatcagaactatcccaaaatataatagaagtgatcactctatcaatgtcagcattcaaggaaatgttgtctggccacctgtcagagatgctatagggtcaggggtgattaaaggaccttcagtagtttttatctccaagaagtttatttgctcatctagcaactttaaaattggtttggacaaagtctagctgttcctagatctgactgcagcatccttaagacattctcctgaatgcgtcctttctgtcagtgtaatttctacccctatgggatgtatacctgaccctaactcattgtttccagccttttaaatatgtgctttatgcaccccttctcttgctgtagtggctctaacttccagagattcggatgtaatctacataaatattggagctgagggctctaaattaagctaaagcttcccagttttctttcaaaacagacgagcattatgaatacagccataaagcacagtcatgagttattcaaccagaggcagctatttgattgataaatctatttgcaggaatatattaaatgattaatgaatctgtcatatcaactaggacacttgctaattattttcaaggttccaataaatgtgatggcaattaattgcacctgctacaatccacttcatgcttggagctgacatggaagtttaactttcatttttcactggtgaaaagccttttgtctattcttgggccttctccacacctgccagatataggaaaacaacatttgtgtgtggcagagtcctacttattacgggctacacatttaaagcctttgcagtcttccctacaaacgaaagtaagagaagtttcgcaggccgtctaaagaagaaagtggtgtacttacagatctaattttcatctgagcatagtacattgtagttccctgaggcaggctttgatatcacaaaagcaatttctggcagattggaagggctattcccttctgggtttcaagcatctgacaggagatcagagtggaggtcctcctctcaggggaactgacaggctatttccaagaaacggaggctctgaagcaagaagcaggtatgcctgactgagtaatgggagactcctcatttaaactgggagagccacagcccagtgatggcagtaggcatttattcatgtcagaggagccttgccagctgtcccagaaaccatgagaatgattcagagagtgctgagcacccgggtcacagaaatcattagggtttaaccctataaatgccacccactccctgaaaatgctgggaagaggtagatttcattccattaccccttgtggcaattcctctctggagccctctagaatacagacattttctccattttctcttctagccagatcacactggttatcctccctaacttgtagctgctaagaatgaaaatcagctatggaatctcccttcatgctccacatcaaggtgtgacaaagcttgagagatcttgtggcttgccatcccaaacatgatgcttgaccacatattaggagaacggggtcacatgggagatacaggtgaaaggctgctccaggacctcattgttcacgcgtcttctgacctgctatcttcatgtccccttctcctctcccctccctgtggggctagaactagacttagccttgagctctgctccgtgagccactctcccctgagccactcttccctgatcactctgtaagcagatctaggaagaatccatgccccttctgaagccaggctggtttgacaccatagaacagtctcacccaaagcagccagcaatatcaccaggtgggagtcactgaggtggacgagcttggagaatcaaggaccacgatgtacattgctagcagctgcagaagaccatggaccatcccataaattcctgccccctgtcactgcctctgcccaactccacaaaactgctacctgatttcttcctcttctttttctttagcctccttcactcttcctcttcctcctccatatacccaaaccaaagggaaaatataacatctagattctggctaaagcgaatgctctagtgccattttttggctagagttaaggaaatgtggttgatagaggaggcacaggtgaaatcactctactacatattttcactccagaataagaacaatgtctcaaagtaaagccccgtgtttgggctgttctttggtattttcctatcagcttgataaagcttatttttgttctctcttttcacagcaataggctctgaacccagagatttaaagtctattggcaacaagagttatttattaaaagatacacagagaagttacatacaatggtaaaagaatttggagacctgtataattaagacctcatcttgctttgtgaccagggttcaaggttcagaacgtaatttttagataatagacattcctctcagctctgtgcatgcctactgcacccaccaactttgcaaattacagggtagttgccactttagcttttgagtttcccaaacaagttttttatctgccctctatgggaacacccatggaatctgaagaggcctttataaataaacaaagcaagagacatctgtatccaagatgtggcatggagagcataaaaacagccagagtctgagaatatcagttgagatcatagagtgatgagatggacccttaggaaacatgcccttgccccacatcagctaaacacagcagcacaacaatcaacatgagtttcgtgacatcccttctctccttagaagcctacagtggctcctaatatcacttagttaaaggcaaattcagcacactatataatctgaccccttttatccctctaaccactttttcttgaacatgccaagaacactccagtcttagggcttagcacctgcccttcccgctgactagaaccctcttctcctgattaacccccatagctttctttctcacctcttgctttatttttctccattgtgcttatgtcatctaacatactatatagtttactaatttttcttgtttatagtcatcttcatattatatagtttactaatttttctagcctatagtcatcttccctgctaggggataagctccatgagggcaggaaaattgtgtctgtttttgttttctgcagaattcccaatacctacaacaatgtctagcataaatacttgtcgaaagagtcaatgaatgaataaatgccatcacatatgtgtaggtgtttgtaagcaaatgttcttttacaaaattgtagtgcagacaatattccaattaaaaagaggatccagaactacagtacacacaactagctttgagccccaccttgacactttctcattatttgtataagtgaacctcatgttcagttaaaatgggattttaaaaaattggagttcttataatgttctaagataaattatgtaaaattattctataaattgtagcactattaagtgttaattactctcctcttcataggttgtcactttatatatgtaacattttcccactgtctaagacaattggtgatactcaataaatatatgtgaaatatcaaataaattgcacaacaattactccagataattaaaaatttccctttggaagaacccaggtaggtatcaatggttgaatcccagtggcattattcagtgggatttctggtcatattcattcgtgttgagttcaaataacttttggcataactaaaaaacaaaatttgtccccaaataattagttagtattattattccagaaaaaagtattaaaagttttaaaaataattccagaatgacaataacagtaattataacaataataagccttaatatgtgtagacatattttcagagtaaataaaaaccatcccttcgtaattattgtgaaaggaataacactagttcagccattgtattaaaaaacaaatctcttcaactaagatgactgtaattccaccattaaaggcctactttaatgagtgaattgtgtgttctgaagattcataagcttgaaagtttagcccactctggttctgcccgttggtaggtcactatgcctattctcctggatattttccgtaaaacaagagaataaaagggagcagaatagttgctattctggaggaggtgttatccccaggcatattcaaaagaaaaccctgagttaaatggttttatctctaagggatcatctaattaacagaacaaaatgaagaaaaagcatgaggtcactgtgatgtaacaacagagtcattgcacgttgtcttttttttaacatcttaccaaggtataattccacatactatgaaattcaccaaaacaaaggttgaattcaatgatttttttagtataatcacaattgtgcaaccatcacaacaatctaagtttagaacatttttattactctaaagagaaaccctgtacccattcgccatctctccccatctctcccttctcccatcccctggcaactacaaatctttctttatatacagatttccctactctgtgcttttcgtctgagtgcaatcatacgacatgttgtctttagtgactggcttcttttatttagcataatattttcaaagttcattcatgtcatagcatgcatcagtatttcattcatttttattgccaaacgtgttccagtgtatgaatgtgtcacattttgcttatctgttcaccagttgatggtcaactgggttactcccactttttgtctattaggaacaatgtgactatgaacatttgtgtacaactttttgttcattgtcttttaatatttctaagattaatattccccatagaatttcctatgaagaaattcacaatctttgcaacttcacagtctacacacaatcaaaccccaccctcaccacacttactgtgtgattatgcatctgcttaacttctctgagcctcggtttttttcatttgcaacatgtgctggcagaaagttaagtgcttgaaagtgacgcttatgcagaatactaaaaaatcttccgaatcttctatcctgtgtctatcttcacagccaccttagagatggcagatttggagtgcttcctttctaagtcaatttcaatatctaaaaaatccaggtaaaatttgagtaataaaaaaaaatgaactacaattcataatatttgttaatagagaaaaaattcaatttaacatgtcatttctgtcgaatgaaggtgactgactagtaaagaagacttaaataatacttatgagtttaaatgtaatttttattgagtttttctgtctgctaatttattgatataaaagaaaaaaggaaaaatgttggtatgatttatcatctatcattagtcaaatagactgtttttttccataatattcttaggataaattgctaatttccattttgtggtaaaaatccatttctatgtaaccattctatcccaacctattccataaaattgggatttactgtagtcaagtgctgacactggttcaaactttaatggtagaatatatagggaatgtttcttttctttttttttctgactatggtacattaagtccctagagggggcaaatgtttagcaacatgttacttatcactatatgactatataggactctaattcagaaatgtcttttgcaatcatcaatgacttcttcctgaattgtgcctaccaggcagccattagcaaattctctacctttagaaacattctgtagacaaatatcaaatagttttctttatttatgatctgctttgctagcatagaaacagtcccaaaggaaggagtttctttttcttttgttttgttttgttttactttcccaaagacatctttcttttattctcttctgtaccctaaacagctttcttctcctagaaagtaaataccatggctgacctatgagccagatacttctgttcattaaactgaccctgctaatcaaaaaaaaaaaaataggaaagtttgtatgcgcaggcatagtattaatggtatgacttatttctgcttgttcatattgtaatggaacttttctcctatggttcattcatcactttaaaaaattaagccaatttagaaatacaatttgaatgtataattgaatttgtcagttgattttagcctttacaagttaatcaaatagcagagactcaaggaagtttctcacacatgctctcttttatgggcagccaatcattccccaaagagaatgtcaaattctttcaggaatttttgctgattagatcctcattctttctttagaggactgaatttttttttcctagcaatcaagattcatgctatcagtcaaactgaaaggaataaaatggcataattttagctaaaatattagaaatgacaaataagtgaaatatgttaactggagtggaaaagaaatgtgtaattaagcaacacaaagaccatatgtcagacacttctacagtcatagatgggaagagagtgtagacttcttgcaaagacccacacagctgtcaggaaacttcagtcctctttaggattcactagacttattggggatatctcacctttacccgcaattgacaagttagttgttgtttttatttttgctgagtattaggatgcttgattaattaattttaacatgtggtaaattaagtaaattataatgggaaaaagatatttgcacgatttaaatgatttaaatacacacagaaataggcttatttgacatgttgaaaatctgaattgctacctttcaaatattactcggtcctgtttcaagcatgttttgaaatttttcatggaaatctgtgtcatacttaaaatgacatttatttctctatgttctaatggtgctgaagcatagagccctatttggatattctctatctaaaatagactggagattcagatagccacacgggtgttgcaaacctgcatcgtgggactgggcgacacctcagtcccagtgaccacatctgcagagcccagaggatcccaggaaccaggtggttccatttggtgaaaagaatgggagaatctacaggattcagtatgagaatatttctaaactctgaagaagacataattaaatctaggtcccagtattaaaatcagtcttccttatcctcagcagtatagtgggattgtcaagattattatattttgaaatactagttgccattttagtcatagaatcaatgtgataacccatttcataggggtgtgcagtacaaaaacagtgatgtgaacctcttttacatttggcatttctgaaaacttccaacaaagcattcagagctagcataattccagccagatgaggacttttaaccatgatactgacatggcttagaaatatgaaacgttggccgggcgcggtggctcacgcctgtaatcccagcactttgggaggccgaggcgggaggatcacgaggtcaggagatcgagaccacggtgaaaccccgtctctactaaaaatacaaaaaattagccgggcgcagtggcgggcgcctgtagtcccagctactcgggaggctgaggcaggagaatggcgtgaacccggaaggcggagcttgcagtgagcggagatcgcgccacagcactcccgcctgggcgacagaacgagactccgtctcaaaaaaaaaaaaaaaaaagaaagaaatatgaaacgttacagtccatcagacatttcaacaaattcactttctgatgcagagtgtacactgaaggattcaagatactgagaacccgctggctgccaagttttacttgtgaattacaaacatatgtaatatattttatataatatttaaatggcttgcattatcaacatttctctctccattgagttctttccttcagtttagcgtctctttcaagtcattccaagaagtctttttatctttgtccaccttcaaactgccacccacccccacttcctttcacagccagtgttttttgagaacagtggcaatggcccgttcacccattggtgcctcaatgtactgtcaccaatggccccagcagcagctatttttttaattgtagtaaaatatacatagcataaaatttacctttttatctatttttaagtatacatcagtattattaagtagtattaagtacattcacattgttatgcaaccaatctccagaactttttttgtctgtaaaactgaaattctatgcccataaaataacagctcttcattatgacctctccccagcccctggcagccaccattctactttctcctccatgattttgactactcagcgtacctaatatgagtggaatcagacagtacttatctttttgtgactggcttacttcacttagcaaaatgttttcaaggtttatcaatgttgtagcatgtgtcagaatttcctttctttttaaggctgaataatgttccattgtataacagaaattctttatccattcatctgttgacagacacttgagttgctttcaccttttggctattgtgaataatgcttctatgaacatgggttcaaaaatatctctccaagactactttcagttcttctgggcatatatccaaaagtggaattgctagatgatacagcattttatttttaatagtttaaggcagcagtcctcaaactttttggcaacagggaccagtttcgtggaagacaatttttcaacagatgggacagacctggggtaagggaaagaatggaggggaatagtttggggatgcaactgttccaccttggatcagcaggcattagagtctcataaggagcatgcaacctagatcacgtgcatcgcagttcactatagggtctgtgctcctatgagaacctaatcctgccactgatccaacaggaggcagagctcagatcataatgtaatgctcccttgcctgctgctcccctcctcctctgaggcccagttcctaacaggccacagactagttccctggggaaagggggacccctggcttaaggaactgctatactgttttccatagctaccaccccattttacattcctgcaaacagggcacaagggtctcagtttctccacatctttgtcaacacattactttctgtttttttacagtaaccatcctaaaaaatgtgaagcagcagctcatttttagatctactattttagagtctttcaaggtgtggtttgcagatatgcctcagagtcacttcaaaaacacatgaggaacatctagattcctgaatccaaagctctagagattgggcctcacaatatgttaacgggtgcctgagatgttgttttcaatgacttttgatacacaacctaccatattggatggatatgatgtgaaagtacctcaagataagaaagaaaatttgcagagaatcatacagataccatatagaacagaatagttgatataataattgtcactttgcatgtgaatacataaactaagattatgtagaaacaactagcaacttgttacctctagatgtataattttgcaaatataactaagtcccaagccacacagtgacaatttacatcacggtgctgaacgttaccattatcatcactgaattgatgggaaactataagcactttcattgtgttcaatgggaggggtgagtatcacatatataatgatatctgcctcactgctgcactggcaaatatttttatttttatctatttcccttcttttaatcagtaaaagtcagggttggcatttcagttattttatgattatttgaggcttttagattgactactgtgctaggcactgtttattttctgcagggtagacagtgccttagaccttagctatttgggaaggttccagtttattatgggagaagaccttagggaccaaaatgaaattgtccaaaatgacagcgggtaggaacataaactgaacaggaagaaaatcagtttttactgtaagtaagaaacaagttaaaaggtgcttaatgtcaagatttgaattaagaagctttagcttatgccaaagaatttttaaaattttaaactacttgtgctgattttgcttcagcaaaactagatttataaaatcatgtataagcagatcttttacttccaaaatgctgggcatctttccaatcctactctttagattttgtgtttctatagttctgtgctggtatttttatgcttctgaaaccctgtctgctttcagcaattaataaaaatactatgggttttgatttgcatcactgcagcatatgaactaaattactttgcatctgcaggtttaaagcagaataaaactctttgtgataaagtttcataatgttcagatgtaagtcactgaaccatggaatccaatgagccaacaccaaggcagcaaggaagagtggctgccgtttgttccagtttatatcattccagctaaactgtctgccattctagagaggtttaaatactaagcccctacgttgcttttaaaatataatgagtaatttcctgaccaaaagcaaccactgagacaaaccagagcacagcacaagatggcaccccaacttgtccatcatggcttaaccatggtaggtgccaagtcaatgcagaaaagtttgctctcacagggtatttaaagaatagctattataagttattatatcttcactagaatatatctcttattcaccattcagtgcttccacccaagggtaaaattaaagtgatttctcctactacagtttattctgggtgacctgcctgccttcattgcttcttccctttgttctagttcagtccactgcagtacaattcacacaggtaagatactcatctacttttcactatagtgtaaaggagtacatagataatctcctagaataaaggatagaatgagttatagtgatataacaacttcaacattgtttcaaagatagggaatagtttattaataatataagaattaaggatgaggattatgtttcattaatatgtacaactcttcagtctttagcacagtttattacatgtaaaaagactcaaactctaaatgcataaatgaattaagcccagttttttgggttagttccatccaggtttaaatatttccctttggcccataaatatgttcacatagcttggccttagttttctttttcttctggataatttaccctaaattcttctagttccaagttgagttgatcccttttaatcactattttatcctcttaaggtcaaaggatctcataaaattacaatgatttcatgtgtatccctttcaacaactctgctaagtttacccagtgtctactagggaattccgacttgcccctttcttccttcttcaacttttgacttagaccccttgctggtatcagcatttattttcaaatgaaccatcatgttaagtagctgctttgaattacctagaatatcttctcacttctcatgccctctatcacacataccccactcttaagttacaatttacatactagaaaactggcttttcttttggccattttttttgaaatggggtctcatttgtcacataagctggagtgcagtgtcatgatcatagctcattacagcctcaaactcctgggttcaagcaatcctcccaccttggcctcccaaagcactgagattatagatgtgagccatcgcacccagccccttatgctatttttaagtctttgagttatttgggcctcatcatcctggaatattcctaagccctgttctatttttaaaactaaagatcttttagagaaagaatctttagtttttcctgtcttcccatgaatatcatatgccaagttgtttgtcctttattacccaaacttggccattacatttcctttaaagcaagagtcttccaaatgatacagtggggtaatatgctgaaagggcaatcagttgtttaaactccagaacgatattccacataaaaatgaatgtggaagcagagaggagccaagatggccgaataggaacagctctggtctacagctcccagtgtgagcgacgcagaagacggtgatttctgcatttccatctgaggtaccaggttcatctcactagggaatgccagacagtgggcgcaggtcagtgggtgcatgcaccgtgtgcaagccaaagcagggcgaggcattgcctcacttgggaagcgcaaggggtcagggagttccctttccgagtcaaagaaaggggtgacggacggcaccttgaaaattgggtcactcccacccgaatactgcgcttttccgacgggcttaaaaaacggcacaccaccagattatatcctgcacctggcttggagggtcctacgcccacggagtctcgctgattgctagcacagcagtctgagatcaaactgcaaggcggcagcgagcctgggggaggggcgcccaccattgcccaggcttgattaggtaaacaaagcagccagaaagctccaactgggcggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacacagctagagatctgagaacgggcagactgcctcctcaagtgggtccctgacccatgacccctgagcagcctaactgggaggcaccccccagcaggggcacactgacacctcacacggcagggtattccaacagacctgcagctgagggtcctgctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaaccagagcgcctctcctcctccaaaggaacgcagttcctcaccagcaatggaacaaagctggatggagaatgactttgatgagctgagagaagaaggcttcagacgatcaaattactctgagctatgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagctgatgcaatcaactggaagaaagggtatcagcgatggaagatgaaatgaatgaaatgaagcaagaagggaagtttagagaaaaaagaacaaaaagaaatgagcaaagcctccaagaaatatgggactatgtgaaaagaccaaatctacgtctgattggtgtacctgaaagtgaagtggagaatggaacccagttggaaaacattctgcaggagattatccaggagaacttccccaatctagcaaggcaggccaacgttcagattcaggaaatacagagaacaccacaaagatactcctcgagaagagcaactccaagacacataattgtcagattcaccaaagttgaaatgaaggaaaaaatgttaacggaagccagagagaaaggtcgggttaccctcaaagggaagcccatcagactaacagtggatctcttggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagtgctaaacatggaaaggaacaacccgtaccagccactgcaaaatcatgccaaaatgtaaagaccattgagactaggaagaaactccatcaactaacgagcaaaataagcaactaacatcataatgacaggatcaaattcacacataacaatattaactttaaatgtaaatgggctaaatgctccaattaaaagacacagactggcaaattggataaagagtcaagacccatcagtgtgctgtattcaggaaacccatctcatgtgcagagacacacataggctcaaaataaaaggatggaggaagatctaccaagcaaacggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaacacaggagcacccggattaataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagtggacctaatagacatctacagaactctccaccccaaatcaacagaatatacattttttcagcaccacaccacacctattccaaaattgaccacatacttggaagtaaagctctcctcagcatatgtaaaagaagagaaattataacaaactatctctcagaccacagtgcaatcaaactagaactcaggattaagaaactcactcaaaactgctcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaaaccaggagctggttttttgaaaggattaacaaaattgatagaccgctagcaagactaataaagaaaaaaagagagaagaatctaatagacgcaataaaaaatgataaaggggatatcaccaccgatcccacagaaatacaaactaccatcagagaatactacaaacacctctacgcaaataaactagaaaatctagaagaaatggataaattcctcaacacatacactctcccaagactaaaccaggaagaagttgaatctctgaatagaccaataacaggatctgaaattgtggcaataatcaatagcttaccaaccaaaaagagtccaggaccagatgtattcacagctgaattctaccagaagtatgaggaggaactggtaccattccttctgaaactattccaatcaatagaaaaagaggaaatcctccctaactcattttatgaggccagcatcattctgataccaaagccaggcagagacacaacaaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtaatccagcatataagcagagccaaagacaaaaaccacatgattatctcaatagatgcagaaaaagcctttgacaaaattcaacaacccttcatgctaaaaactctcaataaattaggtattgatgggacatatttcaaaataataaaagctatctatgacaaaaccacagccaatatcatactgaatgggcagaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctctttgcagatgacatgattgtatatctagaaaaccccattgtctcagcctaaaatctccttaagctgataagcaacttcagcaaagtcttaggatacaaaatcaatgtacaaaaatcacaagcattcttatacaccagcaacagacaaacagagagccaaatcatgagtgaactcccattcacaattgcttcaaagagaataaaatacctaggaatccaacttacaaggcatgtgaaggacctcttcaaggagaactacaaaccactgatcaaggaaataaaagagaatacaaacaaatggaagaacattccatgctcatgagcaggaagaatcaatatcgtgaaaatggccatacttcccaaggtaatttacagattcaatgccatccccatcaagctaccaatgccttttttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactgataccaaaacagagatatagatcaatggaacagaacagagccctcagaaataacgccgcatatctaaaactatctgatctttgacaaacctgagaaaaacaagcaatggggaaaggattccctatttaataaatggtgctgggaaaactggctagccatatggagaaagctgaaactggatcccttccttacaccttatacaaaaatcaattcaagatggattaaagacttaaatgttagacctaaaaccataaaaaccctagaagaaaacctaggcattaccattcaggacataggcatgggcaaggacttcatgtctaaaacaccaaaagcaatggcaacaaaagacaaaattgacaaatgggatctaatgaaactaaagagcttctgcacagcaaaagaaactaccatcagagtgaacaggcaacctacacaatgggagaaaatttttgcaacctactcatctgacaaagggctaatatccagaatctacaatggactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagataccatctcacaccaggtagaatggcaatcattaaaaagtcaggaaacaacaggtgctggagaggatgtggagaaataggaacacttctacactgttggtgggactgtaaactagttcaaccattgtggaagtcagtgtggccattcctcagggatctagaactggaaataccatttgacccagccatcccattactgggtatatacccaaaggactataaatcatgctgctataaagacacatgcacacgtatgtttattgcggcattattcacaatagcaaagacttggatccaacccaaatgtccaacaatgatagactggattaagaaaatgtggcacatacaccatggaatactatgcagccataaaaaatgatgagttcatgtcctttgtagggacatggatgaaattggaaaacatcattctcagtaaactatcgcaagaacaaaaaaccaaacaccgcatattctcactcataggtgggaattgaacaatgagatcacatggacacaggaaggggaatatcacactctggggactgttgtggggtggggggaggggggagggatagcaatgggagatatacctaatgctagatgacgagttagtgggtgcagtgcaccagcatggcacatgtatacatatgtaactaacctgcacaatgtgcacatgtaccctaaaacttaaggtataatttaaaaaaaaaaagaatgtggaagtttcatgaaaatagagacttattttatacactttatcatagctattgctactcatctgctcacttttcttctaagaagctatctggaactattctgtctctacataacaatctaaatattaataggcagtgtctataaactattagtagtgtctacataacagtatctataaagtcccagttaaatgtccatatgaaaatgaacacatagtaagtgctaaattaatattgtttttagaatgaatataataaatggatctcaggcaagactctaaaagcctactttacttagccttcatgtgaatgaaatatcattctaatagtgcagtatcatatgaccttacctccatttattaaagaatttatcatgaaaattccatagaactttaaaatagagatgagaaaaaaaaatcatctttgcctgctaggacttcatcagaaagaggctccatcttctccagcccttcctttaccttttgagtgggaatagccttcttcaattctagtttatttctggggattgcaaataagaagagaccatttgtacatatttggtgccatagagaagagtaaggaatagagatacgggctcttacggaagctgaggaataggacagggtttggtgaaatcccagggaagttagcaaaggctaaggctaagaggcaaataaggacagaagttaggtcacagtgatggcatgaaacatgcaatgattccattaataaatggtcactatacgccaagtactgtggtaaacattagctcatttaatctttacaagaacctagctaggtttatatcattactctccattttatagagagtgagattcaataatttactttttctttggttacactcttaaaaaagtaataactcaaataagtacaaatagaactggtgaaatctgaataagattgtatggatggtgatatcctggttgtgatattttaggattgttttgcaatgttacctttgggagaaactgtgtagagtataccctcaatttttaagaattcttatattgtgaatattcttagaaaactaaacataattttactttatgttctagtaatcattctactagatattaacccaactgatttgaaagcttatatccatataaaaatcttctcattaatatttatgtatgtcttgttcttaattgccaaagattggaagtaaccaagatgttcttgagtaggtgaatggataaataaaccgtgatacatccataaaaagaaatattatttaacaatacaaggaaatgaacaaaaaaaagtggatggaccttaagggcatatgttaactgaaagaagtcagtcagaaatgttcctagactttatgattaaatttatgcggtattctgaacaaaccaaaactatagcgacagtaaaatatcagtggttatcaggagtgaggggtgaggagaggaaggttgagtagggaaattacaggggatgttttagggtggtgaaactattctgtataatactataatggtggatacatgaaattatgcatttataaaaatccacagaatattacagtataaagagtaagccttaatatatgaattttttaataatatcatttaggaggttggaagagcccagtaaataatgcagactgtgacaagagagtctaactgtattatagatgtatgaaacaacttaactaaagagagtgatcagaaaacgttctgacataagcagttttggaaatgagtagtctggaagactaaaggaaaaagaaactgtacataagcactgtactctagttgataagtattgttccatgttagcaatgttagcaattctgatactgctatacaactgtactggaattgaacaattaagtaaatagatggagaatgctaaaagcccaattttttcactgttttagtgggaggttgaagataagaagagaaggctagaatgatccatggggtaatggattagaattggggacattagtgtgagttcatatttagctgaatatagatgcatatagttacatatgtaaatatatatatttacatagaaatatacacatgtataagcacacatgtatatatgtgtatatacatgcatacatacatgtatccataggttagtatacacacacatattttcttgcactgtcagttgacagggcctaaagcaatgacacctcagtagcaatgggcacatctaacacccagcttttggtttctaacaccagtcttcaataagggtcatcttggaaaaataactcattctaggactagagcaggaaatatataagatcagctgggagtatcttataataccagaaaatgaggaaatgcacacacacacacacacacacacacacacacaatgatgggggtatgtcaaaacaaaaacaaactgaaaaacaggagctgactgaaagagtcttattggccaaagtggaaatcatatgttcaagaaaataagtaagtattggattataacccttattattcatatccaacaagtatgtaaattctatttacaaaaatctcttaaatcttgaccctatttgctgttatctctgctgggcttttaattatctccctctaaattattatcatggcctcaggactgggatcttgccttcagccttatctacagttcactgtattttgcaaagtgacccagagtcatctttttaagtgtagttctcaccatgtttctcctttgcttaaaatctttaaatggtcccttactacctaaattctttatcattacccttcaaaatttgatcccagattaccttgttggtgaattccacaatctccctgacagagcccagaaatcctataagccaggacaaaaaagactgacactggagaacttccagaaggtacctcctaagaaaccttaactgacagacactccaagagtaggtagtggaaagaaaagagggttggtggaatgttaagcaaattagtaacaggcaaacaataaatattacctagttcaaggcacagagtaaatgggtaacattccataaatgtttattgaacagaactgaagtggatccaaaatggcagataatggataaaaggtcattacagcttatgatcctgttcctggaaaaaatcataataatgtactttacatatagcatgtgcttaatacatttttccttgaagttcttttagacttttgaaaatacttcacatggtgtatttaaaatatctgcaaagtttccttcatccttattcttcttgccttctctactgctctagaaaggttaaatgtcatcaacattatagtacagattttaatggtccacactcactgttttttgatttgtgaaatgttgaaaaatatgagaaaaaaatttaaaaatgaagaattaacattaaaatctgaattcccttaaaaatggtaagatgtgtaactcaggaatttcatttctgcacaatattcaatgagaacagagtggcacttgcagctgcccagatctactctctcacctctgtaggcttctcagtttgagttaaacagacttttatttgaatcttggctctgccaaggtgggtatattatataaattctctctaccccagtattttcaactataaagtagagataatcataatcactcatcaataagtttagtatgaagaataaatgaaaaaatctgcaaagattttgagcacagaataattactttataaattttatttgttgaaaaattatgcttttgttatcaagtacagagttaaaaaaataaaagtagtggtagattgggagaaacaaatatagacatatcttgttttattgggctttactctattgggctttacggtaattttggtttctgcaaattgatggtttgtgggaactctgagtggagcaaggctatcaacacaatttttccaataacatatgctcacttcatgtctctgtgtcacatttgggtagttctcacaatatttccaactatttcgttgttatcgtatctgttatggtgatctgtgatcagtcatctttgatgttttgggggtgccacaattcacatccatataagatggagaacttaatcaataatgttatatgtgttctgactgctcaattcactggccattcccccatctctctccctttcttccagcctccctattctttcatacacaacaatattgaaattaggccaattagtaaccctacaatggcttctaagtattcaagtgaaaggtagagccaaatgtctctcgctttaaatcaaaagctagaaatgattcagcttagtggaggaagaaggcatgccaaaagtcaaaacaggatgaaagctaagcctcttgccctaaacaattagccaagttgtcaatgcaaaggaaaagttcttgaaggaaactaaaaatgctactccaataaacatataaatgataagaaagagaaacatccttactgcagatattgagtggtcaggatagatcaaaacagccacaaaattccccaaagctctcttcacttgtatgaaggctgagagaggtgaggaagctgcagaagaaaaactggaaaccagcagaagttagttcatgaggtttaaggcaagaagccatctctataacatgaaagtgtaaaatgaagcagcaagtgctgatatagaagctgcagccagtgatccagaagatctagctaagatcattgatgaaggtggctaccctaaacaacagattttttaattagatacaacagctttatattagaataagatgccaaatataacttccatagctagacagaagtcaatgcctggcttcaaaacttcaaatgataggctgactctcctgttagaggctaatgcagctggtaacaagttgaagccaagacttatttaccattgcaaaagtcctaaggacctcaagaatcatgctaaatctactctgcctgtgctctataaatgcaacaacaaagcctgaatgatagcacatctgtttacagcacagtttactgaatattttaagcccactattgtgacttactgctcagaaaaaaggattcctttcaaaatatttctgctcatttacaaggttcctgtaacccaagagctctgatggagatgttaatggaaattaatgttgtttttatgcctgctaacacaacaaccattctgcagcccatggatcaaggagtaattcaactttcagctcttattatttttaaaaagtatattttatgacttatagattacatagataataatttatatgaaggagttaggcaaagtaaattgaaaaccttctgcaaatgaagattttcctttttattctagtgccattaagaacattcaggattcatgagaggaggtcaaagtttcaacattaatagaagtttggaagaagttgattccaaccctcatggatgaatttgaggggttcaaggctttagtcattaatatggcttggctgtgtagccacccaaatctcatcttgaattgtagttctcataatccccatgtgtcatgggaaggatgcggcgggagctaattgaatcacagggatggttacctccatgctgctgttcttgtgataagtcaatgagttctcacaagatttgatggttttaaaaggggcttttcccccttttgcttggcacttctccttgctgccaccatgtgaagagggacatgtttgcttccccatctgccatgattgtaagtttcctgaggcctccccagccaggtggaactgtgagtcaattaaacctctttcctttagaaactacccagtcttgactatgtcattaatacagtaaactggtaccgggagtgctgctatgaagatgctcgaaaatgtggaagcagctttggaactgggtaacaggcagaggttggaacaatttggagggctcagaagaagacaggaaaatgtaagaaagtttggaacttcctagagacttggagggctcagaagacagaaagacgtgggaaagtttggaacttccttgagatttgttgaatggctttgaccaaaatgctgatactgatacagacaataaggtccaggctgaggtggtctcagatggtgatgaggaacttgttgagaactggagcaaaggtaactcttgttatgcttcagcaaagagactggcagcattttgcccctgccctagagatccgtgaaactttgaacttgagagagatgacttagggtatctggcagaagaaatttctaagtggcaaagcattcaagaggaagcagagcataaaagtttggaaaatttgcagcctgatgatgcaatagcaaaggaaaacccattttctgaagagaaattcaagccagctacagaaatttgcataagaaacaaagagccaatgttaatcacccaagaatcctggttccatatttgtctccatccatattctattttatattggcattagataagttagtatcaacttagaatatttaaaaagtaacaataatattacctacattgaacagcacacttaactaatttttttctatgtttggcaaaattgactgcaattttaaaagttttgttacgtgagcaatctaaataaataagccaagatagtatgaacatagttctattccttagataataaaataaaacatagaaataataaaaataacttttaaaataatataatttgtctatgtccaaagagtggttcaataatgtatagctttttaaatatatattctttatctttattccacaaagcaaaattataacatttgcttgaaaacgcaatgttgtatttttctgcctacaagtggaaaaacaatggaaattattgctatgctatttaacaatattttacactgctcttaattatgtgtcatgaactcttattttcacatagaccatgtgactattgctatgctatttaccaatattttacactgctcttacttatgcatcatgaaccttttaatatgcatgtaacctcttttcacctagaccatgggagtataaagagcagttaccagaagaccttggctgggttcctggttctgagagtcatttggggaaaatcacttaatctctttcaatttcattttcttcatcataaaatagagctcaccataaatgttacaacattgttataagaactaaaggacatattatatgagaaagtgattcacaacctgcaatgtattacacacattagcaattattttctttgttattcttaataaattattttcccaattatttccagtaaattttacctccaagctatgctttttaactctaattctgctataagtgtgtttaatatattctcttaaagttttatttatagataatgcatataactaccataggcataatgcacttttgaaaataaagcaaacaaaatagttaagccaactgttcaatataggcaatattactgttactttttaaatattcaaagttgattctaatgatctaatgccaatataaaatacaatatggatggagataaatatggaaccaggattcttttataggatccaagatcaaggttaggccacatttgtttaacattcattagctctcatagaccattgaaaaatgtataaaaacacatcttcacctttccagattttgattcttgaagcagtggcagccaatatcagcatgggcagaaattaatcataggagattagagactctgtcttattctgtgtgtgtgtgtgtttgtgtatgcatgcgtgcacaccattcttcacaactaggaagtgacccacaggtaacttaaggataatgtgtcagaaactattatcttctaaccaatgacccttccacagtgtgatcatcaagagatgttacctgataaagattggagccagctcaaggttacgtagtctgttatcattgtagcatgtcccttgggataatggaaggcatgtggcttagttgactgggttgagtgcatgaaaaggaaggaagaggcaccatacacatcttgaaaaagggagaagcttacacaattttcaacagggtcacaaacgaagatgaagagtgagcactgcatcaacctgatgcctaggccagcagaaatacaacacacttcatgattcaaaaacagcccgtgtgttcctgcttccttttatcctggatttatagggcatctaaagaaacttaatgatatctgaatagctccctcacaatccacatgttctggcagggggaaggtagaaaggaatggactatgctgggcagagagcaaagcatgggaaaggtttaaatgttctctggtgttgggagtgcccctccagctgtttcatctgagacaaaggggcctggagagacacttgtttaatggctggtgcttccatttgtgcacagaaatcaattgcttttctcctagtcttcactcaaaacttctcattcaaaataactaaaagttggttgcccctgtttttttttttctttccatcatctcgctactgtgactgaaatgtatgatttaagtatggtattaactagggaaggaattctaatggtgaggagtcaggagtgaagacatggttagttcatagccacataatcttcccccagataatttatgtatgtatgtttgtagttccacaaatatttactgagcgcctactaaatgccaagctctgtttgaggcccaatggacccatcagagaagacaaagactcttccctcatggagctcatatttcagcgaaggagacagaagattaacatatatatatatacacatatacacgtgtgtgtgtgtgtgtgtgtgtgtgtggtgataggtgctatgaaaaaaaaactgagcatggtacagaaacagaaaaagaaaaaggttgaaggggcaatttagatctggaagggcagggatggcatctctgataaaatgacatttgtgccaggacttaaatgaagtgataaaatcaaccatgttaatatctatgggaggaacgttccaggaaaatgggttagcaagggcaaagttctgcaatggcagtgagtttgccgttctaagaaactataagacagctagtgtgtgtgaagaggaatgagagagaaggagcacagtagagaacaaatttggagaagaaaccagatcaagaaggacagtaaaggttgtaataaagaatgtttatttgatctaattatatattaggaaaagttttaaggactttgagctattgtgcaaagaactgactgtaggaagtcaatatggaatttcacagaaggaccagtttggaagctctgaatcctttagttgagaaaagatggtaacttagactatggtggcaaagcagaaaaaacagaaaaaataattccaattctggatatatcttgggatatgctcaaaagaagtgtatgagaaagacagaaatcaaggagaactcacaaatggacaataggtgaatagtgattcttctcactgagatggggacaacgtgaaggagtgtagttagaggaggaaaatcagtgattctgtgttgaacatattaagttagatgtctactatacaaccaagcagaaatgccaattaggcaagtggatatattgatctgagttcaggggagatcagcactggagatagaaatttgggattcattaatatttagatattactaagaattatgagagtgaatagcaacattaaaagaaaatgattctatgttttcaatgaatattcatttgaaatgaatgtagaaatccagtagaaatggtttttcgattttatagaaactacaactcaggatgtatgagtattgaagatgaatgctggaaataatactggtgtgaatcacaaatactacacagcctctgactaacccgctatcaaaatatgagggccctcagatagaaacaaagggagtgcttatctctgactaaaacactaagtcaggtaagaatagaaaatgaggagctgaacttccacttaacctcagggcaaaagcagctgaaggtggctactgtgattattgtgatggtggttctgtattgtaccctcatattgcaatttgtgaaggcaaactgctttataattgacttcagtaatccatcacaacctactccatttatgtgtcttttggtcttttttattatcctcatcatgggtttcaatgtgtaagccactttgattccccttagaacataaatcataaatataaatgctttataataagaaagttgtgtccattaatagggaaatggtactggtttaactttatcagtgaagagtagaggcctagggaaattcattctcccatattatttaacaacgaaacaatgaaagtgtggaatgttcagattccaacaggtcagtgtcaaggctgggatactgcctccatcaactctatgtttctcatatcccaagtcatagccacccataacatgcagcaaacaatagcttctctgaatcacatgtgcctctggctctgttttgtcatttaggtaatgtgcttgttaattttgcactatttgactgggttacagggtacccagatagagggtaaaaaacattatttctggatatgtctccagaaaagattattatttgaatcaataaactgagtaaagaaggttcaccctcactaatgagggctggcatcatccaagccattgagggcctgaatagaacaaaaggcagagtaagggcaaattctctctctcctctgaggccaagacttcatcttctcctgccaatggacatagaagctcttgtttcttagggctttggactctgggccttataccagtgacacattctcaccatcactatcaccccccaccccagattctcaggactcagactgaatgacatcactggcttccctggttctctgacttgcagacagccaatggtgagaattcttggcctctataattgtatgagccagttctcataataaatatatattggttctctttttggttctgtttctctagaggacccttaaccaatacaagtcgactgccttaacctcactcctctgtcacaaacatattgtgttctcaggaaacatcccctccctagaaagttacactgtggatcccaggtgagtctcttttcactccctgccatcacgcccttacctaggacatcatccaagccttgggcctgtatgagtcctggagttctgcttcctggaagatgttcagattttaaaatcacagggcaattactttttgtaaagatgatggagattttataacataataagatcaaaacattaaaattacaattcactcaaaaatgaattccttcagcattcagaaatgttagcctgaaattcacaaggacaatgatgttattaatctctttcactgctccatgatcagcatctggcagtgtgtccagcacattgtaggccatcaactaaatggacactgtggcatcacagaggcaggggatagtggttgaaagtacagacgctggagtcagatcacctgggacaaactgtatctctgcccctcgcttgctgtgtggttttggaagcttgcctaaccactctataaaccagtgtcctgacctgtaggaacacatagttcctatgtcagaagatttttatgagattcaataagccactacacaaataaaagaatgtggtaaaccctcaatgtgtttttgatgttaatgatgaattacttaagaatttagaatgttatgtgtggaataagttaaaatcctagcctctccatgtagtccatcattaaaattagtactttaataattaataaatcgatcattattaacatttttaaatcaataaattgccatttattctacagtgtgctcttctagctttggtctttgtcaatgaatttagtgaatctcccgaccctgatttcctctggcaaacttgaatatctggaaatgtggaaaccttaacagcaaacagtgaactgtaatgataacatgatatccctctctgagatatgtgcaaagcttcaggcagctgtttctgtgtctttcctgtttctctcctataaattccatgacctttataggtgtgttgaaattagaaaagttagaagtattgttggtaagttcactgctcccaactttcaaagagaaagttatcatctgttatcaaggtttactatttgctattcacatttccatgttccaagatactcaagtttgccagagaaaatcggggtcaagagattcactaaatttattgatatagaccaaagctagaagagtttgctgtagaataaatgacagtttattaatttataaaattgtgaataatgaccaaattattaatttctaataaacaaaataaaaactacccagtagacaaaataattgtgatcagttatgttttcaaaattagaaaaaatctacataaaaagcaagttatagtaagaaaatttttgtttctttttttcttttctgttttctttagggatggcttggaaacagagcatattggttactttgattaatggctgatgatattaaaacagcatagcctgatacatccctcacaactgcaaagataaacctgaataatagttttagttgcaaacacacatatccccctggcttccatacttatatactggagaaacgtggacaatatcttactctttctggccttttgtttttatttatttggagggaaaggaagatggatttagtttataagaccatctgagtgacttatgacagtgattgtatataacttttctagttacttacattctcataatgccttcttcctatttcatccaaatgactttgattgaactttgacttcccaaatctcctctgcttatctgttaaaaaacaataataagtaggtccgaatctatttatttttttttcaattttccttcaaacttggaggcggggtagggcgagatcttacttttatccccgtgtagtgaacaccagatatttccagaaagcttataatctaaaatttagttcccagccacttcgaaagtaagtacatttattacatctattctattttgcgtatttggggtcgtacatgggcctcattcattgtttaaatggtgatgcaagttctttgtactgagttaacaagggtcatgattacggaatacagagattttagcagagatgtatttcaacacatcttttcttcagcattttctatcagtaatgaagagatagatgctgtccatttagaagcatagaactaaaatgttttccaagaaacatctccaaaatggtaaagttcaaataggtgagatgtcatccttggctacgtgctaactccactttccagtaaagggcaaatgtctcacacaattaacaaagattccatcaagcccataaaacgccagccactttcaaattgccaggagatctttggattctcttctgattttttttccatttaattttcttcagacatcctaatactatggtggaaaagacaaattagtctaatgcaggatactataaaatgttcaattacttcaaaaagatatggccatttcccaaaggaaggaatttaatcaaaactagatcaaaatgggaaaatggatgacagaatatataaatattctaacatatttgaagttaaagaagactttacaaaaaggctttaaaaatgaatatatcagagtagatgtacaaacacttagaagcatacagtttgtccatcacctagtgggattttaatgttcagattttaccgtctaatatgacagaatctctcagacttcagttttatgtaaggatgaatttaatatttagaatatttcccattagtggaaattttgtaagtatcacagcttttcaaaaatctccttatagttcaacatatgaatctgtaataattttaaattgtcttttttctaaacaaaaattattatgaaacaaaaacattacagaggtccaagttattttacatggcctttcttttaaatattatttttaaaaccattcgctgagatctctgtttaaccaccaaatctagaataattgtagagacttaaataaggaaaatgttcacatatccaaaaacagtatgaattttactgttatttctcaattgtgtttctgtgtattctttagacatctgttatgtttcaaagatcagacatatccttagtgtgcaaatccatgtaaatatcctcatcctataagattgcctacttaccaaaaataacaacaataaatatgttattaagttgttcattaatcttgagacctcctatggcatacatttttttaaaaagccaagaattattaactgaatgtcaaaggccagaaagagcaatgggggatgtttccagtttcaggtatcaatgagaatcaaaatgaaatgtaaacagtatcagatattgtaactcattacctatgtaacaatttgggaataaaccacacttttcagatatcaactctacagaaaagcagtgtgaggtaggttttgatgtggcacccctgcttttgatgacaggtctgtctcagagccatgttatatggggttgggccagttacttaacccataatacagtgcatggtaagagctgaacttcataatgattattccaaattacaataaaagtaaacatgttttaacattctacctgtgagggcaggagaaaagaaaattagtgcttttaataagtaaggaacattttaaatcactgagaataatattatcaaatattggaaaaacagacaaaagaaaaggaatgaactagtttaaaaagaagtacaaagaactaaaagtcttcacttttaccagtgaccaaacatgtttatatttattgtaccatattgatatagaatattattcagttattaaaataatagcaggagaagtttttaatcacagcataaattttttgacacattgaataaaagaagagaatgtcaaattatctatgaaatgagatctcagttttagaggaaaatttatatctgtactgatatacagtaaaacatcatcaagaatgtttatctctgaattgtggaattatgtatgattttcatttattttatacctttagtatgtcccaagttttctacaatgagcatttagtacttccatgatcacacaaagaaatttttcaatgccaagaaatgtaaaaacttctagactcggttctaccatcaataagctaagtgacctatgggacgtcgcttcatcttacagagtctcagctttcttatccgtaaaatgagaaaattgaactagatcacctcctaaggtcactttcacttctataattttatgaatcaataatgtactattaacactattatatccaaagaaaacaaagactaattgaagcaattgtagcaacaaaagttatgacatatggattaagcctagtaggtatttttttaaaactacaaatgactggccattattctctatgaattaatatcttatcctgtttatgatactaaattctcaaaaccatttcaaagataatattcaatatttctttaataatagccctgtaagttttgcaggacacagtcacccaagctgagtgatgctgaataaggccagagctggggtcacagtcctttcctggtccctaaccacccacaggtcttttctcactctgtgagtctctcctgagctgtccttgtcccttattctaattccatcaggtgtgtgttgcagttttattgagccattttcagagccaattaatcagaaaacactgtttttccatgatttgggggattcctctagtaatgactttgcagccataatcaagaaatatgttaagccttatgtcaattaacttaactgatgtgaaaacttgactggtccagggagcaatggatttccccagctgcaccttatcagagaacagcttagtgtgaaggagagaagttatgctgaagccagagctgtaaacgtgccaggaaaattagcacaagctccaagtacagagggtgaagaagaaaacttgcttagcccatgtatgggtgttgcttaaacagttatgaattattttaaaatctttcattgatgggatgaatagtcgcatacatttttgccacatgtaagtttctccaaagaattgggcccacaagagaaatggaggaggggggcctacatgcaagcagatgaggggcatttgcttccccaaaaatattcttatattttttataatgtgcctcattaaaatatgaaacactcaattcaaagcaaaaattgaaataggatactcctgactcttccctttcttccctctatttcctcatgatatagtcttagcacttcttttaaatgttacaatagtgcttcacaaacaattttttttgccagtccgtcacaatgaatgtttttgaaaaatataataaaaacaaattatcacaaaagtgaaataagaagatgaaaaaactaagcacactttgtggttattatattcaacagtcatgaaaatcacaccacaatttgccatgaaagtttcttaacatttaactctgtacaagtatcgttgcagaacaataaggccacaacacgtacacaagcactttgtcttagcaccatatcaacaattacctgtaaagctttatcttggcattttccactatgcaactgttggtttacacagccccattagactgggagttctgtaatgggtaagccagcagttaacacttggaggcactcagtaagtatttattgaatgaataagtcaatgaataagtgaagcacaaaagagcataagcctttctgctcttaacacctacaggcactcttcttacatcaggaaagctcccatgctctcctgattcctttgccccagattccaagggtacagatgcttttctcacctttggtggtaactgccacctgcttgtcccaaagagcttctttgtttccctgtcttcccacaaaggtgataacaaagattttttttacagtttaagagtatcagtgccaatcacttttcagacaaaacaagataaaatgcaataaataaacacggaggaagttataaaaatttcaacataaagcgcagatctatcgtcttgttttctgctattcagagcactaaagacactgggttttgtgtctttatctgtgggtttctctagtttatccatttgatttactgagtttgtgtgaaaatattgattaaatcttttcttagaaccagttgagaaccatttgctactttccccagctctgatattaacttctaatttaaaaaaaaaaagaagtgtgcaagtatattcgttttctattgcagctgtaacaaggaaccataaacttaatggtttaaaacaacaaaaatttattgtctcacgacttctgtaggtcagaagtctaacacagtctcactgagctgaaattacagtgttagcagggctgcattcttttccagaggttctaggagaaatttcatttcattaatattcaggtcattgaaagaattcagttctttgaggttgtgtcactgagtcctcatttccttgctatcaactgagggctgttccaagcttctagtggccaccaggtctctctgcttgagtcttcctccatcctgaaatccagcaacagctagtggagatcttctcatgatgaatctctctgacccaagctgggaaagcgtctctgcttttaagagctcctgtgactgaacacagtccatctgtataatccagaataatttccccatctcaagatctgtaacctttttcatatctgtgaagttcctttagctatgtcatgtaacaggttcgcaggttatagggactaggggatggacgtatttggggacctcaccctgcctatctcaacaacaaatttataaatttattctagggtaaaaaagaaaattataaatgtatgtttttaactttacatcatccttggataaggtcctaatcttatatgagcactcaggacaaggctctaagagattttatggtggagtcacactgtgtgcatcgtcatactgggaaaggactttgtactttgtttattttgttcatctggtcctttggattgtcccccacatgctctttcaatcccagtgcaccctccagatttctgtcattgtcaacttatgccccaattctctgcataaaattctaaaattgtagatcaaaaatccacactataatattaaatcccatttattttgtttggcaaatctgattcttcataatttgatctcaccctattttataaccccatttcccactatttccccttcatttcctataatacaccaaaatacttgcaaaattctgtgccacttatgcttatctttgcacatgctcttctttctgcttggatggaacttcctttctgcttggatgaaatttctctttggggacatgtgatataattgaaatagcatcagcttggaaaccattttgatttgtatttgacctagtcactctgacacttactaggcctgagactttcagaagctcctttgcctgtggtgcaaaatgggattattaaaacctactttgtaagaatattttgaggctttgaaataatacacatgaaagcgtataacacaacgtctgtcatatgatggacatttactaaatgttagttattcttttgccctagagaacctcatttttcctccaggcttaagttcaccacttctgtcacattgcccagacccatcaggtagagtaagattctcaaccttgagtcttccataactgtgtatatttagcactatcacattttagtgggcaatgtctatacccacctgtgtcctctaataccttataaacttcttgagtgaaagaatgtcttgtttatcattttagccatagcacctggcaaaggtacaaattagtcattcaaaagtctggaggaagagatggatggatggatggatggatggatggatggatggatggatggatggatatgagataaatgtagaatctagcataataactaacaaataatacatatgcttcatttactttaaatataccagttgtgtaagtatatcattctggctgtgttgttttgtctttttatctctttggctgccttgttcactgaataactgtatgtttacatttttattcctatagttatgttaaattcctaaaaggttgtgtctttcatttctttgctaccttcactcaagcaaaacatttgcattctatacattgtgacccttcggtgcagttcaacagagtaatctgtttttaactttgcaccattcttggataaggtcccaatcttatatgagcactcaggacaaggctctaagagattttatggtggaatcacaccataaaatctacctaaaaaactaatatttagggtttctggatagagcaagagctgcttcttagaaagcaaaatgatcacacaggaaagtttcaccagccaacctaaatacagtaagaaatactgtagactttgtagtgtcaaaaccacctgtgtttgctcattggccttatgcaaagttaaagttaaatttttggaatcttcttgaaaagaggtagttttacaacttggagcaaggcacctaatgacgttaggctcctatcctcccatagaaactgggagataggggcactatccttcttgattattacatttcagagaatggtctctgggtccttaagaaagacattccttagttgtaaaactggcaagaggcctttaaaaagatttacttccccaaaggacagagaaatgatttacaaatacaggttttgtaaagtaaatgcttaaagaaaaggggtgttaggagcctagagtcaagaagcctgcctgtcttaaagtttagtcaaccagaggggaatgctaaggtcctcttggtgaggaggaacctaagtgtatatttctggatcagaaaggatgggttcctgagatgtcccttgaaaaatagggtagttacaggagaggaaattatttaaaggaatcagtttatcatagtgcagctcagcaggtctattcattagcaaattgcactgaactagcccgtggctgtagtagagtaggtatacctccaaatccttatgtattaaggaaatttacattaaaagacagagatttaggccaggcaccatggctcacccctataatcctaacactttaggaggctaaggcaggaggattgcttgagcccaggagttggagaccaacctgggtaacatagtgagaccccatctcaataaataaataaataaataaataaataaataaataaatacctgtagtcccaactgtgtgggaagttgagatgatgggaggaactcttggtcctgggaaattgaggctgcagtgagctgtggttgcactgctgcactctagcctgggtgacagagcaagactctgtctcaagcaatcaaccaaccaaacaaaaacccagagatctcaatctggtttcatacaatatatatgtacaagtgtctgtatttcagaaagtattactgctttagaaaatgcctagctttactttttatttcacattttactaacaattaaaaggcagtggaggttacaaccccacatcatggcccgtgctatcccttccttacaattctgtcagaagggggtgacttagaaagaaaagcttacatattgctcttggtggagcactgtgattaatctcagacattctccagaataattttaaaatcataatattttagatatgtttcttcctttacccttcacatttatccaaagctcttggttctgcaattccctaaaacatactttaggcattaagtaaaaagtgagaagtaacgagagtaacattattcgcttctcttcttcctagggtatcttattttcttcaagctttctttcttccttcttactcctatcccatctttgttatttcctctattctgaacatgatcaaactttctggttatcaaaatgtatatgtgggtatgtgtgtgtgtgtgtgtgtgtatacatgcctgcatgtttggggagtgtaagcatttacaataagcagctaatttcacaggatgacagtcccacaattatctggttattatttgtaaccaggtaacttggctagacttgtgggtaggtcagcagagctcataggcacacttctatgctcattatacaaagatggttaaacaaagaatgtatatctaagtatgcatccaatgtaggaagaaatgaattctgcttgtgaaatgaatgaattctatttttgaaatacatcgtatttatgaaattatgcttgtgaaatgaatctgacatatatacagaaaatatttcaaatgcctcatagactacacatcaacaaaaggaacaaaagaaatccaaattttgtattattcttccctctctttcttgtcctcttggctcttcatgcttgtgttcaggcataatttttaaacacttttcttaagccagttttcactgaagaggtcaggtgaggttaggttctttacggtaagtcacactttatcagtgtgaaattctgttgtacttgtcatttctcagttaattaagccagatatctccttagagatctttttcatatgaaattggaaactggcttcatgttagtgattgtaccaaaatgggctttaaaatgtaaaagtctctaatcctcttttagaagggcaagtgtttcatgtcaccttgtctgcagagcaaaatctctttctgaatgaaagatgcagctttgcaaaactgcacactatgattataaatcaaccagtacaataacagtactgcagacaaaacctcctaagataatctctttagcataaaattgtattcagcaagatgaaaatcctaacaagattgtgatttctgtcggtttagctttttacgcatgccatttacactaagattcttttttcatactcatattaccagttcacctggagaaaaatggcttattatataatcagggttcatatgcatggaccacaatgggcatgaagcatatgaggatttatatcaagagtcaaaattcttaacagattggcagttgctcaaagaaaggaaataaaagtgattagatggccacgattgctcctgaattcagaataaaggaactgaggtgcacagctggactacatcacaccaggaaagaatgaggagtctctgaagagtgtgacttcagaggagaagctggaattgtttattgttgccccagggaggtgtaattggggttaatgggataaaattaagcacagaaaaattcatgatgtctatcaggaaatactccctaataaagaggtcttttataaaattgtcccaatggaaggattagaagtccttttgtttgagtgattcaaactttacgtggggaaatatatggaaaaataggctgcaaaagacaatctcatacaagtcctcaagggatgaattacgtagaacaatcagatctttcttggctttaattttcatgagtctattttagtaagctccttaaagactcaattttcaaagcgcttgttgaatcccttctgcattgcacctgcattagtagcaggttccaaagaactgagtttgcaattgtgtactatgacgattgagactcttacctgagaacctggaaacctgaagtcatttgcaatgacttcagctggtatttatggatgtaaacatagtttatgtaaaactcagtatagtaaataaagttctgaagaatgctaacagcaaactgaactaattggtacactgaattccttgtcttatttgagttcatcacatcctttaattaattaaattagactttattgagaatcttctatctgctggtcgttgagtaaatgctggggttaacatgaaatgttaacattttcatgttaaccccataaaaaagcaggcaaacgacatgaacacttttttttccatatgattgttggccacatgaaaagacgtatatgtggccaacaattatgtggaaaacaagttcaacatcacttatcattagaggaatgcaaatcaaagctacaatgagataccatctcacaccagtcagaatggctattactaaaagttcaaaaaataacagatgctggagcggctgtggagaaaaaagaaggcttatacacttggtgggagtgcaaattaattcaatcattgtggaagacagtgtggcgattcctcaaagacctaaagacagaaatactattcaatccagcaagcccattactgagtatacacccaaaggaatataaatcattctatcagaaacacacatatacacatatgttcattgcaacactagtcacaatagcaaagacatggaatcaacctaaatgcccatcaatgatagagtggagaaagaaaatgtggtacattcactgtaatagttaagattctccagagggacagaactaataggatatatgtataaatgaaagggaatttattagggagaattggctcacaggatcacaaggcgaaatcccatgataggctgtctgcaagctggggaagaaagaagccagtagtggctcagtccaggtccaaaaacctcaaaagcagggaagccaacagtgcggccttcggactgtagctgaaggcctgagagccccacgcaaagcacttgagtccaaaggctgaagaacctggagtctgatgtccaaaggcaggaggaacagaaggagacatccaatatgggagaaagatgaaagccaaaggactcagcaagccagcttatcccaccttcttccaccagctttgttctagccatactggcagctgattgaatggtgcccaaccacgttgagggtgggtcttcctctcccagtccatggactcaaatgtcaatcttgtctggcaacaccctcatagacatacccagaaacaacactttaccaactatctaggcatccttcagtccaatcaagttgacatctaatattaaccatcacatgtaccatggaatactatgcagccataaaaaagaatgagattatgtcctctgcagggacatggatggagctggaggccattatccttagtaaactaacacaggaacagcaaatcaaataccgcatttgctcacttataagtgggaactaagtgatgagaacacatggacacacagaggggaacaacacacacttgtgcctaccagagggtggaagtcaggagaagggggagtaacagaaaaaataactaatgggcactaggcctaatgacacctgggtgatgaaataatctgtatgacaaactcccatgacacaagttgacctatgtaacaaacctgcatatgtacccctgaacttaaaataatagtttaaaaaattttttaaacatttttaaatgaaaatgttaaatttgatataattttccattctcttttaaatgcactctggctaaagactgtgtcttttctacattttcatgcctagtacctaacccaatgtctggcacagacaatacttattaaatgaatgaatgaatgaatgcttaagactaccacatttggtatattaccttagtttccatgaactcatttatgcctgtctttcagcatactaattacaaagatatatttttacataaataaataaataagcaaaatgaacaacggtttaggtgccttgtccaagatcttctaacttgttttattccaaagtttctggataaaacgccttcccaaaaaactggctgcctgaggccccttcctcatctctaactgaaagtaaagcagttgtttaaagaaagtttccttctgctttcgacactggcctttttagacacaggtgtgaacccatttcgtttttgtttgtttgtttgttttggaagagggaggaaagattaagatctttctatgactttctttacccttccactatgaccagccctgcaaatgcctagactcaagatcgctaatcttccacactgctggatattgaaagaatatttaaataggcaagctgggcacagtgacttgtttctgtaatccagaactttgggaggcctaggagaaggatcacttgaggccaggagttcaagaccagcctgggtgacatagcaagatcccatctctatataaataaacaaatgcaatttttaaaaaaaatagaaagaaggcaacttacaatgaaaaaaactagaagcaaaatgaagaaattcatagtagagtggaaatatatcagtaattgaaccaggagctctggtgctttttcagactattgaaaacccctccttcctcatctttatctttaggtctctcatgtcattagtcttccttcatgttatatatcatagaagcattttatttctttaatctgcaaaacatatttaagtgttagaagacatttgcttttattttagtatttaatatggctctcatgtagttttcagtctttttttacaggttttccaaaataagttatttgcttcattttagttttttctactttacatctaagttttgtacaaaacctgtaggaagaaagttttagtgacattgctagaattctgtgtattcatttgtaatcttttcttctattccctccactgtcgccctttttattagcaaagagcaactctgctgctattaaactgaaattttatgctaaaggacattttatcccttgccaactttaaaatatgtatttgaaacatcatttatctgtcctctgatgtgatcttccattcattctctacattttttcccacatttccttttgttgaacagatatagatttgtttggtcattgacaggcatcatttgccttgctgttatttctctctgcacgcttcaacattcctgtcactctcatatattgatacatattattacttactggatccctgttctcattttttcccaaatttactagatgtgtgtaccttgtgaaggagtcaaaagtcacttacattttattcaactaaacatgatcagatatcaaaccagatacctgcacttatgaagttgtggttcatctgtgacaagagcacatatgacagtgaaaagatgtttcatctaagtttaggccaattgatgcatgtctgtagaattaaaacaggcttctttaagatatgtgttatgttttccaaagcagccaaacagaacaggctgtagtcattaaaagataattgtcccagtggggtggagcttcctgagacatgtatgtttgtgtaaggttgtccagaaatgaggcaatctaatgagtgacttgttatctttgaaatataaaatatgccaggacactaaattaaatagacccaaatagtcttaaacagaatgggctcaaataggaaagtcaatgttattgagattaagaataaattaactcccacttcaatatgtgtcaacaccatgtttattaagtttttaactaataaggtatgtcactttatgagattctctttattgagggaagatagaaaaacaagagaacaaagttgtgaatacttacagtatctgacttcctttttgtaggcattccagttcagtgaattaaattgacaagagaatgtttgcatattatccccaagtttcatttggggattattttcttaatgttttgagagaagactcagctttagactccagttctaacaacctgaaatgctatcagcagtcccagatccctccctctactgcacacttgcctcccccttgactttcctgttacaaacagctgtagaactcaatgtttgcttgtgtctcctcaaaactcatatgttaaaatcctaacccccagtgtggttaggaggtggggcctgttggaggtgattaaaaccctcataagaatatattttagaaagctctcttgccccttccgccctgtgagggcacagagagaagacagtcctctatgagccaggaagaggaccccaccagacgcagaatctgccggcaccttaatcttggacttcccagcctgcgtaactgtgagaaataagtgtctgttgctaaatctagccagtctatggtatttttgctatagcagcctgaacagactaagacatcaacaaagacactccggaagccactgcttggttaggccgcagttcccacctgaccccagttgcagagcctcactgattaatctctctgtctcctacactatccattctgccagggaattctgcttaagttacagcttcaattgggtgatttttctcttttctaaaacattcaatggttcctcattgtccattgaatgaactacaaatacctcagcccagaattcaaagccttgtacaatatagctccaacctctctctccagctacatcactttctattctctgacataaaccctatcttttagcaaaattgaacatcttatatttcctcacattgtctggtatcttctcctctcaagggcagtgtttccaatttcctttatgaggagcctatccttcagaattattttaaatattgcctactataacaataacttttctgatttttcagtcatatatcctatttcacttccttaacgctattcatttttgccacatgtattgtactttgtatcatgttgattttattgggcatgcccctagcattagcccgagagagtaagcactgcatctaactctacagaacacctcctgcagccaccagaacagggccagacacacggtggcagatcatctatgtaatcttgttttccacaaagactaatcaagtagacagcatatggatgtgcaaagcacaatgttactaactttacaatagggttgcataggtaaagtcaaaacattgttgaatctcattttctaacatgcattgacaaatttttctaagccaccaattcttaccaagagtttagaatattattttaagttagtaaatattaactaaaggatctagtctatattatataaaatattaatttaacatttaatatttcaaatgatctacaacaggaatgctcatccttctctcagaaaccctctgcgttctctcctcactttctttcggtttttgtccacatggtactttctcaaggaagtctgccccctagccaccctgtctgaaattgcaacacacacacacacacacacacacacacacacacacacacacacacacacacacacacacacacacaccccctatctccctttcctgccttattttcctccgtcacacttatcactaatacactgcaatggtctaaatgtttctcccaacattcatgtgttggaaatatatttcccaatgcaacagcgttgggaggtggagcctaatgagaggtgttgaaagcatgatagtaaaagtaaaatagtgcttatcggagaaaacattcacaagcagagaagtggcagagtacacatgatccatgtgccttattagcccacagagtggcacgcttagacaaaggtgaacagaggcacaggaataaaaggagacactctcctcttgccatttttcataatcccaggagaagtgaatggaacagggaacacctagttgactgtgtaacagtgaaagcttccgctcagagaatggccctgttaaaaatgggcagtttcataaaaaagaatgagatcatgttctttgcaggaacatggaggccattatccttagcaaactaacgcaggaacagaaaaccaaacaccgcatgttctcacttctaagtgggagctaaatgatgagaactcatggatacaaagaagggaacaatagacactggcgtctacttgaagcaggaggatgggaggagggagagcagcagaaaaaagtaactgttgaatactaggcttagtacctgggtgatgaaataatctgtacagcaatgcccgccccccgccccacctacacaagcttacctgtatagcaaacctgcacacgtacccctgaacataaaagttaaaaaaaaaaaataggcatctcctcttgagccagattcccgctactctactaaaaaaaaataaaaataaatttaaaaaaagcttccaggcgcttccagaacaatctttcctcagtccactctgggtctgcgggaactcagtgtagataagtctattaatcagctgtggccaataccagattttttttgctgtttaggagtttggtattaataagtgtctcctgcagttaataagtgtccctttcatcattcaggtaaagaatgatgtcttaaatattaggataagttcatattaagagccactgcttgggaaaatcttagaaagctgtttgaggctgtctgtccacatctgcaatagcaatgagttattcaaatcactcacttcaccctgaaatcttgatcctcctatttagattgtctgagtatgtgtccaatccaatgaagagtatcaacgtaccttgagaatgagccacggatttttgtctgcttttttcattattgtatccaactacacagaatggtttctggcacatagtaggcacccagcaaacatttttttgcctgaataaataactgaaatattgacaatcaatgcagtgccctgccctcaattccttctctcatgtctgcatcatcagtaaagatacaagggttgtgttaattcaatgtaagagtttattgccaatttagccacttataaatttccctttactacaatgtgaataagctggtaacggaacaaaattccttatagtaaccaactttcaaaccttgttattaattatagtatgtgctatattatcatgctaacactttattgcttttcctattgcagcttcagaacagatagttaccacacatgatggtgcggggaggctagttagatggccttcaaagtacttggccctccctgaccttgataaccccatttatactcagatgatgctattacttcataccacgtttccttttaacttcttattatctctaaggctctctgccaggatgagaaagatgccactcatttgttctctaaccacctctttctgccccttatcagtgggctttcacccactggctctcatagacacttttctccagattgcataatattacatatttctataccacatagcttgtatcttgacaaatagaatactataatgccaaatagctcctaattctcctttacattaccttctgaaaatatgctttcaaacattttaccccttccttactacgttttctttgacatcctctaacataactttctcttttctttttcatttataaaggcagtatcaaacttgcatgttgcaacatttgtcattgttatgataaccacataaggtctattaacaatctgaatggggaaaaacttatattaataacccattctgttgtatttgtcattataaatccttttgctatcacattatgaattttggaaaaaacagaaataggaaggggaaatatgtctccaaaatgtgcagatgtataccccataatctcaatttcagtgtcctttatctccttatccctctctttctccctagtttctctcactccctggttctctcacacctttctgttgttatatttagaagtaactattagatgtttggtgtataagagttcatagctcatattagtttaccaagggctgctataacaaaataccacaaactaggtggcttaaacaacagatatttattttctcatagttctggagactggaagtccaagatcaaggtgttggcaggtctggtttctcctgaggcctctctctgtggcttgcaggtggccaccttctttctgtgtcctcatgtcatgttttctctgtgtgaacccatccctggtgtctttttgttcatccaaatttcctcttctcataaggacattagtcagattggattaggaccccctccctaagagccttattttgacttaattactcctttaaaggacacacctctaaatatagtcatattctgaggtactgggctgagggcttccacatttgaatttaaaagttgggaggggcacaattcactttataaatatttcttcataagagagaaaaatatagtcataaaagtatagaattcaaagtaagttatgaaaaatgtgataaactctaaagattaggttacaatacacgatgctttttgctttagttggttagatatttgattgttattttgtttttgaaagaaataagatatgagctagaccacaagaggatacaatttgacttcaaaggataggatttctgcagtgaaattggagaaaagtgaagggaataaattgcacacatcccagtggcaggaaaacaaaggactcattaaagaatagagaattgatctggctggaatgttgactatcggagagcgttggtttgcaggagcaggagcaggggtgcccctgggtaagaagaagtctagagggatttcagactagaaaaggtaagtagaacttcactgtaaatctgaggaatttggattttattctgtcagtgacaggaaagaattaaagtcaaagtgctcttgatagttcttttgtttgcatgtactgttcagtgttgaaaatgggtaaacctggagaacattatgctaagtgcaataggccaggcacagaaagtcaaacaccatgtctcacttatacgcagaatctaaaaaagttgaacttatagaagcagagagtaaaatggggttgggggaaagcagggtgattggggagctgtttagccaaaacattcaaacttttagttagacagaaggaataaattcaagagatctattgtacaacatggtgactatatgtataatattagttcttgcactgctataaagaaatatgtgagactgggttatttacaaagaaaagaggtttaattggctcacagttctgcaggctgcacaggaagcatagcagcttctacttctggggaggcctcagataactgccagtcatggcagacgcaaagagggaatgaggcacttcttacacagctggagcaggagcaagagatggagggaggtgccacacacttttaaacaaccacatctcacaagaactcagtcactatcaggagaatagcacgaagggggcaatctgcccccataatccaatcatctcccaccaggccccaccttcaccattgggattacaattcaacatgagatttgggtggggacacaaatccaacccatgttactatagttgataaagggttgtttacttgacaactgctgaaagagcagattttaaatgttctcgacatgaaaaataagtatataaggtaataaatatgttaactagattgatttagccattccacagacatattttaaaacatggtgttttaaacaacattcatagatactgtttttatttgtcagttaaagtgtatataatttaaaaataaaataagctctatattaacagtagtctgtattataaagcatttgcttccctcaaatgtttcaacatttcctatgtcataactggaccccaaacttagctgaaattttcatatacatattcttaaggacctaaaccagtggtttgctttggtcctatgatcacccttcacaaagtctgacacttctgcattatttatatcagtatttctccaactatagtctttggctctttagatatctatgaacttattctgaggagtggaagaaactagtcttttttaatttgtaggttcttaacatggggttcttgagcagaggtgagaaaataattgcatattttattttcactaacttctaactgaaataaaacatttctctttaaagtaaattggcaacacaggcagattttttataggtcattacaattactgtgaaaaccttgaaagttttttaatgcttatcactaatttaaaattatgggggttatcaaacctgatgacagatctcattatttattggtaataaaaattcaccaataatatatttgtcaatgttatgattttttagatattttgattactgtaattctggataattggtttcatcttactggttgaatttagttttatgctttgaaaaactatcctgagaagcagcccgtaagctacaagagacaggcagaagagtctatgggataaaaatggttaagaatccacaacttagaaggagtctatagtattactccagtctaggggtggagggagaactgccttctgttatcactccttgctttaagaaacctgtgttcaggcttttgctttgaatactaaaccatctatttctgtatttatcatatttctttgagtcgatacctttgagccttcctagatggcttcttatcacttgaagttgactataaatggattcttttattttgtttaccctggagtcagaacaggcaggaggaaatcaggttgagaggagtaaagcatcccaaggaaaattttatcaattaaatgttaatgcaaaaaaaaacctattcattctcttgatttgtgttactttaaggtgaaatccagaatatcaaatgaacttatcaaaaggatgcctaaatgctttcaactttttggtgagttctttaactaagttccactaggtttaaaatataaatatattgtttccacttaagcaatctccagataatattttaaaagataatgaaataatatctaagaccctcagatggaagctactgtattaagtgctaactctaatcattattttcttaaatatttggatatttggatctcactgaaacatgtaacattcttttgaaatgacctgtgaatagaaaaatgcaatcaaagcatgttgcagtggaagcacctgcttctctccgttctgtaagaatagagtctcaatgaatagcctgctgaaattccaatggctttatcaaatgagaccctgaccaggttttccaacaatatttaaagcctcccttagtgatttcactgcatttacagagagacctcaacaatcaagaaggaaatgtgtgttttgctctttcttggctctgttcagtccctggttttatcaagctgccgcacagcacttctgtcctgaaagatgcctgtgtgacttggataccatttcatagagtcacactggatcctcttatgtcctgccaattaaattatcttctccagcctttattcctgccaaagaggctcaggctgagataaggtcacactcctcttaagttgtttttgaaatagtgtggaaggcctcatgaagaataagaacatgcacaagcattaatgcctcatcttccccagcccccttggtagatactgaatttctctgcagaagttccttctattgtgtaccaccaccctgaatctctaaaaactgaagagtcctccttaatctcattaaattaaactatagcactacacaaagcatgtgctaaatgtgagattccattatcactgtgccagttgaattacagatcagacatcataggaactgagaggaggttcttaaattggtcctgttcagggaatctagggaacaatacttgactctcttctgtatttatataaaactatctctattctgctacacatctaaaacaaaattaaatttttgtaagctatctagataatggctatttttcatgttttgcattctacacttctccttggcttttgctttccccatcagaatgtttcacaagacacaactaaggtaatggatctttattttataaaacacacaaagtgtaataattgagctttcagttgatttcatattttgcaccaaggtactacctttccatgaggagatgcctgcaaactcaagctctagacttataggagactataaagtgttctctaagaccctcgtttaaagtgcctcttaggacttttgagactgtcgagatgaattctactttctgggtcctgaatccaaaatgagcggaagaggacctacggttgccctgtaagagtgggtacaagggtaagaagtcctcagggtgtggcgctcagactggctcacagacataccaacttcctctgaaacttaaacattcccagccacctgtcccttccacgcaccctctccgttgcctactcacaaaatcattgttgtattttgtgtaaaacctcatcattcctttatgtttccgatgaaagattcttgctgacccttagtactccagttccccaacccttgcaagggatttcatactcagagaacacatggcccagattggagaaactgcaaaagcacagatagtcactgtttgcttgcatatctgctgacacagtttctggcacgatagaatattagcacgaggaaaagctaggctcttgagtatatgcttttcctaaactctctctctttatggagtcttctcaatccaaagaattataacagaatgaagagtttaaaaattttaggtaaaggaattgaaatcagagatgattgagaaggcttttgagctgattgagagatctgtgagtattttcctcctttgagctgtcttgttttttgttttttgtttttttgacggagttttgctcttgtttcccaggccggagtgcagtggcgccatcctggctcactgcaacctctgcctccctggttcaagcaattctcctgcctcagcctcccaagtagctgggattataggcatccgccatcacgcccgggtaattttttgtatttttagttgagacggggtttcaccatgtcggccaggctggtttcaaactcctgacctcgtgatctgcccaccttggcctcccaaagtgctgggattacaggcatgagccaccgcgcccggccctatttttctctttcttagcttttctgtttcatcctatgcttaagtaatttctgatttatactagatactataaataatattttgtgaaatcttgggattttattaattttccctgaaagttgttgagttattttccaccaaagacttttaaatgactgacaggtaaccataaatttgtagaggtttggttttctgctttatgaaagtgggactattgtggtttgcctcctaatcctgaggaaatcacttagtcctaggccattacctttactcttaagatggggaagtctgagtatttaccaagcttttttagcttggcaggtcttaaactccaaattttcttatctcttcagttaaaatatctactcagctctttatagccttcagctctattttttttctccctggacattttgggacctcataagcacgtatgcagttgaggagtcacacaaggatttgagaaaattttataggcagatcttgatatctttcactgttgttctctcctttcaacactctggtggtcctgcatccatgctctgaagccagtaagggtgtggttttctgcttctattttagctgatccacactgcacttgcccatttatttattggtccattcattttttacttttattttcgtctggtgcctcccactaaagtgcaatctctgggagaacagatttctcttctggcaccactatatttcagcacatgatgctatgcacagcacacagtagattcccaacatatttacctgacttttgatagttttacatcatatcatgtgacaatggctttatattaaagttatgttaaattacattaaatttataatttaatcacattaaattaaagtcatgtaaattcttgaaagaccactaaaagtaaaatcaacagagtgtttacatcctcattctagagataggaaagagtccaaaacatttaaaacaaaacactaatcattttgattcaaggagatgtcttaataaactatgtaaatgtatataatttgtagatggtatattactgtaatgtgtgaaagtattgagtataacaaaccaggatggagccatttaactttttattaagcttctatatccaaccttattgcaaaggaaagcatgtacaagctccccacttctgtcaatgtggaaatataatgaatttttcctctgagagtgctgaacagccatctcagctaagttcttacctctacagcaaaacatcaatctaatctgtcatctcagcagcactcactggccattctgtgaaatatccttctgctatttgagagctcaggctcctaaccttcattatcagaaaaataacgaatcacaccatcctaatcctacagtgtttcctaagctaaaaatgcaatatcataaactttatatacaacacttttgaggtagctacaaacagacatcagtcaccaaaaacatactctcaaacatttcctagatataagaattgtctaattattcataggaattgtctaattattcatacattcaaaatttttgtacctgggggaaaaaaaaacaaaacttttgtttgattttctccatcttaccagcaggattttagtaattggcatcatatatgaaagaaaaatttatacttagcctgttcctgtgttgtgtttctttccagggacataaatattgatgcaaacaccatttaaaaacccattttatagtgtcacatttacaaagctgttttgggtcaccacaatcattggaattcattcacccctcagaaaatactttattctggtcataacatcacatttttcctctcatgcagaatgaacaatctatagtcacatgttgtttctttctttaagccacagtttctaaattgagtgtctagcatttataatcaactgcttcatttaattcaggtcgattttaaatgctagccattcatttggtggactgtgagcagcctgtggttttgttagatctacagcataaagaaacagtttttcttatcctgatcctatagttgtctgggaaaggtgacactcggtgagacataatgataagaaaggctacagatgccctaggcagtcagaaccaaagccagatgattaaaccattctgcagcattccccaaagacaaagcaagggaagcaatgttttgaatgtttagtactaaaaaaattctccagaacagaagtcacacatactgtatgtgtttttgttcctgcaatcccccaccctctgtttctgtagttcctcctattaatgaagaattcagagagggaggaatgatagtttttgcatgcctatttactgggatttcttttattcatctgtagagtggaaatatcaactagattaactttgaaagattataaaaaaactcagaattctccatgtctcctcatgaggaagattgttttccctgtttcaagcaatgcacctaaacgatacactccttcattttactgattcctcttacttattgttctagtagaggcacatcagtcggtaaaggaattgaaatgcattcacgacatttgagtttgctagattcatttacaagtgattgatgggttcacctggcaacttcaagacctatttgcttttaaaaatcaaacccttaatcctaaacctaacatgaagattcatgacttgagaagataatttttaggtccctgtagcacactctatattgacattcttgttttaggtagagaaatgtggaagagggaggaatagtgtgtatagtttcatatgtcacaccttcttctggaaattcaagagttaatctcttttcctttattatcttcaacttggtttcaggcaggtagtggccctctctagagacagattctgtcagcactttaatagctccctcaaatgagaacagtcagcttcaataggggttagagaaaatagagtacatatttgctttaacaggagaaaaggaaaacattaacaaactaaacattactttaaaaacatgaaaacatcacattttaaatttaaaactgcctaactaaatcttgcagtatgttattggtatcacctgttcctagatgcaactccagcccttttcctactggacttggcttccctcatgtcaggcagccttccccttgggaattttctgtttcctgtctgttagtctccattcacacccttacactcatttcagcctttctgaaaaaggaggtggtaaaacttcactaatctcttagcgaaattctcactgtgtatctgtgtacaatgtgctgaaaaacaccttcaaatcccatttccatttccccagagaattgggcttcctggagagagatattaagggttttgtctgccttttttaggttgacaatatcttttattttaactgcctctgcatgtcatctatttcaagatttcttatgtaatttacacattttaatttactctattctcttattttagttttttccccttttctttttactacctgaaatctgccttctcttattaacgatgctctgattcattatttcacttcttatgatctgactgttttaagtgcaccagaggccacttaaaagactattaagcctccagaggagtgacaggtacttttgcactagcccaatgattcttacttgttttctatctgctgccctcatgagagctttctttccaagcatacactctatcatccctataactaaaataataccaaaaaaagccacgtacacagttcatcttcctttgccatatcaggagaaccagaaaattgtaaagaaaagagagtaagaggaaatctaggaagagctgacctcatcattaattaacagctactggtaattgcacgtttctatttataaagcttctcagaacctcctatgagacttccctgcagatcctaattccatgagtatcttgactagtccaaaagcccttactcctaatcccaacgagagctaacataaataggtgtattgcctaagacagttgcttcaccataagacattttagagaatctgtacctttgaagtagaacaaaaagtgttgtggatatgtcttatttagtttaggctatgtttaacacagagattcatattgtttatagaagaattaagaaacattttgcataatatatgaaatgttttaaagtgtccatgacccagcaatctcatttggaataatataccctcaaaaaaattgataattgaaccaacaggtgtgttttcctaggatatgtcttttacagaaaaaattgaagctacctgaaaataggagattgagtgaattttgttgtatcaatataaggaaatatatgtaagcattacaaaaaatgattgagagttctattattgtcattgtaagacgatattttgctgagggacaacagtagatttaagcagcatatataatacaatgggatttaacacttttgcaaaattgtgtttttatatgtagattatagtgtattaacagagattaaataaatggcagaattatgagttatttctctttttctctttctactttttctatagtgagcatgaatcaattttgaaattaatgaaatctgaatctaaattttttttaaaaagtgtttatttcttagagtaaaaacacccagcaaaaactgaggaggtgacacttaagctgagttttgaagaagccagaagagttctctaggtgaatgcagtggttctccttcatgcaacagcaggggcaagggctgatatatgttagaggagttgctagagagaatggcatttatgaatactataagtagctcaatgagactagaacatacagtgcaatagaaatataatgggtgtgaaagtcaggaggcaaattttgaaaatgccacatatgccaggtaaaataatttgaattttgtcatgaaagagtgagaaagatattttttaaagagtaatggcataatagaattgcatttttagaaagatcactcagaagcattgtgaaaaatgaattggcaaccttttatcatacactctgccagactgaggcagtggcaatgaggtgggaaaagaaataattgagtttatggtcttagttgtagaaacttagggctttgtagggtggaagtataggtgtaaacattgtcaatgataacctctgagattcaggataatccaatggaatagtcaatggtgccattccctgtgacagagagcaagagacgagggccagagttaagggggaagaggactctgtgctgtacatgatgagtttgagacacacagagtttttccaagtgaagatgccgagtgggcagctgcacattagagcctggagcactgaagggagatatcagcagcatatgtggatttggggaatctacttcccatgtgcaggcatgattttaaaggattattttacacttgcttttcacatgcttttcatttcataacttagagaaatctggcttccccacctcctcgtattaaatactgttctcactaaaatgatctccaatgacttgcaggaggctaagtccatatacagtgaaagttgtggaacgaatagagaaatatgtaaaggaagaagcaaagagggcttaagagacaacttagagatcacaattacttaaagttctgttaacgaaaaaactcagacactgtggaatccaaaagcaggaaggatgggagaggagcaaaggttgaaaaatcatctatcaggtataatgtttactctgggtaatgggtacactaaaagcccaatccctactagtatgcaatatacccatgtaacaaacaagcacacatatcccctgaatctaaaagaaagaaaaagaacccaaaactaagactgaaattcataagtaggtgggagaaaaaaacataagagactattgttactaaggctgagggatgtgagaactgcaagaccccagaggctttttagtggtgttggaacttggccaagccaaataaagtcaagtctgaatactttctgtggacttagtaacctgaatgtcattagacatcctcctagtgagaaccgttttaagatagaagagaaagtggaagcctaatcgctctggattgtggaataaaagacacacaaagagcaagtgtagaataacccttcaacaagcctggcagcaaatgggaaggagaaagaggagggagagagaagaggtgcgagtggtgggggggtcactggaagcctttttaagatttgcatttcttttttcctgcggggaaaggaatggtagaatgggaaaactgaggtaattgaagaaaagaaacagaaggacacagcattcggaccagaatgaaagatcagctatggctcagaggttaaagactttacccttggagatgggtttataggcctgcaggctggatagcaatggaggtaaatttgaatgtgggaaaaatttgggagaatttttctaagtagaataccaggtacaaattacaagttatattcagtttctcaaagagggactagacccagcaatttctatgcagattattggtgctaaaataacccaggttaaccacattaacttcagaaacacaataaaagggactttttcatgtatccgattaaattactatggaaaaataatagagtggggttagtagtgtgagtgccaagaaaggtgcaatttaaaatagtgatcaaagtaaaacttactgaagtgacatttaaacaagatttgaaagagatactgagaaaatattgcatgcctaaaagctgccatgggcttctattttcaagtaataacaaggaagctcatgatagctagagaagagtgagtaggagaacaagaggaggagattgagtcaaagaggtaatggggagacacattatgtcacatttggaagcctctgtaatgacactggcctttactgagagtagattggagagtcatggaagattttgaacaaaagaatgacatgatcagacttacattcttagatgatcaggctggctgctgtgctacaagtagactatgagtaaggctgaattgttgcaagtggggagacgagttaggaggctattgcagtgatctaggtgaaagaaatggcaaattggacctgggagacagcagtgtagatggttaaaaacggtcagattctgagtataccttgaaggcaaatcttacagtattttctgacagattggttctataatgtcagaaaaagaagagtcaaggatgagtccacaagcttgggacttaacatctggaaggatggcattgtcattacctgaaacagaacagctatggatacagttaggtgtagtcaggtattagggagtagagcaggattgtagtttgcacatagtaagtttgaaatgtctactaagacgttctgaggggagatgtctggtgggaagtcagacacacaagtatgtccaaagatactgtcaacaccttggctgggcacggtggctcacgcctgtaattcgatcactttgggagactgaggcaggcagaccacccaaggtttggagtttgagaccagcctggccaacatgatgaaaccctgtctctagtaaaaatacaaaagttatctgggcatggtggtgtgcacctgtaatcccagctacttgggaggctgaggcaggagaattgcttgagcccgggaggtagaagttgcagtgagccaagatcacaccattgtactccagcatgggctagaagagcaaaacttcatctcaaaaaaaaaaaaaaaaaaaagatactgtcaacatcttgtatctttgacagtatctttggacagttgttgtccaaagatacaagcaccaaggatactgttaatgaatgtgatgattttaaaaaaataaacctccaattctagagagaagagaagagaaaggtttaatttcctgacctctaaaccatctgtgctctcaaaacacttgaacatagggtatggaagaggcacagtcaatatttgataatcaaataattcaagcatattttttacttccatgaaaggacaatgcttcatttcttttaacaacaggcttttgaactattgagtattcattggactgggagtgaggaaaaaagcagatattcagacaatatttgagacaggcaaatgtggaactcagaagtgagttttccatctgccacttttttaggaggccgattgggccaagccattctgaaccttcttttgcagctttcttgggatgaagccagcctttaatctcctcaaaggaacttctgttcgtattcattgaattaatggttttacttaagaagttgatacagtacagctttaaaaacaacaacgaaacctacattataaattgaagtcatctccaagtagtatattcaagttctgaattaattatataggagattttgaccatccagagaacattacattatttctgtttatttaatcccatttcattttccttcaaaaactcttcaaataggatatagtcatatacaggtaaaactgaatttttcatgtaaaagtgaattgtaattgcatgtgactataaagagatcgttatctgtgaaatgggaaaatgcctgcaacatcaagcttgcactctacgtgagcagtgaccctactatcttagctatgataacactgcaaggagctaaaccatcagtcagggttactgcactggacagcttcagaaccctcttgacactgatttaattgaaataatgatttttttttccttttactatcctgaacatttctgttcttttagagaggtcaagctactgaaataccaatagtatccaaagggtccaaagggtcaaggccaagggcagcaacaaaagtttgtcattgtacagcataagaggatctggtaatgtggaagtacctcactcctgtgccagcttcagtacacggctccttttccctgaggctggcagctctggcagaaattaaagcaaaccttagcctcctaaatccaattgcagtttggattggaggagtttttgttctgaaagaatatgtagtgatctgtgttcatactgtccatcctgtaagcaatgattaaaactaatttagcttggttattcattaagtctccatggacatttttgcataactatggactttatatttctacccaacagtttagcactgactagcccttgggtttattgtaccctacactggcttcttgctgacagtaccatgcttgagactgacttttgagtttgaaaagagcagaaattctagactagaatttctagaggaagagtaggaagtggatcacttcacctctcatttttatttgcactccagtcactcaatacactgctttagatcaaggacaggaaccatagccacagaaaggtcgtgaggaagtacatcatcattccagtctgtagtctacctaattccaaatagcatgtgatatgtgtatgtgtttgggaggtgaaagggtaggatgcccttgccttacaaatagctaaagctcttaagggtagggttgtgcgttttatttctgctatagtcttgtattcatccacacttccactttaatatagcctgaactctcttattatacaccgtaatttttatcacatctttctattatacagtgttttctaagagataaaagtatggtttccactgtttttttctttagcaattgctggagtattatgcttcaaattataggcactctagattgacaattgttcatatatttttgtgccaagtagtcttttatcagttacttacatttagcagaattagaaggtctcatttttctattgctgagtgtctatattcatcttagtcgtagcatattttcttagttatagatattcaatttagattaaaggcttagatgttgtattatcattaataaagagaaatagttggtttcaacctaaaatttttacctcttcaaaataaaagatattcaaggtaatatatgctcatgtgatcagattttttagtattttctaaagatttaaatataagaattctgtataattcagatttttaataaataatattaaagtgcagatggaaagttatgcttttgtgtatttatttatgtttactttcctaatcagctgcatataaaggaagaaatttcagtctatgaagtgtatattctaaagagctatcaaaaatgcccatggatgccagggagaatgtagccttttacatcctgagcttgactggcagacagtagagtggttaagaacatggattctggagtcagtcaccctgggtttgaatctcagctccactacctattagcaggtgactttgaagaagacttttaacttctctatgccaccaattcctcatctataaagagaatataataactatacctatctcataaagtgattgtgaggagtaagaatttatgcataaacagtgcttggcacagaatgaatactatactaatgctaattgttattattcactaatattctcatattgaatatattcatcagagatgaggaacagcaaagtctgcctgccttttaggaagttgtgaaggttgaaattgatatataacttggaatagtgaagttgcaagtcactgggagtcagagttatctaaagaaagggatttagaaggaatcatactcacaaacaaattctagctgaggaccttttagagtggaggaaagaggtgaggtataaaaaatttctcttacattgtctaattttagaaaattgacctgcagaagcagactgaggctaattacagaattcagccatccttcataaaagaccacaaaaatcagcagaatgtcatttcttactcagtatttcttgctttattagaaatcacattcacacacacacacacacacacacacacaaacacacacacatgtacacagagatgacatccagtaatgaggttttaacaattttgaagtcattaaggtacagtgaggagatagacagattgtcatcaaacttcgcttttctgggagaacaagtgataatgacagcatctttaaaggcaagaaaaaaatgcaaacagcttgctctccccctgagctctgatgctgtggtaataacaagctcatgcctttgtatcttttcaaatgtagtcggaaatataatggaatggaaaacatgttttcctgaagttaagggaaaaaaactacaagtcaaaggagatattaaaatgccgagtttaaggaacgaaaacatggttcttatagcacttgatagcaatttttaaataatacttcaaaaaaaaaaagccctgcataggggacaattctcagcagtctccttttttgatatttgacaaattatcaaattatttttcttctcctactcttgtgtttctttaatagagtcatcaatgttgtattctccttgatattttttggcaagtgtataataaaaaaattttaatgatataataatttaaaagagaaagtaagaactgatgatctggatagaattagtttgatataaatatagagaaaattcgagctcagaaatatgagtgatatttactaataaagataggtaaataactcttaaagaacttttaaaatttgagtagtaagagaagcaattccaatccccatatttaaacttctcttttagaaggcgattccaaaaaatctctaaattagctaaccattctcaacctctgcctgcttaaaggaaaaaaaagaaaaaatcagaaaccacttgagccaattaatacatatactagggagaaaaagagacattaaaaactaccttccttcttgtaggaatggctgaatagagtcaaaaaccgatgaacatttacaaatgaggagaattaatatattttttgcttctcctaggagctcaaagtgcattcatagttatgatttttttatcttcatcttgggcccataaacgagatgaaatatattgtcaggagcgcaagaccagcctggccaacatggcaaaacttcctctctactaaaaaattatacaaaaattagctgggcgtggtggcacaggcttgtaatcccagatacttgggaggttttgagatgtgggagaatcagttgagccctggaggtggaggttgcggtgagcagagatcgtgccactgcattccagcctgggcgacagagccagactccaacaaagaaagagagagagagagagagagagagagagagagagaggaaggcaggaaggagggagggagggagggagggagggaaggaaggaaggaaggaaggaaggaaggaaggaaggaaggaaggaaggaaggaaggaaggaagtcctcctgtcactatttaatcatgaaatcctaaagcaaaattatttaaatgagttggttcaagatataagattggaagtaactgaaaataaaaaccagttaatccttgagagcctaatgtcctttaacagatgagtaagtaaataaattgtggcatcctggaagagttttgctataatggcctccaattgattttgacattgagatgatagcaaacatcatacagagacctgagaagtgcaccttactattattgctctttaagcctgccacaccagtgtgaacaagcccagattattctgatgaatgattagatatgtgagaccacaaatatggggtccatttatttgacttcatcacccccacctaacaataagccaagccccagaaaaaaagtgctacccagatgattcacagtcaaccatagactcatgagtgagcccaaccaaattcagcagaagaactgcccagctgaactcaattcaaaatgttgacctaaaacacaatgagcaaaaatgaatggttgttactttaagccactaaattttggtttggtgtgttatgtctcaaaagttagtgataaaattatattcacatactgatagaacgccagttgaaaataaaacaatgaattactgttagatgcagtagcttggattaatctaaaaaatattatattatgctcagtgaaagaagccagacaccaagcaataagattctattgtatgaagttcaagacccagcaaaagtattctatggttatcaaaatcagaacaggtgtggcctggtgggtggtgtaagggttgggagagtggtgaggatgaaaggccaagaaggaactttcgggggtagtagaaatattcttggttactctagagaatgctgatagtccagtagtccagtttaagaattaatatgcaaaaatgaattaagttgtgcaatataggtatttctcagggtgctatatgagcacagagagtgaggaatgcctatctgtgctttttggtgtttagaaaatatttccctgaggagtagccttgaagtagcccatgtttcatgtaggcattcactatatggtgataaatgttgtttgttggacagagaaatgccttattcaaaaacataaagatatcaaacagcatggcatgtatagtagaggaactgccagagatttaatatggaagagtaaaggggagccacaagtgttggggctgaaagcataggcttgagccaatcatgaatgtccttcgacactttgctatcatgtctttaccttgtgagcaaaaagagttatcgtttagattttcaagctcttagaatcatcccatccatctgactctccacctgatatgagacttgccttgctcaccagcagtaaactgaagacaattagtgactcaccaatatatgtctaacataagaagcccacgctggtgtgtagaagcacgtgtaagcaattcagaggagaactataaaatcatgatgagtcggaaccactgaaatggtaattaaatgagtgggaggagcatgtgcattctcctacatgctccaggtttcccacaagtagtattaaactcctctgtgatttgtctggtagctgagccactttgtttcttgatgatttccaagctctgctaattcaaagctcagtattatcatctgtatccagatttccgacttggaaaactaggtgaacttaattttaacttttttttaagtgaatgtgaattcactctgattattagaatcttatgttccctttgcttgagagtattgtcagttttgccttttggataaactaagaagactgtgtgaaaatgagaagcataggatttagggtccataggcatgaatcaagtcctctcattatgtctgaatcttgggagagcactatataacttctctaagcctcagttttttcatttataaataatagatgatgatagaaattatctccttagttttggaaagaatggatagcagaatggctgtaaagatgttaccacatgcccagaatatagtgaacagtaatggcagctattactttaaatagtaatcactggcatttcctttcctacctcccagctgttaccaggatgtgaggggttggttagatgattggttggttttgaggtttaagcactaaaaataaaaaagtaatgcacagaaatacaattgcactttttcctaggttatatattcccaaacggtaataatggtattgctagtaattaatgaaatcccttcagtctgaggtttatgacattctgtttcacccttgcattggctatgagctacgtagaaagaagacaatctaagatttatattgaaaagaaggtaactcagatggaaaggaagaaagggtcagtgaagaacaccaattatagccaagttctgactccaaagttattcagtccaactagattatactgctacacatggatagacttgacgggccttttaagtgacacttcgattcagtattgtgccttttaaaattgctttgggaaaaaactggtcttcaaatttgtgtcttccccaatccacattttattcccctggagggttctttttcttttcctaccttcactcccattcatcttccttgccacatactgcaacaagtactttgcttcagaggcacgctttattggatgccacataaaataccttttcataagcataaagcttattcccacagatgtcatgggaaagggaccaattgctctaaggttcctacttaactgtattttcaaaaccctaataatgcatctgagtttacgataacattttaaagtcactcttctctctagctggtttgtcctgatgtttccgttgagtttaactgtttcttttttagtgcaatgagagtactactgacatcatttttgtataatattaatcaatgcattatttttgatcactggatatgtgctgaagtctcaggtgcattgtatattccacactttccttatcttccaatctagtacctctaaaaagaaggaaatgttaacgtagttttagcccctttctttttccaaatgcacctatttaatgccagttatttttgcaactaaatattttaatacaaataatcttctctcctagtctctacagagaaatctggccttgtgttcccattgtcatcactggggcagcatactccttccagtgaaattcatggatccttctttagccttgtctactaatgttagagaatattcaatatgggcaaatttatttttacaaatgccttaccttttgtatagttaattttgctattggtaccctattatctctgatcaaaaatgatgttacttgtaccatttgctccccaaagagctatgtagtgattttgttcaaaaattctgtagacagtattaattgtgtacattttacagaacatttaaaaattacactttctgcttcaaatgattcattatgaataaatcagagttccttttgcacattacaaacatacaatcttaaacttagctttaccattaaaatagtatggtattattgatagttgctttttacatttcccaattattttcaatgaatagttttggttaaggactcccctatggctcttatctctaaaccggaaggcgatttcatggtagttctattgcactagattggccatttctttgatcatctcccaaccggcacatgtatggaatggttgaactactgctgtcaatacagttttaaaaacgaatctgatatgtaaaccctgagagaggtattaaccataatgacatttgaatgttattagccatctttcgtcctgcctgagtatcttctgctctgcccagtttactaatacaccagactcctctgaactaggataactttttgataagtttggactgaagaaatctaccagtttccagagactatttcataacaggaatgatttggtaaaccagtgttggcatttagttcagtctatttcccaacttaaatagataataccagtttgcatgtatgtctagttttatttaatcttttaaaaagtgtttaatacagtcatgcttgatgatgcagcagaatacctaaaggctggtattaagatatgtttctgatcctctgaaaagcttttctgacccagtaggctgtgaacattcacaatagccctggaggcaatcctccatgtgttattgcaggttgataactgcacctggattactcgtagcagagaaaatttgcagtgtgttccacaatagtccagccagtggattagtatgagataagaatcatctggtaaacaatacagatgatataccagcccacataataaaatacttcatataaagaccttcattaataacactgatataatcacatttgaatcctttgctgaagcaatctcaaattatgtagatggaataagatgaaaaagagcaagtaaaaatcatctgcaacttaaaattatactttgtgtgtgcataatatccttctgttcaaattcctattacaaaaagcatgggcttagagcctatgaattatgaattcagaacaaaattggattatttaatttaaataaaacatacaaccaatgtatttggaatgtgagataattgtgggtaaaaagtagtgttgctactcctcatttctaatcatgttggcataaaggcacaaaattaaaatgtgtctttgtacttaagaaaacaagcatatctacttggtttagatatatttataactcataaattataatatgaaggtttttaaacataaatagaactgtcctaaaatgtagtatttttcaagtaaacttttatggtgagataattatagatcatatgcaattatatgaaataaaatgagagattctgtttacactttacccagtttctccaaatagtattaccttgcaaaaattagtacagcttcacttttcggatctgggtattgatacagtcaagacatagaacagtttcatcaccacaaggatcccgtatattgcctttttacggccacattcacttccttctaacccaccccccttagtccctggaaaccaccaacctgttctcgatttctacagttttattatgtcaagaatgttctacaactaggatcatataacatacaactttttgggttggctttttttcactaacctcaattctatggaaattcatgcaggctgttgcatgtatcagtcatcccttcctttttcttgctgagtaatatttcatggtatgggtataccagtttgtttaactattaacccacagaatgacgctggggttgcgcccactttggggcgttatgaatagtgatgttatacatattagtgtacaggtttttgtgggaacatgtttttatttctctgagataaaattgcactcctgtgtaggagtgcaattgctggatcatatggtagttgcgtgtttagtttgtaaagaaacctccaaactgttttccagaatggctgtccataaatgtttccctgtttctgctttcaagatatctgtttttgggtttcctaagtttgattgtcatgcatcttggcatgaatttctttagatttatactgtttgtggttcactaagcttttggaattagtaagtttgtgtcctttgccaaatttccgaagttttcagtcattatttctttgaagactttttcagtgctgacctacttctccttttccttcaggactccagtgggggaaaaaaaagttaggtcttttgttatttccatgagtctctgaggctctgtgcatgttttccagtttactttgtctctgtttcttagtttaggtaatttctattgttcaatcttcaagttcactgattctttcctctgtcacctccacatttttcagttctaagttttcagtttggttcttccttatatattctgtttctttgctgagaccttctaatattttaatttatttcaggcatgtttgtaattgcttattggagcatttttgcgatgtctactctaaaatatgtgtcagaaaatcttaacatctctatcacctctgtggttaggttacattggctgtcttttcattcagtttgaggccatcctcactgttggtatgattagtaatttttaattgaaacatggacatttggggtattatgctatgagaccctagatcttaattaaacctttcattttagttgattcctctgatgctgttttgatgggagaaggagggatgctgacttatttctgccaattggggatagaagtccagggttcccacttagcctccattgagacttaaggtgggaagggcttttcattaagtttgggaggctgtggaaggtcctgccccccactagcctctgactgatagctccatatctggcaagagccttattactgctccaaggtggctttcactgatgccatgggggtggcggactggcctcagtactgctgggcattggtaaaagtcctgatcttctactaagcttccactgacatcaccccagtggggagaagagagtgtctgccttgttactggagagtgaggctaaaagtctggattacttactcatgaggcagtggggaagtcttggctccctactctttgttgctgtggttggggagtggggctacaatttttgtgtttttgttttgttttgttctgttttctatggtgttggctaaaacaaagaggtactatcactgtaaaattttctgtcttgctaggctgccttttcccttttctctggtcttttggctagagacagcaagggtttactggggcttttaaaaaatctgtacctgttggcatttcagagttataggcttcttcagctccaagtaagtctggtgtatatgaaataataataataatggaattcaccctcatgtacttttttgagtaccaaaggccatagctggtctgcctcaaagtcttcttgtaattgttatatatataatgttcagagtttttagttatacttaataggaaagatagggaaaggtatccttcccattgctccaacttcccagaaaccgaaatccagaatgtaatagattaaacgctaaggttgctatattttcaattattacaattaaatcttttaaaatacttaccaaaaggctttggtttcattttttctattagcttctaagtgaatttctgggacatacaatcataatttggtctgtggatacaaaaaagaattttaatctgatttagttatacagagaaaatatcatttccttccagtcagtgataatatcaagatgacatgtaattccttaccaggtgaattagaagtgaacaaatcacattagatacatgaaggtgaaaagataaataaaaaaaaaattatacttagctctgctttgaatgacaaagactaaaacaactagaatattttatttctttcactagtggataattgtgtgtttgcctaggataatgccacaggtcccttccattattattctaagcatctttaaatcaggaacaaaataaaattattttctttcaattgaagatactcatatctactctaacaacatgagcctctattatctgctttgtgccgtgttacttccctttatacagcccaagcttctctgaactgggccacttcctcctccctatttcttcccagctctagtctaaactccacttggaagatgtactctccatctctccgtacccctctttattccatttcaagccctcccacctctcaaggtctatctcaaaagtgccaagcaccaacctactccgagaatggattaccagttcttggaggaagcagcacctttattcagccttaaagaatgaattagtgtccattagttgtttttcctgatggatattaactcattctttaaggtcagcttaataccgggagatgaaataatctgtacaacaaacccccatgacacaagtttacctgtataacaaacctacatatgaaccctagaacttaaaataacagtgaattaaaaaattaaaaagaagacccgggaagtaagcaggcagtactgccatgtaaagctttatatccagcttagcaactcaggactctgttttcaaaaacaaatgcaaaaaaagaatgagttagaattactcattactggaggtgcaaggctgactagggaggggaaggaagaggtacagggcattagcattctttgttggcagactgggaaaatgagttaaggaacagagaaggaaagctacctgatagatgtcagcaagctaccaacagctttctactgacatcaattctgacaaggattggtgagagatgaggctagaaaggaagacaagtatcacatcaggaaggatttggacccatgaaaaatgttatacttttgtagggggtgctccttcagctcattgtgtagaaaaatggcatagttccattggcaatttgacacactggaggcccactgattatggccctaatctggtcttcacagctttgcttccattattctagtatgaagtccccaaactcttatcagatgtgactactggctcttacctaaacacaacccctatctttcctgcttgataatctcactctggaaaagcaaattccattttgcctgtcatcagcaaaaatacatataatgctcttccaagggtgtttgagaggattaatgggctaacacatgaaagtgtccaatctactgtttgttgtcacttattaggagtacagttttcttccttctttctgaagatttacctaaatcgacttcaaattacagttatatgtatacctgctacaaaattgcaaactccttaaagctaggactatatttcaaacaatggctctaaccaggggaaattttgccttttagagggcatgtgacaatgtctagagatatttttattgcctcaattgttgacagtcttgattgtaggatgttattgtttaaacattgacaacacataacagcctcaataaaaaagtgcttcccaacccaaaatgtcagtggtgactagaaatctgctttagttcatcattgtagcccaggtagcaattagaagagttgcatgttataggagattggattcgtctcttctcacactgctaataaagacatacccgagactgggtaatttaaaaaggaaagaagttaaattgactcacacttcagcatggctggggaggcctcaggaaatttacaatcaagacagaaggggaagcaaagaccttcttcagatggtggcagcaaggagaagaatgagaacaaaggaggagaaaagtccagtataaaaccatcagatcttttgagaactcacacactatcatgagaacagcatgaaggtaactgctcccatgattcgattacctcccaccgggtccctcccacaacacatgggggttatgggaactacagttcaagatgagatttgagtgaggacacagccaaaccatatcagagacattcagaattgtgggaaataatctgaaacccctttctataggtaaattttataaattgccactggggaggtaaaattaaattagaaatttatattgtgtaggataattggaagatagcagagtttatgaatcttggttaatttgggggacacaaatttccatttgtagttagaagtgaccaatttaaaagctaaagttctcttaatcagcaagcttttgtaacaaaatgcagcaggatttacttttatatcaaaggagctccccagatagttaaagaatgaaaatgaatataattaaaagataactggtaagcagaatgcagtgcagtgcattgccttagctgcattctgggagagtacacttaataatcaagactctagtgacactttaatgagaagtttaaacttattggccatgaatctcagaatgtatcgatgcttgttacctagattttcatttcaaagaaatgaattgatgagtaagaatttttttaaaacagtttgtaattaggacaaattgctttacaaataatttaataagcatttaacactgaaaagaagaggaaaactattgataaacctgtaacatttagccacatatagtaagaactcaatgtggaggaagaggtgaagctataagcaataccaaggggatttaaccaaacccataggccgtttacctagacacagccagatccaagtaccaatgacaagcacccatggcactggctcactccataaaaagagcattttcatgggtcctggtggataaaagatcatgatgtgttagtataatctctatttttccagtacccatgaaaatgctcaaatcactatgtgatttgagtttggacaaatcaaaatctttgctaaagccaaacaggaaaataggagacattggtttttaattagtactcggaactctaaaaataagtcccaaaaaaacaaagaccttgatgactctattatataaagaagtggttcttactatcactatcttattgccaatagttacatataattcagagagaaacatgctgatttgatgagttttctaaaatattttttaaaaagaaaactcattcttctgatatagcatcagtggtatttatttttgactctctaagatgtgtactggtacagatactacagttgggggtagagagggcagggggtacgccttccctctcctccaggatctaaaaacaaaagcgtttgaagactgtgttgcgtaagtcttcttccttcaactctgcctccccagtgtgggcactgctgcttcctgtattgtccaggaatgaccactgttttatcctatgccagttctttttggaagatagctagaatctgccagaacgtgctttctctctcaaatccaaattagggacttaaaagtttcttttcaccagaggccactttgtctcctaacagttctgtgctcattaaatacctattagtgtaccctttgacttaaaatgttccactcacatcctccagaagatcactatctgtcatctaatgaaaaacaacttcattaggcttgtcgtggcggttcctttttttcccgtgcttttgcttcctgattgaagactgcagcttttcctaatgttttcttccccacactgaatattattgtgtggggtcggtcctcagccagatcaatgcctgtctgaaatgtcattgtgaataatcttcatcactattttgaggacatacctttaaggattcctccaaactagatcaatttgcaaaaaaagaaaacaaatagttttccattatccagatattatatttgtttcttttgactagcgctcataagttgactaagtaaatattgtactaataggaaggaatacaaaaacacccaatctgagaaaatagagagatcaagtgactttgctgtgctcctttacaagcacacagacctttttgtagtgtttcagaaaagacgatgcgacgtgtgtaatgccatattcaatgcattttgatgatactccctacttataggtgtccatctcgtcacttctctgtaacatattgtcttaattatactcagtatgccctggctcctgttacagatctgcattttccttacaaagaacccatgcaacaaaccacagaatcaccttaatgtcttccctcaaagcgtttttctgacggtctgtgggtgtccaagttttagaatcgtaggctctgagctaatgaaaagtaaactagaagttgatgggcacaaatgcaaatgttaatccactagtgaatggttataagtctttttctgtattgaaaataatttgttttagattgcctggcaattatcaaatcttacacataaatgcaggtcagagaaaaacagagtaatatatgtatttacaacacagatgagcatcatttgaatgaggaatccacactgaagtcaaggtccagtccgatgagccatgttggttggagccctaagtctggttgtaaactgcctgactttgaaaagccactctccagtgaggtctggtgttggtgcctttttctgatgtctaaagcatctctgttttgtttcagctggcaggtttcatctacgcctgttatgttgtgaaatgtataactgaagaagaggacagctgtaagtattaaagctctattctgtttctttcaagttcaaagcatctcctttactgcctcctacttagccttcctattcctcagacaagatcctacaacacagcattagaatggaaaataagccttttgtgcccatcagactaaagtgtttctcataacagtatccagcaaactgaagaatggagaagcacccattttgaaaacataacttctttcttttcattgaaaaccttttaaaaatcatttcctcttataaacaattctagtagggaacagagatgggagattggagatggaaatgattttaaaatgtggctaacttgaccattctcttttttatgatccctttattaggtattgataactaaccagttttacccaagactacaaatccccaaaatcaacaatttgtaatagttgctaagattcttataaaaactgacttcagattaattcagagaatttgtctttgggaaatcaaatgtccatctgtcctttttgttcctactatttgacacaaatggctagaactctaactatgtcaaagtctcaacattgagacatattgcttgatccagagtttagatcacagtaccctcttacaatcctcccagtggctctgttgttctctgctctccgaaacatggagggtagaaggtttcattccatccctgcccctaaggatctaaaacaggagaactggggaaagtacttctattctctgagggtactatcatgaataattgcctatatagttacatttactctgaggaaaaatcagaattgggaatcatctttcttggtttcaaaaaatatttataatgttgggtttttgaaacagtaaggaaagaggaaggtgagaatatggtgatttgagggaaacatccaaagataaatatctgtttcttcttccctttccaattatactggaaaggaagaggcaatatcaagtgattaatgtagaagaggcacttttcaatcgtactcatacatgatctaaaatcagaagtatacagtatataatttatttcatatataaaaggaaataatggtcctttcactaaataagcatttgtaaaatattcctcagtatttcaagtgctgtgtcagcctttggagattttaggatgagtcatacataatattttacctgtaggaacttgccaactaggaggttaaaacaaacatatgagcaaataagtatgaaactgtgtagtgcacgctgtgggtaaagagaagaaagagatcaggagaaggtttatagagaacagttttgagcttgatctagaaagatgaatagatctttattgtgtagctgatatggaagtgaggggtggtcccaggcaaaaggtgaaaaagcatatcacggccagattaatgtgactgaatttgtttcctgtgctacaggtagacagctggagaaaattggaaaaacaagtatgggtgagatagtagaaaaatgggtatgaagattaaggagtttgggctttatataataaaatcacagatgaaagagcaggtagcttataaaaagagattaacataatcaaaaatgtactttagaaaaaatacattagcatcattataaagaagagactcaagagggggaaagattagggaaaagagaactagttaagacaccatgaaagtgagacatgagataatgtgaatctggacaaggatcagtattggagatagagaggatagatgtgccatgagacatgccgaaatgacatgattagtgggcaatggtgggtactgtgataagggaaaaagaggagactgttagattactgggtatctgatgcaagtgaatgggtagatggaattgccacttgcgaagaaaaatgggaataagatcactagttcagtttgcacaggttgagtttgaggtacctagcgcctatacaagagaagacatccagtaagcacttgtcttatacagaaaagatttattcaaagattaggaaaggcaaaatatatacggattttaaaatgtgtggaccaaacaaactatgtaagttcattgagatattaccattcagtgtctgtgtgccaaatccctgatgaaggggaagtccccagttgattttcatatggaagttgggctttctctgggctatgttgtttgatttcatttcacaatgataccagtgcatttttatcttcagacaatacttactgacataccatgtctcctacatgcataatcagtattttagcagaatagcacctctcaaaggaaatctcagaaatgctagttccacaagacatactgctcaaaaaaaaaaaaaaaaagattccaaagccaagtaagtttgacactgaaaatttagaatgcacatttatatattaacatttctgagagtactgccagaaaaaagtatgtccttttttttgttttctaacccacagttttgttttaatcacattaccttgaggccagatacagatcaaagagaaaaaccagaaagagttctaaggcttgattatatccacagttccccggggagaataccacatgccccacatgggaaggagtggggtcagccatgaggcagagagagagtggaacctttagttcaaatcctacaagaagaaatggatgaggcagggtaggaaggcttattaggataggttagctatgttgcaaagttgcgccccatgaaattcatgttcactgtgactattaatgcataggtttagagctatctaaaatctccacatgctttttggggatgagccagggcttacttggaaacagctagtggtcattttgtagatgttaaagcatcaatttatagaaattaaaagtatggttaatgcaagtctcccaaaatatttgaacacaagactcctgttttccatcaacccctgcccctctccgacctggacacctccagaaaaaagcacttgatattctggagaattcttctaagggaattctgccctaaatcaagttttggccaaagcaatgtaaattcaaggcgattcaaagtcaccaatatctgttgaaagatcaagttatctctcaatcatctaataagcctttttcccctgaaagactccaaaaaataacatatatgtttttatgtgtatcttgaccacacaccacatctgcctttattaatccaaaacacaagcagacttctcaaagacacgttttatcatgttagtcttattgctcagtgcgcaaaatatgaacccttctaaatttttatacacaagtagactgacgcttgcctcagatgttcatgggactagtaaacaggtgggaggagatgttcatttgggctcgctgtctgtccagttgtctttggtgactttcagttaggttcatttacttgtagtcattcacacctagacagttatgagtatcttttggttacaatgctttgggttgatattctctgtatgtaatcactttcctgatgtttatcctcagacgatgcctggacatatgacttccgatccatagagtaaaaaaggtttgacatttctgtatcattttggtaattatattacaaaaaattatcctgatccttaaaaagttgggtgaaaggttaaaataaaaccactctcaagcaaaccctgaaacatgggagggatttaatgtacatgtaaacactgagagggtctctatgtgcctatttttgcccactgtggatttgcaataatgcatcattatttgcagtgaaacatagtggcaggagtaggtgctagctacctgcttgccaaattggttaagtttccattactaagagccttatgaggaacagcggacagttttggctctgtagcttgtgcttagaatggctgtggagataagggcccaatgatggcaactggacaaaatgttctttaagtcaacatgaagctgatcagttatgtgctcagttctgatacctcagcttcacagcaacaggtgtatccaggaaacttcagaggaaagaggcagaaacctccaggaagcaatggagagggtttgagctcaatgagcaaagactcaagcctagacccaatgaaataccaataaatcatcattgaaacagagagttaggctcatgaacatcaaatgcctgagaacttttttcccttatgtatccttttaagcagtatctcattactcttctagggcccagtttgattgatatttatagagatactgttttagttcctttggggtactatagcaacatattataagtaaggtggcttataaatgacagaaatttatttctcacagttttgggggctggaaagtccatcaaggtaccggcagatatggcttctagtgagggctggtttccttgctcataggtgataccttcttgctgtagcctcacatgtggaaaagaggcaaggcagccttccggggcctcttttagaaggtcactaatcccatttctgagggctccactgtcatgacataaccacctcctacaggccctacctccttacaccattacattggtgattatgtttcaaaatatgaattggggagggacactaacatttacatcatagcagacactatattgcaagggtttctgtttttttccattgaaaaaaatctggaccttgaagtttacatctctgaccctttagttatctaagccagagccacagtttggcaggccagctggttgtgcagactcacagggtgccactgccatctgctgtacctaccaggggatgacagcaaccctcagagcagagatcccaaattagatgtgacactccttcccccatgaattagttagctagggatgccataaaaacataccacagacatagtggcttaaacaacagaaatttgctctccaaaatctaggtgttagaaacctcaggtttggtttatcctgaggcctctgtctttgccttgtagacggcactttctgttggattagggccctatccttatgaccccatttaaccttcattacctcttcaaagggccaatttccaaatatagtcaggcatattaggagttaggccttcaacatatgaatttgagggggatcacaattcagtccacatccaaatacacacacacgcacacacactccacgtgtgtcctggacacttgaaaatatctgtggggcacagattgaggatagatgcagctcactggcccatcagatgcctgtgggtaagaggcttcagggctgtattgctgccaggccagctccatactcactgccaccaggcaggaattcccgctcaagatctcctgctgtggtgtgatctgcctctagatgagtagcttctcaccaggataaaagctgaggtccctgctctagaggatgtggcttgaccttagaaccctatttgagtgggccaccttaacaacatactttcatatatttgttcatgaaaaggcagtgatacatcttgggagaaaaggctttctccaggaaagcaggcatctcgctgtgctgtctttgtggcagggctctctgctgtctcatctgtcaccagccatgcagagctttccttatggcctcccgtcttctattcccctctacttgttctcttttacactattctgtaaagaaagaaaatgtttggagattcctggtcgggtgtgccttttattataaatgtggctcttctgtctcacttcatcctcggtttttccccactgcagttggatgtccactcacagtgatagaatcaggaactgtcctcagtgctttattagcactgttcgatgtggcaattaaaaggaagccatgcagccacagaaaatattgctaatccatgttagcaaaaaaaaaaaaaaaaaaaaaaatcatcatgacttctcaatttttattacttctcaatttttattatgtattcttgtaaatcactggcttaatagttaaactaaaactaaatgttggtcctctagcaaatgggttcattttactaagtagtcattttctttgctaaaagagattcaatgtatttgcaaatgttgtttaatgatgaaatcatctggagagagacatggaatatcatttaaaaaataatatcctaagggacttattttgaaatcaatgcagaaaaatgaattcaagatgcttaaacttggagttagacacatgcacatttacaccaaccaagcacaaatgcatcaaaacctgtcctgaattcctcaaaatcaactggccttgggataaaagtcacaatcaatttattgaatctttcatttgaaaagaaaaccacaggaaattattcacttctctggggctaataattttctgttatttttgtttgatttttcttctaaagcctgctggcctacacttctgtgtattgaattccattctgtatgtttttatcatttctccagtttgtcaggatcattggatttgaatgcagttctttgagcacaatcgcgtactctcaaccatgggggagggtagacatgggagcagggaaaactatttccccttgaaaaaaatatttgtttcttcctgtctataaaggaatgcagaaagcatagacaatacagataaataaaaaaaggaaaattaaaataaccccataattctgagttctgatactcagttcaaattttggtatattatgtgcctgcctgcctgcctgccttcttaccttccttccttccttccttcctcccctcttcttttcttcctttcttcttatctatctattatctatctatctatctatctatctatctatctatctatctatcatctaactgcattcctcccatctgattgttagggccatatcatacattctgtttggtagtctgagctttctttcacgtttataaatcactcttcaaacataatctaagaggagacaattagaagttcagaaaaggtgccaagttcttgggtgccaggttgacagggagaattgtgagaagaatatgtttattttacttatctggcatcatactgaagcaatcaagtaaaatgtaacataatcttagtatcttactaatttatcttctctttataacatttgtcttatgaatttgatggtgactgactgaaaaaattttgtccatatctgccagtttcccactaaaccaaaacttggtatttattttgttatctctgaacaggatcacaaagcctgaagacccaggctttgcacgccactaatctctcactatgcctacagaatcctagtggggccaaggtgaaaaaggtgtcatctttcacctttccttcccattcccccctctgcccaaagcacagaagttactgcatttatttaatttaatatcgatttgttctgcttatgatttgttttgaactatgagttgtactgggttaaaaatgatggaaacctgcctactgctctatttcagcactttaattttataggcccagaaagattaaatgacttgcccaaagccactagctcattcatgaccttccgacattcaaatacagtacacactgattcactcaggatggaagaatagtaggagacaccatcaagatccacccctgtcttgttccctgctgtatccttagcatctaccaaatccccaacctagaagaggactcaggaagtatttgcaaaataaatgaatgaatcaattggatctccacaaacattccttgacctttatggaaactgccaaggaaatatgacatctcctcagaattcaatgtattcagagtaaatgaataagtaatttgaataaagcacctgtcattttctaaacaagagtaagaaagacatgctgccatgtataaaactaagtgatcaacacctgagacagatgctacatgcgaattttcctcctgtcaatcaaattcaagttcctattagtgaccacagcattctccaacagtgttacatgtaataattttcacataatctccccagattggtgagcaatggtttgtttttcagccttctattaaattgctccctcttgtgatcatctaacagaaaacacataagctatatttttaaatttggatgttcaggtcaaaactgagtctgattcttcaacattcacttcttattttctttcttttctaataatatcgcctccattattctatattgcttttcactcatacacatacacacacacacatactatgttcatcgttaaataaatctgatatttccaagtcaagaatatgaggggaaagaagctgattcattctctctcctctgttaattaagaacaatcagagctttgtttctacaacacaatatagaggtaacactattcagataagcaaaggagggcctttaactggggtgtaacaaaagaggtattttttatgcaaagaatatttctggcagggtaagttgaagttatccagcagatgaagaatactgatgttgttttaatagccttaataagaaagaaaccatgtgacttgaaggaggagaaagtagtgacatttacagaaatgaataaacaaaaaccttgattttgctgactctgcttcttccagtggtgcagacccccacagcctaccagcagtgggtgtcctggactagctacctcaccatctctctctaccttctcatggataatggcatgagaaagaaagcattcaagtagcagaaaagtggggtgatttttgcagcagaatgttgacatacacactcacaaaataaaatcactgggattctttagtcccatctccaaacaacaaatgagagcaagacaaaacgctggcacaggaaaatgaagtctctttaaaagccctccaaatcagagacatgctgagaagatgacattcaaagttagtctcttgacgaatgatgctggccggtgcccacttccttatgcccggttctgctttagttttagaagtggcatctcatagaaacagaaggctgtgttcagaggtctccttcttaacagcaggagggctaagaaacactagatctctaaggatggccaccaggtttgcggaatgaaaacatctgagcaaagcagcctacacctagctactgaaagagagccttggaaataagtgagctggaggcaaaccctcaatcctgtgtgacatttaaatgaggctgctctggcagaagatactcacggaggcctccgctatgactggttggcgttgtgtggcagggagtgaaagagaaacaaacttaaagctcacaggaggtgcggtttgtttaaataatagaaagtaattaggctgaagacaaaaatcagtgatggcattttataattacgattaatttaaagtttaatttcctttggtgctaaaatcttacttaaaacatttatcgggaaaggaaattaggacgttactatcaagaggcacagagtgcttctgggaatccatgcctattatcacttgaaaattaggttagggccaaagtgggaatttcaattcatttttgagtataataaatggtgaccagacctcagagtcagtggggttggcaggggcaggcagtgtaacatttgcatttgcttgtttgtttgtttgtttataggattaattgcaaatgttttcagcaaagagtgtagtttatacattaacaatcctgctacaaaatgaaaattggatatggattgctgcctttgtaactaatgaagctgatgttgaattcccaaatgtggcactgcaaagggaagcacacagtcacacatccatacaccttcaccactgaattaaacggaacaggggacagtatttctgttggctccaaacccgtcaccccgactgtcctatccaaggccccaactttttcatcattctgttttcccattcatgcctcagtttccaattgccattttcagcagctaatctttctggaaactcacttagtaaaatcaatgcataatagtaacaagcagatggaaataactcctttacactaatttttttcattcattatgcctttgtggatttgctcattttaaatattatattgctaacattcatatgtgaactaatcccagaaatatggaattgtgtataatcataaagttatgaacaatattagtggtcacctactgtaatcccccaattttacagttaaggaaagggacactcaaattgacttgctcaaagttaaacaatcatttagaggcagaactgggagcagaacatcgctgtcaagattcgaagtatactttccatgtcacttcactgtgatacctgagagagattcttgtaacaaataattattgagcaactactgggtggtaggctatttattgtcactagggataaagcagggaaccaaacaggtaccatctttgcctttatggcgcctacaatccagtgcacaatttacgagagaaagagaaattacagtaaatcttgatgaaagttcagacaaggaaaggggatggaggtgccatgggaatgattccaagaagaactcatgcagtttagaagagggaaagaaattcttccccgaagacatgatgattcagctgaaacctaagggataaattagaggactatgtagaacttaacaaagacaggcacgccttttttaaaaggtactacttttcggatccatattgaccaaaggtacaccgtaagtcacacaggaatgatcttaagttcttttaatgaactcgatataggaaatctagtttcagctttcccaaataccaataaaaatgttagagtaaccatgggacattctctttcctgaaattgctactgttgttctaagaagatgattaatttaggctcaggagttttgtgattttcatttctggaggctgtaaaatgatacaaagattatgttagcaaagattacaaggtaaagaatatttctctaataggtaattacagcacgcatgttttatttttttatttccctaaatatgcatatgttaatgtacccaaaaccctaattaaaactcctgcatttaaatgggctgttgattctaaatatattctggatgtcagctgagaagacatacccaatcatgtctaacgagctcacctatagcttgtaataactgctccttccaatttcatctgaaagacatgtcatatataattgaaagcaattctaacaggggagaacaaaacaaagactggaaaatctaatccatccaaatggcatggcacaaagtgagcccaggcacatttaagatgaagttggcttagttatttcaccataatcttcattacatgcttctctacatttactgaaagcatcaaaagatatcggattcataattttctgactctagctttacagtttctccaccctgttagttctcatctccctcatcaccactcccttcatctgccaccttcattcccttcatcgtggatcaccttcattatggtggaaagaggcttctctaagatgcccagttctgaaattttctgcctgaccataaacacctatctattctttttccttgttctactgcctccctcttggaaaaagttttcttcacccttatttggaagcttccctccacctgaacctatgtttttctcatgctttgggtcttcctactcattatctatctccagaattagcaaaagcaatggtgttctcattagcattcttgatttccttccttgcttgcacatcacttgtgcttagactttcaacatctgtgcctgacgatgcccagattcaatttctccacttctaatcctgggtggttgctcattgctggagaaagtaactaaacccgacagcaaatgtgtacttgctacactcagctgggtgttgtctcctgctcaaccatgcttcattcttctgcatttgacaaagtggcactctggccagaggacctgttccacacctttccaggatccttaaaccaagtactgatacctgagaaagtcaaatctatcaaatagaaacttgattttccctcaagaacctcgacaaatctctgtacaggcaattattcttttgtcttcttgcaaccctgcccaaatctgagaggaacaggtaagcttctcctctacaaagtaatccatccaccaagctttggcctatcattctgcctgatccaggacactgagctctcactgtcttcattcttgaccattcactggacagttccttttgcccacaaatgtggcaaagcctcatagaccacagacaaggccagccccaaattctttgtgttctttctgataatatacaaggccatttccaaaaggatttgaaatatggaaattcagttctatgtaattttttaaacatttaacttatttttttctacagtatgtcacacaggctgttcctgttgcttgtccaatcacagttaatcaactaagtgggcatctgaaggctctccatagacctccctctggtctcttcagcttccgtggatgtcttctacacttttgtcactctatataaaattttagtaaattctaatacaaagttctctcttttgagccttgtctccatctactctcctagccttggaaatgctaattatctgagtaaagagcctaaatgtgcattttgaagcataattccaatcattccttttgtataaatcctttttgaaaagagaggagatcccaatcctactcatagtgtatttttaatatatatacctctacgtattacacacatatgacacctgattctctcaataacccttcgaagctgaaattgcttgattatcctcactttacagaggaagaaattaaggctcagagcaattgtgacctgattataggtccaatgatggtaagaagtaaaggcacaacctgagcacaggtcttctgactccaaagccccccatcttgatgctaccaaacagattctacaacaatgtatcaagtagtggcattatgatatatcaagtactggcattatattattaaaagactacctgataacaagatccaggtctcagcagaaaaccatcatttgtttcttaaaatctcacctaaggcactgccctcactgagaattagcagatatgaacaagaacaacaatacaaaatagtttatcaagtgaaccttatatttcattttttattaggcctttagaaccaaaagcttaaagtgatttttcagctaacgatatactttatttattatgatactattatagctattgcttttcactttcattgtttagcacgtgtgaatgtgttaccaagcttaaaatattaaagatctgggggaggagccaagatggccgaacaggaacagctccggtctacagctcccagcgtgagcgacgcagaagacaggtgatttctgcatttccatctgaggtaccaggttcatctcactagggagtgccagacagtgggcgcaggtcagtgggtgcagcgcactgtgcgtgagccgaagcagggcgaggcattgcctcactcgggaagcgcaagggatcagggagttccctttcctagtcaaagaaaggggtgacagacggcacctggaaaatcggatcactcccacccgaatactgcacttttttaacgggcttaaaaaatggcgcaccaggagattatatgctgcacctggctccgagggtcctatgcccacggagtctcactgattgctagcacagcagtctgagatcaaactgcaaggcggcagcgaggctgggggaagggcgcccgccattgcccaggcttgcttaggtaaacaaagcagccgggaagctcgaactgggtggagcccaccacagctcaaggaggcctgcctgcctctgtaggctccacctctgggggcagggcacagacaaaaagacagcagtaacctctgcagacttaaatgtccctgtctgacagctttgaagagagcagtggttctcccagcacgcagctggagatctgagaatgggcagaatgcctcctcaagtgggtccctgacccctgacccctgagcagcctaactgggaggcaccccccagtaggggcagactgacatctcacacggccgggtactcctctgagacaaaacttccagaggaacgatcagacagcggcattcgcggttcacaaaaaaccactgttctgcagacaccgctgctgacacccaggcaaacagggtctggagtggacctctagcaaactccaacagacctgcagctgagggtcctgtctgttagaaggaaaactaacaaacagaaaggacatccacaccaaaaacccatctgtacatcaccatcatcaaagaccaaaagtacataaaaccacaaagatggggaaaaaacagagcagaaaaactggaaactctaaaaagcagagcatctctcctcctccaaaggatcgcagttcctcaccagcaatggaacaaagctggatggagaatgactttgacgagttgagagaagaaggcttcagatgatcaaactacgagctacaggaggaaattcaaaccaaaggcaaagaagttaaaaacattgaaaaaaatttagacgaatgtataactagaataaccaatacagagaagtgcttaaaggagctgatggagctgaaagccaaggcatgagaactacgtgaagaatgcagaagcctcaggagctgatgcaatcaactggaagaaagggtatcagcgatggaagatgaaatgaatgaaatgaagcaagaagggaagtttagagaaaaaagaataaaaagaaacgaacaaagcctccaagaaatatgggactatgtgaaaagactaaatctacgtctgattggtgtacctgaaagtgacggggagaacggaaccaagttggaaaacattctgcaggatattatccaggagaacttctccaatctagcaaggcaggccaacgttcagattcaggaaatacagagaacaccacaaagatactcctcgagaagagcaactccaagacatataattgtcagattcaccaaagttgaaatgaaggaaaaaatgttaagggcagccagagagaaagatcgggttacacacaaagggaagcccatcagactaacagcggatctcttggcagaaactctacaagccagaagagagtgagggccaatattcaacatacttaaagaaaagatttttcaacccagaatttcatatccagccaaactaagcttcataagtgaaggagaaataaaatactttacagacaagcaaatgctgagagattttgtcaccaccaggcctgcctaaaagagctcctgaaggaaacactaaacatggaaaggcacaaccggtaccagccactgcaaaatcatgccaaaatgtaaagaccatcgagactaggaagaaactgcatcaactaacgagcaagataaccagctaacatcataatgacaggttcaaattcacacataacaatattaactttaaatgtaaatggactaaatgctccaattaaaagacacagactggcaaattggataaagagtcaagacccatcagtgtgctgtattcaggaaacccatttcacatgcagagacacacataggctcaaaataaaaggatggaggaagatctaccaagcaaatggaaaacaaaaaaaggcaggggttgcaatcctagtctctgataaaacagactttaagccaacaaagatcaaaagagacaaagaaggccattacataatggtaaggggatcaattcaacaagaagagctaactatcctaaatatatatgcatccaatacaggaggacccagattcataaagcaagtcctgagtgacctacaaagagacttacactcccacacattaataatgggagactttaacaccccactgtcaacattagacagatcaacgagacagaaagtcaacaaggatacccaggaattgaactcagctctgcaccaagtggacctaatagacatctacagaactctccaccccaaatcaacagaatatacatttttttcagcactacaccacacctattccaaaattgaccacatagttggaagtaaagcactcctcagcacatgtaaaagaacagaaattataacaaactatctctcagaccacagtgcaatcaaactagaactcaggattaagaaactcactcaaaactgctcaactacatggaaactgaacaacctgctcctgaatgactactgggtacataacgaaatgaaggcagaaataaagatgttctttgaaaccaacgagaacaaagacacaacatacaagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaataaagaaaaaaagagagaagaatcaaatagacacaataaaaaatgataaaggggatatcaccactgatcccacagaaatacaaactaccgtcagagaatactacaaacacctgtacacaaataaactagaaaatctagaagaaatggatgaattcctcgacacatacactctcccaagactaaaccaggaagaagttgaatctccgaatagaccaataacaggatctgaaattgtggcaataatcaatagcttaccaaccaaaaagagtccaggaccagatggattcacagccaaattctaccagaggtacaaggaggaactggtaccattccttctgaaactattccaatcaatagaaaaagagggaatcctccctaactcactttatgaggccagcatcatcctgataccaaagccaggcagagacacaaccaaaaaagagaattttagaccaatatccttgatgaacattgatgcaaaaatcctcaataaaatactggcaaactgaatccagcagcacatcaaaaagcttatccaccatgatcaagtgggcttcatccctgggatgcaaggctggttcaatatacgcaaatcaataaatgtaatccagcatataaacagaccaaagacaaaaaccacatgactatcttaatagatgcagaaaaggcctttgacaaaattcaacaacgcttcatgctaaaaactctcaataagttaggtattgatgggacgtatctcaaaataataggagctatctatgacaaacccacagccaatatcatactgaatgggcaaaaactggaagcattccctttgaaaactggcataagacagggatgccctctctcaccactcctattcaacatagtgttggaagttatggccagggcaattagacaggagaaggaaataaagggtattcaataggaaaagaggaagtcaaattgtccctgtttgcagatgatatgattgtatatctagaaaaccccattgtctctgcccaaactctccttaagctgataagcaacttcagcaaagtctcaggatacaaaatcaatgtacaaaatcacaagcattcttatacaccaataacagacaaacagagagccaaatcatgagtgaactcccattcacaattgcttcaaagagaataaaatacctgggaatctaccttacaagggacgtgaaggacctcttcaaggagaactacaacccactgctcaaggaaattaaagaggatacaaacaaatggaagaacattccatgctcatgggtaagaagaatcaatatggtgaaaatggccatactgcccaaggtaatttacagattcaatgccatccccatcaagctaccaatgcctttcttcacagaattggaaaaaaatactttaaagttcacatggaaccaaaaaagagcctgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccacatatctacaactatccgatctttgacaaacctgagaaaaacaagcaatggggaaaggattccctatttaataaatggtgctgggaaaactggctagccatatgtagaaagctgaaactggatgccttccttacaccttatacaaaaatcaattcaagatggattaaagacttaaacgttggacctaaaaccataaaaaccctagaagaaaacctaggcattaccattcaggacataggcatgggcaaggacttcatgtctaaaacaccaaaagcaatggcaaccaaagccaaaattgacaaatgggatctaatgaaactaaagagcttctgcacagcaaaagaaactaccatcagagtgaacaggcaacccacaaaatgggagaaaattttcacaacctactcatctgacaaagggctaatatccagaatctacaataaactcaaacaaatttacaagaaaaaaacaaacaaccccatcaaaaagtgggcgaaggacatgaacaaacacttctcaaaagaagacatttatacaaccaaaaaacacatgaaaaaatgctcaccatcactggccatcagagaaatgcaaatcaaaaccacaatgagatatcatctcacaccagttagaatggcaatcattaaaaagtcaggaaacaacaggtgcttgagaggatgtggagaaataggaacactttacactgttggtgggactgtaaactagttcaaccattgtggaagtcagtgtggcgattcctcagggatctagaactagaaataccatttgacccagccatcccattactgggtatgtacccaaaggactataaatcatgctgctataaagacacatgcacacatatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaagaacaaaaaaccaaacaccgcatattctcattcgtaggtgggaattgaacaatgagaacacatggacacaggaaggggaacatcacactctgaggactgttgtggggtggggggagcgggaagggatagcattgggagatatacctaatgctagatgacaagttagtgggtgcagcacaccagcatgtcacatgtatacatgtcactaacctgcacattgtgcacgtgtaccctaaaacttaaagtataataataaaaataaacaaataaataaataaaaataaaatattaaagatttgtttctgatacaagtaagaagcaaactgaaaaataaggccctaaaaccctgagaaaacatatttgatgaacaagtttaggaagcgaagcatctgcggtgatttagctaataagtctcatttcattccatgtatgcttcgcctgctcaaagccttctgttgtataacactttagtgacctttcatgcaacaacaggctaaagtacgtcttcctataaaggattgcattttccttatcaggaaaaaaaaaaaaaaaaagctcagagtccctccagggattttagcccagactgaacacctcaagttcacacagtcagcttgaattcctgccaccaactagagcttagtggaagaaaagtgattcttttcaatttggcttatggttgggtatgttttacgttccttttgtattactggagctaagtacccttggaattcatacctatggaaataatggaaagacgctctattttcataggccctgttaatttcctttaatatttagaaaattcattgaaagacatcaaatactttagtgtctttcagtgagttattctaaatattcaggcttagcttcctatgaactgcctgttaaattttcccttcatggttttttacagctctgtctccaaaagggagtatgttgactagtggctttgtcattaataaccaagggacaattttatattacaatacctcattgccaacatgtatttaataaaacagttttaagtttgctgaactcagtgttcatgattaaaaggtttaaataaaagagaggctcacaacaggaaatatattgtcacaaagaatatttattcaaaaacttttttatcttacttggtaatttctaaattccactatcattaatgttactaaatcatagttattaaattgatatggcacttgactaacttaaaataattgcacctacaattattacagtacatccactgaccctacccataggtcaatagatgtaaacatacccacactgcagataagaaaatgaaggcaaaaagaaaatgcacttgcaaagaaaatgatagcattccaagttgtcttttggaggtgatggatatgttattaccttgattgtggtaaaggtttcacaggtatgcacatgtccaaacttatcaaattgcacacattaaatatgtgcagtgttttgcatatcaattatacctcagtatagctcttaaaaaaaaaatcctgagttgtcttcagagaaccaaaggcaaatccctccgacaaggcagagattaagaaagtacaattttttttcaccttctgtccagttgtgtgcctctgtttagggtcctataaactggccagaaggaaaacaaagttattcctacaattatcaagattggtaacactcgatagcattcatcaatgaatgaccgtctcactggagtccttttgatgcaaatgcatgtcctaacctctttctttccactcctcttggccaaaggggatgcagtggtgttttcttcctactggtatccaaaaagtttcttttgtgtatctcacagcacccagacaacaactctgtagattgtctataaaaagtcttctctttattatcattcaaggccttggcagtcagccaaatttcacttggaagttttactagcatcttctgtgctccaatcaattgccttattttcctttacagcctaaagggtctaagagtttatttggtaaatacctattgagtgtcttccgtgagccagacactgttctgggttctgaggctaatgtagtaaacagtagaaaacagtaaatctcatgtagcttgtattatagtagtggaggaaatcaacaaataaacaagcagatttatacatcaggtagaaataggttgcaatgaagcaaaataaagctgagtgaggagaaagaaattcatctctaacatcccagcaagtccccaatttcccttgcactaattagagttacatttcccttttcccaagcgtctcttcacttagatgtactacttataacttaaatactacatttccaaaagaaagccaaacaccaactcccttttgaccttttttttttctttaaaagcagcaatatgcccctggcaaacaaatttctgagaatcaactttgaaccttttcttttcctccctttcccccatgttcaaaaacttgccatgaactatgttttctacctctttgtccattcatctcaaattcattgacatctttccttcctcattctcctaattctaattcaggcttttagtaattcctgtctgtctttcacattttctgttaagcattgaaattacacagacaatatgccaagtcgcatgaaagaaaacatctctcataactttaaaaaaacatcgttgttatcagtcatacaagatggggatgagaatataaataattttcagaagaaaggactgcttaaatacttatttggtgtcctgcataaattatcagacatgaagcacatgaactaaatcttgaaggatgctaccctcttaaagatacattacaaaaaagccccgaaataccacattggcaactatcactggcaaattcagcaaaggtagtttctgataagttattgtttacatccaaatatttctacagtattagatcaaagaagaatctaatactgtagatccttacagtattagatgggaagaacataaagagcaaattttctagaaagaacagagtaaaagatgctggagaacaaataacagaaggaggaatctacaaccaataaggaactcaaagcaagaacttaagacttttgttaaattaataatttagaaagtacataaaaatgtgatttgatgcttttgatcactgttgataacgttccaaaaatgtactagaatggcatcagtcaaatgcagaaatatctttttcaatatacatacaaaggaaatagaatacctggtttctactctcatcctcagatgttgtgtgactcaagataaaactctataaatctgtactgatttgtaaaattaagataattattcctaccaatctcaaagtaattttgtgaagataaatgatatcacttgaaagggcttcaggaactattaagtattttgtaatttggggaatttagtttatttttaaggatataaggagattcttgatagatagaagttactcttttctaaataatgcagagataaactacgacccaaacatctagctgccatcaaaattacctggacaaagatctgtcaaatgttttatgacccttattgctcagagaagttttagaatatgcagtagtctctttagagcctgaataaatgtcattatataaaagaaactgaaaacagaaaaagatggtattatgggtatcttaaaaatgtaagctaaccccagtaattcaatttttgagaaggaaaaaatacctctacctctctatctacatggcaccccaaaaagttccatatgtggttgaagaacccttccataaaaggtgagaagaatcaagtctctctgtgctgacccccataatcttaactgtaatggttggttggatccagttgatgcctattcttctccctgaggtctttaggaagacatccaaacaatttctgagaagaagtgcacatggaaattgactgtacactgtctccttggctgtgaactcaagcatgtaggtaaaataaactacagaaaatatgccctctacttctgatttaaatttgaatgccccctcatgagtgaaatggtaaaaatccagcctggttacattcagagctgcttcttttctcatcttggttctgggtcaccctctgttggaacttcttccatacccaggccatcagcatggtccgaataatcagaatgatcacagtccttccatcagagctttagtgccgtcctccctaatctgagggttgtaagccatctctctctacctacacagcatacagatcatggttaataagagcaagccccaggccactcaagctccattcgcatcacaggctcaggacaccctcatttccctcctggccttttcttgtgtctttggaaggtctacatggcttctgactcaagctttgctgtccatttttggtcctaattctatccattggacttgaagattcatcttgttttcttcacattatcccttggttcacccgaagatctttggttcataattatcatctattttttttctgccatccctcctaaatccctgtaatcaagttaattaaatatttcaaaacaaactcaataataataacaacagcagcagcagcaataaaaatactaataaacctgagtttgacttggatctcaatttcagtggagaccttactgtttttgtctgccctgatcttgatctattgtaacccactctccaccaccatggtagagaccatcctactaagagggaagctcagagcagtgaagctctaactcggtaaatacctcttagaaaactagtccttaatttagtctcattgtcaacaagagcccatccagataaacaggaatttagacactatctgcaaaaaatccccagtcttaaactatatatatacatatatatatatatatgtatatatgtatatatatatgtgtatatatatgtatatatgtatatatttgagacggagtttccctcctgtcacccagctggagtgcaatggcatgatctctgctcattgaaacttctgcctctggtgttcaagcaatactcctgagcctcccgagtagctgggattacagacacgcaccaccatgcccagttaatttttgtatttttagtagagacggggtttcaccatgttggccaggctggtcttcaactgctgaccttaggtgacccatctgcctcagcctcccacagtgctgggattacaggcgtgagccacggcacccagccaataatttttttaagtgcaaactttaaatagagtcactgtgtaattattacacagttcttctggtactgtttatattagctaaggtacaatgtagaagacaaaagaggcaatgtagaagacaaaagaggatcacactcttttgatccatctcctgtaaaatacttgctatagttctatagttgtcccaaattaagaattttctgtcttctctttctgctatgctgcatggcttagaattataaagaaattttgaattttttgaggggctcttaattttcttcttttacaccatatgtctcatccaggactctacactctccttattttatcctcataccaattatatgcgataaatatgataactcctattttaagagatgttaagttgtttatccaaggtcacatagctggcaaagggaaaagcagaattaaaccctggtccttctaatatcagggtctctgtttttgtcattatgccattccactttggaagagaagagacattctgccttggtaaaagggtttcccatgcaaaaaagaaatgcagtatcaagccatgaaaagtcctggtggaatcttacatgcatattactaggtgaaagaagccagccagaaagggctacatgctatatgagtccagtgacatgacattctgtagaaggcaaaattataaagacagtaaaaagatcagtgattgccgggggttgggggaggaaaggatgattaggaggagcacaggggaattttagggcagcgaaactgttacggtactctaatggtagatacatgtcacgcatttatcaaaacccatagaatgtacaacaccaagaataaacattaatgtaaactatggactttggatgatgatgatgtgtcaatgtaggttcactgattgtaataaatgtaccattctagtgtaggctattcatagtggaggatgttgtgtttgtgtgggggcaggaaatatacaggaattatctgtactttctgctccatttttctgtgaacctaaaactgctctaaaaaaataaagtttttttctaagagaaaacaaaggatttccccactacacagacatcacggactttatgttactttgcaccctgctccagtttctatctgtagcaccccaaatattaataagagaataactagaaaaaagtaagccaatagaaggagatgctaggaaagaagtaatgggtgtcctagggcattttgattgtctctatttgactttctttctccttcctcttatcttgttggccttgtgttcttttgtttcttttatccccactctaaaacctctttattcacaaatgaaaaagaaaaaacaaaaactaaactttttcacagtacttttagaattgactgttccagttaccattgctgccaaaacttagtggtataaagcaaccatttattacgctcataggctctgtgggttaataactcagacaggcacagaggggatggcttgtctctgttctctgatgtcagaaacctgagctgaaaagattccaagactgagctgactcaacagtgagggtctagaatcatttaagggacacttgtttgacccacagcccacaggctacatgcagcccaggacagctttgaatacatcctaaaacaaatttgtaaattttcttaaaacattatgagattttttggcatttttttttttggctcaccagctatcgttagtatcagtgtattttatgtgtgacccaagacaattcttcttcttctaatgtggcccagggaagccaaaagactggacaccccgattgaaaggtattttatttcccacacctggatttggatgctggctatcagctgatacattagttatactgttactgaaacacttatccattggtccttcattgatctctccatgcgggctagcttgggcttccttgtggcatcatggctgtgttccaagagagaacatcccaaaagagcaagataaaagtgcatgacacttttatggtctgaccttagaagccccatagtgtcatttatagcatagtcaaagctgccagaaatgtctgcccatgttcaagaggaagagacatactcaaaccattgtatgggaggaaggtcaaagtcacattgtaaaaacatataaaataggagatactcttaccgccattttggaaaatataatctgccacagtaactcttattatatcttattgtatcttacattgctaagtatgtattgaatttgaatatttggttagactgttccacatgtttacctctgattgtttaagatggtaaaccacatttggcagggacagcaatgttgagttaatttacatgacctccaccatagtaccttgcgcttggtaaccataacatgtaatattattactagtgctgcaattgctcatagatacatgcacttgagtggtcattatttatatttatatgctgtaacattttgtagcatgtcacagaaaatctacactaaccaaaaaggcatatagcatctctattgtgtagatgaattctattactccaattaggtcttggttgtttgaaaatagtacatcattttttctaccaagtgaataaattcttgtaaggcaataattgaatcttacaatgagcagtgggggaggggggcagcggaatcactaccttgaaggaactatcatttcttccatttcttttttcttcacaattagttacttttagaagtttaatagattattactaataaaaggtttattagtaatctgtgtgggtgcttgatcatggatgtatatctcttctgaaaagctaattaatgaattgtcccttttcagttgatttcataggtggctttgactcttatggctatcaagggcctcagaagacatctcatttacaactacagcctatgtacatgtaagtattttacttggaaggtactcttctggggtactaaagataatcaagtaactgtatcacgatacaaaattgatggcatgcagcttttgttcagttatatttttccagtattttttctattaatattgtcttggctgggataattttaataacatttttccatgaatttttcttatttgacttataagaaatgccatttctaaagttatatttagtcttacataagtatcacctacatggctcaaaagcctatgttaattatctaccacttctttgagttgccaaaaagttgtattttttgaaaatgatataatgtaggcagttatatataattatatataaaccatatgttctggtttcagtttacagtggttgtcctggcataattattactctcaaaagagttctcatttagatgataaataataggttcaccctagttatatgtagtgttaagaaaataaaaaactgagtaatacactttctctatcatttttctgatgtaaaagtgaaaatgaactggaacattaacactgaaatttatcgaacccttaactctagcactcaggagagcagacatacaatcagagcctgatttttatatctgtgtttaggcaaattcccttggataacaactgataacaaattctatatatcagcatcaagtgatatgctgaattgcaagcgaagatcaaaatagaaagtaagattccaattcattttaaaatgtgaacttctctttgaagatatgtgtttgttgtcgttgtcctccaccattgaatcattttaccttttaatatctttagtgtgtaggataataaatggagtttgggagtaagtattgctcctccaaagaaattaatctttaaacatcccctttttaagcttctctttaaaaaaagaataatcttgcaccgtgcctgcctttttctttgtgtcacttgtagttctctgaaatcatttgctaatagcacccataaaacagactttagcagttcagaaatcaaccagtatgttgcttcattcaaagcattgcttctgtaaacactgtattacacatttcctcttttacatcctcacaacgactgcactaattcatgcaagtatgacctgttaagtttttcggtctcttccttatttcagaacctccattgtatcctccatatggctgccaaattaatcttcctaaagtactgcgctgatgatttcacttccctacttcaaagctatcaaggagtccctattacctactgttgaaacagtatctcttctcttcaactcttaataatgtttgagtcccaaccatatgcagatgacactggagatattaggaaaatgtagtaatgaataagaactagccctgtcctcctgaagtttataatctattgagagcataaacagtctgatagctccccttagccatttttttcttgccttatccaaatatgatatgtatttttccaattcatgctgttctcttgacaacaaacatcatcttttttccaaattccactctttgaaaccccactatcctttgaattttcttaagatatattcctttatgaaacatttgttaatcttttctcctctaatatttcttttatttctttccccatgtactacagttgtttgctatgcatgccataccttccttccctatccccccagaaagattcttgatagctacaacaacaaaacatgatcaatccttcacactctttaccattcttctcaatattttatgtaacattctataaagtgttctatttaaaaaggcaatcaggactagtggttaagacgacctactgaaggcatactgtctgagattaaattccctccgaccgtgggcatgtaactttgtttgaataactctatttaattttaccaagcctaagtttcctcacctgcaaaatagagatcgcatacagactttatctgattgctctgaaattatatgaaagaatatatataaagcacatgaaacgtaggatatgtcacatagtaagtgcttaataaacataattcattagtggtagaataatgcttgtgttaatcaacatcactcatgaaaaggctgtatcaagtcagaagtaacatacactgcaagtcattcctaaaagatctcctctgtaaatggtatattatatataacagcggtcccctgggccgtgaatagtcctggcccatggtctgttaggagctgagcacagagcaggaggtgagcagcaggtgagggaacattactgcctaagctctgcctcctgtctgataagcagcagtattagattctcatagcagtgtgaaccttattgtgaactgcatgtgtgagggatctaggttttgtgatccttatgagaatctaatgcctgatgatctgaggtggaacagtttcatcctgaaaccattccccccaaccctggtctatgggaaaattgtcttccacaaaaccagtctctggtaccaaaaaggttgaggactgctgacatataacatcagctcaagtaacatgtaatactatatttatgctcaagagtagaatatggctaggcacagtgattcatgcctgtaatcctagcactttgggaggccgagacaggtggatcacctgaggtcaggagttcgagagcagcctggccaacatggcgaaactccatctctactaaaaatacaaaaattagccaggcatggtggtgcacgcctgtaatcccagttactcgggaggctgaggcaggagaatctctggaacctgggaggtggaggttgcagtgagcaaagatcgtgccactgcactccagcctggttaacaaagtgaggctctgtctcaaaaaaaaaaaaaaaggagaataaaatatctacaaggtttgtaattgcttgctactaataatattacataatattttactgtattggccaatatgagtgaccaataaatatgatcaagctgtaataaattagaggtaatctctcatctaaagataaacatgagaatgctaattatatacaatttaatatattaaattcaaatcaagcatttataattctaatgggctttaaagaagagactctacaaagatagatatctttgtccagaattaaattgcataaggacaaaacttatgattttgttaaacagagcactttaaatgccaactaaaagttataaaaaatatattgttttcctctttactgcatgagagtggtaaaattgtatcagagatttcaagtctcactggtcatgaaataagtaaatgtttaatggaattcaaatttaggaagttatgtatacttaaggtacatttaaaaattactagtcaaaatactccaatcattccttccacaaaacatcccataggagacctcggatcctagaacagtaaggttttattttacagacgaggaaactcaacccaataaaaggaaaacaaaagtcacacaacttgttactggtgcagccatgattatcaacgggttttcctgaccccttcagttagtgttctttccaaattcttagacagactgtgagtttgacctggtattacattctgatttttaatttgcttgtttgtattcttaacactaacttagctgccacatttccatacatggctgtgcctctctcccttttctgcattctgtttatttcttttttattttacattacgcactgttaaatgaagggccttttcaacttcatagcccacaagaccaatcatctgagagccactgcttattcaaatctagtgaaaaaccaaaactgacacacctataaacctcatcccctactgagaggcagagaacttagcatctcctatgtctttatcatttagagtgtaccttctgtcaacctgccataaatatgtcttgtaaagtaagagtaatttaacttcaggggccagtccaaacaccctaaaaatattatatagcaaatggaaacacaagctcttccttggaaggaaaacaaatgttgaaaagcaataggcatttttagctgtggggctcccactgttcccagcaaatcttctgtggccaagatcctggacaaagctttgaaaacactgctgtaactgacctacagtcacagctgtgtttcagttcctgcaaacaatgaatagacagtcctcttaagttgggtgactgttcttggtttgtaatttttcagatgatgtataactaacctaaaaaggaaagattttaattatatttttcttaaagtttggtacatgttgttgaaacaaatcaataacaacaaagttgctgcacaaaaaaaatcccatgtctgcgtgctccagccccggcaacagagctagactttgtctaaaaaaaaaaaatcccgtgtctacagcttaagtttttaacaaaatagctgctttgactaccagagacctatgtgactgtcagagcaagtagagatctgattgggcttccagcaatataagaatatcctataatatatcacacaacatttgtaaacattgcattctttttggcagcctaattgtacagaagtacatattcatttcagttgtccctggaaatagattctaaatgaccaaaactggcctctctatccctgcaattgccatgaataaaaagaaaaggaggaaaattatctatttaaaacccaatttgggcttcttttttgtttgtttgtttgtttgctcttgtgcttggaaaggtgagaaaaggtggtgagcagcaggcacctgtcactttcccccttgactaaaaacatcttttctctctctcaggtcaaaataatacagatgacttcagtatgtcagcccatggacctttcaaagaacttttttcgcagtggcctcctgcatttcatgaagagcaagaagcaactgagtttaaatacatacacgtattaacaaaacaaatgcaaagcctctacatacaacactgacacacacacacacacacacgtgagcacgcacacaccaattccacttgacctcctctttctaactgaaacagacaaatatgcaggacacgcccatcttggatttcctgaaagcaggcccctttctcccaggccttcggaaagttcagaaggagatgtgttgatgcccaacggttgccggccattgctaactcctctgcagcccagcgggttggcctctgtgagctgggaagtcatccaaggcacattagtttgagagctctgtcttctgcactccatacatcttgacagcaccacggctacttaggcaatgtaattgcaaaaacaaacgaaacatgccatgatgaccttgtacccgaagtccgaaatggcagattgtttgccctaaaggctgtaccgtacatacttgccttaacccacctacattgtgtgcccaagaatcccagtgcagacagccccaagccacttcctttaggctaacacactgctattaattctaaatgagttcaagcctgtgtgtttcatgtcaaggaacaagactgaatagctcagcagctccagtgtgtctgtataagaaaagtgccagctgtcagcaaagtgctttaccatagagcctccatggtggcccaaaagagacaagtaacaataacaatatctgtcatctttataattctaaaatatggtcttctgatggggttgggggtgggacagagtaaaacattaatctactaaactcactaatctactggaagcagaaagcagaaatggcttaactcgctgattttatttattgcactctaggtgcttttataagtatctacaattgtcttttactaacacagaaacagctgtggatttctatcaacagaggccaactgaatatgtattagctatgtttactcttttatatctaattcaaattgaagactctacgtaggtgaacttttttttctaacttcagtgtacaagattatttttgggtgggtggggggagcaatagttaccttggtgaaatatttgagatctttttgtggtatttgggggatctgttgtgtgttagagtgtatttcaaccctcctgtattattgtggcagaaaaactgtgctgttaacgtagttggcaacaagatgcctttggaaacttaatagtaggtcaatgtgtttatggaatattctgaactcctaggaaattttgttctatattttaaagcattatttggttttcattagtggaaaacataattagctcaggcttatcaggaactcagatgagtcatattttttcttggatacacctgagacattaaactcaattttttaaaactaacacaccattctttagtgcagtgaaattcaaaagttataaattggcatggagcaagttttttctttgatttctatgaagtttcagttattggattaaactactttagaccttagcccattcggatctacatacaccagttccattactgtgtttgcatggatgtctgtaatatacacacacatatacatttgaaaatgatagaggaacaaagagttatcattggaacataaactataaaaaaagattccagcactcatgcttgaatttcctcagtgggttgtatgtttgtccatacatacatgtataaaataaacaattgcaaacatgtcagtgaaacctcatatgacgcttttatagtgacatgcatgtttaatgtatgagaaaaatatttaccaatgtattgtcctttgagtcctaaaatataaatactatacatgccagaaactattctaatgtgacttttaatgtgactattaaaaatgaggtttcactgtacattcatgctgtgatgcgatttcaccttatagtacatgtatatgggtacagaaaataaaccctcatattcctgctttaagttacagccaagttttcaccaaatcacaactatcatcaccaccaaaattttaaaaaacagtagttgactactaaaaagtaatcagtggacaggtcatttatgggatcagtaagcacagtagtgtgattatatctgggaaaacatctacagttgtacagctgtatcctcctcaaaatccggtgaagaatgctatttttctaggctgagcttttgttataaacttaatattcagaaggcaagggttatgatcctgatgtgtcctttttttttgcatttgttaattctgaatgtatttttaacagaatgatttttttgacttactagtgtaatttgcattttaaaaataaatggaaaaatacttaa

SEQ ID NO: 118 - DNA, 8649 bp, Homo sapiens
tagtcggagcgaggtggcgagtcgctgagcccgccgcggccccgagagcggctgcagccgccgccgccgggaaggagagggcgaggcgcgcccgagccgccgccgccgccgccaccgccgccgccgccaccaccgccaccggagtcgcgggccagccgggcagcctccgcgggccccggccggggcggggggcgcgggccacaggcccctgctccggccgccgcttgcagaccgcgggcgccgatgtcgcccgcgccccgctaggctgagcctcgggtcgggcgaggagccgccgcagccgccgccgcccgagccgcgggcaggagcctcgggagccgccgccgccgccgccgccgcccggccgggccccgccgccgcccgcgcgcccccgggcccccgacacacatgagattcttcaggctcactttcaagtgcttcgtggactgcttctgactgcgccgcccgcgccccgcaccccgccgcccgcccgccgccccgtcccccggcccggccgccccccggcccccggccggcccgcgccctcggggccctccccggtgccgccggtgccccccgcctgaccgccgccccccgtgaggcgccgcgaccccggcccggccgtgcggcccgccgaggccatggcgaagaagagcgccgagaacggcatctatagcgtgtccggcgacgagaagaagggccccctcatcgcgcccgggcccgacggggccccggccaagggcgacggccccgtgggcctggggacacccggcggccgcctggccgtgccgccgcgcgagacctggacgcgccagatggacttcatcatgtcgtgcgtgggcttcgccgtgggcttgggcaacgtgtggcgcttcccctacctgtgctacaagaacggcggaggtgagttcccccgcccgccgcggcctcctcccccagcaggccgccggcccccgcccgacccccggagccgccgcggaggggtgaagtccgggcaacgggtggcccccgggcacgcgggggtcggggccgcccctcgtccgccgctgccgctcggtggccgggccgggcgcctccacccccctcgcagtcatgtgcctggcatggtggggggagggggccggcgatgcccgcgaggctgccccccagactcccgggctgggaggagcgattggccgccgaggtgggaaagcaggcctgcgccttggggtctccgcgaggtaaggagccctggctgcccccacgggtcgggcacacaagcggcacattgtgtgggccccccacgtgtgcacacacacgaacacacacacacacaatgggccactctgtccctccccctgccctcccctcccctcgcggccctcccgcccctcccctctggcccgggcctggaacactgggtgcccgagccaggcttgggaagcctgcggcctggcccgcctggcgccgccactggacacactgcatgcacgtcccatgcccgcccgcccgcccgcccgcccgggcccagcttagcaacagcgatgggcacgcgtgtgtcctgtgactacaaaacagcactggggttgctggaagccgaagtgacccggtgatgggtgggaaacagaggtccagagcaaaggcctttgcccaaggtcaggagaaggatgctgggacctggagtcaggcaagttgcagccaagctcagcctctgagtagtggagcgagcccagccagggcaagggtaggaggcccagagaggagaagggggtagtggcacccagctctccctgcccttctgccacccccaccccagcctgctggcctcaggagataggcctgtgtcacgccctgcctatctcctgcagagcctgactccctggccttgctaaggccggcctggcccctcttccgcacctgtatccctctgtccttgcacatcgccatcccaccagcaggggactgtgacccacccaccctctgccttagacctcacacttgcaggcaagcgtccaagggcaggacagtcgcgctccctgcctttggatgagccccccaggcctgatcacccagccttggcacacatgcacacatgcacgtgccctcactgtgctgcctgaaacagggaattgcagcactagggacagcccgcgtgtctgagcgtgtgtgtcctccatggccatcgccccaagtgaccgtgggggtggaagccctgggggcctagggcccctctgccacccagggaatagggctccaatggctcaggggctactgtagcccctcttcaacacactcaacccaccccctcaagactccacctggggcctgagtcagtggccacccctacactgactcacccagtcggaagttgtgatggggcctttggagtctgggctggcccgctgggcctgggcagcctggctgggggccaccctgagtccacgctgtgcctccacccccaggtgtgttccttattccctacgtcctgatcgccctggttggaggaatccccattttcttcttagagatctcgctgggccagttcatgaaggccggcagcatcaatgtctggaacatctgtcccctgttcaaaggtgagcagcccttggccagcctcagggactgcccccttctcccagctggctcccacttgagaaatcttttcctgtcgtgagcaccaggcctggggccacgtgatggcgtcccagtctcgaggggggagcctggaggagatgttcaggccgcacagcgaacttggggaagcggggactagagggggcataggcagctccacaaggcaaggacaggccaggcatagccgggctggggacgggacctgcccagcagcacccttggctctctaggtaggtcctactgttactatccccaaggacgctggggcacagacaggtggagcgacgtactgaggttgcccactgcaggggcgactgtctccaacactacctcaggcgactagaaaccccccccccccaccaccaccatcaacaccagctgctgaggactggaggctactgggtggccaggcagaggcttggacctcctggaaccgccatggtggcagtgggacccacagaaggggccaggtgtatgaggctggagactccacagcacttggtcagatggggacaggaggagaggggctcgctctgccttgggtctagggggcggctggaggagaggagacaggctggggagtcagcgcagtgttggggctcacacaagggggagcccaggggagtcaggagcaccacaaacaaggctccaggaggacagatggtgggagcacggccagcctgggtggggacataaaggggtggcagggggaggtggccagggaagaatctacatggcaaggacttcccggccccaggcctgggctacgcctccatggtgatcgtcttctactgcaacacctactacatcatggtgctggcctggggcttctattacctggtcaagtcctttaccaccacgctgccctgggccacatgtggccacacctggaacactcccgactgcgtggagatcttccgccatgaagactgtgccaatgccagcctggccaacctcacctgtgaccagcttgctgaccgccggtcccctgtcatcgagttctgggagtgagtccggcacctctgggccaagcccatcccatcccccaggtctccctcatgttgcccggctccaggggagtggccctgagggggcaccagggtgttgcctggcagtccatcctggaccctgcctgcccttgcctgtcctcggagagtcctggggccagcctcgctcctgggttcggcagccgatcactgtcctggtcactcccccctgatgggggagctggggctgcatgtgaggtgggatgggagtggcctcccaatggccaggggatcgtgggctccaggcccagcccaattggacaagagggacccgctgaaccctgggctgtgggagagaagggagccacaactcctgggggtggaccctgtggctccatcctctgctggcacaggcctcatgggacctccctccctcccctaggaacaaagtcttgaggctgtctgggggactggaggtgccaggggccctcaactgggaggtgaccctttgtctgctggcctgctgggtgctggtctacttctgtgtctggaagggggtcaaatccacgggaaaggtaccactagaggcatgcagcggggagggtggctcagccctgggagccggatgtctgtgccaggcacacctgtggcaacgggaggtgaccagacagagtctagccctaaggaagggggaggtactgaaagccaagcaatgctccccaccctgcaaatccagggcccagcagcctttgctcctggggatagaggccctggcaggcactgtcccttccctgtgcccatcacccccactggtgccctcctgccagtctctgactcttgtgacagtctggtggacctggtctggccatctgttacctatcttgccttggggacccagagcagagtctggccacatcccttgggggctcctggtcaggctggggagtcacctgaacaaagaagacagtgtctagagctgtgggacatggccagctccctgggggacaaggtccccagagcagcatgtgggaagagggggcagacagtgtggcagctgcatctcgcctgcctctgcctggcccagttccactctccacctgctcaacccccacctctctccagaagaggagggggacccgacccggatccaatatcccgctccctgcctgggcctcccacacctgcactgcccacacactcatacagctctcactccccacgtgctccacgcctcctgtccccactgaggagagctcccagaggctcgcctgctccccaccgacacgcgtccctgcagacaaacgaggcgcccagggagcttccccactgcacttggccagggctgccggggcgcagccttgcccctagcttcctctggcgggagccatggctcggaggacaatggggacctctgaacatacctgcccgcaagggggaccggaggcgctgggagtgggggtgtgagggaggtggtgccacagcctccgctgagcagcctggccccccagatcgtgtacttcactgctacattcccctacgtggtcctggtcgtgctgctggtgcgtggagtgctgctgcctggcgccctggatggcatcatttactatctcaagcctgactggtcaaagctggggtcccctcaggtgaggtggaggtggagaggctgcagcagggcgctgcgggggagccctgcaggcccctcatgcctgcgctctccggcccttctctaggtgtggatagatgcggggacccagattttcttttcttacgccattggcctgggggccctcacagccctgggcagctacaaccgcttcaacaacaactgctacaagtaagcaccgccgccctgccacccgtgccctgtcctgccctgccccgccctgcccagcagcctaacccatccactctggcccctccacccctcagggacgccatcatcctggctctcatcaacagtgggaccagcttctttgctggcttcgtggtcttctccatcctgggcttcatggctgcagagcagggcgtgcacatctccaaggtggcagagtcaggtagggccctacccccagccccgcctccagagcagcgagtgctacccagatgcatgatgtacaggaacatgcaatagaaatgctgaaaagtgacgaggattcaaacggaacttgtcagattgtgggcctgtgggggcaggtcctgggatttgtcaatgttgacagagaaaggacctcccagcccctgccgcacgacccagggttgacagcgcctctgaggcaggcgtgggcatgggcgcgagtgttgcaggcagggctcagggtgcgcacagggcaggacatcggctacaaggtctagagcctgcacctttcccacagggccgggcctggccttcatcgcctacccgcgggctgtcacgctgatgccagtggccccactctgggctgccctgttcttcttcatgctgttgctgcttggtctcgacagccaggtttgcatggggctctgggacagggagccaggaggggggcggagggagggctgcaggcaaggaaaggggtggagggcggtgcggggctcggcctgagctgccctggccacagtttgtaggtgtggagggcttcatcaccggcctcctcgacctcctcccggcctcctactacttccgtttccaaagggagatctctgtggccctctgttgtgccctctgctttgtcatcgatctctccatggtgactgatgtgagtggggtggggggtctgcctgtgacctctggtggccgtctgccatcctccctgactgggctctgtcccccagggcgggatgtacgtcttccagctgtttgactactactcggccagcggcaccaccctgctctggcaggccttttgggagtgcgtggtggtggcctgggtgtacggtaggtcatggctgagggctgggctgggggatggtggcggggaaggcaggtctccagcttggccctcccgcctcacctcgccgcaggagctgaccgcttcatggacgacattgcctgtatgatcgggtaccgaccttgcccctggatgaaatggtgctggtccttcttcaccccgctggtctgcatggtaagggctgggggaggtggggcagggcggggggcgaggcagggcggggtaggggccccattaaccgcagcattctggtccgtagggcatcttcatcttcaacgttgtgtactacgagccgctggtctacaacaacacctacgtgtacccgtggtggggtgaggccatgggctgggccttcgccctgtcctccatgctgtgcgtgccgctgcacctcctgggctgcctcctcagggccaagggcaccatggctgaggtaaggctcccgcccggcccgccctcccctcccctgctgtgaacattcaacccagcctgcttcctagccagggagtggccccgactagggtggcaggcagtgggaaccggagagaggcagaggaagtcaccgtggggacgagcaggtgaccctgggggcttcagcatgtcctcctctcctgcagcgctggcagcacctgacccagcccatctggggcctccaccacttggagtaccgagctcaggacgcagatgtcaggggcctgaccaccctgaccccagtgtccgagagcagcaaggtcgtcgtggtggagagtgtcatgtgacaactcagctcacatcaccagctcacctctggtagccatagcagcccctgcttcagccccaccgcacccctccagggggcctgcctttccctgacacttttggggtctgcctgggggaggaggggagaaagcaccatgagtgctcactaaaacaactttttccatttttaataaaacgccaaaaatatcacaacccaccaaaaatagatgcctctccccctccagccctagccgagctggtcctaggccccgcctagtgccccacccccacccacagtgctgcactcctcctgcccctgccacgcccaccccctgcccacctctccaggctctgctctgcagcacacccgtgggtgacccctcaccccagaagcagcagtggcagcttgggaaatgtgaggaagggaaggagggagagacgggagggaggagagagaggagaagggaggcaggggaggggcagcagaaccaaggcaaatatttcagctgggctatacccctctccccatccctgttatagaagcttagagagccagccagcaatggaaccttctggttcctgcgccaatcgccaccagtatcaattgtgtgagcttgggtgcgagtgcacgcgtgcgtgagtacggagagtatatatagatctctatctcttagcaaaggtgaatgccagatgtaaatggcgcctctgggcaaaggaggcttgtattttgcacattttataaaaacttgagagaatgagatttctgcttgtatatttctaaaaagaggaaggagcccaaaccatcctctccttaccactcccatccctgtgagccctaccttacccctctgcccctagccaaggagtgtgaatttatagatctaactttcataggcaaaacaaaagcttcgagctgttgcgtgtgtgagtctgttgtgtggatgtgcgtgtgtggtccccagccccagactggattggaaaagtgcatggtgggggcctcggggctgtccccacgctgtccctttgccacaagtctgtggggcaagaggctgcaatattccgtcctgggtgtctgggctgctaacctggcctgctcaggcttcccaccctgtgcggggcacacccccaggaagggaccctggacacggctcccacgtccaggcttaaggtggatgcacttcccgcacctccagtcttctgtgtagcagctttaacccacgtttgtctgtcacgtccagtcccgagacggctgagtgaccccaagaaaggcttccccgacacccagacagaggctgcagggctggggctgggtgagggtggcgggcctgcggggacattctactgtgctaaaaagccactgcagacatagcaataaaaacatgtcattttcc

SEQ ID NO: 119 - DNA, 50844 bp, Homo sapiens
cggagacgagagaggaagcagccggcccgcccctgggttcgcgctctcgccgcctctgagggaattgaattgaggcgccgcggctgcgagagctaaaaaggaaggaggagccgccgcgggactgagacgggggcagagccgaagagaccgacacagagaaggaaacgaggaggaggatgtctcaccgggcggccagcgcctggatcagcccgtgactcttaacagcggcgggcctcagaccccagcgcagactcggactttgtctttgggggcccgtgctctgccctccccggtttccgacaggacccagaggagccggcgtgcctctctgccctccagccttcttcaccatgtccaagatgccggccaagaagaagagctgcttccagatcaccagtgtcaccacggcccaggtggccactagcatcaccgaggacaccgagagcttggacgacccggacgagtcacgcacagaggacgtctcctccgagattttcgacgtctctcgggccacggattatggccctgaggaggtctgcgagcgcagctcttccgaagagacgcttaacaatgttggggatgcggagactcccgggaccgtctccccaaacctcctcctagatgggcagctggcagcggcggctgctgctcccgccaacggaggaggagtcgtttcggcccggagcgtgtctggggcgctcgccagtaccctggcggcggctgccacttcggcccccgcccccggagcacccggcggcccccagctcgcgggctcatccgccgggccagtgactgcagccccatctcagcctcccaccacatgtagttcccgttttcgcgtgatcaagctggaccacgggagcggagagccctatagacgcggccgatggacgtgtatggaatactatgagagggattcagacagcagcgtcctgactagatccggggattgcattagacacagcagtacttttgaccagactgcggagcgggacagcggcctgggcgccaccggagggtcggtggtggtagtagtggcctccatgcagggggcgcacgggcccgagtcgggaactgacagctccttgactgctgtgtcacagctacccccgtcggagaaaatgagccagcccactccggcccagccgcagagttttagcgttgggcagccacagccgccgccgccacccgtaggtggggctgtggctcaaagctcggctccgctgccgccgttcccgggagccgcgaccgggccgcagccaatgatggcagccgcgcagcccagccagccccagggagcggggcccgggggacagactctgccgccgacgaatgtaaccctggcgcagccggctatgtccctgcctccgcagccgggccctgcagtgggcgcccccgcggcgcagcagccccagcagttcgcgtatcctcagcctcagataccgcccggacatttgctgcccgtccagccctccggccagagtgagtacctgcagcagcacgtggccggcctgcagccgccaagccccgcgcagccctcgtccaccggcgccgcagcgagccccgccacggcggccacccttcccgtgggcaccggccagaatgcttcctcggtgggcgcgcagctcatgggcgcgtcttcccagcccagcgaagccatggccccccggacgggaccagcgcaaggcgggcaggtcgcgccttgtcagccgactggagtgcccccggctactgtgggaggcgtggtgcagccgtgcctcggtcctgccggggctgggcagccccagtccgtgcctccgccgcagatgggtggcagtggtccgctgtcagccgtacctggtggccctcacgccgtggtgcccggagttccaaacgtgcctgcagccgtgcccgctccaagcgtgcctagtgtgtctaccacttctgttactatgccaaatgtacccgcgcctctggcccagtcgcaacagctgagcagccatacgccagtcagcaggagcagcagcataatccagcatgttgggctgcccttagcgccaggcacacacagcgcaccaacaagtctaccacagtctgacctaagccagtttcaaactcagacccagcctttagtcgggcaagtcgacgatactagaagaaaatcagaacccctacctcaaccaccactttctctcattgctgaaaataagcctgttgtgaagccgcctgttgcagattccctggcaaacccccttcagttaacacctatgaacagtctggccacctctgtattcagcatagctattcctgttgatggtgatgaagacaggtatggaaatctctattttaaatatttgatagaaatgcttggccaacattgtagcttaggatgcaactttgggagattgttgtcaacggaggcccttagcatttttaaatacaaaatttagtttttggtaaaattgatttagattgctgatgctgatgtcaaagggtgtaatgagcgaattggtcttgtcaccgttgtttaaaagcactaaaatgggtagggatgcaacattgtttactcaaaaaaaggtgaatttaagcttaatgcttaccatttaatggtggtagctagtgtgttatgctcccatagaattgtccttttcttacatatcaatcacacttgaacacgtaaggcagagagatttgtcagtgtgagttttgaggctgagacataataatactacaagttttcctttctggaaaaccagaaggtcctctagtgaaaaaaaaaatctatgtaaggaatcttctccagtgtatctggaaaggctggagacataatggtgaaatgtcaaatccggctttgaagatcatacttagttcagccttttgattaaaggaggtacaaggtcacgagtcttcccagggacttctctaagatactatttttttgttgttaagcaaaaaatgtactggaaagatattcttactttccatcagtctatttattataggaaagggaggttgagatcgatcctttaactgtagtgaaagctatagttcttgaaattaagagtaattttataataaaagtgtaaatgttaataattggctccctgtatttagggatgctttttttaatggcctaaataagaattagtgtattgctacaccagtgccacaacagctgatgtttggttatggtttagtgaggatttttgtggttttgaggagatgtcacatgtaaatttgacatacatattgcaaaattttaaaagctgacttgttgcaatgttttaaaattatatttaaaaattatagaaaaagtttcaggaatttcacagttagacatttctttgctggggtttttgtttagcgagaggctaattttaggtgtttttaaaagatacaaactaatattatggatttccagaataattagtatgtggaagaatacaatgacatgtatgttaaagctttctcttcctatggtttcttctgagttccttcacatttcttaacctcccatttctaattagccttgtatttttgttatatacttctgttggtttgaaaaatactcactgactgaaattcattcatcttctctgctttttgtaatttaaagttcatctttttttgtaggtgacttgcttatggggagtctttcttcacttgagaacgcttagagaataccacgtgtccataagtgagctcagctagctagtcattgagaaattttgtgtgtgtgggactactaagtaaactgactccacaagccactcagaaaaatccctctacttttatagttgctcccattgtcacacacagggacacacctgtaacacagattgagtttattttttcacctttggtaataatcaacaggcatcttcacttttctagctgccacaagccaattttttcctgataagttggcaaataaccttttgctttcctctgttcctgtatactgcccatatctcttcaagaaatgatgactggtttcctgagctaccccgctttctatacacacacacacccctccacccgagaatgcagattacattttcccttctgtgcacacctctctcagtttacagcatccatacttagattcctcagaactttagtacgatgataaggcatgaagcagagacttctgttgatagatggaaactgaaatgtattctttagggtatgacatcaaaaatgcatttattttttcctcttactgtattaagagttggtaatctgaaaactctgatttccaaatttgtgaatggttgaactacagatactactgtatcagtgttcttaccaattgcaacagttaattcagtgcaggggttttgatgtatgtacagtcctattttaaacatgacacttccctcccttgccccaatcatttaaaatctacattgcttaccaatgttcatttctgatttttgttacagtctttcattggtttttaacttgacatgctagtttccaagatgtaatcttacacatttgactgttttgtcactggtccaacatacctggtgaaggaataaatccattaggtagaaatagttgggttttttgttttgtgttttttttttttaatagaaagctttggttaaaaaaaaaaaaaagaacagggtattttaaaattttgtgtttgaaattaaataacagttttccaggcatatgtttaaattactgagatgagtacttttgaggagactactatcttaactgaaaattttaattttaatgtgattttgggttgccgccttaaaatctgcatgttttcaaatttgaaataaaaccaactggagtgagaggtcttgactaattgtgatttaaactttgcaagtagtttgacaaatttcagatcctaaggaaatatttgtaaataagatatatgctttttttaaaaaaaaattaggactttagtaaacagtctatttctttgagaaaagaaaggaaaatgggaaattaacaaaaagattgaggtggtttaggttgatacattgaaaactcttatcttgagattttggttccattacctaatgcaaagttctatattggcttaattttgagatcatttataattaaagaaccgggccttatagtaatacatcttaatattatcacacctttaaaaggctgatggttgtatatgcaaaaagttctcaattagcattgcctattgactctacattattaattaccataaagtttatctttctggccattttcattagaaaggtttatggtcagttgttgagactcttcagattgattttgtgtaaactcgtggatgtgatggttgaaaatacagtccttaaatatgtagctacttttatagtgaactttacaaaacttgtttaaactacgtacacacttaacagtctcctgtaaatgagaggaggtgcaaaatattactggcccttttggaaaaggaacacagtacagatcactttccatagatagccaaccaatgtgaactctgtaggccgcattccaggaactcttatgaatggctgcaattgtgagctgtcatctgtggccaaaagactgttgaaaacctgattctaaggatcctttggtggcagatatttctatgtcttgttaatggttttatttgtgtggtttgctaatgatcactgataaaatattatacattgtgaatgttaagtggtgtgtcctggtatgtgccataaatacacattttgtttgtacatttatatatattttaaaccaaattctgctgctttttttacttgaagtttaagtgagaggattaagtaaatgtataccaggaggcagaactgtctcagtcttcgacctctgttgtatgaaagtctcactgaattgaagtctctaaagatggaaatttcttacttgaatctctgtttcttggaagctgacatttatctgttaaattgtgaaggtaattttgctcttgtaggtttacagttgatgtctgaatcacatactagatactatcctatgcctatctacacgtttaagagtgttcttactgaggagttagtagtaaaaatgtaaattcgtatatatgtgtcattattgtttagcataaaaactgatactgatgtattcatcagggattactgatggataccacatggattactaaaacatactttattcataaacgtggcttgaaataaaagaaatgacagatttccaaaaaggcttacgattttccaaactacccgaaattcctaaaccatgagctatatctgtaggagtgtggccttttatattcacagtgacacatactgtataaaattttatgtgcactaaatcatataggccaaacattggtaaatttttttagaaaacatgatggcttatatgtgtgtgaataatacagatttccagctgactattttagtaacacttgttttttctttttaggagatcacaacccctgaactaaatcacctttatgagaagtcattttatataggactggtggtaggggtatatatgtcctctacttcctgagaataaatataatgccaattcatttgttatttaagaatcctgggccaggagcggtagctcatgccttgtaatcctggcactttgagagaccaaggtcagaggattgcttgatgccaggagttggagaccagcctgggcaacatagcgaggctttgtctctacaaaacatttaaaaattagccaggtctggaggccaacacctatagtcttagctacttggggaggctgtaggaggaggattgcttgagcccaggagctggaggctacagtgagctatattataatattgcactgaagcctgggccacacagcaaggacctgtctgtaaaaagaaaaaaaataattctgatagcactaatttggaaatagtgaaatatggtactggatctatgaatctggtacttcctaattaggaatgggagtctatctttctctgcaccagaaaagatcagaagcagttatgaacaaatagcagccccaccaatcaagtagtagagaaacccaaataaatctgtttcctaataaaggaatggtagttaggaaagtataaaaggaatctgaccttcctttcctaaaatggcaggagttggggaaggggaagtgtagaatgatagcagataatcaaaatggaagaaagtacagtggagtggcatgaaatatagtctcaaaagaaataggaacacttgtgaatactgaggaatggtgttctaattctttctttgaagaattgttttagtccagtgtgtatttccttttctgaagattctgtttatttcttaattgcattactcgttaaatacttaaagtatgaggaaggagaggccttacaaaagcaggtctgtctggttaaacatagcctgaatgatattccgtaagtaattccttaaattggaaaagcagatttttggtaagaaatattaatcatatttaaggagtatgtgtagcaaaactcctaaattagaataaattatttaagtgtatggtttttctttatactaaaccagtgggcttgtgatttgaggctactgttttcgatggtattgtattgagtccacagagaatatgtatacctgaatcattggtataatgtctttcccacagcaattcttgaacatatcaaattactcgatatttgttatattcttaatctggcattgcttagggcaaaaactgggtgtccctcataaaaaggtaggaacagtagccagtttgcaccattcctatacattattccatgactttaggaagtatactttgaggtatactcttcagatttggtttaataatattaaaggtatattgatggattgtttcctgtatgaaagtattgcatgatttctgctcttaaatcaggtgaattaaatttcatctggattgcttatctcaaatttaaagcctcaaatcagacttaaataattagtatttagtatttagtttgattcctttgtacccaagctaatttttgtttaaaaagaaaaagtgcttccatccttttaagtagtacatttatttgtgatgttagtgaaagttctgcaggtaactgagttaattttattagtgtttgcctgggacatatacctattattagggtaggcaggacaaataagtaaagtctaaatgttaaattacttaaagcttcttttcccataagcctttcctaaaatttgtctaaagaatattgctttgtagaagatggagtttgtgattaatgtgtcaattattgtaaataatgatggcatagttttaaatgttagttttaggctgttcatcttattacacaagtatataatttaatctgaataaaggattcccaaaggtaagtgtaaagcctctagtttctaaagtagagttagtatttagtttttatcaagtggttttatatgttaaagcaaaacaaatctttgcttggcataccgtctacctagtctttgaagacaaaacaaaggagggaggagctgttttgatcaaataaaaccaatagcgtgtttaattatgtgttaacatatgtgaatgaccattacagagacagtagagtcagacatacccgggctaaaatctaactgctacatttgactttgagctagttggtgtagatgccttgtttcctcttatgaaaaatggggattgtacctacctgggagagttttaaggaattaaatgatgtgtgcaagtaatttgaacagtctgtaacataatatatgtggcaaacgtgtatcacagaaatgttaatatttcagtgtccaaactgctctcccagatcacccctttacatgttataaatcataccaagaatcttccattttaatatgaaagcgtaattgtatggtatggatgtagtcagaaaaaaggagatgatgttttagtctagacgagtcatgatgttgtaagaagtatagggaattgtgttccagtcctggctcttctatcatttagctggtttctttggtcaagtcatttcacttgtctgtttttcttttttgagactttgtcaaattttaagattccttctagccttatgtatatgagaccatacattcaagtgtgcttcatgagagaactgcaaacttaaactttcttctttttacccctttcctgccacttgactattgtgtggcaataaatgaagtttgtaaatactcattaagtaggttgattgcccaagaaaacatttaaaacagcttatcagtcattcagctttcatgatgctctgtgagtagtgagcactggaatacaaatatgagactatgctgccctcctagatctcaggcattttcatcatcatgaaaatgatgatcagatgtatactttgacatacattggaggtggtgatggagtaatataaggtgctaatgggaacaatttgagacatcagatcagattgggattgggagggtagtagactgacttctatttaaaaattattctctgcataggtatttatatagttcaaaactcaaaatatataaaagagtaaaatcgaaagcctctctgctacctctgtcctccagccaccctgtttgtccttagaagtaacccattattacttgtacattcttttgaggctaactcttgaactaaatcttaaaatggtcattcagattaagtcactaagaagagaaggggatagttttccaagcagaggtaaaaggcagtttgtataatgatgtgaaagagtgagaatctatcatttggaaaatggtattgttaatttgacaagaaccagagtgaaggactttaaatgtcatggtaagaaatttcgatttttatagtaagttgctgttaaaggtatttctggaagcttttattgttaaaataatatatatcttgaaacgatttcagtatccttttagtgattattgcattttaaattataatcttatgataaagctgtgttaagggaataccttcagagcgctgagtcccaaaaatcagaattcttacctaatgaaatgtgctaaatattttggtacccctggctctaagtttaagtattctgtttccctcaatattaccttgataatgtcagaacatttggtacatgttgagatactctaccaaaatttgatttataggtagcataatttggaaactaaccttatattaaacacaaagcaagcttacttgtgtcaggtcctatgtatatagactttcatttgatctttccaacaatttgtaagaaagtggtttcttcccttccccctttcttatggattaaggaaactgagactcttaaaatttgagtcacctaggtattgggtgacaaagcctagactcatattcagacctttaacctaaagccagtgcttttgaatattcccagagttagaagtttgttttattacttggcacacaataagttaggaagaaggaagaactaccatagccactgatttgttgtattgtaaccctttacctaaaggatttttttaatcatttaaattccccagataataatactggagatggtgcttgttgatgttcttcatattgtatgtccctggtttctatttagagatctctgaagtcgaattttggcatagattaagagaaagaggtgtttgttgagtgctcaagtaccttatgctttaagctttgacaatttttgtagcttagttttgaggtatggaatgtttgtttttttctccctgttgtacttagttaccctacaaagatagtgtcttgcaaaaacaggtagacatgccacatgctttgagtcattttctgatgtagtattttcacatacttggaaattaatgtgatggactattgagtatataaagtcagagagaaaagaatgtattttgttcagtgatgttaaagaatatttacaaataggaaaacagcatttttgtttaggtggctgaagtacagtgtaaaccacatctcagtcttcctagaattgcttcgttggctctatatttagaatggtagtttatattaatatcaaataaactgttaaaaagctggtttcaaattttatttcttgagtggaagagaatttgtgaccacagctgcataaaaagtcagtatttccttctaataaaatttttaatttcagttgcctcttcatgctttcaggtttcatggactgtaaccttgaaatgatcccattaacagccttttccttgggctcttaatctcctcaattttatgccattccaaaatagaagtctctctgatgatcaagcctttcaatctttacagatggctcttttcccttctacttccttgatcagtgatttcacagacttgactcctttaatctgttagtcagtgtttggagactaattattgttgctgtttgctacaaacccctcagtttatggataacatcccagttatagtatcccagaaacaaaatttcatagcttataagactatctaaatttttacccttaaaatctagactgtttaaagttttatgtagtacatagattgtgtaactgtgtactatagaaaaccatgtactgtggcttcttcactttgaatgtatgtagaaagagtgattgttaattgttagcttttgcaaattaagtgtattctaatatgtgctgaaaactttaggtccatttatacagtattttatttcacaggttctttccacatcccagtatttactactaactacaaatatgttcgtttttcacctttacatttgacttaagagatattgcactattctgtaaaactgctggaattttataacaagtcatatgacttcatttggaaccaatttacctggaatatgaatttgattcaaattaaatatttgtatttccaaagtcagaggatctaaaggtcttttaaagatgccaggtgtggtggctcatgcctgtaatcccagcactttgggaggccgaggcgggcagatcacctgaggtcaggagtttgaggccagcctggccaacgtggtgaaaccccatctctactaaaaataccaaaaattagctgcgcgtggtggtgggagcctgtaatccccgctactcgggaggctgaggcgggaggatcatttgaacccaggaggcagaggttgcagtgagccgcgattgtgccattgcactccagcctgagcgacaagagtgaaactctgtctccaaaaaataaataaataataaagttcttttaaagaatatcatccttataaatatattgtgagtactctttaatgaattttgaattgtagacttgcagaataacttccaagatactctttcttattcttttgtatatactaccttcctctttgagtcactccatttaaactggaggtctccaaacagacctttgaggatagcaaactagttcccatatgttcctgggcaagcctgtttttttataaaacaaaaacaacaaccaaaaaaaaaaccagattgaatgttcaattggttcagttagttttcatttgatttggcagactgacttctaagtacagcgaaaaaagtggcctgacaaatacatcttaagaggatgtaagccgttaaataaacagtaggtagaagcctcttaagcttttcttgttattagcaggtctaatcagtgcctttgattgccttagacctagttaggagaaaagtggaaaaaggattaaaagaatagaaaggagttgaagtagggcaagcaatgagaaatacacgtattagtctcctaattaatcaaacagttactttggtgattctctggcatcttggaagtcttttttttttattgtactaataattctgcacagactttaaggctcttaataggaccccagaattgccatgttgtatctaaacctcattttgtagattaaaataatgctattgatgattcactgtatgccaggaactttacatttagtctcagttctttagcctgcaaagctaggtagtaatgtaaccagttaacagataaagagacagacttttaaagaggtcaaactttaacactgctatgtgtttagtgtagtggtttaagagcataaactctggaactagattgccacctactagctcagtgatgtaaggcaagttacttctatctgacccagttttctcctctatgagatgggagtaataatggtgcctacctcttagggctgttgtcagaatttagttaatgagtgtaaagcacttagaatagtgtgtggtacctaataaacacattcttaactgctgctgttctgctacagcatgggctaagaattttaaaagttatgtggcaaagtttttttggcttccagatgtacaggttgaaggtgggggagactatggaagttgctgaggaggagggaacaggtttgtcaaaagtttaaatccccgtggaaccagtccctagatttgaggtgaatcatacttactgggagatagtccagaagagcccatcagttaagagtctatggtgaaagccctagggaatggtagaaatgaaagataattatgataaataggcttttacccctaaagtaacattgtaccaatgctagaatcagaaagctgccaaacaattgcagcgccattttttgccctagacgaggaaaaaacacatataaataaatggattttgaaggtggaaatgtgtcaagtccaacccaggaaagaattcttcattgttaatcaaacctttgctacttttaacagagcctaagaaaagtttttatattgtgaagatatagcttaacttagtttatatgaatacctaagaacagccttgttaaactgctaaacaagatagatatttgtaaaggcatttgatatagaagagtgttgattaggctatgaatttgtcacatttatatgcacgcacacaaaattggatgctacttagtatttagtttcatctgccttacctctttattttataactgtgatcctgaattattgttgaagtctgctggattttgtccagtttttaatttcttctaaagtgttgttttaagcaaacttatgtggttttaaaatctttttattattaaaagttacactgtattagaaatctaaaatcttccatcttcttttgaaaagtagtgattatactgtacgttctcaacctcatttccatttgattctcggatctcacaggaatccttcaactgctttctaccaagcgttccatttgaacacgttaaaggaatcaaagagcctctgggataggtatgaatacttacatatggaatgcatacatgcaaaactgtatgcatgaattgctttgcactgtactggtttctcattaaaactgatctttgttattttaggggggaaatcacatggtatctagcatgggacaaagcagcaaaataaaccaaaaggacaatctctattttatatagaaaataaacatacttttctgcatcctgtgtactttaagtatatctatatttttgaagggttcatactgtgttgaatttttcttatgaaatagtcacttccccagtgtattttaatgcaaatgcatattctataaaataaactatattttaatttttgtgctattttatgttttttttctgtaaaagccatagtgattcaaagcaaaatgttatttcaaattatgaaattggaggaggaacaagaccaaggtatcaaagtaatcattgtttaatttttggcaagaaactttaacttcaagtttgtttgctagaattcactaggtctgcattactgatttgtaagcccctaaaacagtttgctttcttacagaaatgttgtatagattttactgttaacttttaaaaatacagaatgaagtcttggagttcttttatggcaaaagatactttggtttatctttctgcttaacacacattttaagtagtgtatgctctgttcaatcgttttgctgaatatttattagcattccatcactttgtgtttaattaatagaagttgagttcaaacaatgtttttaaaattcacacaaagctcgttagattcttttaactctgcctggcaacgcatttgtgtcttctggcatagttttggataacactcatgaactcaactccatctctttcattagaaaagagtattgctaagtgcatgtacatgtcatattaagacatgatacacattgcctagaaatgctaaaacagtcttaattcttcggcttgatttgcttgtgtgtgtcactctagggaaattttctaacagtatctttttgatggtgtgttccagaaatctttttaaatagttacttttagaacaggaagttttaaaatttgtagtaccatgtttataaaataaatttttaaatagttctgtagccatttaaattaatacataaatgtaaattgtgagatgagataaacatgaaggtttaatctttcaaatagttttccaaatgtagccagaatgtgagtactttggggtatgctttatagtttctcttagaaaaaggaaaaatagcactctgtttagaaatgtaataagagtagctttcaaaagtatgatgatttatttcaaatagctaactttgagctgtcatgatgttgatgtgaatgatatatattatttttatcagtgtaggaaggtttgagctatatttttgataatttgaatatgatattgaaaggtttattttgtttcataataaaaccaccatagaagttgcctgtacatcatttgttgttacagctaaatactccttatatgttttctttttttagatacctgaaacttttaaggtatcagaaatgaggcaagttgcgtatctatggtttctcatgggttgaaaatatttattttctctcctccttggagcctgttgttcagagccaaagaagttagtggatatttgtctgtagtgtgttaatgccaaaatataataaaatcaaaatataatcagatcagccattcttcactgtaagttggcctcgttggtactaaggtgacaaggccaacccaatggaaactgactagtggctttcttttaacttttcaactagcttattaaattttccattgagaggagcaatcatggctaactttattagttttaatagtctacactttcagttggcaactatctacagaattactgataggtatatcagctaataaagtatcatgagaccgtttattccaaatgggttgaagatttgtgtgtgttaagctttaaaaaatattaaatataacttctgaccttgattgttctggaaatcaccaaatcacattgttcatttttactattataaatttaggattttttttttattttactactaatttggcaaataggtatttggcaggggtgattctcctattaaagagagacatagactgggcgcagtggctcccgcctgtaatcccagcactttgggaggctgaggcaagtggatcacctgaggtcagaagttcgagaccagcctggtcaacatggtgaaaccccatctctactaaaaatacaaaaattagctgggtatggtggcacatgccagctactcgggaggccaaggcaggagaattgcttaaacctgggaagcggaggttgcagtgagctgagattgcgctattgcactccaacctgggtgacaagagcgaaactccatctcaaaaagaaaaagatatttggaagtttaagggactgcaagtccctaacgttatcttctacattatctatttattttgaggcataaatttgtctcgctattactagataacagattttaggctcctatttatgaaatgttggaaatcattttcagtaggggcagcttttaagtgcccattttcagtagacctaccctaaatagctgaatatccctagtttgattttgtctaactagaaagacaagaatctccttttttcctcaggaatctttcagtttagcagaatatcttttaatcaaaatgtaagtaactaatatacctttctcatattgacttaaagttctctaatggcccctttgtttccttccatatttaaattagaattggcaaattaatagacttttcaccaagcagcctgcctctgcctatatttagatatttctccttccatttatatccagtgctttactcagttattgtactaaaattgaagctaccctcaagtcttcctttccctttttctgtaggtgccatcatggtttctgtcttctctgtttgccatttgcagagccctcagggaatcaatcagctgaaccatcttcaaatgtagggacagtagatactgataacgcaaaaataatccaaccctttctgcagtagcccaaactgttttgagttgactctttattaaaataaatactataacttacatagttagctttctgggagattatcttactatggaggagttaatttttcctgagatcctaagcctactggcatttgagaatagtaactttaaaatttgacttcctattttctaaagaacagttttccaaagttaatacttggcattgctttgttaaattggcagaattagtttagaaacctatcctgatgatcactggggagcggcaagcaggttctcattgggagtcctttgtttacaaaagctcagcgtaagggtttatagcaaacaattttaccctcttctaaataccaggtcactaaagtaaaggagtactaaggggaagaaacttcagctagactaaaggaagaaatcaggtagcttgtaaggctttaacctcatcgataagcacttgcagggcttttgtcttcattaagaaatgcataaatgtacttaaaacaagtgagagaacagttgctaggtgtacatccccttgagtctgcttgtctgtccttatgatagcaccagtatttagagagaagttaataaggaaagtagtagacatgggttattaacttaaaatgaaagtctagtaagtttatcctaaatttttttactagataattgatgatctctcaaattgttttctacagtgattattcacttattacctctaattttaaaattattggataaaaaaagtcttcttatttaaatagcctcaagtattttgtgtagggaacgccttccagtatttcctatcattgtttcctatgagatttttttttgaagctaggaataaattagaactaagctgtttatgtcataaataccattggtaccatatgagacaatttattttgttttgctcatctctaagaatcttgggtccatcattaacatccaccagtacttgttatcccaaatggtaaaactcaagttatgcaacttagctgatctagtttttgaatgcttggtgataggacttgtaaaatttttttattgaagtataatttgtatcggaaaagtgcaccattcataaatgtatagctcaaattgaacacacctgtgtgggcagcacccagatcaatacatagaatattataagcccctttcatgtcctcttcatgccccccatcagtcacttcccctcccaatcctaatttctaatgtgttatatatgtaggaccatacactatgtgttttgtgtctgacctctttcatccagtattgtatttgagattcatctgtatggttctgcatagttgtagatgtggactatataattttaaagaatcactcaagtagcttatttgttggagattggtattggttaaatgttctctcctagtgattatgcataagtatcttgaggatatgtacctgaaccattttgtgaccaaccccaatatattccttactaatttgtacctagtacttacataatttattatctgattatatttcaacctgttccactaaaagacatctagtagaggatagtacaagaagctaaaaattatagcatagctttttaatgattgtcaccttttattcttcctccctccctccctctttccttacttcatttcctccttcctttcttcttctcttcctctccttccttccttttattttactttttaatctgaaatattttagatttaaagttgcaaaaatagtgctgaggcttcttgtatgtcctttacctagcctcccttaatgttaacatgttgtacaaccttagtacaattatcaaagttaggaagttaacattgatagaatactattaactaaactacagatcttattttaattttaccaagttttccacttttgtaagtgtcctttttctgttccaggatccaattcaggattccacattgtgtttagtcattgtgtcttccattttaatttgtaacatagcactgttcctttattgaacatagggagtagcaagtctggtcttattggtgtggagagtcagttaactaagattgcctacaaatttccaccttttctgcagtgcttactacagttgctattctcacaggactctttcgtatcacatatataaatgttttcatcagtagtttagtttgtagttcttaagtgggggatggggcaggcccagggtaggaggggcaggtaatcactggtacttagaggatgaaagctttatatattccctctaaaactcatttttggatccctgatttagatggaaacctcagggcgtggttatgttcagatgacattaaatcaaggaagtgatagccattgtgaatgacagcatttataaatttaactgaaacaaatacagaaatcaagaaattggaagaatttatatgtaaattcagggaggttgaaacctaggttgactgggtatagtaaaaaaaaaaaaaaacatacttagatatgtgtgttaatggcattttgtagtattggttagcaagtgacagtgctgccacaaaaactaatgtgattttaggtgatgttgaaatgatggtgactaatctgttgtactccatttctacagaacagttgttctaaatacaaaactaactagaaaaccaaatttctttatactctatttgcatatccaggggtatttcaacaggcaggcctgagcgagcttactgaaaagtaaacagatcccttgggaaatggtcttgccatcactagaaataatacaactatcttcctgtctgttaaccagggatgctgattttaagtgaaatttaattttagttacatttaaaatgcctactctggagttttatttccccaacttttctaaatggaagtacaagcattggaattgaactcctttacttctgtttcgtcattattggctgtgattatcagtaaaccttaaagagctgtgtatttgcttaaggaatggaagggtagtaaactattctgcttttttagggaagaattccatgtcagaggcagtaaatgttgatctgaatagagaaaccaatggagcttccctcagaagaaaatgagtgacagtaagcttatttggaaatgagaattgccataggagtggtggtaaatgaagccccacaaataactaggcaccagttatcaccatgctgatgatttcagcagcatcttaaaaactagtgaattcttcctacccaggtgccaaggggaggtagagtaactcatggagaaaaataactacacattacagactgactggcagaatttaaggttaacttcatttagaaatcatggactatatatataaatgggcatcagtctaggtcatagtcataggactgtagggaaaaccaggtctccaagtttttaaaagccacatgcttggttatgaaattgatgctctcaaaatataattcaaattcttgttgatctggaaataagaatagtgtgtgggaaagaaagaaattgtatgtagagtgtagtgaaggtaggtcattgggattttaatggaagatgaaagaagccacttaaaactgtttgaaactcatgcctatggtgttctgtaaagctacttgggaagttcagtaaagtattagatgcctggtcatattataaagtagtctctttaacaatacgtgtttgtccccaattatagttacttgctatttaaggcattttcctgttaccatcttcagtggtcttagatcaccttttccaaccaaaagattctaaagccttaaaaatctcacttttttagagtaactcagaatgaagctgagggaaaataccaggaacgtttgcaattacctgactcagcaaaagtttgttctcctataattaaatactagaagaaacaataagatttagtaactgctttcagtgagcttggtcttaatatggaaaatggtaaatacattatcacatgattgaaagtaataactcatataaaatgtaagcacttcatatctctcaagtacagctggagggattggtcaaagcttcttcaggaggtggcttttgagttggaaactgaaaggtgggtagaatttggtcaagcagaattaaagaactgaggggaagggaacattccagttagaggaaatattgtgcaccactatggaagtactggccttatatgataaggataaagttaaatttggtaggtgtataacatttgaagacaggagaggagagcagttagattagagacagagattctagaaaggtactgaagcctgaattaggcaatggggatgagataggaattacaggattttacaactgattggtcatgataggggagcagtcaaacttgactccaaagtgccaaacctaattgactgagggaatgctggtactgttagaaagtattagtgaaagaattagtttgggaaggagaaagtagtgatgaggtttttgtttttagctgttttttggatgagttgataagctggtacaaagtcaaggtgaaaatatttggggtgcagctgaggctgcagacttgcaggttggtatagaaattaaagctagttgagatttaagaatgttttattagagttcaagctttaggaaaggccaagattgccaaggattagagtagggtaaagggtcaagccaggaccttaggcaataccacctgcatttagataacagaaggaagtctgaagaggatgattggttttagagattagaccattctgaggatattattttctaatcaaaaagaagagaaaggtctgaatctttaatttgaaataatttcaaatttacagaaaaattacaagaatagtacaaagaactcaatcttcttaccaagattcagtgtttgttaacattttgtcatatttgctttatcatcctaacatattattttaggaaccactaacaaggtgaaaccccatctctactaaaaatacaaaaattagccaggcgtggtggcaggcacctatagtcccagctactcgggaggctgaggcaagagaatagcgtgaactcaggaggcagagcttgcagtgagccgagatcgcgccactgcactccagcctgggtgacagagtgaggctctgtctcaaaaaaaaaaaaaaaaaaaaaaaaaaagagtagataggaaataccatatccatttaacttcagatacttcagcttatgtttcctaagaagattattctcttaccaacaatataattaccaaattcagggtatcttatattaatgtgctattatcaaatatgaatatacagtgcatattcagattttgtcagttattacaataatgtccttcataaccattttttaacctgttcgaagagccagtataggttcaccaattatacttaattaaacagttgtctttttcccttcctgtcttgtttgaatatgtaagtacttgtgttagtcacctaaaggattatttaaaatttaaatatttaataaaaaatgcagtattaatgtttttggataaaatactaggaaaaaaatgtacttgcttagctagtttgtactattgggagtattcgaaaggcaagggagtactgcctaaaatccagctgaaacgactactagagttggtgaagttttataaggggaggtcttttattgctcagagttgggtggtgggtggcaagagtaggagaacatttggatattaatgtgtcccttagaaattgaagtatattcatgtacttccctttctgtactgtgatttttatatgtatgtattaaattgggcttttaattattttgagttggaaaaaatagtgtaatttgaagacattttacatcaccacttgggtttgcaaattatgtattgctatcctgtatatactgttgtatcctcttagttttattctggtagttgtgttaggtggcttgtctgctgcgagatttttaaccacaaatctaaatctcattattcgaagtggtgtttcactggaccctaaacatctcttctcttagcttttctatggctagctgaagtgggacactaaacattctgacatctgttttcgacacattaccaggtttcagaattggcaaagagaaattatttcttaactgctcacccaccattatatatgctttccacccatatgtttaccaccttcctctttagtaaatttaatatgttatttaataaatttctaaacctaagtcaccccagcctattttgagatgttttgataattattttcaggtgaaattttagaaacagttttgaaaaaggtgggaatagctggtaaggtctctttattatttatttatttattcatttattcaattctttttttttcttttcaccaaatagattttaggtaaaccaaggctttgaatagaacagaaaagtgtatgtatgtttgtacatgtgaactaattcgccaaattcgatgtatttttttctaccgaatctaaaattctattgaagagctttttttaaaaaaaaaaaataataaataactgaacttgttcagacaagaaagaaatttaaggaacctggaattgttgaaccaggataaacatagaacatcttttagggtttcgtcattgttgttggttttccattctagtcctcagcaatttaaaattttaaattcacacctcttcagttgtatttaaatccgcagttgggcaaccttttgggaagaaagaaatattaatggaattattttagttttttatttttattaagatttggggtggtaggtagaggtagaagaaagagatgactgactctattctagcctgacattctttttgtttgtgtgcataaacatgctgatagtaatattccaagttactcaaatcagggaatatattaaatttttgtgattgatacagagcttttaaatgccttagcttaccaaaaattagctcctgtgtttaaactttagttggctacttctaaagtatttttcatatttgacagaaataaatttaaataagtgataataatttagaatgtttatccattagtaaatatcctcaagaaataacatttttatgccagtttatctcccagttgtttcaaagtttgaagattgttggttataaatactaaaagatttggaaggtgctattgtatttttcactttttaattgtgtgatatttggcccaaaaatagtggtgtcttcactaagttaaagtatgtatgcagacagcatggctgtcagtgtccccagctgtttatgtggccacatattgagaattttatttgtaatttcagtatcaatgctaatggtggtatccatagtagctacgtattttctaccaatagcaagatgttcagaatatatgtaacctttgtcgtagaagacagaaacatctttctgcatatctgcctggtgataaagaaggtatattttccctagtcctacacagtatcggaaggggaacaaggagggaaaagagttgcagtgtctggctgataacactcctgtttacagtgatgctaaccgttggtcttcagaaaatttctgcgtttatttgcagtagctgtttttattttggatagtacttagtccagaaaatgttgctaaatgtatttttctagagtagtcataactacttttgtttcaagaaataagaggtatcaactcttcaaaaagcataatatattatggtttctttacaagttctgtttctcctgagcacagtggctcatgcctgtaatcccagcactttggaaggccaaggtggacagattgcttgagctcaggagtttgagtccagcctgggcaacatggcaaaacctcatctctacaaaaaacacaaaaattagccgggtgtgatggtgcatgcctgtaatcccagctacttgggaggctgaggcacaagaattgcttgaacccacgaggtagaggttgcagggagccgagattgcaccactgcgctccagggccacagagcgagactctgtctcaaataaatgtataaataaatgttccatttcttttatgttagctattattaagctcagagtcaaaaaataggagggttttttgttttttttttttttgggacagagtcttgctctgtcacccaggctggaatgcagtggcacaatgttggctcactgcaacctctgccttctaggtttaagtgattctcttgcctcccgagtagctgggattacaggcaccaccaccacgccctgctaatttttgtatttttcataaagacagggtttcagcacgctggccaggctggtctcaaactcctggcttcaagtgatccaccctgccctgacctctcaaagttctgggattacacatgtgagccactgtgtccaacccaaatattcagctttctgttaacaaagcatgcagttccttattatacatatatttgagtattatgtaactggcttccacttcctttgattttccgtttttagagggagctctacctttaatttcaatatctttttcctttgccttctttctaagctgtttctactcctttgaaaggatcaagtgtataaatcatttgagagtaaacatgttaaaaataccaatagcctgtcttcttagagctgtttttcaaaggtgtattaatgaaattctttaagctgtgtatttggtgtttcttctaccaataggtgcatttgctataatgcataacataccaaacactttatatatgtgtatatacatgtacttatgcttatatatgtatgtgtatatatgtacatatgcttatatatgtatacatatatatatttagtttctggcatagctaattgtgtcttaaattatatcttggctcaaccacagatatatgaagtttcttgtcattgtgtgttatgtgtctttttatatgtgtctttttatttatttatttattttgagatggagtcttgctctgtcacccaagctggagtgcaatagcacgatctcggctcactgcaacctctgcctcccgggttcaagcaattctcctacctcagcctcccgagtagctgggattacgggcgcccaccaccatgcctgcctaatttttgtattttttagtagagatggggtttctccatgttggtcaggctgttcttgaactcctgacctcaggtgatccaccacctctgtgggatcccaaagtgctgtgattacaggcgtgagccactgcatccggcctttttatatgttaattttttggaacatactgtcttcctagcagttttattttatttaggtacatttgtactaatttttaaagtaaatttatctttgatattttaaagcttattttttcaatatatataacctatggaatgactctgtgtaatttattggaggacataaagggttgccctgtttcccccctttctccatttaaaactaagtatttctgaccaagcattggtttatcatggctaggatttctccaaacaatgtagtgaacttttttgaacagcaggttgaaaatctggctatattagtgggtagtcttatagaattttcagaatcttttaaggaaatgtggtttaaacctgaaaacaaaattttctatcaaactaagataagcacattcattaaaaaaccaagttcctttaggaactcttttagacctgtttgatttagcatatccattttcaagtaattacttggaaattataaatcatctaccttcttcccctttcactgtttttttattttaatatagtttcaccttctcacaaaaggaaatgataaataactgtagggaatatttgggatttggttttggtagcagtcttgccagagattcaagattatgattgataatattagtacagttttctcattaaatattcatttttaggaagaattctaattttaaattttgaagggtatctggttaatctgaacgctgttcatctgtaactactttagttacccaatttcatttcaggttgttaataaggatgtcctacatgttggaatttaatgacttaaactcttgaaatatgaccctgtacttggtaacaactaattttgaaaatatatgcttaggaaaattttgatatataacttttgtatcttttaaaacgtatacagctctaaagtcctgatttaaccatatatttgtgtaatgtatacacccttaaaatttttttttgtaagtttcgtagtaaaataactgcttcatatgactggtttaattgtatcttccaaaaagactttccaagcatttaccgtaacaaggctttttttgttggcaggccctttaacaaagggtcaagcagtcggccctttaacaaaaggtcaagcagtcggccctttaaatgaccttaaattaaagccttgcagacaagcagatttaccagcattatagataagtatttcaggaagtatttactttactaaatatgactgtatatttgtcctataaaaagtaaatcttcaaaagattttaaaaattacagtattttggttgataggagataagaatgttattaaaactttcttaaaacatttggtaatacattaatgaaatgaccacaactttaaacgaccacttatcctcataaatatggatttttgccttcaccaggtgattacattataaagctgtgctttcacagaagacaaaataaagttgtatgatttatattgaagtcaaatgtgttgtgagattacatttggaaagattatattggaaaaattctaatagtttttcagactacgtgagagacttaagtgaccatgtgtaatagaaaagttccactgaaagttaaaatctgtaacagcatgacccagcctgtacatttgggtcaagtatcttttgagatagctgcagagtttcctttacaatgctgtctttcagttttctatagctttatgcgtattgatcatcctcagtaagggcccttttctttcccccatcccttccacccctttatagtgttttatttaggggattaatttaggcaaaactatgcccacaaatctatgggtttcctttcctatgggttactggcaactaaaaatataaatgtacattcttatcagacagaaaatgttattaatgatattattcagtgattaacatagatgcccaattgaaagctttctggtaaaatttaataaatttaacaggatatttttaatgaagtgatttttgccattattaaatcttcctacctccagttttcttccgtgcccatatacaggtgagcaatagggaccactgctgcataggatacattgttattcggttacataaagcacataataaaatttaattcttgccattatgttgtctattttcaaaattgggggtagtagagacagatgaagatttagatatagaaatggaattctgtcttaagcacttaaatgatcggtatggattgttactgatccagccacccatgctataagtctagaaactcagccaggcatggtggctcatgcctgtaatcccagcattttgggaggccgaggtaggcagatcacgaggtcagagatcgagaccatcctggctaacacagtgaaaccccgtctctactaaaaatacaaaaaaaaaaaaattagccaggcgtggtggcacgtgcctgtaatcccacctactcgggaggctgaggcaggagaattgcttgaacccaggaggtggaggttgtagtgagctgagatcgcaccactgcactccagcctgggcggcagagcgggactccgtctcaaaataaataaataaataaataaaataaaataaaataagaaactcatatacatggatgtggaccaaacaatataactcaaatgcctttctacaggactacaaagctgtctgtatcaggttatggtgttaaatcataatttctggatcatgatcttaaacctttaattggttccatttctactttactctttactaacaagtatcctgatggcctgaaaatccatgttgaaatttgaagtttgaattttccagatcaaatatgaaatttattttcattttttaaagtacaaaatatcagttgtataatcatggtaaaacataaaattttgctataaaagatttttaaaggctatttgattaaaacatttatttacttaaactctttgctagaattttttttagaattcagcatcggaggaggaatgtgacataataatgatcgaaagccgaaagtttaaaagttgtgatgccctcacatggttggagggttattctagcttctaaggactgaatgttgtccacaagagtgtcatcaggtcataaattggtaagacttaatggcttagattttatgtattatacctgatgttattgtattgagatgaatatttatgaacaaaatgagcacattgtgtaagagtatagtattaaatataagttaaaacttggaattttaaatacttggagtatgtaagcctttcgaagtctcttgaggctgaaggccgtatctttgcagtggtgtttagtaaatacatcagtttaaaaaaagaaagtgaaatcctgtattatagtaagattattaaaatattgctattgcatctgctgtagatgcctacaatatagtgaagaacccaaatactttttaggtgttataccaggagatatttgagaaataatatattcatcttttctttaaaaaaaatccattttcttaataacatacagcttaattttattgctttggagattttatttcttaataaaagacatgtttcctctaaatgtctaaaataaagccaagaaaattttttcaattcttacattgagaatacctaagatgccaatatcatatgaaaatgatatattagaagtcattgcacattttttatattccccgaaaattaattttctctcagtattctgcttagaaaaaaactactttgttttgtgcagtttcttattttgctttgttttacacagctgtattttgtagggggaccattggaaggatagagtttagctcaggataagaccttatatcttttaatctcaagattatagtattttgcagatgaagaaaaggagtctggattatttgtccaaggtgatataattgtagaattcatattttcattaaagtgtggtatgcatatcctgcatgtcagtcaagaattatttgaaattatttattttccaaaaaagccagaaggcatgggttgatatcagctaaacaggccactatatatattccaactttatccttaaccagagatatgttattttatcctttgcccattctgccttttgaataatattctaaattgtttctgatatagtattccatgacttcattacattctgtaagcttaagtcccttaagccagtaattgcaatcaatagtagtctggaaggaaatacaacaaactaattaagttatctcttattccgtatacttttctattttctttattttctataatctacataactttgataatcaggaaaataacttctaatttctctagtataggatatccatatgtagtagtcagtggctggggttcaggagatcacgaaccatgtgagattttgggtagaatttttttatgttcacttttctgtgaaaggttcagagcatttgtcagatttttttttcagagcatttgtcagattttcatctgtcaaaaacagttaagaaacattgctagtgaatgttttgtgtcaaaaggacaatccttgttagacacctaagtatgagtcgtgaaagaaatttctaatgagaacattggtcatatgacttctactgatgtttattcaatgctgggttactataaatgcccattagactgatgggacaaatcagagccaagccacatttagtttaggaatttcgtactgtcagtctctgtgctcaaaggtcaattggatttttctgcagagtagtcgtgttttggctattgagtgtcaggcactgtgctgaatatttttggcacattatctcatttaattttcacaaagtcatatattaatagatattatcaatatcctcagtttacagagaagaaaattgaaagcttagggaagttaagtaacttgctcaagtcgcatagccattgagtggtggagctagaattcaaatcttattactgactggaacctgggtatcagtatgctggtatcctctgaaaatttgaaggataagataaaggagaattttacattgtatgaagatgtgaattcataaatttgatttatcttgaacttaagtagcaatgggtcatcctccattacaaaactatcttttattatttgccaaaaaataaatgttggaggttgcttactatctaaaagttaagtattaattgcattaaaaaataaattctttttcaggtttaatacttatgaatataagcaaatatatgtgtatttttttttttagaaaagtcttagtacttattagaatagtattattaaggaactcaccctttaatatttaggatttataaacagcaaacactaggaagcattaatttaaaaagcagctttgaactgcagatatttcttgggatagtgggatatattgcatgtaaaacccttattaaatgctatgtgagagttttccatttgcctttagttgcgaataattctgagaaacctccttttttgcccacttttaaagcatttatcaggcaaaattaattttttgggatacatgaagttttttggttttgttttcctttgtactttgtcatatcctttttgttggtttaattttactctccaatgagctccacatcttataaccttttccctgtttttaagtattaataataaaaggttgaatctgcaataatagtactgcttaaaaccataagaatttgtttgctcctgagtgatgttgaaatagtctgcagagctagtataaactgtttctttagcaccacgattaaaaatgcacaaacaacgtgataggtcatcagaatatgagaattctatctaaaagtctttttatatatatattaaaaaatatatatataatacatataaacatataaaatacatttgtaccccaacttctgtagtagtagtatgtttgccttttcaaaattcaaactgggaagtttggaaaatagaataagaataatcatacttaatccaagtttttaacacaattaccatcttagtgtttgcatattcccagacttggaatacatatatattaatagttgcaatcatggtagataagtagattttcaatagtttttaaactgtgtagttaaaactaaagctaatactgatatgtgatacgtttttaattttgaactgatatttgatattttgacatctgtgatagcattccctcctgtttttccttctaccttgctggttgttgcttctcagaccatttggcaggctttcccttctgtctgctcttttaaatattattggaggccgggcatggtggctcatgtctataatcccagcactttaggaggctgaggtgggcagatgacttgagcccaggagttcaagaccagcctggacaacatagggagaccccgtctctacataaataatttgctgggtgtggtggtgcacacctgtggtctcagctacttgggaggctgaggtggaaggattgcttgggcctgagaggtcaagggtgcagtgagccatgatcgcaccactccactccagcctgggcaacagagtgagactcagtctcaatcaatcaatcagtcaataaatagagtcatcagaatgctgtcttcttacattcttcatcgtggtaagagcttatagatggcttccatgcacatatcatctttatgctataggaagtcacctgtatgctctaaggtgctcaaacccattacttccagcctaggcatctctccttacattcaaacttacctgatctctcatagctggttaatcacaaagtactgccatatctgcctcctcagtgttttgccagcctatccatctcttgtcctcattcagtgtactatcctttcttatgtgaaaatgcaacaaccttctgactagtccttgtcgtttaagttttctaatgtggccaactgcacctactgttctttttacttggaacatttttttgtacctatcttttttttctccacccaactgtggcatttcctctactaattctttcctgatccaagagctatgtgcccccagaacaccctctaaaatcttgctctgtcttagcacttatcacacttaacatcttatatatctcctgcactaattgtaaactcacaaactctggaattatgtttatttgacgttgtatccccagggtctgagaaatgtttaagttcattacaacccctttggaatgtggcatcacaaaatttggtgtctgaaaataatgttagagattattgtatacaattagagacaagactcaaatgtaggaaccacattacctaactcctaagtcagtgtttcttgtgtatttcatgacatttagattttgaccactataaattattacggcaagttattaggtaacatagtaagtgtttaccatatgccagatactaatgcattatctcactgaatctcagtacccggtcctattattgtcctttggggaggctaaatattagcttgtctaaagtcatatctcggttttggtgcagtggctcaagcctgtaatcccagcactttgagagtccaaggcaggaggattgcttcaggccaggagtttaggagcagcttgagtaaccctgtctctacctgcaaaaaagaaaaattagctagacatgatggcacatgcctgtaatcccactgaggcagaaggatcacttgagcccaggagtttaaggcagcagagagctatgatggcgccattgcattccaacctggaagacagcaagactatgtgttataaaataaggtgagagatgggattcaaacctgggtataactccagaaccaatgcccttttatttaatatcacatctcagaatttatcttctgagttttgaattataaaactgagttagaagggaatttaatggtcatttattctaaccacctatcctatacttggatcatgtctacagtgttcctttcaagttgtcatccagcctctgaatacctccagtgatgtcttacttttgcatcctggtctctttttgtatttataaacctctcataaaccctttctgtaaaatagggaatcttaaaatgtgaagcagaaaaatcagatgattgccatcacttgaagcatatataagcagcactaaaaagtctgtggagacattgaactgggtacatcctctagatatttctgtattttcatagctgctataatcaagaatgtggtttccagttcatggccgtaagtcactggttttagtacatagtcataaagttctttttcaaaaatggataaggagacattgcttaataacttagagatcacaaggacgtttctctacttattgattctagtgatgatacaaggacttcatgggaaacctttatatgtgacctgatcctcaatgtaaaaagagtgaaataaatgtgaatgacttcagactcctggatctagtttacatataacttgcacttattcatgagtcatgcttaaaggcatggtagtttgaattgtcttttttatctgaccaaaagcatttaggatttttaattcaccctttagacttaattttgattcagtagagagtgagattagtcagctgagagaacacatagatacttatgaggcatgattatacaatcaagcttttcaccagatttacaaatggtttctccttaaatccatgattctaatgtaaaaaagtctctgtcaaggtttttatcttaagatcattaagtttttaacatccactttattatccatgaagtcttctatgatttagtcatcaccatgatcagtatatggagttaccaagtttcactggccatggcagcagtaacctggaaattcatagagcctagcccttttctgttactcaaacttgaacccgtttttctatttacatcagttgcctatattacatagaaactggcgcactttccttctttctcagtaggtaacaaccagatgcaaggaacatcaaaaacctacctttattggggagaaaaaaattctcgaggtctgcccatattttactgtgttccagcgatacccttaattagtttctaatagtttaaatagttggttaatttcttagatctttgtcctggcatgatgagctcaatataacatctgtttataccaaacttataaaatataattagataatatattgtaagttgtattctgtctttttcttcaagtaatatgtttactatcaattatatgcagagtagtgttgtaataagtagaccctggagatggacagtttctgcttttaaggtttaattcaagagaaaggaacatttgataaagacaaaaaaattatggacgaatcagagaagtggagcctgttggcaagaaaggaagaaggctaaggaaaatgtaggtggagcattccatctcaagtgacagtcttatctctggaatctaaatcgatttaacaaatttcaggtcatgatgtaagtgtagaattcatcataaaagatttcacacaaactattgtaaaattctgtcattcaccatgtctaaattattagaattattacctaaaagaattcaaggacatgaatctagactgaaatgataaaaacttagatgttaaactttttgtctctgaaaatgtgcctacttgagtgcagttttgcttgagtgaaaaaaacctaatgaccctttagattttatagtagtgctattttttactttatgtcagaatccctttgaataaggtaattctaaagcagtgattctcagctagggtaataatttgtttaaaagcaaacaacacgttataccacttttcttatttgcttttagtaatatttattgttgaattttcatataacactactaaaggaagacctgggatatttttaaatactctttttggaaatttttatttgaattaaattagttatatttcagtgggctttggaaaaatttcccacagtaagttaagattattttactctaaataatgaaacatcgagatcccaaagaagatccgtaagaatgttattaatgtccagtccacgggaatcctgtgtttaatatgccttgtacaggagaatcgcttgaacccaggaggcggaggttgcactgagcagagatcgcgccattgcactccagcctgggtgacaagagcaagactctgtctcaaaaataataataataataataataataataataataataataataagccttgtaaatgtaaatctcaagtcaaacaatttttattaacatatactttgtggctgcattaaatctttaacatttaattgaatacaaaaaatcaattaaggaataactaggattttattttgggtgaaacataaatataaaacctgtttcttaatactaatcataattgatttttattcatgtttcactgccttgggagattaactcttatttaattttcccaagatacactgggaaagtagaccttataaagtgtcaaagtccaaattgatccaaatgataaaaggaactaattgggttgttgtgtgtactgttgtaaacagtctcacataatccttatagccgtcctttaagatatgtacaactgtatcccattttatagttgaggaaactagtttcagtatgttaacttgctaggatcaccccactagtaagtggttggagtttggattaaaagtcagctagcctcacgcctgtaattccagcactttgggaggccgagacaggtggatgacaaggtcaggagttcgagaccagcctggccaacacagtgaaaccccatttctactaaaaatacaaaaagtagctgggcatggtggtgcacacctgtagtcccagctactcgggaggctgaggcaggagaatcgcttgaacctgggaggtggaggttgtggtgagctgagattgtgccactgcactccagcctgggcaacagatcgagactccatctcaaaaaaaaaaaaaaaaaaaaatcagctagtctaattctaaagtctatgcttttaagccattttattattctgtgtgaattcaactttttgcttagacaactgctgagtgagaaactgtcttacccctcagaatgtctgaccccagaatgaagtggagaagaaaaaatactttagacaagagataataaactgaaacgtagacaactttaattcttcagggcctgtatttagagtgttgcctttatatttgttgaaagtgaaaaatgtaatccttggctgggtacggtggcacacgcctataatcccaacattttgggaggccaaggcaggaggatcacttgagcccaggagtttgaaaccagcatgggcaacagagtgagatctgtctttacaaacaagtcaaaacatttttaaaaagaaagatgtaattctttgctcaaacccaagccactataattttaaaaaacattccaaatggaaaacattcattgatttattaaaaataaagactaggctttccccccacccccaatatgatatattctgttcatttcattaaggaatgatggccatgcttgtgctctccctttagtctaaatcagaatcaagcaactgtctctttaaaaaccccatgatattcttctgagtttagccctattttgaaacggtcccttgacaacctttatttattactgtacttggactttaggagacagattaggaaggagacttggtagcaaagaaaaattagttaataactttggagcaaattctagtcacgaaatcccagtgactagcctaatataattttactttgtcaaatatattgttcatagaattatgctttttctagaaagctattttaactaacatttctgcactttcaagaaataggcataaagaaaagaaataggcaaaatgaaaagatgagcaaaaattatgtgcttttcactggtatttggcttttggtatatacatataccaaaggggatagtctcatttttactttagtcaggcctcactgtagaaatgggattgagaagatatttaaacaaggcgtctaaacaagaatgactttaataaaaagaaataatatgttgaatgcttgagaaagaggaggcaaatgtgaggccattagatgaaaagaataagtagcattcctaagaatagtttcttcccaagcccatctttttccatgactctttacatgttagtgttctccagtgttttggccccacttgtcttttcattgtttatgcaagtttgttttctcctatggtttgagtcgcctactgcattcttacaactttcaaatctagacttctaggccagagattactctggagttctcaatacctatatccagcagccttctctctatatttctccaacaggattctacatttccatgtctccaaattcagtagtcccaagtgaaacttaaatttcttttctcgtctttatttgcagtgctttatttgcaccacctactccccaccccacttcatccccccaccaaatctagccacctttctgtgatacaccagccaactcctagttgctccaagaataaagccccaggcatccttagcattttctttgtcacagatagtctcttttccttatcatctcactgatctctcaagattctgtatgcttcaattgaaacttgaaatatgttctaatccctctcaccctgtttttcctctgaggtaccagtgtacatctaagtctaggtaactgtcagtcttacactatttttccagtcaccaagaaataatttaaagtagcaggtattatagtgtcgagtttttaatttgggcttacatcccttggtatgtattattcactcctcaataatgtgctgtcatcagattaggtagttgctgctatgtaaacagtaaaatgaaatctctttcaagagagcctgctctaaatgttaagtacttcaatatcaaggaaaatgccaccctcctcatacccctttctcctgtcctttcttaggtcttactcagaggaaggaaataatcttttcaacctgttaaactttgcctattgttagtctattaagaaataatgatttcatctaataagaaataatgctacgtaggatgactgcttcctgtaatcctagctactcaggaggccaaggtgggaggattgctttagcctaggagttagagaccaacctgggcaacagggtgaggccctgttgctaacaacaaattttaaaaatcagctgggaatggtggtgcacacctgtagttccagctgcttgggtgactgcgactgaagcaggaggattgcttgagcccaggagtttgaggctgcagtgaaccatgatcatgccactgcactccagcctgggcatcacaagaccccatctctataaaaacaacaactagctagcacacaaagtcaagtatcttaaataaatgtaattccatattattataacatttaagtattaacttgaaataggatattaattaaactttgtttggaatatttggactgtaatagtgaaattgctgtgcaaattttacttttgtatcagtcttcaatttctccagactaaattcttatctcttccattttgaatgttttaatagatttttagttcagctagttttaaaacgaagtttctttaaaatggctctacaagaaaaaagtaattttatcagaattttactaccaaatattaaaatgatccccccaaaatatcataacttggaaatgtgaaagagatctggaaaaagaagataatgttaattttaatcttgtatatatatatatatatataattaggggataaatttttaatgtaacatttttattgtgtaagtttacatgactttttgtattatagatctttaccacaaatttttaccatttgcttaccagatttactttgaataaacagaaatcgctgtactgggagctataaacataatttacatcacattctcagatggttataattcactctaaaccaagaaacaggatttttacaaatcacaaatatcacttatgttgatcattgttttgtttgttgaatatagtaccttatcttgcagaatgaaatagttgctagagaaaatagagttggcacctcttccctcctttctccctttcctattttctgtcattgcttttcctgtctgccatttgttcatgtctggagtttacactgtaaaagataactccttcatgagtcattttcattttggaacatgtttttcattgttcttcaaaatgtagtagaagtactcttgcttctatctctgtcctgcatctgcctgccttcccaaacagccactttcttaatgtgtgtatatccttctttatgtgtatataagcaaatcaatgtatattatcttctttaatgtaaattataatgtattgtgcacacatctgtacctttacttttaaagatctccagaatacattgttcccatctcagtactagaaaagtatctttgtggttttttaatagatgcatactatttaattgaatggatggctacaccatgattcatttaaccagaagcattgctgttataaacagtgttgtaatgagtagccttgttaacattatttgctatgtatataaaatatctagaggataaattccaagatgaatgattgctggctcagagagtgaataattaaggggaggtcgggagaggagagaaaaggagagaaatctgttttggaaaatagtattacattatagttttaatttgtatttttattttatgattcagatgttgagtattttttcatgtctttcttgttaatgttcagtgtgaattctccccatttttctattgggcatctggtcttaacagattttaggaaaatttattagagactttttaactttaaaaaaaaattagacatgcagttacatagtcctttcccaccaaagtattaaagaaattctaattaaatgtgtttatttaaagttcttagtacagatgataagactgactctagacaaagggggtctaaggtaggagatggacttcatatagattgcatgctctttaatctacgctttactggctagccatttgactgaaattaacaagataaatataaaatatgctgagggcattggtgaacaaggtttttgtagaagatgctgacaataaatatcaatatataaatatttaactgagtttttaatagttccttggtaaaggcattcatcacaccattgcgggactggctacttgagaaaaagtaacacttaagttttgtaagtagaaattttacctgcttgctcaggatgaataatagctttaaaataacttattttgtgttactgctaataataatctctatggggcattttgggtttttttttaatcatgaaattaaacattatttgttttacattggtagaactgatggtcaataattagaataacataacattttgagttcttagtttaatttattattaacttcacccaagttttattcttaaccatagaggtttgcattcagccagaggttgtctatatgaattttatttatttaggcccttttgaaaggaaaattgttatttgttcttaaattaagctgtaaatattttttagtctcctcttacagaagagtggtggatttttaaaattatatttaacctcacaagtttactgaactgtagattgattagatttattcctttgtaatcagtgactcgcattttcttaattttctttctaaaaaaataaaacatgcatttgttagagaataggcaaaatgttacccaggttagaattaatgcattttagtagtaatgatgttattacagtgcttattttgggagatgggagtgggtggaataaaagttatagatgatttactggaaacagtgtatgattccttaggactgcccccaaagaaaggtatagcttccttctacttgtgagtttctgaagaatcagttttagttggtttgggcaagggggtgtgagcatgaagtatgccaaatttaccaacttaaaggagtttgtattacaaaagatttgattgtgtaatttggagagttcctgtagtgcatttatagttgtgattgtaactcaatgcaaagttagaggagtctttgagtaaagcaaggcatttattttatttatttattttttgcagtattttaattaaagatacataaaatttttaaggcatcttcagctttctaacaaaccagaagaacattttcgttcttagcaattaggtaaactgtatcagctataaaaagatcactaagcaagtgccttttctaagaggttccctcccttattctcagagctgaacctcttctaggaatttgccagataagataaatggcatattctgagcatggtttaatctttggatccatgcttatggtttcacaacttaacatttggtacttagttaaagcactcttaataatacacataattctggatttatttcaggtcattagagattattttttcacagtcttagtattatggaagaaaatatgtgtgttttgacattaggtccaggtttgaatcctgttcctagtattgtgtctttgagcaagttacttgacctcactttcctcaactgtaaaatgagaatgttgctcaggcttattgtaaggactcattaagataaaggtgtgcctgccctaaaatagacaaccattaagtgttcttttcctctatcttgttgatttgttaattagcatttatatctagggaaagacaaagtagtcaaaatatgtccattttgaaaaagagaagtagttctcttattttttttagagacagatctggctctgtcacccaggctggagtgcagtaatgaaccctgagctcctgggctcaagcagtcttcccacacagcctcctgagtaactaggaccgtgggcttgctttcttttctcttttctttcttttctttcatgggttctcactatgttgcccaggctgaatttttttattttaaataagtagtcaccatgtctctgtccacattactacagataaagaaaaaagttggtttctcatagttttttaaaaatagagatcaaggctgggcgtggtggctcacgcctgtaatcccagcactttgggaggcgaaggcaggcagatcatctgaggtcgggagttcgagaccagcctgaccaacatagagaaaccccgtctccactaaaaatacaaaattagcagggcatggtggcacatacctgtaatcccagctactcgggaggccgaggcaggagactcgcttgaacccgggaggaagaagttgcggtgagctgagatcgcgccatttcaccccagcctgggcaacgagagtgaaactctgtctcaaaaaaaaaaaagagagagagattaaattagattacctttttctttagtgattttaacttgtgacagagttggaaattcttcatccatcctcttgctttctcagtaatgttgcaagtaatctcatggtaagagtaaggaaacctaggaggaaaagctgtggtggagagccagttaggatcaattaaaagatgaacagcatggaaagccaacctgccttactgtagcattgatactctgagttatactttttctgtgagtgtaagtataattagctttaaacactgaattcaagctcatttagttattttggagcagcaattccagtaaataaatattttcttgtaggtctttcttactttccacagctctatatttctgttcattctctccatatccacaatttttaatgcatctgtaaatgctaataaatgtttgatttttattctaagaatgattcatagtaaatagaaagtttatttttaaaaattatcttttgactttatttagcatttccagtttaccataatagtttaaaaaagaaaattctgaactcatttttccctcatgcttctgtagcagtaattgtaacacttgatttaaaattgacttatttcagtttgagtatgtatctatacatacacactaatctgaaatatttatactaccaccattgtagggtaccgggtatatatactttgtgctggaagtaaagacaggaagccttttcttagggagcttaagtttggaaactggttaaaccatcaaaatataatgtgctgaatataataattaaaaagaaaacaaggtatatagtattataacattaggtgaaggaaggaaattattgattctgcttcagttgatctttctcattttaaaagagtcaaatctcactatgataactttgaacataatagaaaacatcttgataccctcattgaaacagtatttttaaaccatattctgggatcttgaaataaaatagtctcttatttgcttaagactaccatattggtatctccatcgtaaatatggctaaagcagtggttctcatactttagtttctatctgaatcgcctagagagtttgttaaaatagattacggggccccgccccaagagtaaatctggggtgggtccaaatatttacatttctaacaaggtcttggtgggtccaaatatttacatttctgacaagtttccaggtgatgctgatgattctggttcagggactacactttgagaactgatttatctgaactcaaaaaattttaatgccttcctcatatgaaccattaattgtttcaaatctatcatatctaattactatcagtatgcattgagttactatgtgctaagcactgaattcacttattcacaaagatgaagaagttatggaacctttctcaaagagctcaatctaataggatcaacagtggtagtattacaatactcaaagtaatcactgtctgtattgagtgctcagtgtgccaagtactatgcattatgtaaactcatttaatcctcacaattggcatataatccttattttaaatgaaaaaactgaggtctagaaaggttaaataatttcccagaattcatatagtgagtatatggaggagccagaatttgctattctgcctttttgcactataaaaagtttgcgaagattggtagaccccagaaaggatggagtaattggctctaccttagaaaatcaaacagcatcacagaagagatggcactggagcatcttaagggacaggtctaagatagccagatgaattggaactgtgagcatttccagctgagggagcagtttctgcaaagccaaggaaacccgagagaacatatgttccacagactacaaatagttgtataagaccataacacaataggcagatggagtataagaggaaaacagactgtataaggcagaggtcaaagtcataaagaattttatatgccaggctaaaaagttttaaaaatagaattaggcttcttaatttttcctcctataactttcatttgtaagccagcagttctcaaagcatagtcagacagtagattccacatcatctgggaacttgttagaaatgcagattcctggttccatgcctactgaatcagaaactctgagtgggggagcccagcaacctgagttttaacaagacctccagatgattctggtgcatgctaaagtttgagacccctgcagtaggttatagaattcttgaataatagccttcaagatagttaaaggtcactatagtggtagtaattatatttgacactgatttattctattagagtacaacacctaacagttgaaatattaacaccatttaagggatacatcttcatcatgatctatttataccttgcaaacctgtttcttctgttgtcataaaagagatcttaggacaagagtttgttaggtcagcattcaaagaatagcatgctaactattcttccttagctatgggaatcattctaaaactcgctgactgattttaattatcaaaaaaaaaccccagtaatttttgttttttttactgcttgttaatacataaaactgatgttgtagttagtatttaaggtgtgctatttaaaccaaatgtgttgaaggaatcaaatgatttaagtcatgacatgacttaaaagtaattcaatctttccttgtcatgtcaataaaaatatagaaagtataatctgggattcccaagcaaactaatttaaatgcctgtcaccgtcttttttgccaaaatgtgttcagtatttgtggtgaatatgtctgcatggtatctggcactgaagtatatactaaagcgttatggttgacttagtggttctgtagtttatagttacatatagtcatactttgcacagctcactaaaagcatttaaagcccagcacatataaagtatttgttaatgatccataaatcctttctagatattagatatacaaaacctcttttcatcttagaaatagtagcagcaagaagtgaaggtagtatgctgtaattaatgtggttaatgctcaaataaacaaacgtagtttcccatgtaatgattcaagatttcaaggatttagaagtggaaagtccattgaggcattgacatcaaccccttgttttacagatggggaaactcagatccagggaagttaaataggtgatttgctgatgtcccataggaagtgaatagcaggatatcacaggacaggatatttctgagcctcaatctgatacaacattatgggtccacaccatctaaagtaaagtagtttccaggtattttagcactaaaatcttaggtggagtatactttatgaagaatatttagtaacatataaaaaattatcttttcgtattgatacaataagctacagtatcagatttttctttacaagagtaatttttaaaaacctaataactgtttttagaaataaaattcattaaaaaacaataaaagggtataaattccagctattcttactacttaatacatggtagaatataaaccaccaaagaggacaattagccttctgtgttattatcatacaattgctaaggtgatatttgaacttggaatgtgcttacaggctggataacttttcagttattcccaagaagaactgatctaaaccacacataccttataggtgatttttgccagcaagtaacctacagtcaaatacatgtaggtctgccagaatgttgtttctttttgttttttttttttttgtttttttttgagatggagttttgctcttgttgcccaggctggattgcaatggcgtgatctcggctcactgcagcctctgcctcctgggttcaagtgattctcttgcctcagcctcctgagtagctgattacaggcacccgccccaagcctggctaattttttttgtatttttagtagagatgggttttcaccacgttggccaggctgatctggaactcctgacctcaagtgatccaccttccttggcctcccaaagtgctgggattacaagcgtgagccaccacgcccggctgaatgttgagtttcttgttaaccaatcctacccaaagactttctgaaccatttttagaagccattaagttttttttaaaaaactagatgttaaagtataaaacttataccagaaaagtcttactaagaggagggactagaaaaaaaaaagtcaagccatcatctgaattttactacaataagtaattattggaatttctacatgaaaggcaattagaatgtatagttggttaatgtagaaatttaagagatacggagaagacactgcccatttaaaatgtatccttttaaaaccactgaacagagaaattcttaatacaattgagagttagttttaaagtagcatacatgtattacaggcaaattagaaatgttggcactacaaaggacctgtagaaatcatctatttactgagactttcattttagaaatgagagctttgagtactgaaattgtcagaacagaataagctattttaaattactgtatatttggttttaagtgaaacacaaatgtcttttacattcttttaagagttggaagggaggttaaattttttagaataataacatattctaattttttccagtgcatctgggggaggtgttgtagccattgacaacaaaatagaacaagcaatggtaagtaaaagtttacagttctcccatttcatagattgttggttgtatggaacacttagcttttgtcagttttagaaaacaaataagttatttaaaccaaagatgaccaaatcatgttttttgataatgagatttagttgaagatgctagaacgttgagaacttttagtctagaaatactatttaagtagatatttcttccatttgaatatctcacatttcatgcattatcattgataagggccattggtgagggggcatacatatttaaagacaatatgttccccagatatttcagcattgaaaatactttagagtgaaaaagagtattaaagcaaaaacagctggaggtctgattgaagtagactgtaagtaagctataagtaggccaggcacagtggattgtgtctgtaatcccagcacctgagctgaggtgggaggatcacttgaggccaggagtttgagaccaacttgggcaacatagcaagaccccgtctctacaaaaaaagttggtatttttgtttgttttgagatagtctcgctctgtcacccaggctgaagtacagtggcatgattttgggtcactgcaacctccacctcccaggttcaagtgattctcctgcctcagtctcctgagtagttgggagcacaggcacacaccaccacatctggctaatttttgtattcttagtagagacggggtttcaccatgttggccaaggtggtctcaaactcctgacctcaggtgatctacacgcctcagcctcccaaagtgctgggattaccggtgtgagaccttacaggactgttagtctcaaactatttttttaaaaataccaaaattttaaagtccaaaattacagatcactttaaagcagtactatgactagtttaacatcaaacagctttccgttggaatattgttcctttgttctctttatctaccattttaagcatgtgattttaaactttttttttttttaattctaagcttagttgacaatttaagaagctagtattttttggaaatcgtcccaaactttgaaaagaaaattctgggcttactgctctggttgggaactggattttttccaacccatcttccataggctcggtcaagataaagcagaaacattaaaagcaagagcaggaaaactagtataaaaacttagcaccaagtaggccagaaccagatagcaccacctttatcttttcactcttttgacattcctaattttgtttttcacaggatctggtgaaaagccatttgatgtatgcagtaagagaagaagtggaagttttaaaggaacaaataaaagaattagttgaaagaaactctttacttgaacgagaaaatgcactgttaaaatctctttcaagcaatgatcaattatcccaactcccaacccaacaggccaatcctggtagcacttctcaacagcaagcagtgatagcacagcctccgcagccaacgcaacctccacagcagccgaatgtctcctcagcataaagctttcttaagcctcattaagaaaaaaactgaaagcaatctatccttgtgtgccactggtgttctttccactttatacgaaagcaagtagccatgctttggttgtgtgtttggccttttcagtattagacaatcattctacaagagcttttcctctctctgagatgtcatgcagcgctgttgatgtccagttctatgtcatcagtacacaaggagaataatagatggggtttattaaagcgagcaaagtctgcattttacctggtgcgcatgagtggggtctttaagagttttggtggctctcccatgtttcctattacccatggatttaccctgagccttcctatcacattataaataacagttcatctaaagagccacttttctttctgattcagtaacatttgcctacataagttttcatttatttgtgttttatttattacagggctgctattttcataatgtacatgaacaatgtcacagaacttttttaatttttttgaataattataagtatcagtaaaggaagtgaaagacaggattgcatttaatagataaaacgtttaggcaataattgaacaaaagaatcctggcatatttctaacactaatggcaatttacttatggtatttattttcagtagtaaagacccagcttgaatgtaaattttgtatagtgtaagtatgaagaacatagtgcaactgtacaggtagtcaccagttattgtgatatgataaataattgggctattttgatgaagaaaactttgttcatttgtttctactttctaagagaaattgccacgattcctctgcttttcaacatttcgtatgacttttttttcgggtgggaataaaaagctgtgaaattgttcaacctactttgtaaccaaagaagcaaagctgtgtaatggagtttggtttttttttgttgtttttttttttttgtctttttttttttttataatgcacattctttatgtatttttatttagtgttttctcagtcacaattttctttactgtctagcatgatctgcatgacctataatctttgaaccactttcgtacctcatgtttttatccagcactcttattgtaatatgtactagtctgtgaacaatgtcaaataaaagagaacgaacaggtagtttggtggagctgagctagtgtacaatacactagttgtaaaaaaaaaaaaaaaaaa

SEQ ID NO: 120 - DNA, 764 bp, Homo sapiens
ggatgcagagacaatatcactcagaaatgaataacaagatcagaaagagaggaatggaaaagaaaaaaaaacaaatggcaaatgaagaacattcactggaaaaatgttgccacaaaattgtgccaagtagatgccacagttcaaaaagtgtaatgaagctgccacttgtatataactaaagcttaaagggcagataagagagaaggtgagggaagtttggccagaccacagaagaaggtaaaacatgggcaggtagaacaagaggaaataaaaccattgcagaactgaagtctcagttggaggagagtgtatattggtgtaacctcaagggaaggtaaaatttcaatattgacaaattaaaatttcatatgccctttgattcagcagttccacttttaaggatttatcctacaggcatttccttgcaaatgtgtgaaaatatatgttcaagtctgttaattgtattgacatttataacagcaaaacttttgaaatgacctatataatcccttaaagagactcccttaaataaattttgggttacccctcccaagggaggtttttggccacccttaaaaccttaaaaaaaccgggggggggacccctttatggttttccccaaaataaaaaaacctcttttttataaaaaatattaagggggcgccccctttataaaaaaccgggtgtaaaaaaaaaactcccccacaaaaaaatatatatgttttgtgagagggggggaaaacacacaaattttttttcttgtt

SEQ ID NO: 121 - DNA, 71540 bp, Homo sapiens
aggaggaaatttgcaagaggcggcagcccctgagcgcccagagctcttgaaaggccacccaggagaggtgtgagacccggcggcagcatccgtccaggtgggacccgctgagcgccgtggccagtcccccattcccatcccggcaccccaaaggcgcgctcgcccgattgcttcgagttccccgacctggggattttttttttagccgctggtggtgggcgcctcgtgggctaaggcccggcgcctgctctgctacccgcgctgcctttagcggtcgcccccgccgccgctgccagggacgtgctgggaaagcccaagccccgggagaagatgccggccatcctggtcgcctccaaaatgaagtcgggactgcccaaacccgtgcacagcgccgcgcccatcctgcacgtgcccccggcccgggcgggcccccagccctgctacctgaagttgggaagcaaggtggaggtgagcaagaccacctatcctagccagatccccctgaaatcgcaggtgctgcaggggctgcaggagccagcgggggaggggctcccgctgcggaagagcggctcggtggaaaacgggttcgatacccaggtgagagatgccgtttgccggggtactgttctggaaggatggatgaatagttctttcgggatggtgtgggagaaagggctggatgggagaagggtctaccatgtggccagggaagggaaccattccccttaggccggcaggttgggggatgcgcgaggagagtgggccggccggtgggtgtggcccgggtgccggaggtttgccttaagagctcttcgagacctgggatggcgggcacgtctgcagcatcttcctggggaggaggaaaggtcgggatgttctcaaaaaacgtgtgcatcgctggaaatgtgaggtcctgcatgttgaggtcttggccccaagaagccagtatccgcagcagcagctgtgtgtctgtctggcggttccgcagagattctgttccggacaaggaatgatctaaggccccattgggttcgacgccccctagcctggctgtaagatccaggaagaaaaggggatcgcgggtggcagtgaacctgctcttcccttggcttgaagatgacctgtccctgccccatcctgcggggtgacgggattccgggcaaggtgctgggactgcggtactagtgcaccagctgaggccggcagctggagactcctagcgccttggctggctgttgcggtgggggtgggggtggaggtggctgcctcagaatggcggccgaagctaagcccctccttcctgggtggtagatcctggtgttggtagcccgagtgacggggcgtggggatgggagatggcttgaagagaattggtgactcctacctttccagacagagcctgcatccagacaagccctggccgtgcaatctcttttacagaaattagcaagggccaatcaggttctcttggtcctccccgctccatttcccccttcttctggtaggagggggctatattttcttggcagtcagtcagcagggacttttggggacaggccgacctgacggatgtgactgtccggttaggagaggcgggaagccagaggggaggtggtttggggctggtgtcaggaaaatggcaacagaccagctgacctttttggcacatacttccctgctgacaccatctccaccttctcctggagctttctctgatcagaggctagagctcaacacgttcctaggctttctgatgcgggaactggagctgaagctaattgtaagcagacttttggaactctgggctggagaaggccctcaaagcagattaagctcccacaccaggctgataagcatgccccttgctgctgcacttgctaaacatttttggaagctgacaggtttgagtgatggtgtgtgggaggaaggcaagatttcctccagtgctccgggggcctgcctctgtgagggttttgtgctctgctcttcttctgttgttacgtacaggatttgtccagtgggctctgccatgggggtgagcaccagggtacacttctgcatggggtttcccttcatccatggacttggggtttatgaggtgtagtgggcagtcggtgggaggtcagtacagtgactcgggactggaggtgacacataccctcgagcctgatgaggagcacccgaggaatgagagggaaagtccatgctgggattgttcatatccaggcagctgttctgcctttgcccgtttgacccttcatttaacaaacattgtcagaggactggcagtgcataggctctggaaaggtgattcatcaccctgtccgtgaaaaaaaatgttcttcagcttctctctgaggggctggaacagtccacttccctcaagactttgcttccctcttttgcccttggtccataatccccccatttcacctctctcgccctcaatgggcccttgtgtactgatggtgaacatagtttggatggactgctaaggaaattggccacttccagtggactaccctgatttttacctgcctgccctcgtttgccagtgcccaggggttctgggggctcttccctgtggcagatccctgtctgcacagctgacatcaaagtgattttggccaatgggattttaccttctttgccagggcttctcccacagtctgcctgatagggtacccattccccctccaaaacagtctcttggttatggcatgaggactgtgtctgactggccatctggtagtttccaggtcccaaatttggtatatattattagaagatactcaggaaacaatgaattaaatggcaaatgctctcttggggcccctgactccccttttattcaggggatttttggcaggagattgggttgtgtagtggctgataacatagcttttaaagtcagatgggtatcgctggtgtcttgcgtctgtcatatactagctaggtgaccaccttgattaatttctttgggctttagtgttctcatctattaaaaaatgagcatgaacaaccattagagttgtgagcattaagaaaaataacgtaaagtgttcagtgcagtgtctggcaaataaggaacacttaataaaagtagctatttatattgctaacctaagagatggggcatgctgaatcaacattaatagcccgtaaatgagaaaagatatggcttattctctcaagcccctggaaaggtatcaatctgttccaaggatctgtagaacatctatcacctttctagtacagtaccaggcagaacgggaagatgagggaagggcatgtccactttctgagtgcctgatgggtgaggctctttacatataatctcatttcatctttacagaaacacttaaatcaggtctgatacatccattttctatgacagtaacaacatggtaacaataataacaatggtaataatggccaaatccttatatatcactttctatgtgccaggaattgttctaaggactttacattaaaaactaattttattcttattacaatcaaatgagataaatgttattatccccattttacacatatgaaaactgaggcaaagaccagtttggtaactttgtgagtagcaaaggtagaattagaactcgggcagtctggcactagatcccatgtctttaaccatgatattgtacagggagaaacacagagactgtcttagaacttgcaggccctgatttataagaccattgctgtaaccattgagctagatgaggcttagcaaggtacagccacttgctctcggtcatccagggtggcagggcagggagtccagcaaggttggtctggctttgaggcctgcggtcttcccactcttcattgctttctttttccatcctgctctggcagatctacgaggcaaataggacatggcctgggccttggggattttataatctagttgggaggcataactgatatacacagggcaacagggcacaacacagggaggcctcagaggcatgcttggggctgggtatccaaggtgctcaaaggaaaggccaagatggctggagaagtccagagagcctctggaggagacagaagatgagctgaattttggagatgggaaggacagactggtggggaggagaggaagtcagaatgaatgtgatagtggagaatgaagagcaaggtcatgcagtggtaccgagcagttgatgttgcttcatgcaacaagtcattgctccagatctgacatcttccctttcaaaaggtgatgaagagaaagaacaaaggctttgcagctgaaggattggatttgcatgttggcttcctggtggatcatcattctgaatgtgcagggtagttgtgagaagatccggagagggtgtccgttaaggacctgattcagattcataacagatcattgggaaatgatggtgattattatttttagcttggggttcagaatattcaacgtggtagttacaggggaaaggaggctattctgacaccttgttttattatgcagcaactttcttcagccagtgacatcccattgcccctaagcctgctcttcatctccatcaagtgtgaaaagacctaacttagccagcaagtagctgttaggtacagccctactgtcacccacccttcctccaggccccttaccttgagtctctcccataaacctacagctggttctcccccacccacccccacccttcccagtgcaggaaactgtgttctgcagcagcagcacacctcccctgaattaccttcctgggactgagatacctgtgccttcccccaagtatgaacatttatagcatctgctctgttaacatgtgaataaattaggaccatgtgcagagagctgttttaaagacacgctctgtgtttgttcagaaactctctctggctgaccttcagataagtaacatgcctgagctatttgaggagacattagcctatttttaagaagcagttgcaaggaaaaaaagaaaaaatatatacatatataaaatattttgatatttcctgtttttagcagctggtgttcaagttgcacctagtttttttaaaaaagtaattagaagtgattgaacttctctgtgggtgttttagatgttgaaaaagaaagcatagaggaggcccctgggaagagagcgcagctctaagcttacaacctgtggcaactttgctccattgtgttttgattagaatccttgctccatcatcaaaggtgattatggatttgattagtgcatttttctgctattgtgttactccctttcttctctttctcagttcttggaggggaatgtatagcatggttatctgccaacatgcaagaatgtttatggttcacatattattgcttactccatgggttaattttctaaagacactttaagggtggtactggtggcttattcagggtaacattacatgtgtatatatctgtatataaatacatctacttctggatatgtgtatatatgcatatatacacacagataacacaaatatatacacatggaacagcttaaagtattgagcacatataagcacacacacacatcaaaggggaggctggaggagttacggcccaaattctagctttcagaatagctaggtttgctttccatttctcattctctcttcctctgtgaccaagatctgaagcaccaaatctgggtcccatattatttacttataagatataagggatgtagccttcagagaggtgttttcatgaggccccagtggaactcttggaaccattctgaaaaagtcaaaccacccagcgagattttggcttaaggtcagaaattcttagttctcagaatccgcctcagcagcagggaagggaacatttatggagcatctgctatgtgccaggtagtctgcggagctctttatatagatattatttaatgtgaggcacaagaagctggataaaatggaaaacggtctgtgcattttttgtgagaaagcagaggccaagggaggttatcacttggaggcagttttacgtggtaaattcgactttattgagaggtcagagtttgcatctaggctttgggcaaattatagaacatccctaaacttcagttttgtcatctttgaagcagaaatggtgatgcttataggttgggggtgagggttcagtgagatattccaggtaggttcctgaacacagtgtatggcacatactaagctaggaatatatagtattgcctatttttgttacctaaggtcagatccaagtttggaaactatgtctgcctcattccaagctcacgttctttccaccctacctctctgcctcccaagtacgcagctgagtacatgaaaagacagacggcttgcaccatgaaagtggagggcatagcagggctttggttagatgaatgggtaaattaagaacaacgtcatccaaagaagtcatatctcgagttgttaattgaaaccttcacaggttggtcccagacatgccatctttataacagtaaccaagctgagggatccgctacaaaccaaacttgtgggaagcttcctttgtacaactagtctgaactggcactgtagaggtggttgagtggagccggccaatctgagggcctagcccaggacaggaccaagaatggaacattttcattgactgggcttcttaatggttcctcattgttctgagggcagaaggaaagcccttttttctcccagcaggcatggttgtaatgagagctggaccttgtgatcagttggccattaaggtgccccaaggcatggccagctgcccaatggtgctttaccaataaccacaggccaaattcaatgactattctgtctcttggtcacatttttcaaagagatggacaatgtgttcctagaatggcttgggcagaatgggccatgtgattttgggaacaaaacttagctaggctttttgtgctttaatctacacaagacaatagtgagtgacacaaagttttttgcaggaacccccattcgcccacacagagccagagaatgactcatggcttagtgccccctttcccagggaatacagatcctctcttgtgttttgcaaacaatgggcccccagcctcagaatattttgcctcttcttccaagtgaaacctcaacaccttcagtgaattttgggttattccaatccttccgttcatcttggtgggacagaggatagggtagaaatggggtcttagtcaagataattgtgatcccactttcagcggtctttggaagactttgaacaaaattagctactcatggcaatgtggcactttaaaaataattataatactagtcacggatatcgattgagcacagcctctgtatcagcataatgcatagcaccagatatgtatcattcatttaatcctcacaacatcccatgaggtagatgctacttcctgaagagaactggaaatgaccactctaggacttagcaactttggttctaattctgtctctttagtcaccttgctacatgaccttcaacaaatcacattttctttctgagcttcagtagcctcacctataaaatggagaagatagtacctgctgtaccttctttgaagttactatgaagattaacacaggtaattattgtgaacaaggcacctgtttaagcatcttacactttaggtagcccttgaggaaaccagggctgacagaggtgaagctacttttccaaggagcacagctggtaggtagacccaaatatttgaacgcttatctgtttgacctttgaagtcaaccttcttaaatagcaagtgtgaaagcactttgaaaaaatatctgaaaaaatgctgttactactgagtctaagtaaatcactttcaaatttcctttagcttggtaatacatatgccatttgactcctccccctgccctagagtttggaaatattgaaaatactctttcaatgttaagtaagtattagttgcttatagttgcttaatcatattggttgaacccttttgggatgtttaaaatttcaagtcctctgaggccacaaggcccactaaacgtcattgttgagtgttaactggccgggctgattctagacagaggaaggagaaaatgaggaatttgattcaaaatcacttgttggcatgaggaagcaatcagataagtttagattatgaatcattatttaagacaacaggccagggatcttcaaaaatgtcagtgtcatgaaagacatgaaaaagttttaaagcaggtgaaggactcttctagaaaagagtaccaaagctatgacaaccaaatccgatgagagattcttgagtagctcctggatgaggaaaaccataaatgctacaaaggtcatttgtgagaaaattggagatatttgattgtagattgtgtattagatagtattattctatccatttcaatggtattggggttatgtaaggaaatgtcctttttcttgggagctatatgctgaaatattagaagggaagtatcttgatgtcagtaagtaacttaactctcaattaggaaaaataaggtgagaacatctgcagaaagaagaaagaaaatgcaaaatgttaacaactggtgaatctaggcaaagatatatgtgcacgtctttcaacttttctgtaggtttgaaatttttaaaaacaaaacaaagtcctgcctgaatagtatttgtcaccgatgcccctgatatttatgagaacataaatgaaataggagtgtgtgtatgtactcacaatagcctggccaaatttgtttcatgaggtttaagttctggactctttatcttctttctggtatagtgtgaaaactttggcttaattccttgttctttcatgagaatggttgctgacattttctggaaataaatcacaagattcagtttcatttggtaatcttttataaaaatctaaggtgtttccaaggttgcaaatacaaaataaattttttaaatgaagtaattttttaaaaaaaatttaaaacctctgactgagccctgctggtctaggcactgagaaggtaaggagtatgattggaagcaagcttttctcttttgcctgactgaatcctcccacactttacccacacaaaatcagtttagtgttacctcctccaggaagccttctgccaccaccatggtcctaatacagtgtatcttctatgtgttccatagcctggccattagcccctcagcttggactgcgattgcttattttgctggaccatgacttccatgaggtcagggctgtgtctctcctgattcctgctggcacaggatctatacataataagtttttagttaatatttgcagaagaaaagaagggtaaggggagataaaagaaagcattggaaaacagtagtaaatagatattgaactcgagctgtggatggatcttgcagaactccctcttaggatgtgaactgagaaggtcatgtgatggtgggtggccaagcgtaggagacagagacacagagtgggcaacctgaacactgtctggagccagcatcaaagctctccaacaccaggtcttagggaaacttgcctggtctggctgagtagagggcggaggcagattcctttgcacaaggctgtttatgatatccaaactctctggctgctgcgatggaagaagagctgtgaggatgtaataatggcactgcagcagactggaggggttgagagggagataacaccatgggctttggcaagtttgggcagattcctgccccccacccccaaccgcccctaccttggatggaggacctgagaagggttctgagggggttttagttggttaggaaagggagaaggtttagaaaagcctaggataggacagagtttccaggaatgatgatcacagcaaccatttatgtgccatttccttacataatctcatttaatcctcaaacgaactttctgagctgatattattgaacttactttaccagtaagaagaaaaataggagacagtgagaggactagccttagaggagttctgggacttttttgggtcacacagctggtatagacagtgtgtggcaggatttgaactgaggtctttctgattcccaaacctgtgcttttaaccactgccttcttttgccagtaattgaaggaggcctgagtcccatatgagctactgctttagataatcaaacctccagaccctcctcttcttggagcctactccctgcttccctggtctcggcccttcttgctgcttccccctcgttggggccttctgtgcctgtgccagcttgttgccagaggctctgtgtttataggatgaggagccctatttggcctttgcccacatcctgctgcaatctgggcaggatctccttgtcctactgctgtggctgctgtcccccaggtgacccccgtgctgccggcccagcagggtccatgtgcctaacagctggcaggaccttgttcctgtcctcctgccacatgctggctgcagctctgcagacagtccccatttcatgctgatttgctttgattcttttcagacctgggagtgactcatgtttacttcaaaatgtgtgggccacaagtgtgccagagctgtcagaccttccggtgtgcaagctttgatcgttagaagacaagccttgaaggaaaaaacctccatttaggtgacaaaaccagatttagaataacctggcttacttgggatatctgcttagtgatctgtgcctttaagtactagagacttaggacatctgagccagaggagacctatgaggccatctgttcccatagctccattgtacagatgaagaaaccatgacccagagaggagtgtgacttgcctccagtcacccagctccaaagagcagagtaaaaaccagaacccaagccttctgactgtggaccagtattttcatctcagttagtaatcagatgttctgctctgaaaggcctgatagcttaaagattggaaccagccctatgctatatattttttcccctccttctaccaagtagttaaaatgagtatctttttttaagagactgggtgtctctctgtcacctaggctggagtggcgtgaccatggctcactgcagccacaaactcctgggctcaagggatcttcctgcctcagcctcccaagtagctggcattacaggtgtgagccaccacacctggcccagaatgagtgttcttaattgcttcatattaggaagcttttgcacttggctcaaagaatcagaaaaatagggcctctttgtggatggtataagtgtggcaataggccaacactgaccacctcccatagtccagacactttacatacattatcccctttaagtctcacaagggcactgggggcatttcatccccattctatgtatgaggctcagaggaggtcagtaacttgaccaagaccacatggagccagtactgggactgtctaatttcaagtccatgttctttctacccagcctcttagacccttgctagctggaagccagagagacctgggttaagttcctacttccccatttatttacgaggaatctcaccttcctaatgctagggcgaggcctggggcacagtaggcacttaagaaatagttgttgaactgcagcttggacaggtctgccctgtcaagcctcaatttccctgggtggttatagcatttcaacacattgtgcaagctaaagcagttcatgtatgtaaaagtgtgaggcagataagatcactgttatttactgagcacttactatgtgcttgatattctcagcattttatgtggattttcccatttaattgccataaaagcagtaaacactgagatggatacttttgtgattgtttccattgtacagatgagctggggcaggtaaagcataagcaacttgcccaaggtcacacacccagtgagtggaggcgccaggtctgaatctcaggcagtgactacagagcttgcctccttccccacagcatggtcctccctcagtgctgccgcccactaaacccaagtctagttgagggtggggaagagagacacatgcaactgaggacacagaaagggaaagcaacttgtttaaggtcccccagcaagtgagaggtcataaaacccagcaaagacttgctgtctaaagtaacacggggccttggtctttcaaaagtattccctctctaatggagaaggacacgatgtcctggaaagtactcctaaactagagacggtcaccaggaatcccgactgcctggtggactccatggctttcctctttggtccttgcctctcactcatttggaatcattccttctctggattgcagagcagaaaccaatataaatttgacccagtctctagaaatgtttacctggctaaaaatatgccagctttgtcatatttttagccacatttagatttgaagtatatgaattgcccacacccatgtattaggcatgaactgttggtacattttgtaacaggacctgctagttttccattccaaagaactggaattcagtcagaaatttgtcatttgcaaataccaactctcgctacattccattgctgtttttaagagtgtctcgtcacctggattgtgaggaagcaggccatgggcgaggccaggctggctgggctgccttggtgcattccccaggtctggtggcttctaatcgacctctgcctggctctgccgaggccctcgccgttctgcggtgtgttgcctttggattagcataagggcagacagggtgcttattttagaactggaaggagaggagatatatcaataaaagaaatgggaaaggaaaaatcccttcagtggtttaaaaatatctcttccttaacaggctagattatttcatttcttaaaaacaactagtaattttctcctctgaaacagcattggaaagagaggcgtgtcagactaaaaaaggaggggctgaaatggtggcctgtagttttcactcccctgtcctgttcctataggataggttattttccccagtctcccaaagccttcctattgactctggaaccttagaactatatcacaaagactctgttttcttaccccttcattttgaagatgaggatgccacgcctcagggcctttgcacttgctgctcttcctgcatggaatgtcttccccagataccaacagcactcactccctcagctccagttctttgctttgatgttaccttatcagagaggtgcctttcctgagtttagaactgactgtgagctgcccacagtagaatgtgggaatcagggttgccaacaggcacgattccactttgttttcagattttcttttttatttttcttttctgcccactttttgtgatctaaacacttgctaacaaaagtatggtctgtggcctggttgtaatggcatcacctggaagcttgttagaaatgcagaatcccaggccttgccccagacctgctgaatcaacatctgtattttaataagatcccggatgacatatacagaaatgaaagtttaagaaacagaagagcatttatgccctcaaccccttcagaagaagaatctaagagaaaccccatcccacaaagtactgtcgccacctctgtctggaggcacaggcccaactgcctcaaataaccccctatggttgaagatgggagggatggatggagtcaccctagaagaggacctcataagacagacttccgaaatccatagctactctgtttcttacatctctcatgttgcttagggtaattcacctgtacactgggctttgtagctaatgtttggtcaccatgaccagagactgttatctacttggtagctgcagagggaagggaaacccagtcttcaacctgggagtgcagcagtaattagagggccttgactccccactctgccaggtgtgcctgggctggttgagatagcacctttcaggagctggaggtagttccatccagcccgtctcacaaatggctgtgaatgcctctctagatccttcagcaaagacaggtcagctattcccacagtctgaatagaaaccaactcccacagtcctttgctgtttggaaatcttccagttcttgagtcccccaaatcacattgcatcattctagcatgtggttatgtaggaggcaggatgcttcccagggcaccagtgggaggggctcactccctctccattgccttgtctaatgctcagggaagccctctcaatgggcaggtgctgtgcaaatctaatctgcctgtggaggcatttctttcaatcaccctgcaattgtgcattgatttggggaaagcccattgataagagtagagcagaataactgagctcctgaattaggctgcttgatgaaattattgtctaatgctgatgttggagcctttttcccttgttctgtgtaaatcagggctattttaaagctgtcacatgatcactgatgccatagaaactgcctgaccttgtgcacacctgtgtctcagtcaggcatggaccaccacaggtggaggaagaggacttagtgacagaggtgtagcttcactccagagtctgcacgaggaaggaaggtagtagaggatgctgtggagcactttttggtttctcctagctttgtccagctctcctagctttgtctcatttaaccccattgaaaccacctggaggaatgactactccagccactctggagtccagacctggtcctgagcagggacagggaagctgtcctatgactgagagatgatgttttggcaccaagaaggtttctgtgtgtgtgcatgcatgtgtttgtgtttgcatgcacatgcgtcgagatgctccttgagaggttgtagaaagtccactttggccactggcatcaccatagcatatgagacagtatggtgagcctgaaagagcactgttcttagagtcaaaaacattaagttctctttctagaccctcatttagcaagcttcatgactctgggcgcatattcagtggttcttcaccagccgtgtgtagaattgtccaaataatccaccagccctgatgtctcccatagattcaggcctggagtggcactttggcatctgtatttcttagggctctgcaggagattctgatgcacaccctggggtgagatctgaatttgagactagccccctcagagaagtcaggatagtgaagtggaaaagagcgagtggtcattgccacacagaccagggtttggatttcagctctgtccacgtacagcagcatggtcttaggcaagctgctaaaccctgcctctgcttcctcatctgcaccacaggcaccatagcaatgacctcacagggctgctctcagcactaaatgcgatcatgtggatgaggcatgtggcaaatgcctggcatgtgagtacaccgtaaatgttacatcttgggtgtgagtatgtctgtgtgtgttttctgctgtactgttatatatggatagaatcctctcaagaaaagtccaaggcagaactcaatcaagaaatgagatggcagtgctctattatattagtgtaatttggtaataaggaaaccaattaattcattctttgttattaatagcaaggaacgtatgcagagaaaggtcctatggggcaagagagagatgccaagagtgcaccccttccttcatgacagtagttcttaaacttcaatgtactcaggattacccagggagcttgttaagtgtgcagaatcatgggccagagcatcagagagtctgattttgcagatctggggtgaggtccaagaattcatatctttgaaaaatatgaccaagtgagtgtgcataagatggtctgtagccttcactctgacaaagactggtctagattagaagatgaaattggaagactgagggaaggagggaactgggtgacttggagcaagcaggaatgggatcctagaagatgggagaggagctgaggtttgaatgcatgcaagatcccgagaaaacagggaagcatactttggatttggtctgatgaacagacggtggagagctctggtggacaggaagctctggctcttctccctgctgccattggcaggagatgccaggttgggtaggcatcacactgggaatgtcagccactaggaagggtttactgagaatcctggtgaaatataatgaacccaaggcatgtgtctctttgtcctctctttaaggcccaagatggctggctttaagttgcctaactgtgcccatagagttgagcttctttttatctatttccttattcagaaatgagggcttgaagcagcctgcagtggtagacctggaagtataaagtagatttgtgatgctcagggcaccagagtgggctagcagaaagggcaccagagatgataggagatgttgagtgccatttctccttattaggggctgtgttggctgagaggggccacagctgaatctcaggtctgcaggggacccatgttccatgataaagtctgaaccaagacatccctgtaacagtggcctttggatctgcaacctataggagagcaaattttggggggtcttcactggatcaggaagagctacaaataagaatggagaggggaaggggttgtgtactcagcacttactatgtgccaggctccacattccatgcttacatgatgtttgtaatctagcctccaccttaggaggtagatagctctagttttacagatgaagaaagagatgcccagagaggtgaagcaactcacagctttacacagccaggatttggtaaagcctgggcttgaacttgcatctatctggtttctgtcatgaatcttccacagttctatggtgaatgtgttggggaccttgattcttggtcctcaggtgcaagtgcctcggaagcccagttcccctcggcagggtcgggggttcagtgtgggcagagtgccctggagtcctgtgacttgtggggcatttctgtgccctctgtcaacaatccagccttcagtaacgttgtgctgctgccggctgctttcaccacatccagaccccccacccacacaggcgaaggttttggccaagggcaccctggagggggaggaaaaagtgccttccagaggggcttgttgcaaagcccctgaatggacccattgaggctccagggcaggatgacaatgggcctgttggggccctcggtctgctgaggtgacagggctggggccgggcaggcagtgcagtgctggctcagaggccagacgctgacttccagggctgggagccagcgcttctgacgtgctccgaaatgccagctttgcttaatggggagcagctggggtgggctccgcataactccctatgccaggaaggcagcgtgaacccagttcctcaggctacagccgctcttttcctcctcccggcctggcactgctcccccttcctgagccaggccttgctcaccggacaccaggatcatagtcagctccttctagtgtccccttggtcctcaggggcattcttttcagcctgattggataaataacaccccttccccaatagtctagcctgcctacaggtgcagctgccagctaacatgcagcatgcccagtgaaatttgaattttaaataaatgatgaaaaaattttaattatatttaaatatgtaataaatgacaaagcctgaaccaagatatgagttcattttgtgggtcatgggacacacttaaaccaaaaaattatttgctgtttatctgaaattcagatttaactgggcatcctctatttttatgtgctagatctgatgaccctacccaaggcagccatgatggatacccatgtggggttactaggacttagttaggttttcctttatgccaccaaggtgggggatagggagaaggaggcctctctgtgcccaccctccacctcccatttcctgtacataaaatgctggatgccacacttagtaggtcttactcacaggcaagcattgcccccagtgttacccacaccaccctcccttctaggagctgcagctttctccctggctcccacagtgggaagggaagctttgggatacaattgcagttggtgactatttactgagcacctgcctatcacactgggctgaaccctggcaatttaatgagaatgagacagatgtaggctttgctctcaaaagagcttacaggctagtaggggagagaggcatttgaacaaaagagcaactataattcagtgaaccataaacactgtgggtaggtggcaggggttgttggggggatagttattgagggaggtatctcagaaattccaggagagcatctcactcgcacctgtaggaccaggatagaggtcttagagtcaggagatttgagatgaaatcctgggccacgtcattgagttgagtagctatgtgggcatgggccgatcatttaacctcttgagccttgattttccttatctagaaagtgggaacaattttccttgctttagggaccaatgtgagtttccaagtaaaatgattaatgtgaacatgtattgctaactgcagggtcctagatcaaacaaatgtgtgtgtttgtgtgtatgtgtgaagtcagaggtaggagttgaaggatagggaaaatacagaggggttaggaatgcttgggccccatccctgctctgtggcttgtacagtattttgctgtttgcaaaggataatgattaagagtatgggctgggaggctgaggtgagtagatcacctgaggtcaggagtttgagaccagcctggccaacatggcaaaaccccatctctactaaacaaaaatacaaaaattaaccaggcatggtggcgcgcacttgtagtcagtctccctgctactcgggaggctgaggcaggagaatcgcttgaacccaggaggcggaggttgcagtgagacgaaatcatgccactgtactccagcctgggtgacagagtgagactccgtctcaagaaaaaaaaaaaaagagtatgggctggaaattcaaacaggcctgggtttcagcgccatctctactgtgtgacctcaagtaagtacctaatctctttgtgccttagttttctcccctgtaaaatggagcctcacaggcatggttaaaaggatgaaaagtagaccattcatataaagtgcttagcatggagtctgtcacatagcaagtgcccagaagtgggcagctattaagagggtcttagttgagtagcataacaaccttgtgaggtagaaattatcaggtggagaatgaagttcagagaggttaggtaaccagcccaaggaggcatagccagagaggcgcctctgggagaatatacccctggcttcttaggaggcctttggtcacccagccttcaaggaactctgcttctagcttttggttggacaattccctggggactagctggactctgggattccttgcccagttatggtctggttcagatacctgggtgtttcctggagatctcagcatgcctgtgtgtgccaggcctaccctgcccagcctctgcagggtcagggagaaagagcatcctttaggaatctgatgacttacgtgcctcacaccaactattcttcctttgctggatttgaagtctgagatatgggcctcatttttattatcttattcctttgtgttaatcaatgcctgcacaattatgcagttggcatggatgctagttttattgtcttgaacacaaaagcagctttgaaaatgtggtatttctagggagcggctgggggtgagcctctcactggagaaggcaaactttagccaatcatttccccctccaatgggaacagaagcaggtggattaaactgctccattaggcgatcttttgtttctaatagaataatcatcaacaacccttgatggttgaaggtcagggaagggagctagacctggctgagcatttgctgtgtgctcagctctgtgttggagcttctttcacatcaagttcagttgtctctatcactctgtgtttatgtcttagacccatttttcaaatgagtaagatgagatagagaagttgactgatttgatctaggtcacatggctggtaaatgatagctccaggttttgagctcaagtctgttcagttctggagtccataccttactatcacccatgtgcctaggtctatgtgctttacgggagaccgaaacagtggaaggcatgtgcttgccttcaggttctgctaagaacccaagatgcttcacttaccgcacaacgggttttaaggcacctgcaccgttagttcctgacttgataacatgggactgagacttccaggggaaatggggtaggagctggtttctgatttcacatttacttaaaggagagaaaggatttagatatatggggagaggaaagagggtttttcaaggacagaaagctatcatgggattccaagtaggggaaggcgggctgaaaatagtgtataagagattcatatcaggacatggaaaaggatgaagactggaggcctacctggagactgttggtaatcctggtactgctactgatgatggtaatgggaggctgatggtggtagttgtgatagtgatagtgatggtgatggttaacgtgtattgaatgcttaatatttgccagatactagtctaagaattttacaagcatgaacttgtttaatgctcacaacaatcttataggaaaggtactgtaattagccccatttttagttgaggaaatggaggcatagagaggcataagggtctgaaatagtggtggactttgaggctggagaataacaagcagatgtaagagccattgaaggaagaactagggcagaatctggtgaccatgtcgagaaagggataaaggaataggagagtctacaatgaattcaaggtaacctattgatcttttataggagccaacttcctggtggtagttattggtgaagttatgacctgactaggaaagacaagctttcaatttactaaatgcctttattaaaatggaaatgtgatatttgagaggatgaatatgatgacccattgccagacatagacatcttaacatgagtgaggtcatcagcttcagtgcaaggggaattgcttaagtgaagggacactggatgggttagttttgagaaggcctgtgccagccaattccttccttcagggtgtgctatcctaaacataaccacccagggtctcttttcctacaaccgcttccccttccttcctattcaccctcaatctgatgtaaagcagttcatgctcaagcattcgttgccaacactggattaagatctccctccttccaggtcatacattggcattttaacagagacttttagaaacttggctaatgaaggtggggatgtgagtgatcctggggttaggaagggatgggaaaagttcatgcatccctcccctaactcccaacagacatacaatggaaagggctggggtctcaacttaggcttcacaccagcagtgcctggactccaagtttctagacccagattcccaaaaaagtcatgaaacacattctcttagccaagtatgccatggagggctgggtcaagcctatgagcctccactcaggctggcagtgaaaagcagccctgggccctccagcccacctaggtagcatgtagttattacaagcatggactctccagacagccaagctagagttggagccaagcctcagatttgtttgctgtgtgaccttaaacaagtcatttcatttctcgactcttagttttctcatttgtaaatgaggataatagtgttgagaggagtaaatcagagaaggtctgtaaggtgctgagcccaggacatatcacatagtaggtactcactaaatataagctgcagttgtcgtgccaggcccactgtgaacaactccagaagacataaagcttctccatgggctttgggtgaagcctgggaccaggcagctaggtgttcccagttgcaggatggcagtgagcttagcacgggcccctgctcacgctccctggctctctctgccagaaaaatgggtggtactagagagtctgcatttccctgcgagcagctttcttcccttggcatcctaggcagggcctttgtacaattccttttcagcccccaaagatctatatcagaggtaatagtagttccaactgatacttacagagcacctactatgttccaggcactggattcattaatcctcccaatctttctgtgaaatcagcactattattcaccctgttttacatgggatgaaatgcaggcacagcaaggccttgcttagagcaagtcacttgctaagaattatatagctaaatcagagccacaacttgaactccattctgaaccaaggagtttgaaaccattcctcctgcatgatgcatgaaattttaataacctgccgacagcccaggaggtttgcagtttctctgagcccaagggaccagagccatctggtgggtgctttttcaagggagctggtgtgactgtttcagggtaaaatgcagagaaatagcatcactttttttttccccgtggtaaaaataacatgcaaggatgggaagaacaaatggaggttgggaggctgacattgcggggaggaaggagctagaatgctgggggctgtctacctggtgccatgtgctgccatctgcccagtatgggggcaacatcagcctgacctgccagcacctgcctggctaccagtatcagctttcaggaataaaaagatctttttcaaaaagcctttgttccccagggaagctcaaggggcagagtgaggtccgtggagggttgtgacagttcaaaacatgctgtccatttatagtatgcagcagtgaccctatatctcaccctctctatagcaactagctccagacacaaactgggcatggcttttgatcatgaagcatgtttttacaaacaaaaaaatactgaaagtagtatgtgaggctgagattatgttaatttatgcagtttccactgctgctaggattaaaaatagctttctttcaagaaaactagaactacgcactgtcagtatgccttctaggccctcttgttgggctccaggactggtgggccagacacaggacatggattatgagatcctccttggcagtcccaggttctggagctttgctgaagtggaagataaagacactttatcttccagtggtaaggactcttacaaagtctttactgcatgtttcataaaactggatatgctgagctctaatgaaagctgttgtcagcattaaatacccagggaaaggcatggaggcctttaaaaaactgccacaatgctcctgcactgaagtgctcacattttgctccatatgtgagagggaggggaatttggccagtgtcatccacctcataaaaggcaaacccaggatttaaactcaggtctggtgcctccaaagcccaggaactcatgacatctcttcccccaactctgctgttctacatgttgattatggctacctgtggtgctcattttaatcagatttcatcaatataaacattagtggtggggtcttcctttagagttagtatagccacaaccacctcccctaggttatgcaggacacctggcaaaccttttctgaggggcccctaccaggggaaaaaaaaacttattgccaaacattaatatgccagccccattttggcgggccggtctcacacaatctcatgaaagaactgtagtgccagccaggaggggcagtcctcttgctctcctagaattggctgctagccgtagagcccaaggcaacaccactggggtaattcctgaagatccttgggacatctggttgacaccataagtggacagaagtttagagactgctctgaagggacagctgaggacagggactcctgtggttctgggtcagagcaaggaacagcctggtcaatcccagccactggaaagagacttagagaatttcaaagagagcatggaaaccagaaaatatgagtgaaagggaagggagtgaatctacatattatacaccgtctatataccagttacagtgctatgcatcgtggggagttacagggtgcacaagaaggacagaacccatactttcacggatcttacagcctggttgggagaataggcattataattacatcatggcagggagaagggatggggaagaggagatggggaaagggcccagctgtcaaatagataattccaaggcagagtaatatggtagaaggtggtataacctggcaattgcaatcacagacttgggatcaaagagactggatccaagaaccatccttgctcctttccagttccatgtccctatgcaaggcatttatttatactctgagctcagtttcctcatctgaaaaatggagataagagttcttacccgacagggtgcttgagagggttaagtgaaatagtgcatggaaggcacttagcaggaggtctgacatgcatatcgtgcccagtgaatggtggctattactagttattatctgatttctgagacctgagcagatccaacgcagctgatccgagtaggggagctgagataagtaggtgctctgacagcccaagccatggctgatggtgaaaccactgacaatctgacagcaaaggaagaggggaccaaaaaatctactgtctcagcagctcttagagcaattagtggtggttatgatgtgaatttctgtttgatgtcctcgtctttttgagaagatgtgagtgtataatgtacaacttcatgaatgaaaaggtaaaataaaattttgagtgctttgaacaggaagattatctggaaaattcactgactggggaggcctccttccctgacatggcatgcagaaagagctgtcttgggcttatggagaggttgacacctccagaaccatctgctctgcagagagttccctcagggggccagtgacatgccccagagtcgggtccctttcctccctcagtgccagctatgctttccctgccacatggcaacagcccaggcagggcaggggcctctagacacatgtctgctgaagacccagcaggagcctgtcagccttgcccaggccggatttccagttctgtagatgtagatcataaatgtgggtgacagatgtgggagagacacatccaggagatgaaaagatatctccatctgcttggttctggagaaaatacggagaccataagtggatggtggcttttcctaatggggaactgtggctgagttttcctggggcgaagcagtatttacaaccaacccagaccccgcccccagtatcctgacaccaggtttggctgatcaagttggtagagggggcttgtttgctaggggatactggggagaatggttcctggccattgtgaggagagctcagtctctgtcctgtaaaggaaaccacacaggttttagtgtttgggctttgtgaaggctctttaaaggtgttttaatgacagcagagatgaaaggtaaggcttctgctgctctgatgtgtgactgtctgtccaagctgcccacagcagtgcagagttgtgtgctggagctcagaacctcccttggagctcagtaaattagcttctgtcccctggttcacgtattggtacctgctgggagaagaggcagaagctggagaaaacacacaactaatattagatggaaaaatggaattagaaacatatacaaatcactagcctgggcaacatggtgaaacgccatcactacaaaaaatacaaaaattagctgggcatagtggcacacgcctgtggtctcagctactcagcaggctaaggtgggaggatcacttgagcccagggagtttgaggctgcagtgaaccacgattgtgccactgggcttcagtctgggtgacagagtgagaccctctgtcaaaaaaagaaaagaagatacatagacaactcttacacacttcccttgtaatcctcccaacttggtcagtaaaatttaaaatcatttattgaacattcatatatactagattctgtgttactctcttcatattctcagttaatcatcgtagcaacctagagcattctcattttatttgcattttaatgatgagaaatgagtaaagagagggctagatgcccaaggtcacacaggaaatgacagagcagagatgtaaactcaggtctgtcccccttaattgttacttcagaggtcacgctggggaccctgaatccccctgttttcagggtcagtagcgaatttttaagctgaggggtgtagctgatggccctcagactgaatcaggtctgtggagacatttgcttatctggcacattggtttagaaaatttttaaaaatgattttagagagtgttctctgttagccacagtatccaccatgctcatatgtcttatacctggtcagcttcttggcccctatgggaatttgagtttataatccctagctaaacctctcttttgctggagtcagtgatggaaacagaggagactggtagtgtcctaaggaaaaaatgctttattttgccctctgaagaaggaagcagcggctggcagctccagacttcggccaagctggatggaggaacttctaagagggccctggtgtttgcttttaggctcagaacccagctttcatgaatttaaatttcacagtagatctgaagaggacagtggaggggaaactgtattatcctctccttggagagggaaaggaaggttctccctgtttattcgtactccgagcaggctccccctggagggcagccactgggagcttgatggggaatcctttgtactgcgcactttggaggcatctactagaaacaaagtaccctgtgacatgctggaagggatctccggacagtaaaacatacaaggaacagacccagggcaaactgtacttattcatgatgggccctgaagtgtgaaggggtttattcaaaagaagtaggtaggtggcattccaggtaaaggggacattgtgggcaaagacatggggatgaaacgtgtgctgtgtcaactcagggttaaatggattaagggcagtgcaagatgtgctttgttaaacagatgcttgaaggcagcatgctccttaagagtcatcaccactccctaatctcaagtacccagggacacaaacactgccgaaggccacagggacctctgcctaggaaaacagagacctttgttcacgtgtttatctgctgaccttctctccactattatcctgtgaccctgccacatccccctctctgagaaacacccaagaatgatcaataaatactaaaaaaaaataaaaataaaaataaaaagaacacaggagacatattcaggcaaggagatttactgatattttgcagaggggaagagtacaatgggggaattgaactagaaacaatacttcctttggtagcccagtcagcaataatagcaaacatttattgagtgcttactgtatctcgggcatgttatcagcatgtgacatatattgttttctccagtcctcacaaaaagcctataaggtagacactattactattgttatcatctacatttgcagatgaggaagctgatgcaaagagctcacagccacattccagatcacccagctagtaacccaggtattatggtcttagagcccaagagcccacactcctaacctcttcttcctgctgcttccaatagcagccaacagtctgggtgacttatcagtagaagggatgtgagattgtagcaagagatcaagtgagaggagtttagatcctgcaatggcaccattttcaaagatgggaatgtaaccttttctgacatcaaggctgtctcctaaatggccttagcctcccccttacagattttattttttaatttttaattgtataaatttaagatgtacaatctgttttcatatacttgtacatagtgaaatgattactacagggaagcaatttcatatgtccatcatctcatataagtatctttatgtgtgtggtaagagtacttaaaacctactctcttagaaaattttcagcatacaatataatattaactatagtcctcatgctgcactttagatctctagatttatttatcccacagaacttcaactttgtcccctttgttctatatctccccattctttcccccacttccctcccccacttcaggtaacaactgttctactctctgcttctatgagcctggctttctttctttctttcttttttttttttttttaaagattccacatataagagagatcatgcggtatttttctttctgtgtctgggcttatttcacttagcctaatgtcctgcagtttcatccatgttgatgcaaatggcatgatttccttctttgtaaaagttgaataatatttcattgtgtatgtatgtatcatgtgtgtgtgtgtatatatatatatatatatatatatatatatatatatatatcacaatttatttatccatttatccgttgatagacatttatgttgtttccatatcttagcaattgcaaataatgctgcaacaaataggggagtgcagatatgtctatgaggtgctgacttcattccctttgggtatatacccagaagggggattgctgggtcatacggcatttccacttttaatttcttgaggaacctccatgctatttttcataatgcctgctttcccaaaaacagtgttcaggggttaccttttctccacatccttgccaacacttgttatcttttgactttttttggatgatagccatcctaacaggtgtaaggtaatatctgcatctcactatagttttcatttgccttttcctgatgattagtgatgttgagcaccttgtcatacacctgttctccccttcacccctcctgagccccttatactccagcccaaccaaacatttttggaagaccatggactcagcagtcatcgggacttggggtcaaatactggctctaccacttcctacctcctgtaactttgggctagttacttaacctctttcagtctcaatttcctcatctgtaaaacaagggtgataaaagtacttgcctcatacattctttgtgagaattaaagaagacaagtgcaaggcacttaacacagagtctggcacatagttagtgcccaataaacagctactttaaggccagaataaatttcacacatggtcatcatctagctctgggattggcaagggtgtgggtgtggtttgcaaggaagactcatggactgcctgctacccactacgtgaggcgctccaggtaagagctggtggctggcagttcatgcctccttgttctgcttggtgcctatgtggatgaggcactggttccagggaggttacagggctggttcccctgtaccagggcacagcctggtatcagctctgcccatctctagatagtgggagcaggaatccttcagtcctgatgcacagatgggcaggaaatctaaaagccacctctgcccttgtccaagccagtccacatgtggattagaagctgcagctctgcactgctgtacctggaaggcacagacaggcagacaggcccatgttcctgtccactttggtggctgtcctggcaagctgtggctactattgccacctggtggcgtttcacagcaacacatgcatggagacttctgtagtgtcttattaaagatgtcaaagtttgtagcatcctgggaattgaaggtccacttctacctgctcacagtgcggaaggcaaaaccaagattagagaaggaagaacagtggggtttaggagaaagagcactgtgagagttgtgtagccttggttcaaattctactccccctatttgggattttggacaaatgacaacctatgtgaacttgtttcttatctaaaatgtggtggagatcctcaacatttactcataaggccactgtgaggctcctatgaagggctttataaactgcaaaggaccctacaggtggagaggtggtggttatagctgttgcagctccaaagtgaggccagtacttctgaacttgggagtcaggggtctggcctagcataaccaaccactacccaagcctagcaacaagacagatggcagaaggaatggatatgagctactccctctttgctggcccaggatatctccagggtgggtgaagcactggggtcttccacccgtgctgtgagttcctggtgctttctccctcctgggtcttgcctgcagtctgctcacacaagtgtagcttcaggtgggaatgcctagtgcctgcagttgtcagttctaggcatgaggagcttgtgtctgggtttccccaaaggacaacattctgggtctcaatgaaggacaagatgcagaattccaaggcgaggccacaaaaaagtgctgggcttagcctagagctacctctccagccccaggaatgtgacggtatctggacctggacacaaagcattagctcatcccttctgatgatagacaaagagcctagtgctcagagttgggcagtcatcccggcagcttctcactgtcctgcccaggcagctgtctggactggtccagcccaaagagcctggagtgtctacttaccccactggcatggaaggtttgggtcaggccagggtcatcccaatcctcaggccctaatgctaagcccatctcacaggtactcggaggaggagtcctatttgggttgtagtatgcttcccctccactggcctcagatacagttggtttactgagcacctaatatgtgttagataaggtacaagatgttttcacagagattatctcatctcttcctcaaagaagccctggaagtgtggtgtgattgttcccatattacagatgaagaaactgaggcttacagaggttcagtcacttagtgaagtgggagcttggttttaaacccatacttctgcctctagggcttgcctttgtgtagtttaagagtgaaagactttccagaaagagacctggagtgaaggcctatcctagggatgagttgcaggccttcactgtgcagagtagaggatgccaatggcacactttgccagagacccattgaaacactccccagtgccagctgttggctgtcactccttccatctccctgtcctaaatacctccagaaggtttagttctgacaccactcatgtggggcccatttagagagacagtgagttagggaacatggctgaggatggaggaaggagcaccactaattgtggtaaacccataattagttctctgcttatggcttcaatcagtacttttaatttaaaaggtaatatctgtggattttttttttaaagatttgtgacatgggtataaaaggaatagaaaacactcatgttttctccaaccaacctcaccccactgtctcagaaatcacctctatgaacagtttcttgtgcatcattccagaaaatttgtacaaaaacaagtatattcaaatacatctatcctttctttactccagttggaatttcaccatcctcaccatcctacagaggtcttctttcatgcatcatcatctcttaggcatctcctgacatagatgtcaaatgccttctcttaactctgcactgtagactattatatggccattgtcctcctggtaggcattttggttatcctgattttttgccgtcatgaacaatgtgctgattacacctctatttttgcacagtttcccatataggactgtaagataggtggactcctgaaagcataattattggatcaaagtacatgctttttagattttactaaatattccctatcgctctctagcagggttgtactgtcaccagcactaggagtagaaatgatctccacatggaagatgagtccagtagtcatgtgggacagttgctgagaagacatgatttcagaggcacccagaaactgctcatgatcctgtccccctcaggaatctcccctttccgcctgtcatggtgtctggaattctcattcattccttgacctgtggcattgtctccagaaagctcaggtgtttattttatgactgcatttgcaaaagacaaatataatccaggctaaattgtatccatttcatccttctggtttaaaaaacaaattacaacatttccttgggcccctaaaactatcttggctcctaagcattgtgcctactctgcctaatgggtaagttggccctcgattttgtccccagagtagccctccacacacctgcttccctacatgttgtcaccattcctgcccctggcttttgacactggaaaggtgtaaaatacaatctttcttgggggtagccggctatcacagaaagcggtggtccccagcctttctggcaccaaagacccagttttgtggaagacaatttttccatggacagagatgcaggatatggtttcgggatgaaacttttgcacctcagatcatcaggcattagattctcataaggagtgtgcaacctagatccctcgcatgtgcagttcacaatcgggttcacgctcctgtgagaatctaatgccaccactgatctgacaggcagagctcaggtggtaatgctcactcgcccaccactcacctcctgctgtgcagcccagttcctaacaggccatacaatggtacttgtccatggttcaaggtctggggacccctgacataaagcactgggcaacatttggatgggatcagggctgaccgtatttactaacaactgcagaatcctgcagtttccaaagcatttttatcaacatgattttcttaaaatattatgcccattttacagattagggaaatgaagacactaaaacagagaagagaagtgatttgtccaaaacacaaagctagtaagaaatagaatcatagggtcaggtcaaatgcagcctcggcccacttcacagcttccagcacagttaggttctgctggatctcatgatatatctttgtccctgaacatctcatatgtgtggcattgcagaagacatgctgacagtgtcacatcctgacaggtgcacaagtggagctcaacatatttgggtggcatatggaagctaattgcagccgtggttcccaaatctctccccaagtaactgacttcagtatgcgtttgtatgtttttttttaactagagtaaatttgattgtcacacatgcctccaatcttattttaatgtaagtagagcatgattggaaattcagaattagactgcccagcattaattacctctcaactacactttttatttatggagcatgtttactgtcattaatgaggagaacgctagaagggcatggaaggaggattgatcaaaagaaggtggattgaataagtagttatggatagggcaatttgaaatggatttattcctttttaatttaaattgtatctgatttctgcattctgattcttctaacccctttgccacatgcccccatgttctctttttgaatcttgctctcattcacctcgtattgccccatccacagtgttaataagataatgtccaggatgccccctaaaattggtactcctgattgcaaggggctgcaagattctctcatcatgtctgtcccggcttaaaaaaaaacatgaagattatcactgtctaccttttattgaacactctttttttaattttattattactatactttaaattttagggtacatgtgcacaacgtgcaggttagttacatatgtatacatgtgccatgttggtgtgctgcacccattaactcatcatttagcattaggtatatctcctaatatctatccctctcccctccccccaccccacaacagtccccagtgtgtgacattccccttcctgtgtccatgtgttctcattgttcaattcccacctatgagtgagaacatgcggtatttggttttttgtccttgcgatagtttgctgagaatgatggtttccagtttcatccatgtccctataaaggacacgaactcatcattttttatggctgcatagtattccatggtgtatatgtgccacattttcttaatccagtctatcattgttggacatttatgttgtgaacactcattatgtctcaagtactttctcaccactcattattttacctcctaataacactattaggaggagtaggaataattatacctaatatatagctgtgaaacctgaggcttagagaggttgaatcagtagtttgaagtcacacagcagatataggagtcaaattcattacacattgtcaacactgactatgccattctcacacaggacagtagtcagaaagggctgaatgaagcatatcgccaagcaaccaggagtggaagggatctaggactagggctgagtctcaatgcttggaccactcagcattcaatttgcccttgcaggggaggcaaatctgcttttgtcccattcctggcgtcctctgctccccctgactatctttaggcagtagcattgatctggtttcaagctattttggtttttcaaactaaaaactaagctgagttgggctacactatttacttaatgctttcccttggcagttatttcccttccaggaaagagctactgtgtgtcattttctctcctgacagtgatcccttctggaaaccaggagcttccggcccaggtagagacctggaagacttggccaggctgctaggcctctgtctgctgcccctggggagcctgctaaccaagtagggagatggtttgcagcccaggaaaccctgagcacatgggcagttgagcatggcattagtgggatatgctgggcatgtagtgagaccttgtccaggctttgtggggaaggctctgatgtcaaacgaggcagctctgaggctgtgggcagtgctgaccagtggactggtggaggcagagagattggatttccttcaaagcaagtcacagtcaattctcccagcttgttcagaggcccttatagatgcctgcatgtgccctgggattttcacatcccaggagacagtgaggcagacctgtttacccacattttacaaattaggtaaccaaggattgcagagttcaattaagccactcttatttatcaagcatcttactgtgatgtgaaggcacaagagacctggaccccacctccaaggagtatgagagagggaaaaagaaatgtagccaggccactggaagtgtcacaatctaggctggatttgaatcctccctctgctacttctcactatttaatcttttttgaatctcattttccttacctgtaaactagttataatacatacaccacaaactcctcagggacaagggccaggcttgtcttgttctccacctaatccctggcgcctagcatggtgcctggcacagagtaaggaatgcatatctgttaaatgaatgagtagacattgtcatgagtattaaatgtaatgatgtgggtaaaatgcttacttaaaggttcatgggaagcactcaatgaatggtagtgttaatactctgttaggaacggggcagggaaggtgcaggcacctcacttcacagagaggtgcagaccaaagagaaacaggcttgcaagacaatgagcatatccctcagccaggtttccaaaacagatgatgctgctgaaaggtaaagatgtgagtgaccatgattaaagatattgacaggcagagatagggaagaacttgcccaaaccacaaggctggtgactggcaaaagccagggttaaaacttggagcttctaactctcagtttgtgttgtttctgggccattcagaggtcttcttgtaccctttaaagttttaccagcagattgtttaagcatcctctgtatgaagctcttagaatttcaaatggactcttatttttagaagcagcatcccactgagcatttgacagtgatcgattcatttcccagtttgttttttaataagcttaaaggttactgttgataactgtttatagacagttaatgtggtacttgcagttcctgatttcttaggcctgggactcactgcgccttcaagatgctgaaaccaagcaaggtgtgaggagtaggtgggggcatctccctcccagattttcctcacctcttcaaggctgtcattcacaactccagtcactggctgctgcaacgttgttcccaatttgactaaaatgtcgttattttttatgatgactttattctttccatcataagctggatgattaggagctagaggcagccagtaattaagctcacctgtcagagtttagattcagtcagaatgaaacacatcctttaacttcccctttcatttccctggatgtcaagacgtctgaattaagctccttatgggaacaatatctgacccaaaaatgttaggacagggattaccgagatggaaattcggttacgttacctacttgtcatgacttagaagggctgtgaattctcaggctgcttgagaaaactactcatttgtgaggagaattgagttccaaaccataatagctagtggaagcaatttctgggatcacagcattcagacttgatattcatttgtccccttgagaaggaattcaggctagagactttcacgaataaaagtgcaaagtccacaaaatctcctggtgccgtttgtcatctgcggagaggcctgcctcacgtctatggctttgagggagcagagcattcagatactttgtttctgctggtgggccatttgagccaatggctagatgaagctttgttcttgactcttgaaaattatactctgatgtacttcaaagggattctaatgaggacattggaagcacaaagaattcagctttgcaaagtcagttctcaattccataaagttcggcattacttgatttctctaacgaacctcttcgctctcccttgcctgtgtctgggtgaggattgtcttagaggacattgatcattttcaccttcattttccatttttgcttctggtatgctcatctcacccccagttttatcaacagctcctctgcattcttttctctcttcacatgcaaggtttggcagaaatggccttcgtttctaaaatgttgattaaagacattttctgaaaatctatcagtcccaaaccttctcacttatacacatctttttctctcacaactgccatgtgtctcattttctccccaggtatttttctgtcgttcccttgacctttcaaacaatgctttggccgttgccagtaaagaactcactcaggcttgctgtcctagactctgaacacatctgccacctctgtccaggtagttttaatattagtgagatatggctaactctatcccaccttcctgctgccttgggagccctcacccactctgttaatgctgcttccagagcattccccaaagtaggaagttatagaatgtcccgtgtggaaggggctttatactgagttctatctctcacttcagatagagtaactgaagaccagagagggaaaacaacttgcacagtcacaaaaggaggcagagacagagtcagaatagggtcccaggctcctcttggccctttccctttgagaattcatttctatacacaaatgccacacaggaattcaggatccttattgagtcggcattgctgctctcatttgtggagcattagctatatactatacactgtgctaagtgctttttatgtatgcttcatctgattcccaccaggtactctataagatgaaatccattttgcagatgaagacactgaggcaatggtatgctgaggctggctggtactatctcttgagagccagttgtgtgcatctcttcccaatttcacattcagtgacatcatgttgctagctaaaaatagactatagcaagagtatttacaccatggaaattggcaaatgctacaaatcagagcatttctttatcccctttcctcccaaagaagatccagtttcccagcgcaccacttagcttacatattagctaagcagcttacccaagggcacacagcagggaggtgacagagctgggacttttatccagggctctgacttcggagtctgagctcttaaccaatactcatactgctagtcaacaaggacaggttttcagtgactcatttactcttagactggagatgatgagtaggagaaagcagctgccaggggtctggtacataggatggtagcaaggtgtggggtacccatatctatagagaccgtaccccgccagctagagaaggatgcccccagaagttttcccagatctcactccacaccaaccacatcagcttccttactgttttccaagtttttcaagcatgctcccaactcagggccgttattgttgttcctgctgtcttaaatgcttttccaccgataaacacgagcttgctcctttacttctttagtatgtgtgctctttcttgaccaacccatctaaactagcaccccaatattctctactctcttcctttattttcatagcatgtatcactacctgttttcaaagcacgtatttgctttttgtccttctctttcagtggaatgcaagccctgtgaaggttggagctgtccctgttcactgttgtagcttcagagtagagagcagagagggattagataggaaaataagtgaatctcagctgtattctactccacatgccacctttcttagacttgacccaggtggtcaactactagctcacacattcaccagtaaaggcaaagggctttctccttggttctgtgatctcgtaggatcttcaaagtctaaaaccatcttctttccaccttggagcctcttctttcatgttctcaccgtccctctgaaaataggccaacagtcatatttgttggtgctgatttgcagacagataatagatcaaacattttcagaaggaacctttggccccaagaactaattacatccccatcttggaaggtgactgtccctgtgtcatttaaactgtgtaagagaatggtggaggctgagtgtgacctttggcaaagcccacacgagggtactcagggaacagccagcaatgggagaagctgcagtgagccctggcctgggtacctgtgcacttattttcacctggagggccacactgatgttgtttcctgcatttcttgggtcatgtccagcagtaaatgcataatcactcttacatacccatgcacatatacatacactcaacttcctttctcatttcaaaaatcttatagaaaatgtcaaccatagggatgggaaaaggatgattaataatcacctgcaatcccacccctgagataaaaattgtgaatattttgatcaatttccttttagtcatttttttcctactaattaacatctgtatattttgtgacccatatttttaaaaacttagtacatcatgaacaccttttcatgtcattaaggatttttatacacagtcacttttagtagccagaaagtagttgtatgaaggtaccatgatttgtataactcattcctgaccattggacaggaatgttgtttccagttgtatattatcacagataatactatgaggggatttctcattggtaagtattagacaaacagtggttattctcatggttattcacttcaatcattgtaaactcaatgccatggactgaattgtgttcccccaaattcatatgttgaagccttaatccccaatctgatggtatttggaggtggggcctttgggaggtaacgaggttgagatgaggtcatgaggctgaagctcccatgatggcattattgctcttataaggagatgaaggtattagactcattctttccaccatgtgaaaataaagtgagaagacaactgcctgtgaatcaggaggaacaccgttaccaagaacctaaccatgctggcaccagatctcagacttccagcctccagaactgagaaatgaatgtttcttgtttaggccacccagtctacggtattctgttatagcagtccaagctgagtaagacactccccacttcatgagtccttcacttgtacttattagaatggtaccttcatcttgaccatgattttgcctctaggcctttgcatattctgttccctctgtttggatagcccttccccctcaagcctctttatcttatttccacagattttttcttaccacccccacccaagcatacatttttttatattttgatatctctgaaatggggatgaattgaagggtcattatgcatatttgtggtagtaagtcatagactggagacatagaattcctcttcattgtctaaggctcagcccaggcagttcctctttgggtttaggctctcttctctgggttgcagtaacctccaggctactctgtcattgcattagtcagactatactgtatttgtctgctcattggtctccccctgcacgaggacctccttgagaacagcaaatgtgtctttcattcctttgtcccctgctcccagtagcccaggctccaggacagttgctgaagtcagaacaggtgggggtggacccagcccctgattatcttctgccctctccactaataggcaaattgaattatttcctcattccaggcccatggagagctcctttaaggagcccttggcgggtggggcaaagcatctcacctgtcccagctttgaggttaatgcccattttaggccatgattggtgtatttatttgctcagagggagggtggggagaaagcttggtgggtggaggttttggtaattcatgcccgcatgactataagagagcttccaggaaaccacgttaccagcatagcaattgttttcactgcatttcagaatgacattcaagagtcaacagaaatgcttgaatttcaactttacaaaagggcttgctagagatatcgcctttcccctctgtcccttttgcttagtccaggatacaatgaccatgaaaaaagttggccatttgagcttttcaatgcccttcctcccaacttttcccctttccctacctctttctgggcctttctcttttttctgagttgatattcccttatcttcctctgcatgacttttaactttgctttttattaattaactccagaaggaataaggtgcctgttacatgggaacacactgcacaaagttgggagaagggaagatcatcctttctggctgggaaggtgggtaaaggcttcgtgcaggaggcagctgattcttgaaggctgggtaggattcaaacagatgaagaagtggtgaaggaagaggataagtcattccaagcctaggcaggagcaaggcatggtcaggaaggtgagggctgaggctgaagcaaacatttatttataatgtttacagactacctgcagtaagctggcaactttcttaagtgagtaaaccagatgtcactcaggtccctggttctccagctcatgtgtctgcatgggctttcttcatttttaccccatgacaacaacccagactctaaactcaatacatttacaagtttgaaccaaaggaatccatgattataaaaatattggtacccaatttagatttgactggttattttgtagaggacatggaggattgagctcatcttgtatacttcactgcaagcaactgaaaatatccattagaggtttctgttttctcagagaactccccttagcctaccgtggtatggaggagtgttgctgtctccttccctcgcttacttccttgctggcccttttctctcctggattctttcctgtgaactctgcattcctcaccctttgttagccaactcttgccaccgtcacccacaacttgcaaactacagatccattgtgttaatcgacaggatcaatgatccagatcattgtgtccagatcatggcccttgggatccactcttctgcaagaggttgatttagctgtactttccaaacaaatgcaatgtcttccccaagaaaattctgatggcgaatgtagtctccctgttgttacgtgtacattttcacattcaactcaccacaacagtccttctaatatcttcattttacagagtagacaactaaaaataagagaattggcttgcccaatgtcacacagcagccaaaatggtggaggtgaaatctgaactctgtcattctatttttttaaaatgtgtaagagctacatcccatgcatggactgtgaggaaggtgactttgatggaagaaaggctagacatgtaggttgtgacctgtatttgtttcctatggctaccataagaaaataccatgaactggtggcttaaaccaacagaaatttattatctcacagctctagaggctgatgaaagtccaaaatctggttgttggcaggattggttccttctagagcctctggggaaggactcgctctatgcttctctcttagcttctaaggtcgctggcaattcttggcattccttggtttgtagatgcatcactccagtctttggcttcatctttacatggtgttcttctcttcgtgtctcctgtatcttcacatagccttgttataaggacaccagtctttggctttgcaacccaatgttgtgctaaactcctattattctcagtagggaaggcaccaggttctagaggccaaagaagagacccagagccagcaaatacgatatggagttttattagggacttacctacagggcagagaatctggtggcagcagtctggacaggacaaccaccttacatatagaaatggtccagcggcagcaggctggacaagataactgcacagcctagtggtggctggctgggcaggaaaatcacaactgctttcaaaaagactgtagtttctacatcacttaacagcctccccttaatgacctccacgtggcaactttcatttaacctagagctcagagcctcaatctcctgtacagctcttgttctatgggacgggatgggggctcagatgttcctcatgggcaaggaatgaatctgtgggttggttacgtctggattccctggctcagaacgcacattcaggtgtttctgccagacaaggtcattctaagggtatgcttaaattattgctataaggggcacttaccctacacccaccctaatccaggataaactcattttaactaattaaatctgtaaagatcatagtttcaaattaggtcatattctgaggttccaggaggacatgaatttttggcaagacattattcagaccagtacaggaccagttcatgaagagtctagaaggtattaccaagaaatttggactgcgcgcaaggggcagtcatgaagggtgactgagggaaagaataaccagagtcaacctgaaacccccaggaatctgattggctccgtgttctttctttctcacccagctccctatgccttgttgctttattaaggaattaaacagggtgggcgtccatcagcagatgagtgttttttgagagtggcagccttttcttctttttggaaactttgcatttgcctctgttgtgccttggactaatcagtatgccgcgtgaaactatttaaagcctgatgcattagtcacaacaaatctgctcctgctgggagttaaaaaggctgatcagggcgccagtttctttttggtgagcacagtttgtttttcccgttacttcatttgcatccagccccttggatttctcggacttcacgcacagagcccctttcctgaattgcccctggtacagagagagctgccaaggcctggtcaggccacctttgaaaacctttctgaggacagaggctgagacaaggccagggaccaaaacaggaggggctgctgggctggactgagctgggctgggctgggctgatccacggggaagaccctgatgcccagagaacacactgtgccagctggaaactgttgataaagcctgtggtgaccacttcagcgccctgctctgaccttttcccatctaatgtggggctattttaatgttgttttgaagctgagagagcaccagaaccttgggcctgctctcctggtggaaaccacaggcttcatctgcctttgtggtgttgccaaacccttgactgtcctataagggagcgggcttgagagtaacacagttggcctcaacgcgtgtgtggaggcctagggctcctgtttatttttagcaggagtactcaagcagcatggcagagtttctccatactgcctcataaggtgtcctcagattctggggctgcaggttgcacaagagagcaaccctggggtggtgacaagaagagagtttgaatttctgaattaaaggcttttgctcctctgcctcgggttaactgtgtgaccttaggcaagttgcttgacctctctgaacaccagttttatcagctataaagtagagtgggtaattcctctttatcgtaagattcagcagcatgaactaagaggatttctgggaaagtgcttcataggctgcatggtgtgtgatgggaaggtataagggacatgaatagccctgtatctggtgcacagtaacagcttacacttattgagggtatggtatgtgctatacattgttctgggtacttttcatggattgtcctatttaatctgcacaaaagccctaagagatactgttataatctctattttacagatgaggaaactgtggcttagagaatttatttgctgaagatcaaacagctaattaattgccaaagccaaattcagactctgcagcctgcagtcttacccccagtctcttggtgctgcctctctcagtgtcatcattatcattaccatcatcattgcccagttattggaacctggtcttcgacaaaccccaaaaatattatacattgtctctaatcctcacagcagcatcataatattaactcattgtaatatttacattgtggtgtaaatattatcccctccacttcatagatgaggaatgttgagaataaagggttttgttcactccgtttattgagcacctacatctctatttgaggcactgggacacaagaatgaacaaaacaggagggtcctgccctcatagaaagtatattttagtgtgaaggaaccaggtgatgtaatacctaagcacagtaatttcaagtaatactaaaggcagtgaagaaaataatgtaatgtgacaagtgatgggtcagggaaggcctctctgaggagggactgtgtgagatgaggcttgagtggtaaaaaagagccgcataaaatgtatgggcagtagagaggggctgaaggagctggagctggcgaagggtggtggtggaccagaggagcaggaagcagcgactgtgattgcaagtggggtgacttcgttataagaggcagtgcgggggaccaggaatccatccccaccaatgtatggaaggagacatgatggccaaggacaggcccaggtgactcagggaagggtgagctgagctggtgggcagccccagtggtgggtgaactgagcaggttgcaggggagcggggttcaggcttggggccctgtggagccctctgctattttgctgcagtgcagtcaactgacctgggggattgtgggttccctccacgccagctcgggctggttgtggtgctggtgcatgggggattgatgaagctggcaatcgccttgtgactagacccagctggctgccagaaagggagccaaaacctcaccagggaggcagagcaactgcttctgcccttttccacaacccccaggaggtcattgatcttaattaattatcccccctgaggattgtggaggaaccctcctgtctacagagaattactggtggatattctaaagaaccgaataagatccccaccaccaacttctgtcttgagagaaagaaggtgcttctgtgcaattgatcagaatgaaatcatagaactttggatctgaaagacacttttttttttttttttttttttttttgagatggaatcttgctctgtcagtggcacaatctcagctcactgcaagctccgcctcccgggtccacgccattctcctgtctcagcctccccagcagctgggacaacaggggcacgccgccatgcccggctaatttttttgtatttttagtagagacggggtttcaccgtgttagccaggatggtctcgatctgctgacctcgtgatccgcctgcctctgcctcccaaagtgctgggattacaggcgtgagccaccgtgcctggcaaggatctgaaagacactttaatgataatcttgtctaacacaccctaacttttaagaagaaactatggctcaggtattgtttgaatttagtgttaggaaaaatagtcggtgaaagtctttctgggaaaaaaacaaaaaccaaacaaatgcacttttcctgtcttagtaaacagaataaatcgattgcttggtcaaagagaggccaggaacaacatggagcggggcctctggtgctgggtactcctggggttggctcccacatcaggtactacttactagctatgttttcttgggcaaattgctttaagtctctaatttctcagtttcctgtttgtaaaatataaataataatgatatccacctcatggggttttttaatgtgaactgaaaaaataatatatacaaagtgctcatcacatcctgaaggatcattattcaatgaatgattgctgctgttgccgtttgaggcgcaggtgcagaagacacagatgagtggtgttgtggagcatgtggaaatgctgggggtggggggtaaggtggtctacaaatggcactgccgttatcttgagctcagccctccatagcatccttcaaagctgatttttttctttttgtaaatttccaaatacataggtgttatcctgtccatttgactctattttctgagagaggcaaatggataggataacacctatgtatttgaaaaagaaaaatactcccagttaagtgagagttccagcagatgaattagggtttaaaacagaactgtatcctcatttcatttcaagggtggcccagcatatctgctagtgtgagctttggcattgctcctctgagaggcaggctggagaatgagaccctctgtctaacccagccattctaggaccctgtcctttaccccattctcaggcccactcccaacccaactccagggcaatccagtaggtttataagatgacaattgatcttatcatcctaccagcatcatattatggtttagctgaaataatactggacagtgattctgttattagttatttccctcctggcttcaggggagaatgcaggcatgttgcaggaaaacagaagaaccatgcacaccaaccatcgactcacaagctctgagaagagaccatttgctggtgacgaagcactgacttgcccctttgctgggcttttcaggggcttggctgggtcttactatgccaggcttctttcccctctgtagaatggagtccctatcttcatgttatgcaaacggcaccttttcaaaataaactttagaggagtaagagagaagaatctagtgccctttctgagaaggaatttagctaggagaaccaaatgttgtcccatacactgggttaaaaagaaccagttatgaactacaaatgcagttgactttggccctgagctctatagggaaaagtagggagaaaaaatagtaacgaatcagcagcacaagcaatatttgcttgtgagttcttccagtcatgggcgtgaatgagtaattctgtcctgggatcctattgcctttgctttgtgccccaaggtatagagtttggaaaaataccagtgctggtggttcttctgtttcggggaataaagaaaaggaataccccattgggagtgctgttctttgaaaactgcagcttacctgagccctttgttgagatggaggccagaatgagtctgaaacagctggtggggaatccaaccacagggatcactcagaccaggacaacactgaagtcaagtttgctatggatgtccagaatgccaaaagagagggcagtctggaggccttttttcttgggggagttattcactcatttatcttctttttattaagtacctaccatgtaccaggcactgttctaagcagtgtggtgcaagaatggcaaaatttctattctatggaatttacattcttatggagagatgtagacaaaacacgagtaaacaaatacaaaaataagtttatttcagtgagcgacaagtactatgaagaaagtaaagttgaatgatatgctcaggagtgacaggggcaactttggatgaggggctcaaggaagaccactctgaggcagcagcatgaaaactgaacaatccaccaggtaaagaccagagagcatgatccaggcagcacaatagccaacacaaaggctccaggtgaggacatctgtggcttttcaatcaacacaacaatggccagtgtcactgcagcctcatgagttcgtggctgtttcagctttacacccagctactgtaaccccaactgcgatgtccactgacgtagccatttcctaggggagagggaggaagggatgtctagaactgctctaaggactaccagaaattactgattagaggactaatcctaccctcatcctcatctccacatttaacctaccattgagttctgttggttcatgctcccggttttctcctaggtaagtccatttcttttcatgttcattaccttcaccctggtccaaaccatctgcatccttcccctggtctactgaaccttgcccattcttcacactgtagtcagaatcttgtaaaacctcaaatctggctgggtgcagtggctcacgcctgtaatcccaacactttgggaggccaaggggggcggatcacctgaggtcaggagttcaagactagcctggctaacatggtgaaacctcgtctctactaaaaatacaaaaattagccaggcatggtggcacgtccctgtaatcccagctacccaggaggctgaggcaggagaatcactggaacccggaaggtggaggctgcagtgagctgagattgcaccactgcactccagcctgggcaacagagtgagattccatctcaaaacaaacaaacaaaacaaaccctcaaatctgatcatgtcagacaaacccacacacacatgccgaatacttcttcatgactccccattgctgtcagcataaagatccaaatccctacaatgatatgcaaagcccactctgtgcaaatccccaagttcttctccagcatgtttctagacatttgtggcttcattttccatgctctggccacacaggctttcttccagttgttgcaatatgctgtattagttctggcctcagggcctttgcagaagccttggctcctaatcttctgttctcctccatgagccttggcctcagcaactacttgggtatcagcatagctgttacttcagcagagaagtcttctttttttttttttttttttttgagatgacatctcactctgttaccaggctggaggacagtggcatgatcttggctcactgcagcctccacctcctgggttcaagcaattctcctgcctcagcctcctgagtagctgggattacaggcgcacaccaacacacccagctaatttttgtatttttagtagagacggggtttcaccatgttagccaggatggtctcaatttcttgaccttgtgatccgcccgcctcagcctcccaaagtactaggattacaggcatgagccactacgcccagccagggaagtcttttttattccttaacatcaatctactccatagggtcttttggttacctgtcctcaatagcacttcatattttccttcatacttcttagcacacttgtatttacctgcaatcttcctgcacttgtccataagctccaggagggcaggaaccttgtctgtctggttcactactttgtcctcagcacttaaaaagtatctggaccgcagtagatatgtgatatgtatttgttggagaaatgaaggaatgaatgctcacaaagatcttggatcttaaatgttccacttgaatatgctacttgcttttgacaaaatgaaataacaggagactgtctgtattttctgttccatttctctaccctatagagatggtgattgatatctggagtttaagaataaggcatagcatgcaagaattctggcagatgaacaacctgcttagaaagtctgttcttgccttcgactatcagaacagcattattttctttggctcaaaggaatctaagactgtgtgtactcagggaaatggtgtagacccacggtgtggagtcagggccaagggtgagacttaaataataattaagtgaaagagggttgtgtgaagcctgggggcgacactgcctttctcagtggctgcggaattagaacattctcccttgtgtcaatgtggaagtgaatgaattaggctccgttttatgctgtgcctggaaaaataccaatccgtactcgcatagtttctgaaagcaaaccccaaatgccactgtctcagctccatgggagactgttaaggaaaaaaaagaggtaacattcacagactatgggaaatatcactgaagtggaaaaagattagcgttgttgtttttttgtttttttgttttttttgttttttttttaccttttttgaagttacatacccctttggtaatgtaacaaaacctatggaccctccttccccttcactgccctgcccactgcaaaacgtatggccgtataacatctctctatccatggagacccctcgggttaaaaatcccagttagtgggtctgactggaaattgagcagaaataagctaataagagatggccaggaatctgaagtctaaaaaacaaaatagaagtagtgctctgtaattacattttttccattcctgaagttcttcgttttttagaacaagtggattggcacaggacgaacacgtgccttagtgaaatcatgaatgatgagacctctaggtcttagaggaagcattcctggagggaatcaaagtggccagccactctcagccactctcagcaccttcctggattttaactgatattttaactgataagcatgcattttataattaagtactgcataagaaaaagtattgtaatgaaaacatgtgtttatttaattgtactaaatttagaggtaagaaacaagaaaattttattgtccctggtctgtagaaaacaattccagacaactgggagaactcaatttgtccactgtgtccccaaataaaaatgcttcaacacaagcaccaaaaaaggaagggcatattcccaagtagacacagatgtattgttcatgctaacagatgtggtgttaagaaacttgaacccctggtttgttttcttatcagtaaaataggagagacaaatggagaattttttccttataggttgttgtgagaatgaatatgaaatacttcacatgtaagagtaagccttcagtacattcttttttcttttcttttctccaatagcatcagtgacatcatcattctttatgttatatgtgcgtgcatcttgcatgaatgtatatataaatgtctccatttgatgtctaatcatctcaaactggtcatgcccaaactggaactcttggtttctcaagttcatctcacagactgtttctcccttagtcttctgcatctttgtcagtggcagcaacacctgcccagttgttcaaactaaaaacctaagagtcatccttcactcctttctttccctcacactcatattcagttgcacatctttgccaatatgttgcaaaattgatccctcttcaccacactcactgctaccctcccagacactaccctcctgtcattcctgtgcaagtgtcctggatctgaccctcctgccaccaccctggaccctgcagtcatctctccatggtgtagccagtgtataggcattaacagatttacatcaggttgttccacttgtttgcttaggaccctccagtgacttttatttccagtgacttctgataacaccggaaataaaatttaaatggcttacaattctgtaggtctctatatgagagataagcaaactttttctgtaaaaagccagatagtaaatattttaggccaaatgggagtctatcacatcatcatcttcttctcctcctccttcctcatccttcctcctcttcctcctcatcctgtcctcctcatcttcccttctttccttccttccttccctccctccctctctccctctctccctctctcctcctcctccttcttcttccccttccccttccccttcccctccctctgtctccttctccttctccttccaaccctttaaaactggagaagctgaaagctgtccttaactgacgggcttacaaaaacaggttgaggactggatctggcccctgggtggcagtttgctgactcttgctctatacaagctggcctgacccttctctcctgctcacatcttcttgcccactgccttgctcactgtgctctagcctcagtagcttgctggctgtttgggggcacactggtcacattctgctcagggcttgcacactcctgttccctctccccgcaacattgccccttcaggtcttccatgtggcttgcttcctgcctttgtttaagcctctgcttgcagaagctctccttggagaagcctctctgagcagcccctccaaaatgctctccccactccaccccaaggacatgctatccctcagtggcttctctctctaggacttactatatcttcacttgcttgtttgtcactaatgccagcctagcatcagctcttccagggcaggtgccagctttgtctgtctcattcctcactctccctccctatcacccagaatagaacctggcacttagtggtcaatcagaaaaaatatttgctggatacattaataaatatatccatataaggacaattttttaattatataatatataattaatacatataaggacaattctgccatgtggccagctggttttcaacccctgtagtactactcatttgcaacaaggccctctttttaaatcctcagcccggttggctctgtgtaatgcaaagaggaatcggatgaaggtgccaagcagtgcttggggtggctgtggactgtgagaggccagttccatgtgctgtcatggtctgaagggtgaatccaagtgtgaacatggtgatgggggtagaggagagcttagccaggctttgatgtgaggggaactgtccagctctcaggaagctgatgtcattagagcatccctggacaataagtgctgagtggagccagtgctgatgtctcttaaggagggagtgaagtagctctcagagccagaagagtgccgagataaactgtccttcccagaaacacacagctgagccaacctgcaaaccaagttggtgtggatgggggctggatggtgcttatcagtcctggatggatcatggtgtgaaaagctggtagttctggagccactttatggagcatggtgcctctcagctccagatgtgaagcctcctactcctgggatctccttctataggccacttgggaatggcaactagagggaagcatctggagcagccagctataccctccttccacctccttctcccaccctgatttgctatagtccagaggcctcaggagaaatgagcttggatttgggtcattgaaaaagagagcctaggccccttcctagggcaatcataaaaggccccttggggggtggactgcaggggatgatcctgtggaaggctccaggaggacttggtaccctacacccttgagttttggctcatagtcagacgatgagtcttggctgaacctgatgccccaggatgggatggactgggtagtgagccaggctataaactgactcatgcaccaggcagggactggaccatccttggcccaggaaccaggtcagggaatgaaaagatacaagaatctcttctttggacttcccctaggatagaaactggggtgtatagatcagggtagcctgtacatatccacatttgggaattttatgtcctagatcatgagagtagctcttgattgtagtaaataagacagctgcataacaggagggaaaatgcagtgatagtacatgtcaaacttcatcacagccctgtctcaggagcccaaggcaggaggtcagatggtctgggatctaatcatgggtctagactgtgaccttgaaccaggcatttcacctttctgggctttagtgttttctcctacacaattataatggtaaaccttgatgttgtcacctcactgaattattaggatcaaatgagagaataatgaaagtccttgcaaagttaaaaatgctctagccatgtataacttgatccctagtcaagttgtataaagcaataataccaataggaacaataaactttcaatgagcactgatcatgtgacaggcactgtgcccagtgttcgcatgcatatctcacatggtccccacagcaatcttgagagacaggcatcattataatctgcatgtgcagatgagcgagcagggcatgaaaaatttaaataatttgccccaagtcacatattttccagggaagaccagaacttgaattcaagcagcttgtctctgaaggatgcactcagaccctgagggcctgcagtgcagatctccaggctcccagcccagccccctaggcttccttcaggaagataaccatgagtctgtccagtgaaaacagacccatgtctatctcttccctgcagacgggcttgatccctgccaactgcagagaagctgcagagcctgagcagagcctgatgtttaccagctctaagagctaagggttccagctgggacagcaaatcctcagcaatcctgggaaacagggagtgatgccagggcacagggtctcctccaggttatgaagagcagacacatgtggttggaacttcttcatccgggatgggcgtcctgcacgcacgttgagtggctctcaggaaaacatttccttgagaaagcagaggcagggaggcaatctctgaagggcaggctgtttttttccatgttctcatcgggaaggagagaagaaaaagcagtcagcacttcctctctgcagcccttcctctgggggcttctcatcccccttcacagcagcagagccccatggtgcagtttgctgtgcttgcctaatatcagtcagcgaagtagagtttgatgagttcagtcaacaaaaagtagccgataagggcttctgggcacccctccgagaatgcctgaggagccttttcaaggatggactggtatggcaaaaggacggaaaagaggtagaagaagtattgaaagaaccgtggcctttgtcctggcctagagaagatttgggaagccttggcacttgttctcaaatatccaaagggctgtcttgaggcaggctagttctatgtggactccatggggtggaggagggatggcagggactagtctaaggaaatacgcagaaaggcacagaagcttaggttccaggctatgcagtctgacaggcctgcgttgcaattccagccacactatttataagctgtgtgacaattagcaatttgcttaacacttgtgtacctccattgtactgtaaaatgccagtggtaccatattcaaaggtttattgtgaggactgaagatggtgatttatataaagcacttagatagtgcctaggacttttgctaataataacattattgtgtaaagtccacttgtcttgagaacctatgaggagggtatttggataggagctaataggtctaaggcctagtgtgaacctctcattaggcagctgtgcagctttggacagctcattcaacctctttgtgcttcagtgtccttctcaggaaaatgggaccatgccagccattcagcttagttcacagagcagttctaagaataactgccaggataactgatgtgagagtgtttttgaaaaatataaaaccaggttatcatgagttcttgatgttggcatttcactggaatatgaccaggaaggaagctgtggaaaggaattgagtttgctctggaggacctccgtactggttctgctctacaatctgagaaatgcccagaacagctgaggccaatcaacagcagcagtaattatgaccaatgcaatgtcatggacctgcgcagaagccaaaagcaagtcattagcagcacttgaagttttcctttgctaaacaatggcaccttcattttgggagttcccaggttgtcctctctggacttttggatagagggtgattgcagatacactctgtttctgctggtgcacctgtttcctccctcaactcatgtttgtggaccagacccagagtgccagcatccaccccgaccccagtggtgctcactggaggcaccctctcctgggctgggtgaaggaggaagccctggagtagattgtgtccaccgttgtgtatgtgtgcttgcaaacaaccatgtcctgggaggattaagatccctaacaaaaatggagttagtttacctactgtttttgttctaagggaaaggtttcccaagcctcccatcaggtaataattttttaacccacttcaaggctatttgttttcctttaattgttcaatcgggtaacttttagcaaccacattccctacagcaaaagggttattagggaggcactcagttcctcaatagttcccaggaaacatagaccacagccctttgggaaagacactgcttcttaaattgctaaccttaatccctagtgaccagaactggccaagaatgaaagggctgatcccacagggaaaataaaataaacaaaaccacaccaaccctcacccccaccaaaccacaaccaccgaaaacaaaacaaaacaaaaaaccaacagacaaatgcaacccagtgagagtttgagggcaactcctttctaaactgtttctctgaatcattcaaatacaaaaccagaacagagggcaaaagttagaagccattgaacttttaaaagtgcttcaacaatagctatccatatttctgtgcccacagttctgtggcaggaattttttttaagtttaaaaaaatattttttttttcaccttaatgaacccctagcccacctgagtagactagatatgcctaaaatgagtctttaaggcacttcccaaaatggccacaggtccccatgccctgaccctagaggtgcagctcctgggagggtgggaggagggaggaccagcagcacggaggcccttaaaagggggtcagaggtctcccaaagattgcacaatttcaacccttatctgctgcattgaggtggtgggtggggagggggctggagaaggagtcctcaggccccggatgttgaacagagcaaataaattccagaggcacctggcaacccttggattcatgggaatagcatgtctgctcttgggatatatgccctgggttgcttgggaccagtttgtctgcttgaataagtaaaaaaccacttaccctggagctttcaaattagtcttcaattattcattcattcatcctgaaacttattttttaccctgaacgccttctatgtttcgagcgttttgagggctatagagagaaatgacacgtaatcttcactctccaaaagctctccttctggtaatacttaaaagaaaatgtcaagtacatatccagattcccagcaaacaagtgaatctttagcctggtgagggcatcatgaatttctgatttcttcgtgaggtctcactcaagatgcctgtatgcctagtatttttggcttcccgtttcagtgcagtttatattcattacatttttgatggtacagtggaaaggggtctatctaggggactcagattcttctggaaaattagggagtaggatgggatgatctttaaattccctatagccctgacactgaatctgtcaattctatttaattataccaatgataagcccagtactattctgagtacacaaagatgaataagatagagtatctgttcctaagcaacttataatccagttgtaataatattaatgtcattgcttacatccataacaacaaatgaaatgcacctctctcctactataagaggagttgtactgttttaaaggccgtagaggagatagaaacaaagtactaagagcatttacatacttctgatgagtggaaaggatccgagaattcaccagcagttagttttgctctgagtcttgaaagatcaacgtgatatcaattggtagagaatggaaggaaaaaccttccatgctgagggaacagcctgagcaaaggcatggaggtgtgaccatacatgacctactccagaggagtaggcagcccacagggacattgggaggggtgataggagacactactctacccagaaattcttgaccctcatctgaccccccccattagaaggaagaaagtatctgagttgtcgggggagccaggaagtgacaaattaaaccctgtcaagggaacatactaaatgcagtggcatttagtatgcgcaatggggagatccctttacataattctttatctcaagaaaaaagaaaagggaagagaggaaggagagaaatcctttgctagcccaacccagccctttctgggggcgtattcattcattcattcattcgtaggcttgtcagtgtgacattgtgtttgccctcctgaaagccatacatcttactttcaaaacctccaacagccttcaaccccctgcagaccccagtgttccaaggctgaccttttggtaggaggcttactcccctccaaggctggtggaggggagacggcacctcttgtgctcaggccttccttgtcgctggcttgtggacaggagtcctttcttctctaggaaggattagtgcttttcttaaattcgactctgaagttctgaaaagcctaccaactgtgtacttccacaagctttttattttaatttttatacatcttcttcctttctttccaaggtctctgggtacccccagagaaggaaagagactaagtctttaagctacttgcaaaaatgtctgcacacagtttgccttcatgatcctagagatggcatttctggggtttcatttcctgcatgtaatatgacagtaatgcagacaactgcagaaataggggaccaggcagggaggcctgagttttactcctgtttggtggctttcaagtcagatgaagaggatcaatcactctccatctctgagcctttctctgcaaaatagcaaaaaggatccttttcagtattgctgtgatgaggtattttcagtattgctgtgaaaggtgtccagtaccatgctcaataaatagccactactatggctagggttttcatgcggcaggcaatgtgaagctcttctgtggtatttttatattcaagcccagctatttggaggcaaaatgggctccctctgacaagctatctagctcattccctcctccccatggggtgccacagtgcttctgatccttcttttgtcattttaagaccatgtaaaagctgacatccccccatcagccttgcctcatgtgtgggtggagaggcgtcagcccacatcatgcatgggagcagtctagagagcctactttgtctgaagttcccctggccggcccccaccgtgtctgagctttttcccattagtcattgctttggctgaaagagtggaagacccctgttaaactgaaatatgttatctgggaaatacattaagccattaacagctggacacaaattagtttatcagacagaggctgggcttgcagaatttaggagtgagaaggaactttatagatcatcagtttcttagtgaagaaaagaaggtccactgatgagtagctcttgctcaaggaaacaccagtggcaccttttgggatgccaggcctcaaccctgcctcctggcctgaacccctcttcattccaccttgatgagcaagatggacagtccaactttcattcaggagatatttatcatgtggctgccatagctgggcaggtgctgaaaattcagagaagcatgggaggcagacatgggagtgttgagtgattgaacgatgtgggacaggtctcttgtatggtgggacgggaaaggtctggaacagaggacaccactcagtgaaaggcagatccagactctgaggggtcagccccaccaggggctccacagtaccagaacactgggaccctacctcgtggctaccatgagagttcaagaatggtcatgctcagggagataggctaagctggcagtcagggccaggggatgggtcagaaagccatgagctgaaaaaagaggacaacagctggaaggcaccagaccacacttcagggcagaccttcataagcattgttccatgtggtcaacacagactgatctctttccgctacttcacatcaaaggtcttggtggaagattatggaaataggaggaaggagaaaggtggtaggaggggtttggtggatgaggaggttgtgagaagccacttctgtctctgcaaatctacagggtcctgacacctgtgaactcacagccattaccctttggaaccatctgtaccatcatgctggtgatatcaggcatctcttccactcacctcttcttgcttgggtcctcatacccatcccctgcatgatttcaacagacatctaattggtctcccttcctccagtctctacctttttaaagctatcttcttgctgttactaggtcttcttaaaatgggagcttggacaaatcattcccctatttataagaattaagaatagagtgtcctttacagcaatcttgcttgtcccagcctaccaaataaccccatgtgatgtgaacacacagaacctgccatgaactttcacccctctacacccttgcacatgctattccaccttcctgagatgcttctctcctcttgtcaaacctgccagaagcaggtcagcatcacctctgtgaagtccttccatgctccccagccttgtgcattgttcttttctttttgcagagtttgtggaggtcttactctgttgcccaggctggagtacagtggaaccatcatagctcattgcagccttgaactcctgggcacaaatgatcctcccaccttagccttccaagtagctgggactaaggcatgcacaatcacacctggctaatttttaaaattttatgtagagacaaggtctcactatgttgttcagtctggtcttgaaatcctagactcaagcaatcctcacaccttggcctcccaaagtgctaggattacaggtgtgagctaccgcgctcagccagcttttttctttatgacccagctgtacactatacaggcctcttttgtagcacctgttgcattacattgcaactgttggtgtatttgtccattttcttactagactgtgtgtgtgcatggtagggacacacacatacacacagagagagacacataccccagacaaggaatcctccctgattctcaacaccctcggcaaagctgggtaagtgcatcatggtagatgctcaaggagtgtttgctaaatgagctagaatacctatgacctaaggtgtgtgagatctgaagggaaaggtcacaggctttattctctttaattaaagctgaggcaggtaccttctgtatctccctccacaccttcccatctctccttgtaccatgagtggtattttttcacctttttccagcaaagattggaaactagttgctcattcaatgactttctgcagatgtatagatcgtaaatgttgtggctatcctagaaagtataatgaacctaatgatgttttcccagaaaatgtataaatccctgatcttgcagtattttcacacaatcaggattttggattctttatccagccactcaactccaaggaactttaggctttaaaaagctgtgatagagatatcttgtgttttgctctcttagccaataagatttgtcaagctttatttttggaaaaattattttaggatttgttttccaaatatataaatatattttaatacagaatatgctttttcaaatgacacatgctctctcatttctgatatgttgtcctagcctgtgccccttcccttgagacagcaaatattgctgcctctgtttcattcttcagaaatgtgtgtagagatgtacatagaagggcctcttgtagtcattcagtctaagttagggcccgaggcaggatgtgggatctgctgcctgggtctggctcagtcctagctgtagaggaagctgcatggacggacactaggacaatcatcaacagcctttcatttgggaaacatttactgagctcccactatgggccacacattgttctgggtactggggaacagtagggaaacaaaacagacaaggttgttggaatttgtagtctagtgggacaaggcagaaaagaaacaagaatacaggttagctaagttaactcagtaggcaaaacaatgacgatgagacaacagtaatggagtggaagagagtgtgggaacgagaagtttcaacattaggagtcagaagtctccctgaagaggtgccattagacatgagaccatgggcaagtctagggggaaacagtgctccggggagtgggactatcacgtgcaaaggtcctgaggtaggaatgatttggatgtgtttgagaaaaagaaagcagaccactgttgctgcaacacagctggccagagggtgggagaccaggttgcaggtcatagaagagagctgggatttttaaactctgaaaggaaatcaagtcctgaaaggtttaggtagggtgacaagttgatctaattgccatgttttaaagattagaatgaaaaagattaggaccaattttatcacctttcctcattatgaacagttttgactacggaaatgaatatataataaagcaatccatgatttctcattataactctctgccagtgggggagagccaggatttccatcctaggatgtcatggctgcccaaatcagaaacaagttccgaggtctgggtggctagtgccatctttccttggggagctgaaggattcttgagccttttcaggataccgaaagttgctggggacccctggagggtcactgccagatgagaggatgctggacctaggacaagggttgggcaggaaggtggggaggtccccagtcctcaaaggaaggcacccggggcctgtggcaggtggagcaggcagacgaggaaataaaggccacaggctgcctcctctgtcgctgcctgacctctcctcctctccagagggccttgaatggcctttctccagcagcggccaggcaaggtgtgtttggaaatacccaaactctgtccttcacgtggcaggaaataaatattgctgggaacgcagcgtgtgggctggggcaggggtgtgtgtgtgtgtgtgtgtgtgtgtgtgtggttagagttgtgggggtcagaaaatgtgtgtgtgtgtgtgtgtgtgtgtgtgtgtgtgtgtgtgtgtggttagagttgtgggggtcagaaatgcatccatcctgcagccatagttccaactgctccagggggaggcggctctgtcaacttgcgtgagttctgtgcagaaagaaaatgcggatggagatgagtgcgcatagtgaggcgccggctggtgtctgagctaagaacccatggggacccgggagccatgaactgcgctccacagccccttcccccggcctcacccctacccatcttctgcccaaggctctccctactacccacgccctccccgaaatagttaagtatcctcccaccaactccgaccatctttcccccttcgcgcccaccggcggcagtggcgaagggcccactgaagcgccgggtgccacgcggggcggcccgcgggccagctagggggcggggaactcaccagccgccgacccccccccccaccccgccctcggccgccgcggccccagcggcctccgcgctgcgaggagcgggcgcttggacacagggcgagttgtttgatttggcggaggcggggaggccggcggggagcgagcgagggaggcacgagagctgggcagcgcgggcgccggtctccagggtagggtccccgcgcgcagcagcggccccggggcgggggcgaggcgaccgcgggcgccggggatgcctggaggggccgcggccgagaggagacccgggactggacggccagacctgccgggcgcgcgggcaggtgcttcggctttttttttttttcccctcctcctttttcctctgccccttccttcctcgccctgaagtaagatgagcgtgatgctgtggcgctgggaacagaataacaccaccatgaagctggtaagggtggattgcagaccgcaccccctgggcgctgctctactttttaaccccccaccccgccccccatcccctttaggaactggcccgggtggtggaaagcccctgaaatgcattccgcacttggtatttcccttattgttttgaagctagatctcaggggaggtgtgtgtgtttaaaccaggaaagtcgatgtgtgtatgtctctggttgtgagtcattgaaggggggtgggactgggctgcattatctctccgtcccttccacctacgaattcctggagctctcttggattgcacacgctgggattgtctcctacgagcatgtctgcgccctcacagcctgtcccgggacagcgtggtccgcgtcccccgagcccccattgtgtcttgatactttggggtgcacatggctattgatctctactgcggtttggcttgtctgtggggaatacatgagccccgagtgagtgagtatgcaccgggtcctcctcccgcctctcacaatggcttagttctctttcaagcttgcaaagaaccatccagggtgcaggtactttttccctcctccgttttcaaaaataaccgcctatcagtcccgggagagctgaggatagcaggattttccttgctgcccaaagaagcctgagttgtttctccatcccaaagaggaaatgtgatcggaaatctctgggttttgcttttgtgaattgtttttttatcggatagtttcaactggcggggaccataattcccccattaaagtcagccagtgctgtggccaagtcggttaacccccttggatgttagtttccttctcggtaaaatggagcaagttcccaccttgtagaactagtgccaggataagaaatcatatttgtggattgcctggcatataaaaaggattcagtaagaaataggtatgattaataaactggaatgcatacttactggtgtgaggtctttaaagatgctaccaaaaacaaaaacaaaaacaaaaacaaaacacaaaaaaaacaaaaagaaagaaagaaaagaaagtcacagcagctgcattggataccaagatgctaaatcaaccaaagctgggtcttcatataatgaacttatttgttggaaaaatggcaccttgcttttcatacttcttgtgttatgtttggcctgcctaactttaagctactattttacaacttcatttaatgtgctgtaacattagcagacgttatgcacctttgctatactatgtcatgattccagctccctaatcctttcctggaatctttctccaaccagactggtgtggaagaggccagagtttcacataatttctctccaagctgtacctgagatgccactctaacaggcagcataggaaagctgggtcccgatctgaactgcatagggtcaggttgccaaacctaaatgcttttttaaaaagaagaaaaagaatgatttgccaggcagggaaaacgtggagcctcccaggggatggcttctggagcttggtggcaggtggccatggtaagggctgggatgtcttctccactccgatattgctgcccgtttagtctatggagggagctttcctcaacaagggtcaggggtcagcctttattgggtctgcctgaatctttagagctgtctcacttttcaaattaactgtgaggaccacccaaggtagttatggtccaccaaaataccctttccccatgaggtggaggaagggctaggggagctcaagcaactgggaagccctgagggagtagcagtttctgtcccgtgtatcccactgccccagagcccaggcaggaagaggcatgactgggtcttggcgtccagatagcctcagatatcctcagtgatgagcctcagcttttctgtgaatgctagaaaccactgatacatcattagctgaagtatcattagtttgcattttgttcattcacttattgattgatcaatttaccctttatttgttgtgtgttttgtgcagagcacagccttggtgcctgtgttcgttgtgaaagattttgcttgcagatgattcttggtttgaattccagccttgccacttactaatccctgaatcagttttcctcttttgtaaaaggctgttttacaactctctttccccaggttgtgaaaagatgaaatggcataatacaggaacatgatccagcatagagttggaagcatgtttgtctgttaaatgggaactatcattattttcttcagtggtaaatgagacataatctgtccccactctacgttgtactgttgggtgaatggttggttcttctaatgggccctgggaaaacaaacctttcttacctttgaatcattagtagccctcagcaggaaggagctccctgggaacatcttggaagtcaattgtgtgtgaataactgctccagaatgaggcctggggccagaggtgtgtgcccgaacttttatcactgatgcacttcaataaacatgaaatcagttaacccacagcttgaaaatgcattgttttgtttgaatagtagaattaaaggtcttgcttcatgttctattttaaggctaattggatcaaaaataaggcccagagtaattagaggcaaaacttgcatctttatatgttatctctgcaggggaatgtcagaaatgcacctgcccacctaggagagaaggcagtagctggtagatcctacatctgtccaaatcccatctgacagggtcacaggcctttgatgaaagtgagaggaggtgactgcccaggtccaaagcacccactgggaggggataagcttggggcacagccacagagcatactgtgggtggttctgacattcttaccaccttccctccacaccctagttcccttcttttaaattctttggacttaggcagagcaaggagaaacaatgaggccacttatggagcagctggtattatttgaggagtggtagagtccaagaatggcaaaaggaaaggcactgagagaggccccctggcagcctgtgctaatgcacggagtgcaggtagtccagtcagaaagacctgtagccagagctctgcacaggagccactgccttgtgacatgggccagttgctttacctcttcgatctttggttttctcattgtaaattgagactacagcacctcacagaattacagtaaaaattagggaaaaaaatgtatccggatttgagctcagcgttctgcaattagttggtggtcagtgaatggttgctcatatgatgacggacgagatgaaccagtagtgtgtgcatttctccacacacagagaaaagactcaacagaaacattcccaaaagtcaatagtgccaagttcttggggggaagttaccaggactgttttttgtttgtttgtttgtttgtttgtttttggtctatacttttccttatattctagttttgtacaaagctcatatgttacatttatcatcaagaaaagattttttaaattactgctaaaatcatattaatagctaacatgtgttgaacctttactttgagctttatgtgtatgattctatttcatcttctctacaatcctctgaaataaaaactattattatctccattattcagataaagaaattaaggctcagagagttaaatgacttgcctaagattccagagctagtaactttagaagtgctgctttgtctgatggcaaaggctgtaccttgaactgctgtatcagacaccctggatgcctcctagagcgctgcagggcctgctgctgaggtgggtctgcatgagcgtgcagtatagatgcctgtgctcactgctgcagttctctctgtgaggggcctctctgttcactgcaatcccctcttagcccctttgatcagggacatcctgggagggaggtggagaggagagtggggatgggttgggtcatcacccttcagcgtcttggaaaacacttaagggggctcttcctcaaaatgaaggagaaagtggctctgcatgaagaataattgagaataatgatgatgagggaaatgtgcccctgacctttgacctttccccagagaggcattggtcaaagaccccctgggcctgtccacagccaggctaacaagcagattaaaagaggtcagtgggttaaagggctctgtctgcttccctgtagttatattgctccctcccaaaggccaggatgctgtgggccctgcagaactcctgagctcccaggtgctgtgtttaaaagacaaatgctcctttagcttttttttttttaatccctaactttatggaggcttaattgccaaataaaaattgtatatatttaaggtgtacagtgtgatgatttgatctatgcatacattatgaaatgattcccactatcaaactaattaacacatccatcagcttgcttcagctctttacacgtatagactgattcccatcttaacaacttccgttttttttcctgactaaagctcattaacactcacatgaaagtattaccaccttcagctagaaaacaacggtcatttccactctcagggacttctaggactttctcctgctttccactaattgtaactggcatagatttgaccatctcccaggtactgaagtcatgtccattttctactaattccccaaaatctcaagggcaagaagttccattctttccttgagaaagcaggttggaatatacaggaatagttccatatgcatttccgctgtgggtaatgagccctcatagccttgatgtactttcctgaattgaaaccaaagcatgtgaggaaggttttgactttggttaattactaggaaaataaagaaaggaatattgggagggaaggagagaaagcctctgaaattagtaagtgacttcctcttaatgacattttgaggtaacacattttccttcatttttgtgttaatagagaagtagagatttataattggtccctttggtgacctggcagtgcttacattacttatgcaattgtttttgtttttgtgtgaagccagggaaaaaaattgttttgtttctggctcctgtaatgtaatgccagccacccagaaggcatgtggctaagcttttcttcagggtctctaagactctccaggacacatggaccaggctgccattgtctttccagctgccagcccagagatctgggctgggtgacccaggtgctgttcccaagggttgttctttttgattcagagattgttacagaaatgctgtttctaatataagagcaatagccagggaggtggaaaggcagtggaagagcctgacctcccactaagaatgggtgttagagtgaagggttagaatgagttgacagatattgtttaaacagggtaacaagaaggtgtgatggagatatttggctgggctgagatgtagtcgaggattgcccttgtgaccagaaataatatgtctggttataacactgtggagtgggacaagggtaagcacctgcattatacattatctttgtcatagtgagagatgagctgtgtgcttgctgggaacatgataggtcctgtggcacaaatgaatctataggaaagcaaggcactttaaatgggatttatcagctccagtatgtttactgggcttaggaaggtgtgtatgtctgtagagggtccaggagtgagtcttttgtttcacagctatagctttgcctatttttctagcattgttcccgatgtgaagtttcaggattcaagactactgatttctcgttccaacctttgtgggatccagtccattggtggatgaagtccaactcctttgtgggattcaaggccttttagatgatagcagtgttttaggtcttcttcagcagagcttccacatagaacctgttagttccaatcagcatggttggcctggtgatattccaatttcacgcttcttccatctctccatgttatcaccccatccttttgaagctcagattgagtcccctttttttaagaagccctccctgacttcttaaaaggagggcttttaagccctgacaggcagtagtatgaaccctcgtctgattctctaagtccttgagctgctggtggatgtggtatctttgctatcagactttgaacagtggcttcatgcatagatactggggatagtcaaaccccccttccctcctagctctgccaatgatctgtgcaacctggggagaatattgctttatttctctgagccccagtttcttcatctgtaaaatgatgatgatgataatcattccaaattcaaggttgttagggttgtttagtaagatacaggtattcagagcagcatccaagcacatagtaaatgctcaataaatgttagccattgttataatgataatgatcatgatgttaccttaattcatccaacacatttatgaaacatcttctaggaactagggaatatatgagtcaacaaaaaagtttcatacctatattttactggaagaaagagataataagcaaaacatgttactttttatggtgatgaatgctattatattaagaaaaatatagcagggtgagaaggatagggaggaatggtggaggttacctttaatgtaggatggttaagaggggctttattggccagtcgcagtggcttatgcctgtaatcccagcactttgggaggctgaggtgggcagatcacctgaggttgagagttcaagaccagcctgaccaacatggagaaacctcgtctctactaaaaatacaaaattagctgggcatggtggcacatgcctgtaatcccagctactcaggaggctgaggcaggagaatcgcttgaacccgggaggtggaggttgcggtgagccaagatggcaccattgcactccagcctgggcaacaagatcaaagctccatcttaaaaaaaaaaaaaaaaaaaaaaaaaaaagaggggctttattgcaaaagtgacatgaatattgtataataataatagtaattattattattattattgacactccttaggtattataccaggtgactgtatagtttattatcccaaccaagatacttctgagagtgaaagggagtactaatgataattgcattccctttgatcattgagatacagttgtaaattttggtcctgtcttgggcagagtaagttgcatttatagttgcacttgatcactccaagtataagagatagtatggtgtcagacagacctagattcaaatcctgggttccaccactatctgtgagatcttggaatagtcatttaacctctttgtacctcagtttcctcatttgttatgcatacctaatagggattttgtgagaattaaatgagataatgaacgcaaagcgctcagtacaggacctgacacctcataaagagtcaacagaaattcatcatcatcatcatcatcagat

SEQ ID NO: 122 - DNA, 9246 bp, Homo sapiens
acccgcgctcgtacgtgcgcctccgccggcagctcctgactcatcgggggctccgggtcacatgcgcccgcgcggccctataggcgcctcctccgcccgccgcccgggagccgcagccgccgccgccactgccactcccgctctctcagcgccgccgtcgccaccgccaccgccaccgccactaccaccgtctgagtctgcagtcccgaggtgaagcccccgccaggcccagagcccctgtggccccctcccttcgccgcggcgcccctgcctcctttacccggtgccgctgcgcacctctccgcatctctggcccggtgcagctgcgcacctgctccgccgcccgcgcccagggcgccttccctccctggccttccccgcccgctgccttcgctttctggccctctgcgcgcctatctctaactgcgcctctccacccttgcctgcctctctcccggtgctcgccctcatctacggttctatttgtttctaagttgggagcctctccgggcggtgcatttttatcctagagcgtcccttttggtttgcatttggggaaatgtcttctctcaccgttcctcacctcccccagacttcccttggactcccctctctcctgctcttccccacggcgcccctctccgttcgcgcttcctcccctctgctgcacgggggagagatggaagaagtggggatctgtcgaggcgcagaggggaggacaggcccagctcgcctccactccccaccggctcttatcctcttcacttcccgctgcaacccccagggactgcagggcctttctcaggaccctcttccccgacacctgtattgcatgcgcctttcgcgggaagaggagggatacacgtttgggagagagtgggaccttggggaaggggcagtgttcaggcagctggggtgttaagttggggaggtatgggggctctggaagagaggcccaggcagcccatcctcttcttggctcccaggagaaatgcaagcctggcagccattccgctctgaggagatctgggggaaccccaccggctggccaagctgcaaagaggcgcgggaaccactgtcgtgcccctcccctcctcactgcagtgttctcccatctcatcatttgatcttaccccgccccccactgcagtgacctccccttcctcactgcattgaccttctcctcttcccaggggggagggggaatcccttctacagccctagactgcagccagcgcctccctacccaccccccacccactgcagtaacctctttcccatccctcccagcctcccgccccgcccattgatctcaggctccacccctctaagcctcttatctttctccttccttcccttccacccgaggagatcccagccatcatgtccatagagaagatctgggcccgggagatcctggactcccgcgggaaccccacagtggaggtggatctctatactgccaaaggtaatgggtgtggcatgggccttcctacagccctagcttttccacggccaggctgggttcggccaggggttcggaggccttttttgatacccaggggtatggggtgctgggccaggctcacaagcctgggttgtggcggttggatcctccttgtccggggagccagggtaggtgggtctgtgttcgagtttagcgtgtgaggcatgtcctgcctccgtgtgtctgcctgtgcacttgcatgtgtgcagacgtgtgctgcaagcaattttctttctgcgggctcccacttgtgcatgtggggcctcagatgggtggatgaggaggccacttcttgtgcatctgcctcagtgtgtgtgtggggtgggggtggggggatgttagggagcagtgtggggagagagctagatgtggtaggcaggcagtttagagccagaaggctgaaggactccctggcccctgtgtcctcttcactccctctcattccatgttcctcctttaggtcttttccgggctgcagtgcccagtggagcctctacgggcatctatgaggccctggagctgagggatggagacaaacagcgttacttaggcaaaggtgaggtcccttctcttttccagactctcccccacctcagccttatgcccctacctcacaccagtccccagtcctcctctagcatggcttcccctcctcccattgatcccttccggcccctcctggcccgacccagtccagcctcttcctttccccaggtgtcctgaaggcagtggaccacatcaactccaccatcgcgccagccctcatcagctcagtgaggcctgctctttgctggggatagcagggccagagttctggaaggaatcccggagcagggcaggaggaagggaagaaagaaggcccactcttaggaatcatggttacaagggggaagggtggggaacagcttccttaatgcaccctgctcccatgggagttcaggtcccctaatccaggtaggcccctgtcacagggacctggttggaccctggccaaatgtgagcttgggtgtgaatgaggggaccctctgccttagggctcagcctccagcctggccctgggtgatggaggctctgccctcagggtctctctgtggtggagcaagagaaactggacaacctgatgctggagttggatgggactgagaacaaatgtgagccggggccgggagaaagtggggaagcgtcagggtggggaggcgtggagcagatagagagctgaagggccagtgctgtagtggcttcctcaggaatgactgtcaggggcattctcctctcaaagccagagcaaggggagatgagtttagctgcagagggaaggaccgacagtaggcagaaggaagaccttctttgcagcatacagaggagggggatggcctgagagagtctgtggtctcagggatatttagaaagaggtgtggctctctgccgtttccaatctcctcctccccacccattcctctccctgctgttttcaagagagcatggatgaggtgttgctggggcaggggtggggagggaggagggggtctcctttactggctccttttggagactacagatggaggcaggagctagaaaggagaaggggacattgtgctcagcaccttcctctataatctcctagccaagtttggggccaatgccatcctgggtgtgtctctggccgtgtgtaaggcaggggcagctgagcgggaactgcccctgtatcgccacattgctcagctggccgggaactcagacctcatcctgcctgtgccggtgagcaataagccagcctgcggctctcccaggggcgggtgggggagggagcatgcaactcatgaggaatgatgggaggaaagtgaattgagggaggtaaagaggaaggatggggacgtgagacttagtccggaaagctgggggaagtttgggatcttgggttaacactcctggggcgggcagggaggggctctttgacccttctgtctttctgtggctccccaggccttcaacgtgatcaatggtggctctcatgctggcaacaagctggccatgcaggagttcatgatcctcccagtgggagctgagagctttcgggatgccatgcgactaggtgcagaggtctaccatacactcaagggagtcatcaaggacaaatacggcaaggatgccaccaatgtgggggatgaaggtggctttgcccccaatatcctggagaacagtgaaggtgaggccaggagccccactcccagctctaagtcttaccctattgtgggacatcagaaagggtgacacagttcaccaagtcctgagtaggcgtggagggtcctaggactctgcaaactccaaaaggtaccagttcttagagtggattgcagagagcctgccaaattcacatgcagacctagggggacagtatttttttttttttttgagacggagtcttgctctgtcacccaggctggagtgcagtggctcgatctcagctcactgcaagctccgcctcccgggttcacgccattctcctgcctcagcctcccgagtagctgggactacaggcgcccgccaccacgcccggctaattttttgtattttttagtagagacagggtttcactgtggtctcgaactcctgaccttgtgatcggcccgcctcggcctcccaaagtgctgggattacaagcgtgagccaccacgcctggccaggggacagtcttttacctgcctagccagatgtgttagcatctgttaagttgccactggaaggccgggcgcggtggctcacacctgtaatcccagcactttgggaggctgaggcgggtggatcacctgaggtcaggagtttgagaccagcctggccaacaaggtgaaaccccgtctctactaaaaatacaaaaattagccgggcatggtggcgtgtgcctgtaatcacagatactagcggggctgaggcaggaggatcgcttgtacccgggaggcggaggttgtggtgagccgagatcatgccactgcactccagcctgggcaacagagcgagactccgtctcaaaaaaaaaaaaaaaaaaaaaagttgtcactggagcccttgggaatactgggagatggtctggatgactgttggattcatcccatccattcgaaatctgtcctgtccccgtcccaacctcctaggcctctagaatccctaatttttctgtgccttgggggaaactgtatagggaatggaaagaatataggtagtggttaagagttaaggttctggggccaaataacctggatttatttgaaccttgacttgtggagttactgctggtgaactttcttacttctctctggaaataataacagaatctagctcatggtagtgtgaggcttaaatgaaatatatataaaatgcttagatgacatgataccaatgaaagtatagtaagtattattaagagaattccattcctctgtgttcctagaagatggcctctcctcccagacctggggataaccccaacagcatccccgccacacttccctcaggaacagccctccacctctgccctgaatgtcttttctttccctcctcctccttgcccatccctcctgcttgtactataatctcactgtattctgtccccagccttggagctggtgaaggaagccatcgacaaggctggctacacggaaaagatcgttattggcatggatgttgctgcctcagagttttatcgtgatggcaaatatgacttggacttcaagtctcccactgatccttcccgatacatcactggggaccagctgggggcactctaccaggactttgtcagggactatcctggtgagaggaagtggtgtgagggggaggtctgggggcaggcagggacgtgtcccagcaactctggaccttatggggtgctgactcaggcaccaggtgggggtgtcctaagaagaacctgagaaccagggagagggtgcaggagccacctgcaaagactgggctttgtatgtagtgtaaaaatgcaggtacccgtgaccaatctgttctgtctcagatcctgattaaagtcatgggttctgaaaactactgggtcatggggaaggctctggaaggaaccagggatgatatgagtgtgactggatctagcagagaactagaacatttcagtatctttgattgatgaaattgtggatgctgaatggagctgggactgatgtgtgagtagaaagaaggctgagggggactgaattagcttctgcaagtctgcccagggcctttatctcaggatggaggcagttggtcgccatcttcctgacacagagcgaaagaaaatcaacataattgcagaattaaggatttggattagcaatgaggaagggcttgctggcagtgagaacaggaaaatgcaaagctaggttgtgaacccttgttactggaagattttttttggggggggggtggggttgttttttttgttttgttttttttttttgagacagagtttgactcttcttgcccaggctggagtgcaatggcgccatctcggctcaccacaacctccacctcccggattcaagcgattcttctgcctcagcctcccgaatagctgggattacaggcatgtgccaccatgcctggctaattttgtatttttagtagagacaggggtttctccatgttggtcaggctggtctccaactcctgacctcaggtaatctatccaccttggtctcccaaagtgctgggattacaggcgtgagccaccacgcctggctggtttgcttttaattaactttttttttttttttttttttttgtagagacagggtttagccatgttgctcatggctggtctcaaactactgggctcaagtgatctgcatgcctcggcctcccaaagtgctgggattacaggcatgagccactgtgcccagcctatggaagtggcgtgagatctctgctcactgcacgattctcttagcctcccaagtagctgggattacaggcgtgcaccaccatgcctggctaatttttgtatttttagtagagatggggttttactatgttagccagggaactcctatcctcaagtgatccgttcacctcagtatcccaaagtgctgggattacaggcatgagccactgtgcctggcctctccatgtaaggttttatgaaataagaatcaggagccaggcgtggtggctcatgcctgtaatcccattactttgggaagccgaggcaggaggactgcttgaatccaggagttcgagactggcctggcaatacagtgagacctcatctctacaaaaattttaaaaattagctgagtgtggtgccacacacctaaagtccctgctactcaggaggctgaggtggcaggatcacttgattggggaggtggaggttgcagtgagctgagattgtgccactgcactccagcctggatgacagaatgaggctctgtcaaaaaaaaaaaaaaagttaagaatcagttagggcaggcttacactggggggatttgtcttagcaaggatgagcaggtgtagttaaccaagggcctgtccatttcagggaataaaggggcatgttcctgcctgatgtagagacccagggaagatgaacacctcccccctccccaccatgctctctctgcagtggtctccattgaggacccatttgaccaggatgattgggctgcctggtccaagttcacagccaatgtagggatccagattgtgggtgatgacctgacagtgaccaacccaaaacgtattgagcgggcagtggaagaaaaggcctgcaactgtctgctgctcaaggtcaaccagatcggctcggtcactgaagccatccaagcgtgagtgacttctggccctctcctgtgtggtcctcgtttctataagactccttttgcaagtgctccagcctaattctacccaggggtgccaaagagagcggggaacctggaatcatcctcacagttctctcacctctgcccctccacccctgattctctgctcccctcccagatagctttcccctagatgtttcctgacatagaccaaggttggggctgggaagagagtgcccagtgtgagagctggagaatcagtgctgtgtgtggatacaggtgcaagctggcccaggagaatggctggggggtcatggtgagtcatcgctcaggagagactgaggacacattcattgctgacctggtggtggggctgtgcacaggccaggtgagtgaggcagcctggtgagtgaagagaactctctgtgggattggtatttctagctcacccacctggtctctccttccaggtgtttgagggtgtcaggggagtttcaggagagcagaagtttcctttcaggggtgagagggcagtcactgagctgcaaatcctttgaaatgtttcagatcaagactggtgccccgtgccgttctgaacgtctggctaaatacaaccagctcatgaggtgagggtccctggggtgggagcccctggcccagatggctaaaggccccatttgcctgccagaccatctgtagcaccaagggcctggataacagtccatttcctggataacagtccaacagataatattggtttttgcttcctgggtttattgatggcctgattgacaaatcccagagatcacatgggaaagccagggaatgctaagccttggggcaggacacaaaagcaggtggtgtgggggtggttggagtctgggggacccctagagagagaagcaggatcctcctgcatccctgaccacttcctttgtggttcatctctctcagaattgaggaagagctgggggatgaagctcgctttgccggacataacttccgtaatcccagtgtgctgtgattcctctgcttgcctggagacgtggaacctctgtctcatcctcctggaaccttgctgtcctgatctgtgatagttcaccccctgagatcccctgagccccagggtgcccagaacttccctgattgacctgctccgctgctccttggcttacctgacctcttgctgtctctgctcgccctcctttctgtgccctactcattggggttccgcactttccacttcttcctttctctttctctcttccctcagaaactagaaatgtgaatgaggattattataaaagggggtccgtggaagaatgatcagcatctgtgatgggagcgtcagggttggtgtgctgaggtgttagagagggaccatgtgtcacttgtgctttgctcttgtcccacgtgtcttccactttgcatatgagccgtgaactgtgcatagtgctgggatggaggggagtgttgggcatgtgatcacgcctggctaataaggctttagtgtatttatttatttatttattttatttgtttttcattcatcccattaatcatttccccataactcaatggcctaaaactggcctgacttgggggaacgatgtgtctgtatttcatgtggctgtagatcccaagatgactggggtgggaggtcttgctagaatgggaagggtcatagaaagggccttgacatcagttcctttgtgtgtactcactgaagcctgcgttggtccagagcggaggctgtgtgcctgggggagttttcctctatacatctctccccaaccctaggttccctgttcttcctccagctgcaccagagcaacctctcactccccatgccacgttccacagttgccaccacctctgtggcattgaaatgagcacctccattaaagtctgaatcagtgc

SEQ ID NO: 123 - DNA, 3560 bp, Homo sapiens
agcggaccgacgcgacacgccgtgcgcctccgcggctgcgctacgaaaacgagtcccggagcggccccgcgcccgccgcacccggccctcgcccgcccgaagacaggcgccaagctgccccgccgtctccccagctagcgcccggccgccgccgcctcgcgggccccgggcggaagggggcggggtcccgattcgccccgcccccgcggagggatacgcggcgccgcggcccaaaacccccgggcgaggcggccggggcgggtgaggcgctccgcctgctgcgcgtctacgcggtccccgcgggccttccgggcccactgcgccgcgcggaccgcctcgggctcggacggccggtgtccccggcgcgccgctcgcccggatcggccgcggcttcggcgcctggggctcggggctccggggaggccgtcgcccgcgatgctgctctccaagttcggctccctggcgcacctctgcgggcccggcggcgtggaccacctcccggtgaagatcctgcagccaggtacgcgcggggccggcggggccggggccggggccagggcggggaccgggggcgccccgggccgcaccaaccccgcccgcgcctccctgcagccaaggcggacaaggagagcttcgagaaggcgtaccaggtgggcgccgtgctgggtagcggcggcttcggcacggtctacgcgggtagccgcatcgccgacgggctcccggtgagtcggaccgccgggcgggcccgggtttctcgcgcgccttgcgcctcgcttggcccggcctgacccccgcgtctccgcaggtggctgtgaagcacgtggtgaaggagcgggtgaccgagtggggcagcctggtaagttggggcacgggcggcggcggcggcggggggcgggcgcggggcttttgctgaccgccgtgtcccccagggcggcgcgaccgtgcccctggaggtggtgctgctgcgcaaggtgggcgcggcgggcggcgcgcgcggcgtcatccgcctgctggactggttcgagcggcccgacggcttcctgctggtgctggagcggcccgagccggcgcaggacctcttcgactttatcacggagcgcggcgccctggacgagccgctggcgcgccgcttcttcgcgcaggtgctggccgccgtgcgccactgccacagctgcggggtcgtgcaccgcgacattaaggacgaaaatctgcttgtggacctgcgctccggagagctcaagctcatcgacttcggttcgggtgcgctgctcaaggacacggtctacaccgacttcgacggtgagcgcgggcgcggggcagggaacgttccgggggccttgccggcgggttaacgcctgcaggggcggcacatggaggggctgatgactgttgggcggccgcgcgccctgggtctgctctcgtggggagcagaggcccacgcgctaccctggggagggctgagcgagggatcaagagcgggatcgtgctgggtgggggctaggggcgcgctcaatattgcttcctccatcgcgttggggggtacggggcctcttgccccggtgtgggaggcgcgtgacatccttccggcccgagagacccccggctgggggcggtagcggaggagtctccgtgcgtgacgcagggcgcagccgggctgggtctgcgccgggagcctggaggcccccgcggcgcggttggagtggcggggcctcccctgcgtgggggcgggagctgcgtgcgtgcggagcgcgggggcgcggcggcagaaatccccgcattgcggagcttggggaagccggggctccccgcccgcccctccctcctccctccctctctcccctccccccgttcccgcaggcaggcgcgccgggcggtaagggacccgcgctgtcccccccccacccaggtagcctcacagcgcatctgtttgttgtgaaagccgagctcttactcatgtgacctgctcctcccccgcggccggcggagggggacggccggcccctcccccagcccccccatcgcctgccggggtttttccagggtgatgacgagcaggattttgaggcctggctctgcttcctgttactgaggccagggagttaaccagcagggacctcgccgtctgttgagcggctctgcctctgtggtgggcgtgctaagccctgtgtccccttaggcacccgagtgtacagccccccggagtggatccgctaccaccgctaccacgggcgctcggccaccgtgtggtcgctgggcgtgcttctctacgatatggtgtgtggggacatccccttcgagcaggacgaggagatcctccgaggccgcctgctcttccggaggagggtctctccaggtgcgtggtggctcgaggcgggggtgggggcctcgccctgcttgggccctccctgacctctccgctccgcacagagtgccagcagctgatccggtggtgcctgtccctgcggccctcagagcggccgtcgctggatcagattgcggcccatccctggatgctgggggctgacgggggcgtcccggagagctgtgacctgcggctgtgcaccctcgaccctgatgacgtggccagcaccacgtccagcagcgagagcttgtgaggagctgcacctgactgggagctaggggaccacctgccttggccagacctgggacgcccccagaccctgactttctcctgcgtgggccgtctcctcctgcggaagcagtgacctctgacccctggtgaccttcgctttgagtgccttttgaacgctggtcccgcgggacttggttttctcaagctctgtctgtccaaagacgctccggtcgaggtcccgcctgccctgggtggatacttgaaccccagacgcccctctgtgctgctgtgtccggaggcggccttcccatctgcctgcccacccggagctctttccgccggcgcagggtcccaagcccacctcccgccctcagtcctgcggtgtgcgtctgggcacgtcctgcacacacaatgcaagtcctggcctccgcgcccgcccgcccacgcgagccgtacccgccgccaactctgttatttatggtgtgaccccctggaggtgccctcggcccaccggggctatttattgtttaatttatttgttgaggttatttcctctgagcagtctgcctctcccaagccccaggggacagtggggaggcaggggagggggtggctgtggtccagggaccccaggccctgattcctgtgcctggcgtctgtcccggccccgcctgtcagaagatgaacatgtatagtggctaacttaaggggagtgggtgaccctgacacttccaggcactgtgcccagggtttgggttttaaattattgactttgtacagtctgcttgtgggctctgaaagctggggtggggccagagcctgagcgtttaatttattcagtacctgtgtttgtgtgaatgcggtgtgtgcaggcatcgcagatgggggttctttcagttcaaaagtgagatgtctggagatcatatttttttatacaggtatttcaattaaaatgtttttgtacata

SEQ ID NO: 124 - DNA, 40696 bp, Homo sapiens
ttacatttacagtgtagcaaaagagaaagtaactatgttgctgctggagatcaatgaagccgagtgaatgggggctgaatgtgcgagtccatagctgaagaggagcgccagatggtggaggaatacacttatttatgaagtaagtggaagtcaccgcgactactcctgagagcccgggactggaggtggaggattgtaaggcggtgcttgtgtgagtgtgagtgtgtgtgtttgtgtgtgtgtatctgtgtgtgtgtgagagagagacagagacagaaagatagagatgcgatgctgacggaggagctacagcaggtagggttataaggttccggccgttggctcctgctaccctgtgcgtttactccctgcagtctacttggatttggggcgaagaaaaaatgaggtttgttgggatgctttgcggcagttttaaatgctcggggctcattagtgcgctgtgtgccgaggagtgaagcggggggcggggggatgttaagtgctccaggaatggggaagaagcattctctaaccacttaattttctctccagctcttgcctagtggtggaagggagaggggatagctcagtatttctctgggagattttctgggccagactggatggtttcacgggcagtatgtacgcccgaccctctgctgcagggatgcaggtctctctatacactccgtgtgtgtgtgtgtgagccttgaactctgtgtggaggtgggggtcccagcgcgtgtctctgtgaacacgcttatgcgtccctctcagaagaaatggtatgttgatcctggacgtgtcctaccaggtaacacaatagcaaagactttcaccgcttggtccaaccgggaaacagttatagcttctggaatagaactcgctcttcagaaaaaatactacgcaagggaaggggggttgactccttcgctcccatccaaaggtgggtgagagaaacccgagtcgttggagatctgccgacgtgatgggtgcgtgccccgtgtgcgcgcgtgagtgtggattccgcctgtgacactttggttctgtgtcagagaatggtgacggtcgtgtgtagacggatgagaatggtgacggtcgtgtgtagacggatgatagatggcatttttcctgatagctcttaaagttcgtttaggtgagcgtctcttggcgtggggtttggcgtctttgctatgtgcatgtctaatagaagaagaagagttagcaagcctgagttgtagagtgcccctgtgcctacaggaggaaggagctgtctttttgcagacactctgaaatcagagatagatccggtgggcaacaattcactgtccctttcaacgagtacaggctaattgggaggtcctctttacggaatcagtactcttgaaggggggatatctgtatgggattgaaaccttatacaacgtggctgcctcccattgagagaagctctaggatgcacagtctgtgccagccagggagatgaagaggggaggagagcccaagttgtcctttccaggcaggaatgagggcgggggcaggtgagagagcaaagggtgagggatttgccggggctggggtttccaggtttccagatctggctccatggcttgagatttcgttttaggacaccagttagtagtgaaaaggggaaatgcagattaatttataagaggccaaaagacaacatgtgaggttttagtatgactatgttgtgcttttcaaaggaccccaatagagaatggaaggcaagaatagctccaagttaaagagattcacttaaggggatttgcagaaagttgacatccaccctgatgtatatttagctgctgtacctttctgtgaaccatgccagtgctcttggttacccctttgcctttgcagcgagtgagggaattaaatggcaagcatgcaagggtggacaaatgggtctttctcagatgtttgcagtgtacttctgcccgagagctgaggttcagaatagatgcctcttaagagcctcccttctgtcttcagcttttctaattatttgtgcttataccttctctacagctgaacttttatgtaggtccaggaaaggttgttcattaacatttacaacattacatccaaatttaaccttagacttagcaaccaaattgattggagccctcaggtttgcatcctctttgaatacataaaaatgaatttcaagttttgataatggtatgataaagggcaattaggacgactttgctcagagggatgcaaaggtctttcccagggattggatgagactgccttttgtgtcacgtgactttattctttctttcccccttccccttctttacagactgtcttgagttcttcttgaattgccagttttcagcctcctcatgcctccgtctcctttagacgacagggtagtagtggcactatctaggcccgtccgacctcaggatctcaacctttgtttagactctagttaccttggctctgccaacccaggcagtaacagccaccctcctgtcatcgccaccaccgttgtgtccctcaaggctgcgaatctgacgtatatgccctcatccagcggctctgcccgctcgctgaattgtggatgcagcagtgccagctgctgcactgtggcaacctacgacaaggacaatcaggcccaaacccaagccattgccgctggcaccaccaccactgccatcggaacctctaccacctgccctgctaaccagatggtcaacaataatgagaatacaggctctctaagtccatcaagtggggtgggcagccctgtgtcagggacccccaagcagctagccagcatcaaaataatctaccccaatgacttggcaaagaagatgaccaaatgcagcaagagtcacctgccgagtcagggccctgtcatcattgactgcaggcccttcatggagtacaacaagagtcacatccaaggagctgtccacattaactgtgccgataagatcagccggcggagactgcagcagggcaagatcactgtcctagacttgatttcctgtagggaaggcaaggactctttcaagaggatcttttccaaagaaattatagtttatgatgagaataccaatgaaccaagccgagtgatgccctcccagccacttcacatagtcctcgagtccctgaagagagaaggcaaagaacctctggtgttgaaaggtaatgcccctgctcccttcccaagcacggtcctgattagccgggttcactttgggttttctcgtagagtgacagcattctccttaccctggctaccaaagaccaaaatagactttattcttctcttcccttctatgctctttattgttttggtttagtaagaaaaacccagcagcactgaactggaagccagaagatctgggttctacccttcatttgggttctaatttgcattgtgcaagtcatttcacctctctgggactgttttctcatctttctaaaaaggggctttatacacaccagatggtatctcaagtcatgcctggtctgctagctctattccaatcaatcactagttggaaagttattgtctctcagacttaaccaatgttgatggaacagaggaaggagcaactatggtgaactacaagtaaacctacaggtaccagttcttactgtgggaaattctttctctttctcacctttctgaccagcttgacttttatgtggtttataaagtgaccttgaagaagggcagagcttcttattctaaggccccatataaagtataagttcaccaattacatccattcctctgccaaggctccaagggaacagagacgtttttatgaaacactccccaacccattgttttttctggcctcacctgacaacggttggcatcatggctcctcccaagatggagtaatgggtcacttgccccagtatactgaatgcagaataactgagattagcagaactgagctctggcagaaggaattattcaccactcttctcggagcaccttccataccgtgttgcctaacctttccaagtagcctgcatcctgtgcccagcctagttgcacctctttgccctcagatactgacttttggggcactgtacatcactctcattcggcatcttttacctggtggtggtagtgagagatagtcgtcttctctcttctctcctcttgtgttctgagccaaggtacgcagtttctgggtcacatctccaaccagtctcctaaagtgtgttgaccaaaggtgttgctgagtttgaacacattgcatatttaaattgcaataggacatgtgggtgagcaagttagttattttgtctctatgggacagctttgccattctccttcttgtcttcccagtggggcattctgccttttgttaagcagtgttctgggaattatagttctgaattccactgacacaatctcctcttcccaccctccgctctcctcaaacttgccctcatggggctacactaccacaaaggcacatctctccttagggctggtgggctttgctgggaaggagaacatgaaagaattgtatgtagagagttccagaagcttctagacatttcctggtcgtggtggttgtggtgggttttcttgaggtcacaaatatgttcagatttcctccatatagctctgtattttattgtttctgtattcttgtatggttgactttgagtgattcccaggatatttaccctgctattgtcttaccataatcttgatgtgtctagcctcttacaaatgagaaaatcctaccgaggaatttcccatttgtaatagtttgtcttggggagcaaagaggaggatagccaatgatcatgatgatctcctcttttctcacgcagagcaggtgttcatgataaaaagcaagtcttttgtgtcttcatgatctgaagagaggaaacaacacggatcaagatgatcctagacctcctaatcatggggatgattacaaggagttgcagaccctactctctattttgcagtgggtggagttgtggataggggtgacccatcagtcattgagaaatgaatctcctgggtgctacttgtgaaagtgaggatcctctctccctttcctgtggatgcagctgagattctggacagcctagacttcttcctcagtgtcagagtaagattgcctcaatggggcggggcaggacacactgctgacctcaccactgggcgccctgggcagccactgcgaggcctcgtcattttcgagttggtgagacaccgcggcagtcgacttggaagatgctctggtggtagaggttagattatttgtagttttgggggccttttcttcaaatatctgggaatttcattgaaaatatgtagttcaggagtgaaggggtctatattctactttataattatcattatcattttggtatcttttgggagaatggcctaaaattgggaccaagatggaaaagaagggaaaggaatgggtcaatattagaatgcccttcgttatcctttcaacttggtaaaccagagattaataccatagcaccactgtggtgaaagacggggtgggcattccccaaaggcatgaccagcagacttctctcagattcttgagtgggtcaagcagaccattctggtctggcttctcctctcagatttatttgagtaatcccctcccttggtgataagattgtgtttcagcaagagtggtagtggtaccatttcggaaggagtaatttttgcagggaagttggtgggaggggggcatagttagaacataaggaggaaacttctaaaggcttgttagtttattttcagagatttcagtacaatcttgggtaatttatggctggcccatctgatgctctggtttatgtttgtaaacactggttgctaccctccctgtccaagatccttgtccccctgtctccatgccatactctccatttttggtgctgtctgtcaagtagagcggctgctaacttgccattttagtaatgctgtgtcaggttgggaagaaaccgatcagaggcatggcagcccctgggattaagttactgttctaatttacagtgccctccctgttgtgacctatgctagaatctatgttttagtctcatcttctaaagaataaatggcatcagacctgtgcttctcttcaacctggtgaaaatgatccaaatgaataaatatttagggatttgtgaggtctttgaaagaattatattgttttactcaaagctgatttttaatcaactaaaacttgctttctagtcaaactgagtaagaaagttgaacaattctagaccatccataacgagagctaccgtttttgctataaagtttttcaggctccctttcttttcagtaaagctgggtccagggaaataatttgtcatttacttaggtaggaagaaatagtctactgcccctttttcttaaagacagtatatgccttcaaaaatgttattataaacattttcaagcatatagaaaagcagaaaagtgtgtaatgaacatccatacacctatcaaccagattaaacaattatatttttcctatttgctttctcttttctgttgaaatatttaaaaatatagataatgttttaatgtatttaagtatgtttaatgtgtaaattaatgtttcaaattcaataaagctggaaatattttatagtatactatgaacattttcactcgtaaacacttgagtgtcatgtacccatttttaagtgcttttcaacttcgaatccctctgtgactgactggcagtcaggtctacagaggagcttccctccctgggagtaggagggctccaggtgcctccttggggtctgtgtgtcccccttcctccctggtatgtcagagcccatgcctctacttgctctatgctgttgtaaaacaaggaatgaccaactgctacaatctttataggactgctctgtaccaaaggcctttactgggggaatgtgagaagaagagggaaatggtttaaaaggatgatccatggggaggatttgatcatgcaggcagttaggcctttatactataaaacttcatcactccttagaattgagcaccatacattgcacacttttccctagttgaaaagaattctgaaatatactcttattggcaatagagttctatgacaaagtggatggctaggctcagaaatcagagacctgtgaaaaatattctgtttctgcccttttttcgggggtggggtggggaagggaataaaagtctccccttttctctcagagatgttatgaggattttaaaaaatacctgaaataaagacatatctacattcataaacgtgctgttgttattctgagcctctggttaacatccaaggctaaaatgtcaaacattagccttgtagcaaatgatggagaaatcaaggcagaacttcggatctagtcagcctgaatgctagccttggctcccctctaactaggtatgtgcccttggggaaggaactgaatccttcagttccttagttacctcattaacaaaaagaggatataacaatagctatctcaaagtgttagtttctgaaataaatgaattaatgtgtgtaaagtgttcagaactttatacacatacatggtaagcactccataaatatggtagaatgtttttattgatattgattgaaaggaaatgatagtgccagtacaaaggcaaattttgttcctaaggagtacaaataacaagctaggtatagtagagtgtgtgtgttgctatggcctaaaaataacttggtgactgttaactaatttaagttgcatagagttggagtgccaagtaattgcaaaaacatattgggccaggaggctggagtaatttgggtatatccagaattatttgttttagggaaatttgtaaaaacatgataataattctgtccaaataatgtcccataacaaaagcataaaactttttagctttgctttttgttgcctctcatcatctcatcaggaggatttatttttggaataaggattgtggactgactataaaagggtagatggaaggaggggtgcgctggttcctgagcctagggttgtgttgagttagaatgtgaaggaaaaaggagggaaggagttgaatggcctgctcctgtctttcaggaagtcctgaaacttctttctgaactgctgcacagttagttggctgtcctctctctgagcttttgggtacactctcctgcttcctaatttaagtgtaggtgaacagataatagaaatgaactctctctcccagccatgttcttgctttatctgttcctcattcacgatgtgctcagcagagtgaaattttgctcacttacacctgggttcaaatctaggcatttccattgaccaactgtatgcctttaggcaaatcagggggcctctcagaggccaggttttcttcattgtaaaacagggacagctccagcatcctaggttgaaacaaggtgatacaaagtacctggcatttgatggctgtcaataaatcaagcctctggaccctgctctcctactctcatgcactaatgtaagaacctcttacattgcaggggcaggggtattggggaggatgggcaagtcgttctaagcacagtactgtgggagcctgttaagtatgaatactcttgcccttaccaattcagaacagttaattaacttaatcatccagcttgtcatggacaagttcaagaaactcctctcctggcaataggagacatgatttcacattagaaaagcaaagcaggggaaggaaactgaataggtaaagcactttgcctatttctgttttcaaagcacgtgtgtataggagaaaggagaagggagaatggtgaatatgtacacttttctacttggtcctttaggcaaacccatctgaaggtctgacaaaattacaggagcagaaaaactttccgtcacatactcctggtgcatacaccctcagggactaagtgggagcttttgaccagtagcaaaaatctagttccttaaaccctgcattatcagaagccagaacctccaagccccagcattgctgaagagcagtttgggcatgaatgtgtgatatatcggagtgcttaggcagtttaatccaagttggttgaaaaagatagactacatattaaggagagaaattctagttccaggagaggtcatctcacctttttggaactaaagaatcccagctttgagaagagcaaggaactttagagggcccctaatccagtagttttcactgcaggctgttcattggtatcacctgaaggtgatttataacctatgatgcccagttcgtgtgtccagaaagcctgattaaattggtctggggtgcagcctgcacatcaagatttttttaaagctcccaaagtgattctaacaggcagcaaagtttgagaaccattgatctagtccggtattctcattatgccactacaggaatggggcttgtccaaggtcacatgcatgattaattttagagatttagtccttaatgttaaagtaggtcttgccaggttcaacagattcaatagatatcaacagactgaggtattcgtatgtatcattatttaataacaacagaatctaatatatagcataaaatataagattttttgagtactgatgccttttttcttgaattttgagatttcagttcagaactaaaaagaccaaagtctgaggactttcaaaaccagcagttcatggtctatatatttacctggatattagaatatggaccaaatattaatgttgatttaatctcttcatctggggaacctagtggtttaagctgttaacctagtggtttcagctgttaacagctatcaaaacaggtatcaaagaagcccaaccatcttaggcttctagggactttttggtaggtggtctccacagctgtacaaacttgtgggcagaggagattcatttgtttgttcaataaatattgttgaatgcctttggtgtgctaggcactaatctgcaggctgggcaatctgcatcacaatgcttatcattcaaatgcaagaaagacaacatatatggatgggaccagtcttccagatcctttccatcttggaaattgtgttcatgtttctattcttcatcttcttctgccacacaatcttatttagggagtgtttcatcttcacgaaattttgttctcctgtgaagcacatgtttgtactttttttttctttttcttttttaagaaatagccagccgggtgtggtggctcatgcctgtaatcccagcactttgggaggccgaggcagatggatcatgaggtcaagagattgagaccatcctggccaacatggtgaaaccccgtctctactaaaaatacaaaaattagctgggcatggtggtgcacacctgtagtcccagctactcgggaggctgaggcaggagaattgcttgaacccgggaggtggaggttggagtgagccgagatcccgccactgcactccagcctggcgacagtgagactctgtcgcaaaaaaagaaaaaaaaaaaaaaaaaaaaagaaatagcctagccttttctaaatatgtcatgggccaataggatttctttccaatgtcttgatctgaaaagaaatgattcattggtttttaatgaaaaaataaatatatatgccctctgtgcctcaaaagctcagggctgacaagtctcctctgtgtgggagagtgaaactttgtaatttggaccccctaattttgtacatgttgatgataggaataagggcttcgtttattttcactgcatgctctctatggaaagaggatgtgctaagcaaacaagcattgtaaacaatatttcagaggcaaggttttggcctgctttaaaaaaataaaatgtttgcaagtacaattaaaaaccagtataagggacaggggtgggatgaaaacctgtctctaagattacgaagcctgcgttatttcccctaaatccccttcgaggaagatttgaatccctcatcaacaaattttcattgattatgtttctattatatatactgtagactctatattcacgaatgtaatcatactcattcagaaaaatataggaagagaaaatgagtatgacctgtagcctgaatttcattataaaagatttaaaaatatacattttatattaaaattgatgtaatcttttaattatgaagtctttgattctttagatgttttcatccataacccaagagcaagatcttggcatcagttttttccaggttatgtctatatcatctattattacttaaaagttggagttacatatagatatatagatatatagagagttatagatatatgtaattttttttcattccagtcccccacccgagcaagacccatattttatgtaacttaaaagtaaagaaaagaaactttgagcgtatgtttttggataaggaaatgagctgtgcaggcctagtactttcatataagataaaggctcttacctattctctgaatctggcaaagtagagaatcacttacagaaagaaaaggatttgtggatgcatcaaattatctgcattgcccttaatgttttatgtgtggtaaaggcctactcaggccaccgcccccaaccctggcccccgacttgaatttcatagaacacaaaacaaagcgcaactcttcctgagtgcttccacaacgggattttgctttcttgccttaccacttcagaatggaccaccatcaggcatctgttgtccattgcacacatcaagtaaacagattaaactgcccgagccagggggtcgcatcaggcctgtcctccctttgaggagcttaaacctctcgtgttataatgcgaactcgactgatcttattttgtgtcctgaggtaaggaggcagtcaccgttttgcatcagaacatcactatccggttccttaatatcttatatttattttatggaagaaataatctcacattctttgtatcacagccctgagcttcactaccattgagctaaatattaccagctgttgctactggcaagagagaagcaaaaaacaaattgaaaggagaaagaggaggggtgggggagtggacagaaaagaataacatgagggttgagggtcttagggtgacagcaacatatcttctagctcccagacctgagttctgggctccagtattgaagactgtgagtcattttcttcaatcattacagtgtttcttcctgtcttaaaagaataagactagacacaaacttctaagagggccttccctgaagagatagaggacattttctattgtttcttttaatttctatttttattaaaatgctatgtttttatgataagactttaaaggaacgggtcttatggttctcatgaggtgatattttaatctgccagcagaacatcagttaatcacatagaactactctggctctgtgaccaacctatcatccctgaaattagaaaattattttccagatagtttggaagaaaaacaagttaaaagctattgaatgctttctagatgctgggcattgggctgtcatatatgtgtcttatttagttctcagagaagctctgtgaacgtcattttatatcctgacttttatagctcaggaatctgaggaacagattaaatattttctcccttgttattaactagtaaatgagagaataaggattgaaatccagttcttatgatttcaaagcccaaattcttttcaggctggccatatctatttgcaagtctcattccttatggtggctttagttgtgctttacctctgtggtgccttagttataatgccatcttcctttccccatttttcttgtatatcctcaaataaaaattccattgctaaggtgagtagcctattctgtgtccttagagtagactggcttcccagtaaccttgcctcaaattatatcccagcttttggatactttaaattttggtcatgacagttttttaaggaataaaaatttgagcaaaacaaacttttgaaaactgtgataattctaacatatatgaagtatttcttacatgccagactctatgccacaagtgttatgtctcatgatccctttccaatttacatacgagggactgaaactcggagaggttcaggcacttgtccagtgttactcagctggtgcctagtggatcctgggtgtagctctggtatacttctgctcagtttgcttttgatatctggaaccttagaattcattctcctagtagcctgtggatagaaggatgatatttcctgcttttgcacacattaataaacccactttctggagtaggaagtagatgaacaaaggtaaagaaaagtacaagtacaaagttaggtaaaaagaacaagaaagaatctgtgacgagtatgatgactacatcctaaagactctaatgccaaaggtatttgattgtttatgctttatattcattatctgtcctattagtgtggatgataatgaaaactatagattgttttccctcaagtaggtgaagaaagaatctctagtaggttatgattgccctttgggaaggttagttatcagggataagtgaacagatcctatcaaaccatttactgtttagtttctctcctctcctttcctaatctttcttatctctgttcttcccttctacagtctaagcctacaaatatagctcaggtaatctggaggtgtggcaaggacagaccctgggaaaaataataatgaacacatttgaaggacagcaggatggactccttggaatcctgtgttaggggcagcattcatagaggcagaatctgtcttctgacagagcacccagcttcacacagtgaaagtatgtgactgtcctctcagatatcaactataagatttcgtcacaaagttcattttatgctgctaaaacagaatacctgagattgagtaatttacaaagaaccataggttatttggcttatggttctggaagctgtgaagtgcaagagcagggtgccaacatctggcaaggtcagcccatggtggagggtatcacatgatgagcaagtgtgtaagacagtgagaaaatggaggctaagagttcatcctttttattaggacccacccctgtgatgatccactccatggaatggccatgcaattatggtcttaatccactcttgagagtggagccctcatgacctaatctcctcttaaaggccccatcttttaatactgctacagtgacaattaagtttccaatacatgaactttgggggacatattcaaaccatagcagtaaggtcaccccaaacactcaggtcctccagtgagaggggaagggagggggacatgggtgatcaaggcagtagaattagtgaatggagaacaaaatttaaaaatctgagcattttttattctgaaatataaaagtaatcaattttaagaaagcttaaaataaattcaaggagattaacttcactgatcataagttctcacatttacatggcaaggtaagttttctgaaccacaacaaccccaggatgactttagaaatgttgaaaaaccacagaattatagtccattgcacagcaagcattcacttactctatgttgaattagaaaggaaagacatttttcaaagaacatggtgttacagaattgtgagagatgttatcaagcatttgatctaaccatcccattttacagacatagaaactgattacttatccaggaggatataaatagctattagcagtactggcataggattcatgtttcctaactctcagtttagggtgtttagaagcccaaccagtatataatcctttggattagtatctgagttgttgttaaataagcaaatcttgtgggttcaagtattcagccaggtcattccataatttttctcattacctttcttaggagcgtatatagtgactaattgaatgagccggctgatgctcccttatatttgtattcagtttatatattttcttgcgaagggagtatagtttggaggttaagggcacagattctggaaccaggctgctgagtttgaattctgattttgccaattattataattttggacaaattcacttttctgtgcctctgtttgcttgtctataaaatggggagggtaatggctcttttctcatgggctcaattgagaattagataacatatgtagaagtgctttgaacaataacgaatgcatactagctaacatttattgaaaatcaaccataattataatattgaatctctacaataataattcataatctgcttatattcaactgatatatgagtggtatagttcagtaaaatgctttgatgtcaccactaatgcagtacaagtaggagatacttttctgatgcttggtagatctttttgtttaaaagtttggaaaaacccagtgtttcttttggggtggatagataactacatagggtttttttttttttttttcctgaaatagtgctgtgctgaaaaattatatgctatttctatgtaaggaaatcttataaaagtcttagcagaaacactttatgtatacttattgttaagatattaagaacattttagaaagaaaaacataatattactaatcccgccctgactggcctagtttcatttttacatttctttttgttctctacccatatatgtgcatgtttttcagggtttctcacatagtaactgaaattcattttcactttatattgcatgtacttttgcttcctgtgttgtgatcatagattttcttctttaatgctgtaacctgtcttattaccacattttacttacttgcctattaatataaattaagattgtttccaaggttttggtatgacaagagaaacctcttgaaggaaacccttgtttggaattttctccaccttcccacccaactgcactccccatttagagaaatgggtactagctgccattttgggtgctagttgccagtttgagtttatttttccccccaattctctttcactttttaacttctgcttttctttcctgagtgtaagatccaaatacctatcaaagttgtgagtttttagggacatctttatccttgaccacaggtcttgatactgatcctgaatgtgtgtgtttaccacatgtcctgtaaggcacatattgcagatcttggacctctttggtggatagagtgaggacatgaggaagcaccactcagcgctattaaaaatcagaagctattgtggaagtgaatgatctggcaaggctaacaacggctccttatttcataaatatgagtcactcccagttttacactgtagataaaacactctgaaagggacaataaaagcagcaagaggtagatttagtgagatgctgagtagatgtgtttgtgtctcccttcctctcaacttttctaaatcctgaggttttagtgcagtgctgaagtcttctaggggcttaagcaaacacaggcagcaaaaacacatcagaatggaaagataattcccattagttcattttgccaaattgaggtaaagtgccctttaaataggagataattctttgacagataattagcttgtcttccttgataaaatatgtgaattggttgagtatattataattaattttgcatattatgtaaaaatctattcatgtacacttactaggtgaatctcttaattcctaccttgaggatggctagaaagccccatttctgctccagtgaatagaaagagctggaggaatgctgtggttatggagtccaggaagccctctcttacaaagattgggaggagctgaatgtggtatatcattattaaaagacacagagacttcatattaatacatgcatttattaaaacaaactttgagaacacttttaggcctgagaatgagatgctacaaagttgcctaaataattaccttgaaatcaatctcttgctagtgacattcttctggcttcccaatgtggagctttttccagggagtggagtgagtgattggctgggtgcagctagctgttggctgggcggtggctgtgggaagtagcctgagagggcacagaacagttgctcaatgactcagtgagtcaaagctcctctctgcagtttttcttccccctactccttaagccattctgagctccttcaggcatccccatgtatctgcgcactgcttttggggtgtcttttctcattcaaagctattgtcgtggctacttgatttggctcatattaaaacgtgcactgggagatgttggagtgctgaaataaaagagcatgctgtagttaatcgatcagagagcctctcttctccaagttgaagtgtttcttttcctgaaaatagagtggctatttgatgttccatgggagccgaatgacttcctggtgtagtgtggcttatagcaccgtagattttagtcattggtcactacccctccatgtgcatgcacacacattcacatgcaaacaaacacatattttagttaacatttgtagaatgggaacaattatgacactgagcattaactcatttaatggggatagcaatagtattaaatctatctgcagcgtccaatatagtagccttgctgcaagccaaacgtggccattgagcacttgaaatggggccagtccaaacagagatgtgctgtaggtgtaaaatatataccagatttcaagactttatatagaaaataatgtaaaatatttcattagtaattgttttaatattgactcttgaaatgatatttgcacatgttaagaaaaatatattagcaatattttacctgtttgtttttactttcttgaatgcagctactagaaaaaaaaaatgcttgttattatagtagcctgaattccatgtctatcaaatgttgccgatctcaatgtggtaataacagtattattatccccactttttagatgaggcaattgaggctgagagaggttaggtaagttgcccaaggtctcacagcacaatgccaaattcagacctgcctgactccagagcccacacccttcatcactaagaaactgttgtataatagagaatttgtctggccgttgtcctcagttcctgggaaataatttctaaacccttggaactccccgagtgttaggagtgtctttgttatgcatgatgagccccttggatcacacctgtgtttatgttaatgcgatgactcaggataagagtttatcatcagaaagacatccacatgattagaaggtcagggctttgtattagttcatcttcttcagcagaagagagtgggactgaagattgagttcaatcacaaggccaataatttaattatgcctaagtaatggaacccaataaaaactctggacaccaaagctcagttaaacttcctagtgaacacattgctgtgtcagcagggcaatgtgtcctgattgcacaaggagagggcctagaagctccatatgcaggaccctcccagatattgccctgtatgtgtctttatctggctcttcctgatttgtagcttttataataaaaactatcatcataaagatagggcttgtgttctgtgagtcattctagtgaattatcaagcctgaagcattgtagaagccacagaatttataaccagttggctagaagtgtgggtggcctgggaacccctgaacctgtggctagcatctggaagtgaaggcattcttatttgagactgtggccttaacttggggagtctgcactgactctgcttagtcagtttcagaattatattgcagtattgcaagaatagactgccttttatttggatgtatgtattaggagaacagcagctgagagagctaagtgctgcagcttaacttgcttatctctgtaacaccatttccttggtgacaatggccatttgcattctagacttggaaaatgactcaatctttgagcaactgcttttgaccactaggatcagttgggaggcaggcaggcctctgagaccttcatactcaaaacccttcaggctgtaatctctggggcctatttcatctcccagttggcatcatgttagcggtggtgacaaacatatgtgttggcccctctttgacaccagggattcttaagtattggttttgggattgagatgttcatgggaagctgacacagggtgatactatgggtaaggagtatttcgattttttgttgtgttttttaatcatttgccttgtctggaattacgcttttgtggtatgtcctattacatttcataaacaaggtatttagctcaattgttgctttttcttttggggcttttgtttggatttttaagccaagatccatgtgttttatttattttggtttagtttcttcatccctgcttaaaatagacactgcctcttgtctgtggtcctggtatccactactcttctgtttcctgctcaggcctggcccatgttctgcaaggccctcttaggtcaccagctcctagaaagttgactcctatgagtatctcttggggccaccttagaatgcagatttctaagaaaagtccaacataaactctgcagttattgggagaaagtttccgtcaccagtgaaaactaggaataaaacaagattttggaatgtataaaagaagcctctttcaaaaagaaatcaatatgacttgttttttcctaacatgggccagccctgggcacttttcatctgccaccacaccaggcctgctcttcagaggtgttcagctttaagactagggacagttcacaccagataactatgaggcagtgttctctgccactcattgactgtggaagtctcagtcccagtttctgagagggggagagcaaattcatcagaaccaactgaagaggtacagaacatgaggcattcacttctcacacagtccctgagcatctcaccttccagaataccagaggcttcaaggccctttttctacctttcaagagcgttatagcgtgctattgctctttgagagatctagggctgtaacagcccttatttttagaaaagagagaactcctgtgtttgaagaaatagctcttatgatatgatcgtgtggtttcacatggtcttaagttcaagtaacttgcccaaaggtgcacagttattaagagggataagaggaactccaaattactgatttcagatccagtgttgtatcccttcaaaaggagatagaagaaacagggccacccggggttggtgaagatactgtcagaatcatctgttactgcttaccacatctaagtgagagggtcagcaagctcttgagagggcccacctagatcttagcttgtgtataccctatactgagcactgtgcccccatttcatatttagtgcttaataaatgtatattaaactgaattgagggcccctcctgctgctcagtgacatccctcagggtgagtttccctcctgagccttcttttccctttcatgactaccttccatgcatctctaccattcatcactcatatagaatgtccaagaagtaggggcgaggagagaggagaaaggggtaagaggccaccaagtgtgatttgccttggatttcagccctccctggaaggtgcccatttgtcacatttaagggaggcccagcacccctgtaaattgcctcttcctcataagtgtactcagccctccttcccagccttggaatgccaggatttctaaatccttgtgctgaattcacctggcgagtcctgcacctgactgtgtgagttacagctggatggcattgttcagctcaatcttcagtgtgttctgaaaatgtttcttcttccagtcctgtcactgaatttccctaaagttccttcctcctttccctcattagatttctctttggggactatttttttcaatcaaatctcgcaaatccatagcataatgctgaacagcatataatagatgctttacaataaactggtcctatctcatctcattccagtgttcaatgaatctaaaaatatttaatgagcacttactatatacaattcagatgctaaacagtgaatacttagaatttctattaataactacaatgtagtagctgatttaattcttgcaataactattgttgcctgttaggactattattagctccatttcagggtacaaagaggtgaaacagctttgtcaatatcatactggaaagttgtggagacagtctggccctagtgcaccaaaccattacactctatttcctctaagagaaagaacatcttgactttcttggggtccacactttaataagaacaataaacagggaagaaataaataggtaacttcagatagcgataagtgttctgaagacaatgaaactcttaaaaacttcatgatatgataaaagagatttggaagggtagctgtaaattgaatgtcagggaagacttttctgagaacacatctggtctgaggtctgaatcatctatgtgagtctaaagaaaaataaatttttatcctaccatactttcggaacacctctgtggatttatgccccctacacacagagcagtcttccagcagacactagcagaatgtcttgcaacttaattttgactctacctggtgttagcttcagaccccacaagttgtggctcagtcctacaagattaccccaccttccccacactgtttataaatcagtatttctgcaaccccctccctgagtcccattaattttctaggacagttcgcagaactcagggaaatgtgtttacacatttattataaaagatattacaaagaatatagatggacagtcagatgaaggagatggatggggtttatgggggcttcattacataggcatgattaattacatcattggtcattggtgatcaactcaaccttcagtccctgtctcctccctggaggttgggggatgcggctgaatgtcccaatcctctaattaagctgttttaattctggtgaccagctcccttcctggagctatttaggggcccccagccactagtcatctcattggcattcagaaaacactcataacttcagagattccaggggttttagaagctatgctacaggaaccaggggcagagatcaaatatatattttttcatatcacagtatcacagtgaggatctacaggaagggagtttgcggaagagggaacagcaaatgcaaaggcctggaagtgggaagcagagcacccaggctttacacaacctctgacagctgattttgttcttgccattgttcattcatgtcatatcgtaccatatcatatcatatatatggtttatcaaggctatattgaagttatagaacaccagagttgggagaaacttaaagattaccctaagtcctgattgtataggggtggcaaaagaggtcacagagctagaacccagtatctttttagtgtggaaggaagggctgccctctgagtccttgctgtcagggcttttgttaccctgtgcaaagttagacatggcttcaggggaaatggtcgaaagtctgatggtgccagatacgggatgcatcccaggtcagcgcttcattctgcgtgccccaggttgaactgaccattacttggctggtccttcacttagcctcaagtccatgttgacaatatgtaattccagcccacctcctcagagacaagcagtgtttttaattgttttgttttccccctaatctcagaaggtggtcacccaggcagggacatgctagcttttttttttaacccagtgtaattttgtatgtctcttagtgcatggagacctcaccttgcttcaggtggacctgtcaaagctcagccctcatggtacggtgtgatcattggacatggctgagtccatgtttaaggaaagcccatgccttttctttctgcaagttgatcctttagtactcagccttgctcattatattcaccaaacatagaatccagctcagtgacttgaggaagttgttgctatgccttttgtgaagtgaaaacatcggttcaggaaaacaattcaaattttgatgctgacatttgatcctttcccctaccacttcctgaattccctaagccagagctctttgacctccagatcctactgaaatacacagttatacatactgtttgttggacatgggggttttattcaaagcaaactcagatgcagcatttttggctgggcacttccatacatgattttagcaatggaaccctatccaggcttcacctgtgtaactttgtcttgcttactgctttcccccacccctcctgtcatggatgtttctagaggaccttttgtgaatgtaacttccaatgggaatgtttcacagtagaaatatgctctcctgtgaggctcgcatgtgacatttctgaagatttatttaattggactttacttaaatcccattgggaaacatacttttgctgtgaagctgtgatgtgtttaatttggggtctaagataaatgttggtcctcggggtggatggttgagcaatagttttccttttgtacagtgggtttgtgtaatgaatagctttactgggctttcctctgtttgtttgtttagcaatgcttcattatttaaacttctgcactgaaaggcaagaatgtttttagacattctttagagacttaatgcagaatatctggttgagctctcgggagaaatatggctttgtgttttatagcactctcctcctgttaacattcctctctctgcagcttcccaggatgatctcatggatttttccccctcctttaatccgtcttgatggattaaccagtattaagtttgagaccagtgagcaaaaaaggtggagccctaacatggtatagagtagcctccccagtacgcagaatgtctccagctaaaatattcttccgcccagaaggatgccacatggaggtcatgtgccagtgctgatctgaaagggcatatatctaatgaggagggaagtgtctttgggagaggagtgggcttctgtgcgtgcatgtagctggttcatggaactaaggttctacaaggcttactgcgcttgccttttataggcatgctggtcctttcagcacacccccaccccctgcagcccccgcccccacccccaccaccctgccacccccattctgaccttggaccatttttggcttggctttaaggtatgacaccaagttgggttggctctcaggggctttgttctcaggaagcccacaagttttagtgtggctcttcaaaagtaagtattatacgttgtatttctaaaagtaagctacactgggaattacaagtggcactatattcatttgggctgctttaaccaaatgccgtagactggatagcttaaacaacagaaagttattttcttatagttctggaggctgtaagttcaagattggggtgccagcatggttgggttctggtgaagcctttcttcttggcttgcagacagctgtcttcttgctgtgccctcacaaggcagagaaaaagagacagcaagctctgtgttgtctcttcttataaaggtactactcccatcacaggagccctaccctcatgacctcacgctggggattagggcttcagcatacgaatttgtgtgtgtgtttgaatatggggaggagagatacaatcagtccacagcagccacaaaaaatgcattcagaaaaggaaagggtatgaattttgcccaggatttggagtgtatgtaaattacaccatttggtaaatcagtgcgttctctctctctctctctctctgtttcttttcccctcccccctcttttcttttcaaacacatattgatcacctgttgtggactttggaacactcaggagcttcccactgaactcagaataaaacctgcctaagaggccctgtgaggagggtccctgcctcccttccttcccctctagcccttctcctcacccgcctcttgcccagtcattgtgcctccccacatttggctcccttgagtcactcagaggttccctgagttccctgcctttcccagtgtggtgttccctccctatgttctcctggattccgtcccctctcatacctcagagaggctgtccatgaaccccaatctaattagtcccctctcatagcacccaggaactggacagcgtcttccgttatgacttatcttaatttgtgactgccttctggaatctgtgtttatggttgtcatatgtttcctcctgatggagtggggaggggcagggaaggggcctctgcagcgtgtcactcacctcctcaactcccagaatgtttggggagggtttgatcttaaatacaagagattataacagtgaaaaatgtgttaatgtaactggcatgtctgttaacaaatcccagacttgatctgagtgtttatggtgtgcatttctccctgggaaccagttggtctgtgctaacataggtaaagtttagacacgtaccagaaagaaaactgaacttgcaagttttcaggaacatgggggctggaacttggctgtctttctgtcggcccctgacccctcacccccagactggatcttggtaggcacccttcttagccattcacttgattgaagcccaaaatcctttcttggaaagcaaaaatacttactcttattttctttagttggcatttttgttagtgagaatggagttcaatagaagtagacaaaattctggtggaaaaaaaaatgagactacacaggctgggaggaaggtctgtggatggaggggacaactggaaccaccagaaacatctgttctgacccttctattccagactaggattaagggagagcagaaggcacttccctgcccctctggcagagggactgacttgaagtcaactatgcccacaacctgtcttcaggtggttcttactgaaacctttgtgagacagaatggggagggtgagttaaagatggtattctctgcactagcagagccttactgtgtgtttggctggcagggatgagtgctcaatcactcttcccagcccacctttgactttttaaaaataggtctaacaaatattctgtggattcgtttgaaattcaagcatcaaaatgtattccaggtagaagtctctctttcatgttttcttcccatctactgctgatggatttatgagagacagagaaggtgtagggagagggagagaagggtagaagaggggagatggcagggacagggagagaagagggagaggggaggggaggggagggaggagggatcagggtagaggagcaagagttggggaggagaggtgagggagagaagagtggagaagggggcaaaggggatagagatagagaccaaacccaaggccctggtggggaagaaaccagagagagtcatagagtctcactgacttctgcaaaacctgaggggcttcctggctctgggaactcttgagatcttaacagttcaaatcctgctcacataaaagtcatctgctcattaaaataacacaaagctgtttaattgttgtctttgtggaaaattacatgactgtcatcagctgttgcttctggcagtgctttctgttctaatgtaaataaatgaggtaacagatttaaagaaacaggctgtatttacatacttctgaggtatcctctcaaaacaatctgcctgtgttattcaaatacacacaaattaaacttgtggtagctcaaacattagttattcattaaagccttaaagttgaaatggtaggaggggggcaagagaactgcacctcccttcagggggtaggaaccagaggctgacttttctgtgtggactgagctactccagccggcggaaatccaatccccagctcttttctataccaattctgccctgaggcaacttctgagccaggaggggagggtggtgagagcagaggggaatctttaaagctctgacaaaaactttccagggtcagcatttcttggaaggcctccaattaaactttattttcaattttcataaatcacaattcctaaatcattggatgtttctgactcagtttacttttttgaggtaaatatgtgggcaataattttttaaaattcttcctattgagggcatggcaaaggttttatcaaacaaggaaggaaacagtatattcgaaaatataagaaaaatgacaagagacccctccaataaacaagttaatgactggaaaatgtagaagtatatggaacaaaaaatggagaagaaagcacactgctaattatacaaagattaggaagtagcgaaagtgactgttttagttcttggtaagtgtcattgtcaagtattagcttctttctggaatgctgggttttttttaacgttggggtgggagggaatggcacatcatctgagagaaacaatagtaactattgaagtggctaccttgtctgggttaaataaccggggttcgttgtctcacaccaagaaaatttaggacatagacacacaagaggagtttagaagcagaggtttaataggcaaaagaaagggaaaggaaaacagctcgctctttagtgagagagaggtgacttcccagaggaaaaaggccgactggtggtggatgtgccagattttatagtctggcttgaggaggcagtatctgatttacatagggctcacagattggtttgatcaggtgtgaggtttacacagcactcaggggaggctggtcaccccaccctaatcttattatgcaaatgaactctccccttgcctggcgccatcttgtctgctccttactgtacacgtggccggcagagaagggaagatggagccgccattttgaacatgtctagtcgcaggtaattctttcctgctggcatccacacgtgcgagctctcagtttgcttgtctgtgtctgcagctcaactttacaggctgctctctgttgaaaatgatttggggctgcttttcattaaaaggaaaacgttacggaggacttctgtaccctcactatctgcctaagtaatttcttcttaactcctgtatcactatgataccaaagttactatacgatgacaactcaagcaatgtctatttcatgtaagcctcagtattctatattatgttgttttgtccagacaatccaaagaaaagactattgttaactcaaaattcaggcaaattctggtatcaacttttcagaatttttttttctcttaaaacattactaaatactacttggttagatgaactaaataaaaatgaacaacttttattattggaagatagttttgggagggctattctggaaatgatttcagcctatcatttatcactaggaaaacaccaggaagatctttttattttattaagtttttgtaaattatttccaaaaagaaattgaccacctatctcaatacctctttccctgtagctcctattggtatctaacatatcagcagtcacctgtcttcatgtgacttggggctaattcctgtgtacaaagggatttaaataagactagtcctgctctccaaggacctaaattctattaaagctcttaatctggatatacacagaaaggaaaatacattttaaaagaatatgtattaataatgcagttatagttgtagaatgaggctgcatgtatacatataataagttgttgaaactaagtttttatagaatgactctgagaaaaactgtaaacacctcaacttattgaggaaattgaggtatgaaaaagttgtgtgtgtgataacttttctgtacgtccatttcaaaaatttctagaagtatgcatatatttttagagaatataccagaaatgtatttttggctattcgatatgcctaaaaaatgtcttttttttcaaggcttctgaaaatcgtagacataaagaactaaatataatgaggttttcaagggagaccacactaaccaccagccccaacccccactctgcatgccacttcctccggcagtgatggagtgtagactaggctaacagcactgagtacacttttagcagagcagagctacagtgggctgtcctcatggctcctgctttgtcctccctctctggtgatgcccttgcatggggttgcctctgcaggatggtctccttttcctactgctctgaagcaactgtaccagcatcaaaagttcatctctagcaacactgacattgacccctgtagtctctggtcatcttcctgcatctgactacctccagtgctagttagctttgctgctccatttgacagtcattcaaatagctgcagggtttgaatgccttcttaaaataccaggatggctattgtacacacaaaatcattgaatcattacgacagacctaagtagtagtatcctattttatagttatggaaagatagcccagaatacttcaataactttcaaaaagtcacacacttggcatgtggcagacccactattctaaatccaaggcaaagctctttttttttttttttttttttttgctgctttatatatcatccactgtcttttctagagttggcttttaagatatatctgtagataactgtgtctccttcacacaggaaaaacccatgaatggagggactaacttatttttagatatatcttcctaaaagacttaataatatagcaagccaaataatgtggatgggtactcaatgggattcaagatcccattatgttatatgagtatatctgaagttttatgtatatgtgtgtattttaagcttgtgatacttccttgtttatgtcttttcaaacataaggcatctcacatgtaagccagaccacactggtttgagggaagcagtcaaatgacgtgatcataagaagacttctctctgactcatagtcagcctcctaaatctctttcttcccctgagtaagataaatacttctttatctcttgtttcataccttatacctagtgagacagcactcccattcaactctctctgcctctgtttgatagggcctccctttactcttcttgggaaagaaatacaagttccctgggggcaagatcctaagacaatttaagtaatacttccttgggtattttacagtaggaatgattttcatcttgaacttgaaaataccctactgtaaaatacccaattcctactgtaaaatacccaatcacatctatggagtataaagaacatttcatagaaaacaagaagtagaaataatctttgtggatcgagctggtacccaccaccaccccacatgtttctcctgttaagataggtgatattctgccctgaaacttatgaagtgactctgaccctgtctttgaagaagatttcagccttggcagcctgacatcagctccagttcatccaggctttgttcttccacagattcttgtgcttatagaatcttgagtggctctgatgttctgtttccatggagtatatcatagcatccatctgttcctggtataaacaaaatagtatgcaacttacagcaatgtctctcccacttataataaaacacctaactctcatgtagcattttatccatattgagagctctgtgagatagaaattattatattacaagtcacagatatgtaaactgagatgcagagacatcaataacttgctcaaggttacaaggtaagtgataggagtcaggagttttaactcaagcaatctggctccagtctatgatcttaaccactatcatcaaggtactgttttactttaaaagactggttactcagtaagaaaaactaggcaacagagaggggtgatcaatatgcttatagcaaactgtagaagagtccaattttagcctacacccctccccctggtctttggacattacttctgtttgctgaccttcagtgagagtgttccttaaatttctggaaacagctcactttctagcttagcataagaccaaaaagggctgtccacctttagagtataaaaatctcttgcttatagattctgcatttggatgtggtttctttaactcacaacccagcgcattgcttctgaatcacattacagaggactcttctgtttctaggactgcagtcgccaaaacagcaacaggagctgaaatgcatctataaagagaagtttcccactaaaactagaatccattgcttcagtaggactgtcactgaactgaccgtgtgttagaagaaactggcaggcagtatttccacatatagttctttaggggtgctaggtattctttgttgctgccatttagaatcaatgtactgaccatactcattttggcagagaacctacttttgacataagctttgaaaatgtttgctgcccccccaccccgccttgcctcaccctaccccagcattgttgctcatggctacaatatgttcgcactaataactgcaggctcttgtgcacataaggaagttagccaccttggtagaaattagaggaaaggaagaaggagggaagaacagttttattttcaaaatccaattctgtggaaaaaccagaaatgcaaagacagtgtttgttaggaaagctaggaccaacaaagtgaaatcagatatatttgtttaggaaaaatagggagctgttgctttctttatgttaaaagtatgttttgcaaactttaaaactgctcggataccttggttcctaattcttttttgttaaataaaattttaaaagtaaaaactcaggaacattagtttacttatatagagtctttatattaagcagatttttttttttttagatctttaaaatggtagtttcccaaagtgatgaaaagaaaaagcacttacaatgtgctggacattgttttaaggtactttattaaccactttaatcattacaacagtacagtgaggtaggtactattgttatccctgttttgtatacagggaaactgaggaacagacaggtgagaaacctgcccagggtctcatagctagtgtttggctgtgctggggattcaaacccaagaagtccagcctcaatactccttctctgaatcactgcactgcacttagggctctcatggactatgcgtgtgcatagatctgttggaatttagaacaaaggtgatgatattgggggtaataagacattatttatcgaatacctggtcgtgtatcaaaacctttacataggcttcctgaactatgaccctgatgggtagatgatattacatccacttaatagattggtaaactgaggcttaatgagggaacctgacttgcacagggtctcacagctgctaggaggcagaatcataactgcagctaggtgtggtttgtctctgacctttgctcttaacctccatgctacactgctcctgctttgtttgttaattatcatgttctaatattcttaaatagtaataaacataacatcatcagggttcctcattaagtgatcagtcactttggcctctggtgatacttgatggggtagggtcggaggaaagtaactggaaaagaaaaaccagattagctttactcttccccctcccctccagatttcaatttcaacccttccccaagagaagaaaacaatccttcctgcagacttctctggaaaaagccaccactgtgagcttccactcgttgttttttactttaagcaccgtccacagagagagtttttaactgcagtacagagctgtgcataagccttatggaaaactgatgcccaagttgattagcagagtggcagttgaacaggagactatttcttcagacccctcaaggagaatttccttgtttaccttatatgtttaaattgtaatatctccttttctctccacccccacccctcccacctccaaatattataagaacagagttcctacatggcttaaacatacaatgcacccatacttttgcacataagcatgctctgtgatttggagcattctgtgtgtctgtctcaaattccctcctccccccactccgccacgggtttttttccccccattaggcaaatggaaggcccatgccacctgttagcattacatcattggctccccagaacacagttgcaccaaaggccttaaacaaagtagttcttcttgtattgtttgcactcaaagagctgatatcatgccaactgatgtcattgtatgtctttgtgtaactgctatggcaactgggcaggtggggagcctccagctgatgtcattgagaaaggaggtgtagaggcagaattttaaaaagctggacgctgcttttttctgtgtgtggggttttctagcatgtgttggtttttttttttttttttaaactagctgcttttaagacaaattacagcttgagtaccctaaataagaacagagaggtttttcccctgcttttagagccttcttttgaatttgttttattgttcttccctctcatcttatatggaaaaatgtaacaactgccttttttgaagaaaaaagtgaattaggttcccatcacagaatctgtgtggaatttgggtttttgtggaggcgaagctgagcagattttaactcttcagaatcccttttgtggaggctgtgatgatgacaatgggtagtttttatcttatttattttttaagtcttcactggtgaagttattttccatattttctttcttctacttcagaattatctcttcaggttcaaactttattgtcataattgcctagcagaataaactatcatatgtaagggcagaggttaattctagaaatcaactgaaattcgtatatagctcttgtttttcttttcaaaaagctagggtaggttttgacttcttactttcaatgagtaaagtgaacataatattgccctttgagttttctttggatcataaccataccttaaggaaaatatgatttctctcttttacacagccagctccgggtccattggttgtgaaaagtcatgagactcggtctaggttatggtctggagtttcccgctgtggtttgtcaaagatgagacttgaaatggagaagaacatatgccaggctcagaggctagtggacagatagacttcctgtccttattgcaacataaccgtctcttgttcatgctttgggttttctgccttatctcctggaactatcaagacagccacaagccatctgtctttgagggtagatgttgtgttctggtggctttcagctaataggacttttccacttccccctcttttcaaagggaaagccagagtgtatctagttctgtttgagtagggttagagctcagttggcactaataatgtcaatccagattttatagcacttacatgtatattattataatttgagctttgtaataatcctttgggtttatctgtgcatgccattgtgtgtaaaaatattagcagaaaatttaaacaataaactatgatccgtaaattccctaatttaaacaattgttcgttttttgtacagttcttcagcttttggtcaatgttttttacttagcttttaaaaaatttaatattaaaccaaaatgttttatttattttcacatcctttttgcaactactcttttaaaggctacataatactccgtggaatgaatgtaataactttttttcttttatttttgtgttttacttggcctttttaaaatatatataaaacagataacattgtagtgaacatctccatatatctagctaactatctttggttagatgatttccctaagatccattcccaaaagtgagattgcacttgttcaggggaaggtttgcattttaaaaatggagaaataagcacagtttataagctttttatactagacccataactcgtgggaggcagagcagagccgtaagctcaaaagcatgcattcacacatccaaaagaggtttcttgatgggtttatgtgcccacaagccttggaaagtcgaggagtaagcaaccgcgctgctctcacattctgttctactgaaagtcagggttgataaatgtcagggccctacgtggagaatatcaaaaaagattataagagcagtccttcacaccccaccctggcttgtcttttccaagtacttctctgctgatttcacctgtgggcaatcatataaataatataaattaaaatagtgaatgcctgctgagttctactgtgtgccaggagatgtgctaagtattttacacgtattcatttatctcaggctcacaattgcactcaaagggagacaccatcaccctcagtttacagatggtggaactgaagcacagagataaatgaacttaagtaatagtgtcaggaaatgatggtacccagattataatcaagataacctgtctcttccaatgttcctgcttgtaaccactctgctgtattgggagcaaacttgtccctctgggtgaggtgagctatgaagggtgcaagacatgctcctgtggtgctgagattccacccgaggaggtcatctgtgcctttcttggctcccaaagcacagggttctatgtaggccactgagcatatggctctttgaggcaggtcacatttgcagctgaggaagattgcctgatgccgcgtggaactcttgctaggggaacatgccctcatttgtagaaagagcacatttccaaagtgttccatgcagtgatactccccgaagcttgtcttgggtctccaaatggacttttagtttttgttttgttttgttttatttttatttttattttttttgcttaaatacatatttatatatgtatttaaaatatgcatgagctacaatgcaaactcattctaatggggaggtggcattctctgccagctctgaaatctcagtcacactcaccttctgtgtttgtgttctaggtggacttagtagttttaagcagaaccatgaaaacctctgtgacaactccctccagctccaagagtgccgggaggtggggggcggcgcatccgcggcctcgagcttgctacctcagcccatccccaccacccctgacatcgagaacgctgagctcacccccatcttgcccttcctgttccttggcaatgagcaggatgctcaggacctggacaccatgcagcggctgaacatcggctacgtcatcaacgtcaccactcatcttcccctctaccactatgagaaaggcctgttcaactacaagcggctgccagccactgacagcaacaagcagaacctgcggcagtactttgaagaggcttttgagttcattggtaactatctcccatagggaattttcatccgctgccttccttttccctccagctcttgctttgatatcaagttcaaggtttattcctgtgttggaaaagaaaagctgccctggagttttggagggctctgccacctgaaacagcctaagcattctcctaagtcatagcctgtcgagtgtatccaagccatcaggatggatataaaaggacagtaattgaatttgttgggatctgttcaactagaaatcctcatccctcaagttctcagtgaaatagtggtaggggttagcatttatgtgctctgtaaccagaaaagtggatggaaagtaaggaatcggaggtcagagctggtgctactgctacttgatctactagcgccgttgagcaccttggaagcaatatctagtgaatatgacaccccttccaaacatacctatgccttccggtcaccctactaagccttattcatccagcataaggggagatggtactaggtttcctttgacagtctgccccaaactcattgaactaggaaagatcaggttgtgtagacggagtagttcccaaggaggaagttttagcaacagcacgctttgatccccagaaggaagcaactattagcctaatcctaatcttaatttctgcaacttctatagccccaaactgctataagactcaaaatatcgccgggcgcggtggctcatgcctgtaatcccagcacattgggaggccgaggcgggtggatcacctgaggtcaggagtttgagaccagcctgaccaacatggagaaactccatctctactaaaaaaatacaaaattagccaggcgtggtggtgcatgcctgtaatcccagctactcaggaggctgaggcaggagaatcgcttgagcctgggaagcggaggttgcagtgagctgagatcacgccactgcactccagcctgggcaacaacagtgaaactctgtctcaaaaaaaaaaaaaaacactcaaaatatcattttgggagcacctgcaatatagcaaaactcaacatttatttttttttacgtaacttcaacttttattaccataaaggggtggcctagtacttttcctaaatattacagcaggttgttattccaggaagaatacagttaagtggagtggggtgttcctttgtcagagaaagaaaaaaacagcctcaggtttaacagccagtggggtctggtggatttgctgtagtgttgacatctctggtcattttgccaagctgttttccttgctaattatgccgtcagcacaggaccatggaatattgagtctgaaaggaaattcagggtgatcactgaacttagagaagtaaagtgacttcttcaaggtcataggaattctagtgtccaagaaggggccagaatccagggtttttgactcccaagcctgaggccttttcacaacacactaaggcaatgtttatgatgccctattaagtaattcccaactggcaacactgaggatgcagagatactgcagattctttattaataaaatctgagccaaacctggagcgctgaggaagaaaaatttctcaacaagcatatgaggaacttctggttgatacatgatgtgatgttatgactgagattccatctgacttaactccagttggaggaagttaggaaattgttttctatttaatgagtagggtaagatatacttgttctaagaggatttcaactaaagctccttctcacattccttatagattattcaggcttacctgcctttttttttttttttttaaggaaaacaaaaccaataacaaatagcattcagcccgaagaacaactccatatcacaacctgcataggcacaattttattttcattgttatattattggataaactgaaatcttacagtcttgctttagtaaaaacacagcaggttttataaacataatagctttcactgagagtgtaatataagctgagcagcatctaagtttagtgtttataccagtttatttattcctgaatcaagtgtgtgtagtggaaccggtggtccagccaggcactcagaagctcattctctcaccaccatgctttctggtcttgacttggagctaaataccgtgtgctgaagggaaaaagttgaaaaagagagatgcttacttttcttgaaatactgttgactatgagaagtaaacttcatctgtaaatttttaagatgaaaatttacatcaggttttttttccttggtccactggtgggtagccagtagatgtagtttaggtgaaatcactactctctctaccccttctccttccctacctgtttatctaattggtgttccttcaaggaagctttcttagggatgtgttagagtctagaaatgtcattaagaatctgttcaggtagtgcccacatgctattgtcctgagcttttaatatatttgaaaacttagcaagtcttcctctttcaattgctctggattttgagccattgctgggattcctccatcttctgcattattgccacactggaatgtcatacatggaagcaaacgggattgaatgcttgagaggtgacaccctcggcctgtatactactagcctttagttaactttgcaacaactggattttctggggagaagctgaacatagtatcttcctagttaagctttattcctttaaccttaatcagggtttagtaagactaaaactcttatccatttaatgcccgttcctgtacagagcaattctatagaataaagaaagtgttttttctctattacaagtgagagagttgttactagcactaggtttgttaagtcacacaaccgaaaattggaattaacatccttaatccaaagaggaactgcatatatatatatatacacacacacacacacacatacacacacatacatatacatatatatgtgtgagtgtatattttcatgtgtgtgtataatttttccccttcctctctccttttccttcattctttttttttctttcagtagtgtaattccagaaaaaaagagaacaagacatttgagagaaggttcagtgactgttagagtcgacttgatcagtagcttgttcaacgtgaaagttaactgtgttataggtctggcttccggccactgctgtcacctgtgcagcaaactgttcctatgagcaattctttcatttaatcttctctttaaatgtagatgtatagcttcttgttcgtgctgatatcaactttagccagttctggaagttgtgacataagtatacgtaatgaactagtggattatacttggctttaaaactgttttaattcattatttctatacaaaataaggcattgcaaagttgagatgaaagtttctctctccgtgcctctctcttccatcttcccttcatctcttgtctttctcccttttttcagaggaagctcaccagtgtgggaaggggcttctcatccactgccaggctggggtgtcccgctccgccaccatcgtcatcgcttacttgatgaagcacactcggatgaccatgactgatgcttataaatttgtcaaaggcaaacgaccaattatctccccaaaccttaacttcatggggcagttgctagagttcgaggaagacctaaacaacggtgtgacaccgagaatccttacaccaaagctgatgggcgtggagacggttgtgtgacaatggtctggatggaaaggattgctgctctccattaggagacaatgaggaaggaggatggattctggttttttttctttctttttttttttgtagttgggagtaagtttgtgaatggaaacaaacttgtttaaacactttatttttaacaagtgtaagaagactataacttttgatgccattgagattcacctcccacaaactgacaaattaaggaggttaaagaagtaatttttttaagccaacaataaaaatataatacaacttgtttctcccccttttccttttaagctatttgtagagtttatgactaaatagtctgtgcaggttcatagaccgaagatactacacactttaaaccaattaaaaagaaccaaaagtaaatagaaaagacattgaatcaccaaggcctgggatcaacctgggctgtccacacagaaaacaaaaacccaaccaaaccaagccctgttgtgctcactggtgcaaagagaagatcagggcagcttaagtggtctaagaatccttcaggcattctttaaggagaaaaaggatacctttgattttgtgtgtttcatgctctggattttttttttttttccttctctgggtttaagagattttttttgaaatagtgaggaactgaccattatatgccttcactggcttcttgtgcaataatatgatgttttaagtgtgcaaacaagttagagctggcagctgaatgatagacaaatagtgcaaatttgccagcttggagatagaaaggaattcaacaatatatcaaatactttccttcccacctttttccttttttttttttttttctgatttgattctggttacagtgccataaaccttgttacatatgtatatcagaatgtaagaaaaaaaaatttatttaaaaatatttttcgcaaaaaaaaaaaaaatcttggtgtgtttctgttgattgtgtaaaaatttattttcattatataaatgaaactgg

SEQ ID NO: 125 - DNA, 40696 bp, Homo sapiens; identical to SEQ ID NO: 124

SEQ ID NO: 126 - DNA, 2967 bp, Homo sapiens
gcccagataggggagcggaggtggcggcggcggcggtagcggtggccttggttgtcttccagtctcctcggctcgccctttagccggcaccgctccccttccctcccccttcctctcttccttccttccctccccttccctttttcccttccccgtcggtgagcggcgggggtggctccagcaacggctgggcccaagctgtgtagaggccttaaccaacgataacggcggcgacggcgaaacctcggagctcgcagggcgggggcaaggcccgggccttggagatggagaattctcagttgtgtaagctgttcatcggcggcctcaatgtgcagacgagtgagtcgggcctgcgcggccactttgaggcctttgggactctgacggactgcgtggtggtggtgaatccccagaccaagcgctcccgttgctttggcttcgtgacctactccaatgtggaggaggcggacgccgccatggccgcctcgccccatgccgtggacggcaacactgtggagctgaagcgggcggtgtcccgggaggattcggcgcggcccggtgcccacgccaaggttaagaagctctttgtcggaggccttaaaggagacgtggctgagggcgacctgatcgagcacttctcgcagtttggcaccgtggaaaaggccgagattattgccgacaagcagtccggcaagaagcgtggattcggcttcgtgtatttccagaatcacgacgcggcagacaaggccgcggtggtcaagttccatccgattcagggccatcgcgtggaggtgaagaaagcagtccccaaggaggatatctactccggtgggggtggaggcggctcccgatcctcccggggcggccgaggcggccgggggcgcggcggtggtcgagaccagaacggcctttccaagggcggcggcggcggttacaacagctacggtggttacggcggcggcggaggcggcggctacaatgcctacggaggcggcggcggcggttcgtcctacggtgggagcgactacggtaacggcttcggcggcttcggcagctacagccagcatcagtcctcctatgggcccatgaagagcggcggcggcggcggcggtggaggcagtagctggggcggtcgcagtaatagtggaccttacagaggcggctatggcggtgggggtggctatggaggcagctccttctaaaagaaaatttaaaatgcctgggagtggctataggggtagctctttccaacagcccaagtggggtcaactcctaagccccaccccctcacacacaccgccttccctgttttgcccttgggggagccacttctaaggctgcttacccttgggggtgttcctctatttgcctgccacctctcttgtctctccctctgaagatggactcggccccacatacacatttttgtgttacagtcattgatggactctatttttttattattacttggaccttggtcgtttttatactagcaaaatgtcttgttttaatttgtgttttttggggggagggagggagtgaacttgctgattctgtagcaaaacctgggtgggggttggggtggggggtagtttactttgttgtaaggacttgataacctggctacagcgttttctatgaaatctacttggatcccatgcctgaaatttggaagcatatgtacaaaaatcatttttacgttttatttttaataaatcattgtgtttgaccgtacatgtctaacattttttttctaggatccattccgtaccgttttttaagggatatttgtttaagactttacgtgttaattctttattcttgatgtgtacttagagaaacttaagaggtcctgtggtttttttcccctctcctgttgccctgctagttgcgtgttgaattatatcccttacaggcaaaacttttgaagtggtggatgtggctttttaaactcttaagtttctgtgcatccatctcttgtactaagcgaattgtttatcatcttgacatggttggtcatttctatgacaatttacttcaaactgtgtactgtgtagttctatatagtttgtgttaagcatgtcattcatataaactgtttaaaatttttcagatggcctagtttcatccctcttactggtttgtctgtaatgaatggttaaaaataagggttatattttaccctcaaatgcgtttttgtactttcagagcaggtttaaacgttttttttttttttttcctatatccgaactgttggcctcatggaaatccctttcccgatctttgtagcaccatctactggcagaatggcagagtagctgcgaaacaatttgtttaaaaacttgcttaagacaattgcatcagatttggaagttttgccatcaaaattctttgcagaattggaagttaacacatttgcttgtaactgagatgggcttcacaggaatgtagttgccagttcatatcacaatagccctttctatatgaggtttgaaaatgtaaactgctatgcatagcttgggcaatagccctaaattgctatgacaactaatgaaccagctacgtatactggtattttaggtgcaagttgtaaagcaaaatatctgtgtattctgcttggttaacaaatgtatatttgtagccctttcctgcaatagcattcaagttgttgtttataagagaagaacaaaagtgataataggtgaaaattgcctttctggatagaaatagagaatagcaacgtttatggatatcacaaataaagaattcaattctttacatgattgagtgagagtatgtataacctggtgggtgggttcagagtaccttttaatctagtatgcttaacttgatgttaatatttaacttaaatatttgacttacatgttgacgttgaaggctcaaagctatactaagaagctttctgaaagattgggctttaaaataaaataatattttaatattgaa

SEQ ID NO: 127 - DNA, 69245 bp, Homo sapiens
gcacccggacgtgcggctcccctcggcctcctcgccatggacgcggacgactcccgggcccccaagggctccttgcggaagttcctggagcacctctccggggccggcaaggccatcggcgtgctgaccagcggcggggatgctcaaggtgcgcgcccccctcccggcggcgagggagggacggacggacggagctggggagaaccgggcgaaggcgatggggtgaccggagagaagaggggggaagcgatgggggggacccggggaaaggtggcgaagcgatggggagaaccggggagaagagcggggaagcgatggggagaaccgggaagaagcccgcgcccggaagcggcaggggtacctgcggggcggcatgagccggcgaggcagccccggggtccttgcccggtggggcgggggaggaagggacatggcggtaggaacctccatccggaagatcagtgagttttccaccttcggttttgttttaaatggaacctggcagagggagtcgcctgaagcgccctcgggggtcgttctgcctctgagctgtaggacggggccgggcgtcccctccgaagcgtgggtacagcgcgatcacttcctaagtgcccccccgccccccaactccgccgcacgccaccccctagaatgtcgaggaagaaacggctgggtccccgcgcgcctcctgtcgcctcgtgccctgcgcggcgtgggcggggtcctggctgctgcaatgcgggacgcggcgggggtgcgcggggttcccgcctggcgtctccagggcggtccggcagcccctcgcgtttccgctgggagatttttaaaaagggtttcctgcgctcgcatgtgctgtcgccttccggctcgtgacaaaaacgaaaaccaaaatgggtcccaggccctccccgccagcctccgcagacgggaaggatcaggaagcggggactccgggatgtcagcggcgccgcggcgcgggctccgggcttccctgccctgcaatgtggaagctgctctctaggaggggcccgaggctgggcccacggacgcgggcgcgccgggaggatatttaacattgaagagcggaaggtggcggagactcggcgcgccccaggccccgggtgcacgtgggggcgccggtgcccggatgatggagtgtcccgatccgtgcaatccctggcgggtagatcggcgcttcccaggcgaacgcaacctgggagccttagcgatcgcgcaggctggagacgcggcgcgccccgagctgggttttgatttttgttttcccggttcctcctgccgcagatgcgtggaaaggcccggatggcggatttcctcccgtttcggggccgcgcactgcacagggttggagcggggatgcaccccctgcccactgcgcgggtgaccttcccttcgcccttgagcgcgcggggcgggcgcgggtgccgcaggttgaggcgctgtgggcgccgccccgcccgccacgagcgcctacgtgatgcccggcccgtcgtctccacgagccccggccccgacacccgtgcgccgcgcgctccccaggcccgcagcgcagcctccccaggcccagcgccccccgcgggagacccgggtggcagcgccaggccccgccccgcagcccgccctgcagcgcccccgggaagtgctctggcgttagcattccagtaaaaggaccccagcatcaacgttcttcctgcagggctgggttctcagagaaagaaaacgtgatgcagcagaggatgggattgaagaaacaggagagtgaagtggaaatagcctggcccgcgtgacttaaaccggcccggagatgtgcgggtacgaatggagccgccttggggtcgggataggacccagagtggcttctcagtcaaaggccttcagaagcagagggagcaccttgagtgaccttacctgggccgcgaaagacaagaaacctttggcacaggaagaggaactgatctctggaagccaccagggcgggtggaaagtcagggtttcaaggttattttggaatttaggtgctgtgggccttgtacggtggctcatgcttgtcatcccagtgctttgggaggccgaggcaggaggctcgcttgagccgaggagttccagagcatcctgggcaacatagtgagactctgtgtctacaaaaaaaaagaaagaaaaaaaattaagatactgcatgtattggaaaatatttatgggtcattcctttgagctccatgtccaaaagcttgctaaaatgcgcgggagtttgtgtacaggcatgtgagattaggatacattggcagaatcgcggtgttctctgttaccctggttttgccacctgggaggagttagacatattgaaggttagtaagtccacgcctcttcttttctggggaaaatgatactttggaaaccaatattatgtggggaacgcggcttggttgctgcaacctcgggttaataggagacagctgccctcagctctgcaggtggcatcaaatatggtggcctcgagcccacatgggtcacacctgggctgtccctggggaagcccgccatggcgggtcgcctgggcactctttccctggcagagctgaagtcacaatttttttgtagactctgtaaagagctttacccttcggtgatacgatcttgaacctgttggagcatttggacgcatttcttttaaggaagttcacctccagatgtactcagagggcctggtcttagctgccacagatttacaaacccttacagtaagtaggttattcctcgagaatatctcagtgtccccattcttttaccattttattctgattctatgttagtacttgattttccctgacatagaagactattgcttgtagctagagatgagagaacatattcacattcacgtattaatttcaggggaattttctgtcagatgtgaaattatggtaaaattccgtatattaagatgatcatagctaccatttgttgaaaacattttgtattctaagagctttacacttcttatctccaagcctaaatacatgatcccaagagaggcgtgtcctcattttggaagtggggagaaagactcagaaagaaaagtaagttaggtaagggcatgaggtgcatacgtgattgtgataggagcaaaacagatcttaattccaaatattgtactctcccgtagaccacgaagagtacttatgtctggctgtgtcacccaggccagagtgtagtggtgccatcatagctcactgcagcctcaaactcctgggctcaagtgatcctcctgcctcaaccttctgagtagctgggaagacaggaatgcaccatcatgaccagctaattattattattattattattattatttttgtagagacaggatctcactatgctgccgagactggccttgaactcctggcctcctgtagtgatcctcctgccttggcctcccaaagagctgggactacagacatgagccattgtgtcaggcctccaccatctccaccatgtttttcagggacctttcttggtgaagctgctttatctagttaatgctcaaaagtgagcaaaacccgatttgcccaaaattacacagatattctttgggtggctttgttaggggaacggaaaatgcctttttatagtgataggagtccaggtggcaagaacgatattatgtgatgggctgctttttcttctctcagtagagtgtatattatttaattataagatacaattgaaaatctctttctcttttctatattcccgactccccgggccttgaatgaagaaagtatttctcaggctgtttttgtttgtttgtttgtttgttttttctacttgcttggatatcttctgtctcaggctgttttttttttttttttttttttctttctcttcttctgcctctttatgtatcttctgttgtcccaagacatgtctggaaacttaaattgattttcactcaatctgaaataagctccataactctgaatggcggacttaccatgactaagtccccactgccacagaacactgtgccacacaccaagagtgactcattgtcttagtcacaggttgtggcttctgaaggtcctggtgcctggtggagctgagtgtactgggaagtccaggtgcatccttagggtaggctgcatgtgaaagctgcgtcctttttgcctgtggtgaggtgaatatcaatacagtatttatagaaagtccacataaattgagtaagtacaaacctttccaatcctagtgagaataactagcattaatgactctttgttatgtggcagggcctcagtgatcctgggcaatgacttatccctattttacacatgagcaaggggcgcctgagttgcaccaccttccctgagttcacagagctccgtggtggggccgggccctgtggctgcagcagggatgttcagggctgcgcgtacctgcgtcttcactggtgtctttcccgcgcccagcaccatgcctggcgcttcgcaggaatgcaagtgtttgctgcctgcctcctgcctggaatctccactgaggagcaggaaaccaggggttctagctgtcttcttcgtccatgaagtcctttagaggaattcaaccctctctaattaaaagtatccaatatcctcaggtcaatatgtgtaaactgttaagacttcaagattagaaccttaaaaccgaagtcagaagtgtgaggtttccattggctggacgtgcattaggtcaatgacacacatatttattggacaccaggcttgagccccacatgggcacctttggtgtctgaagcaatgctggcttcggagcccagtagggtggaaggggaaactgagaacagcgccattttgcctcccacggctctgggcccgttaccttcctgtgtacatacattatttgatgggatcttttcagtgtaaagtgcagtaattaattttgcaaaaattactgggtctgggaggcagtgtgttggaatgatggtgtcaccatgtggcacagtgggagatttgtgtaatggcatcattttctgtgaatgcagaccgttttgtgtgccatactcgaatgacccttcgaagctagacattttgtcatctttcgaaagaagcatgttttcccccttggttacagaaagctaaaagcttttgatacaggactccaaccttttatcagggagaattaggctctttaaataattagggctctaccaatctgatgggccatcagaagcaattaaaattagaaaggtgaagatacggtaacgtagtcaggacaaacatcaggataccagattgcacgttcacaatggcatttcggctaagaaagtgcgggtgaatatagaacagagggccgtatgtcagtaattgggttccgttttgtgtttcttttccacaagccctttctggtgttgtgtttttgtttattagagagtagctgcccaaaggctacagtttccctccccactcctcggttctctccgtcttcacccccaactcccagtcctgtgtttggaattacagtcattgtgcttgtcaggatgtaagaggcagccagacacatggcagaccagagcactgagaggcagagacatttataggtcctagccctggtcctgctgtctgggtcagcagggtgctgagtgctgagtgctgagatagggtcttgatgttttcctctgcagaatggaggcatcactcagtctctgtctcctctccctgtctctgtcttccctcccctcttccctaacacatatccacagtgaaagtgttcaggaggaaaagagaataggctggactgtgctgggacccccaaccccagggcccgtgtgctattttcccagcctccgtgtgcccagagatgcctaggggagcctgcggaggtgtagatcctgactgtgtgggtctgagtgaggctccgactctcacggggagggcaccggtgctgctggaccccctggggccagtggagcggtttgcaaatcgggcagatcagcttctccacttctccaggtttccccaatgtgagatgctcccaggagtcccatgggattgttttctgactttgaccaggattttgacagagaagattcattaatataggaccccttgtctaaacgtacatatgtaaatgatctgatccgaagtttcctgaatggaaaatgattgaaagggtggcatgcagtagcctcggggagtcagtccttcatatcttttcagctgtgtcttactacgattaagattttatttctgtgtgtgtgtgtgttttttttgtttgtttgtttgtttgtttttgagacgggatcttgccctcttgcccagcctggagtgcagtggcttgatgtcggctcactgcaacctccgcctcctgagttcaagcgattttcctgtcccagcctcccaagtagctgggattacaggcatgcgccaccatgctcacctgatcttttttgtatcgttagtagagatgggtttcaccgtgttggtcaggctggtctcgaactcctgacctcaagtgatccacctgccttggcctcccaaagtgctggtattacaggctggagccactgcacccagccttatttctgtgtttctgtaatcattgtgcatgttaacagactgccttgggtgagtcaggacaggattttggcaaaagaaccaggccctttctgcctggagctgtcactcctgtggtgaggtgcgggtacgacgtgcctgtagcctgacctgagaggaaaagctcctgtcttatgaaagggcccaggggaacctctggttggggccctttgacctgacctgacagtgagggaggagtccgtagaggagagtggcccagtggaggactttggctttgccttgggtgaactgggaagcaggtggagggaagcagactgactgtctccgataagggtggctttgtggagaggagaggaggggaggggaggccacaagtttagggtatcacaaggagcaggccacagatggaaggttatggggtggggcacgtggcagggcagccctgtgtccacagacacatcccgccaaggggacccagagacttgagtgtgtcagggcttggggtgaatgggcactcagctgttacagctggaaggtagagcatgtgagctccaacagacacaggcaggtgggggttaaaggagaatcttcatagcagtgcttagaatagcaaaaagtgggaaaaccagcaaaaaactatcaataggagattaattaattccattatggcacctggaatgtgccgagaccagctcagtcggggagaccgtaacccagcggcgctagaggaattaaagacacacacacacaaatagaggtgtgaagtgggaaatccgtggtctcacagccttcagagccgagagcccagaacagagatttacccacgtgtttattaacagcaagccagtcatcagcattgtttctacagatatcaaattaactaaaagtatcccttatgggaaatgaagggatgggccaaattaaaggaataggttgggctagttaactgcagcaggagcatgtccttaaggcacatatctcatgctactgcttgtggcttaagaatgcctttaagcagttttccaccctgggtgggccaggtgctccttgccctcattcccataaacccacaaccttccagcctgggcgttagggccgttatgaacgtgtcacagtgctgcagagattttgtttatggccagttttagggtcagtttatggccagatttgggggggcctgctcccaacagaatggaaggaatttttgtcagcgtttaataaggagctttgtgctggtcgaaagtcaagaggtacacagtatactcaagggcagtattgaagagccgattccagagcggcttccctctggagccagtggggcagtttgcaaatccaggcagatcagcttcttggaggtttctccaacgggagaatctcccaagagtgaggcttgcatgtgggtggcctgtgttatatatgcaattttaaatgatctagttgccgcattaaagaaaggcggggcagggggccgggagtgggggactctgggtgccaagactcaacatctgtaatcccagcccttcaggagcccaaggcaggtggatcacttgagcccaggagtttgaggccagcctgggcaacatggcaagacctagtctctacaaaaaatacaaaacaattagtcaggcgtggcggtgcacacctacagtcccagccccgtgggagattgaggtgggaggattgcctgagcccaggagttggaggccgcagtgagctgtgactgcaccagttcactccagcctgggcaacagagtgagaccctatcgcaaaaaaaaaaaaaaaaaaaagtagtgaacccgggaagcggagcttgcagtgagccgagatcgcgccactgcagtccgcagtccggcctgggcgacagagcgagactccgtctcaaaaaaaaaaaaaaaaaaaaaaagtaaaaaccggtaaaagcaaaaaactatgttttatattcaatccactattttgataacaatcaattattgtagattattcatattttacactgttttccgtagtaagtctttgaaacccagtgtgtaaagaagcttaaagcacatctccatgtggacgggacgcacgtggccagcggctcctctgagggacagtgtggtcacgcaatgggtggcgtgtgctgcctgtatttagaaggtccccatgtgggtgtttttgcgaaggctctgagggatgtgcaggggagggccgacactgtcccagccacgcagaggaccctggaatgcagcatgctgccgccgcgcccccgccccagcccctctgctacctgagctctttcccagatgtccatttggctaaactccctcaacttcttccctttccttctttctccaaacgtcactctcaggcaggtctgcaggctctccgattgtcaatggcagcccctccctgtcctccacaccctcaacaccccccaccccgcttgttatttttctccttagcacttacggccatccatccatgggcatcatgcatttgttcactgtgtttcttgctttcgggtctctcctgatcggaacaagctcttccagggccagaggcttcccatcttgtcactgatgcatccacacagagcccagcagaggtggcacttggggcacccgagctggacagtgggttggtggttgagtgaagagccctacagatttatctcaagccctcccctgaccctactagaagacacggtggtctgcacagtccaggaggtcagagaggccccccagttcgatgactttgaactggcaggggtggggagggaacagcaccttgacagaatctgcctttggcatcccacctccccatgcctacataatccctacattatcaaaggaaagacccctagaaggaactttggcagcagtagtgagatcagcgcggtgtaagctcattttctaacaaagcagcgggaggagtcggcaaactgactttatttctcaaaaagaatttatgcattgaaattaacaagtgagtgatcaggagtgtgggaaaattcaggaaaagtggctcagtgctgtgagagagggcgaggcagggagctttattactccagacaatggaggaggtaaaagatagacccagattatttcattagagttcatctattctttactttttttttttctttttttttttttttttttgagatggaatctcactctgtcaccaggctggagtgtagtggcgcaatctcggctcactgcaacctccacctcccgggttcaagcgattctcctgcctcagcctcccaagtagctgggactgcaggcgctcaccaccatgcccggctaatttttttttttgtatttttagtagagatggggtttcaccctgttagccaggatggtctcgatctcctgacctcgtgatccgcccaccttggcctcccaaagtgctgggattacaggcatgaggcatcgtgcctggcctattccttactttttaaaaaaaaaatgcaatttagattttatcagagcagaatcccaggaaactgagatttgtaaactgggaaatccagctcctccaagtagccaggaaataagggtgacttaagtcatgcttgctaggccctggtgtaggccaaggatgactctgactcaaggaagaaaccgtcctgtgactctcttacctgcattgtggtttagtaagaagctgttaaaaagtacggcatatgaagaaagcgatttaataattggtcagagtaatgaccagatctttcctatgaaaccgctccctcattatctccaactttatttttggttctcatgacaagatattcacttccctgaaaactgggatttttgcaaattacgaagcggtgtttttccaaatgttaaggttcttctttggtaggaagatgttattttctcctggaaatccttgggttgggctcccaaaaccaaaacaaaaccagatggattagccccaggatgcctgagctatttggacaatctgtggcttgagtgttgagtgaaagactctgaaactgccctttgtcccttaatggctgtgtgccagggcccacggacagccctaaggaaatggtgaaacaggtgacttttacctgtgacgccaaaagcccacgttgcgggctgtgaaagccctcattgcaggtgtgcacgtctgcctgcattgcaggtgtgcacgtcttcgtccctgtcctgtgggtgacagcccgccagtaaatgctggtatatttcccccttgcttttcatccaccagtgttcttctccctccaaacccctcactgaatgttcctggggcttcctcaggtttcatcttgcagggcccagcaggaggcagctgacttgcagtcctcactgttcagaagttcagagggagggcttagaactaaacagtctccactcccaggcaattaaatgagcatctggcctcagcaggtattattttccttcaagttcccattggtgactctgaggcacaggcattgtaatagaggaaattaggaaggcttgaaagttaaaatgaaataagactagggtttacactacagcttcaccgcttactaatgttgttaccttccagtaatcagtttatccccctaagagcctcagctttctcatccctccagggaggtgtcaggagctctgcaggcttcctgtgagaaacatccaggccagggctctggctgtgggtctgcagtcagcaagggacgtcctactgggccccaccgagtgctgccagtccctgagctcaaggaggacacatgaataaaagccctttgcaatgcatggctccatcctaccaatgcataaattaatagaagtcctttcaggacctagaattgtgtctctttaaaagtgtggtgcccccatcacctggaaattgctagaaatgcaagttcccaggctccctctccacctgtgaaacccgggggcagcccagctacatgggggtgctgcggccgctgatggtgagctcctgctgtggggtggtgtcactgttctttccaggtgggtgcaggtgaacccggagtgggggtggggagaatccagcagggacttcagcgattgagtttagtgctggggtgcatttttactctgcacaggagtctcctggggtcaccttgtgtatcatgtccagctttttttttctgagacagagtctcgctctgtcgcccaggctggagtgcagtggcatgatctcagctcactgcaagctccacctcccgggttcacgccattctcctgcctcagcctcccgagtagctgggactacaggtgcccgccaccacgcctggctaattttttgtatttttagtagagacggggtttcaccatgttagccaggatggtctcgatctcctgacctcgtgatctgcccacctaggcctcccaaagcactgggattacaggcgtgagccaccgtgcccagcctcatgtccagcttttaagaattttattccttcttctatgtctttccacttaacatttcctaaaatccccgagttcttcatcattcctttatgaaagaccggtgggaacgaggtcttcagagagcggggtggggggggggggaagaggagcaggggtgaggggccgccattgggtcttagttgtgctcctgcatcacctgcttcctagtgttggcacgggctgtgtttgatgggtaattcatccattagagtgaccatagcgtaaggtcctggaaccagagctgtgcgtccacccttcgagttgaagagtccaggcactgctgagcccagccatgggagagatgagcgaggaccttccacaggtgtgaggccaagggggcgggaggctctgtcctgccaggaataaatggaatcaggtgggaggctctgtcctgccacgaataaatggaatcaggtgggaggcaagccaggcccttttcctgggaggtgccagagccgaggaggagttggaggaggaagagcgtccgagcaagagcactggtgggactgctaccaaggttcaggaacaggagcctccgagtgctgccagacaggtgggaggtccctggggcatggccgggagctcaggggaacttgggttttcttccagtagccctgggaacctggaggaacgcggtcatattcgtgctttagaagagaacattgccgggtgcagtggctcaagcctgtaatctcagcactttgggaggctgaggcggatggatcacaaggtcaggagatggagaccatcctggctaacacggtgaaaccccgtctctactaaaaatacaaaaaattagccaggcgtggtggcgggcgcctgtagtcccagctgctcaggaggctgaggcaggagaatggcgtgaacctgggaggcggagcttgcagtgagccgagattgcaccactgcactccagcctgggagacagagcgagactccgtctcaaaaaaaaaaaaaaaaaaaaaaaagagaatattgaaactggtatggaaaacatctcggacgtagtgtcaaagtgtagaaagaaataacaagtgtgaaactcgcacagcccaacagcaaggcaccgtccccatacccagctctccaacggggtggggctcttgtggctgttacttcatttgttttttttctaaacaagaagaatatattcataaattatttgcataaaagcaaatgaaagagaaaaagctgttgtaatccttctggccacagtgtggctcatgtcagagggagtcagggagtcgggggtaatgttgggagcaggtgttggttgtatgggcaggagccagcaagggtgttagcagcattcagcgccagagacagagaagaaagttgtgctgttcggcaagagagaggttacagcgggaggaggaaatgatcagggtgagatgacctgcattttgaaatgctgagtttgatgttcttgagagatggccactagttaatcagtaggtcattcgaattctttgtgttataagctaggtttgaatataaagtaaataagactatgtaatatatatatacacacatacatatacatacatgttagatacatagtaaacatgcatttacctctaaaatatgtatccccaaggtttttcagccaaatagatactctcattcagaattgtcaactttcagaggcaatggtgactccagcatcgctgacctggcccaatgtaattgaagatttttctaagcatcttctgagccggtcaccgtccaagtgcacatagcctgcctctgtcacagatgcccctgcaggaccacagtcctttcatttgtggtttattgactggaaacatcactggcttcatggcccacgaactgcagcatctttagttctgacagctgtttctgaaacttaactttgcagaggaggaagcttggtgctctcaggtgtgtttgggagcaaaggcactgaaggctcaggtgttcctcatccttaagcagcagcgctgcatggctgtgggtgcggccctcgtgccttttcactcctctcccgatgggcctgagcttgttagccacgacagcaagacagaccctccaggcccagaggtggttccgagacactagtggcttcagctcccccaaatccagcggcagtggagagctaggtggaggctaacagacttatgatacattgtaagcagacttatatgatgatacattgtaagcagacttatatgatacattgtaaatagacatgatacattgtaaacagacctacatgatgatacattgtaaacagacttatatgatgatacattgtataacactgttcttctcaaggggggcctccctttatcttcatgaggtatggttatttgtaatatgctggtttattttaactttactgataataaaattgcatgacttgttttctgttgaagcccattgccttttttttttttttttttttttttttttttttacagtggtagttggtgatgtgatactccatttttcatctccttctcaaatcacacacacacagaatttggctagctgcaaataaacccctattctgtacttcgttttgcagttgaatggagtggcctacaaattcgtaccaagtccaggcagtgatgttttgaacagaaagtagcctgggcatgggggtaccttgcgttacgttggctgtttcttttagtccttaccctaatcccagaggagtgtgtgtacccatttctcatattaggaaatgaggcattgagaggttaggaaacggacccatggtcatgggtagttagtggcagagccagaattaccccgggctcttcagtgactcttgctcctgtttccactgcaggtatgaacgctgccgtccgtgccgtggtgcgcatgggtatctacgtgggggccaaggtgtacttcatctacgaggtcagtgtctgcccctcaccccctgtcgcccttcttccacctgcccagagccctgcagtcaccggcgctcgctcacccctgcctcccccatgctgagcacagccgaagaggtgggcaggggagcaagatcctgccagccagggccgttcctcagcccacagaagcccctggtctgcagggacagatgcctggtctgcaagttttttgttaggcaagaggagaaaggagatgagagggagcccaaaaagccattttcttttttcttttttttcttttttagacagtcttgctctgttgtccaggctggagtgcagaggcacgatcttggctcactgcaacctgctgggttcaagcaattttctgcctcagtctcatgagtagatggaattacaggtgcccaccaccacacccagctaattttttgtatttttagtagagaaggggtctcaccatgttggccaggctggtctgagtcctgtcctcaagctatccacccgccttggcctcccaaagttttggtattacaggtgtgagccactgtgcccagccacaaaaggccatgttgatatcaacttcctggtgttgatttataggattagaaatcaaccaatgatctctaattggttgtattggttggttggttgtatttgtctgaggctcttactgctgtagaagtgatttattaatttccaatgtaggctgaatttgaatacacatttagggaaatgaggaaaacagccactttgagcttttcatcattcatgtaaggtggaaacgatgcctagtgtctgctgatgtgttaaatagcaggagtgactccctgtctgccacttttgaagtcctggcaacttaagactaaaaagtatttgaaaggaaggcaccaatagagtttggatcacagtattaatttcagaaattattaggaaaaatatttaatgtttaaatttataaaacatagctttaaaaatgagaagaaggtatttttgtaaatcacttaatgcctccaaaatggctattagtgttttagtctgatttccttcagtatgacgtatgtaaaacaccggaaagaaacacacacattaggaaaagtacagcaaacacgttctgtatactgtgttttttgtttacgattatgtcatgacttttcactacgtaggtttcacgactgttgctttaacttattttattttattttttttgagaaaaatctcacttttgtcccccaggcttgagtgcaatggcttgattttggctcactgcaacctccgcctcccagattcaaatgattctcctgcatctgcctcccacatagctgggattaaggtgcctgccaccatgcccagctaatttttgtgttttttagtagagatggggtttcaccatgttggccaggctggtctcgaactcctgacctcaggtgatctgcctgccttggcctcccaaaatgctgggattacaggtgtgagccgccgcgcccagccaactgttgctttaaatgtcaacatactgtcttgttgaattgatgtctcatcatttatgatggaccctgtattccaccattcctgtggtattgcactatttagctttctccccgttttttaagctattgtaacactgcaagatctatgttaatattcaaagcgatttgatgttttgtattatttaataccttggtcctaatatcaggcaccgactgagctaaaagggacagtcatcatgatggcttgggatgcctcttgcctaagtaattcctgaaacctgtccagcctcgtcccagccccgcgcagggaaggcggtgctctagctcccatgatgatgctgtgtgccgctgtgtgcggcggccttctgagcactggcaggtttcccctgtctgctttctaagccatgtttccctttggtgaaatggttgctactattattctttgctcatttatctgtgtatccatttgtttatcatttgctggaaagaggtttttttgttcgtgtcattgttgtttgcttttattcaattaaactggttacgtggttattgtttgtatttatgcgatttgggcaattttaacggagggtctagctgtagcattcccaggctgttgtttttatcattttatatttgggtgtttttaaggtcagattgccctcctgagtttccctgcctggaccctggccctggtggcagctgccccttgctcagggatgtggaatgagcacagtagacgcggtctccagcacagtcctccagcccctccccaggagagtcctccagcccctccccaggagagtcctccagcccctccccaggagagtcctccaccccctccccaggagagtcctccatctcctccccagtacagtcttccacctcgtcccaagcacagtcctccaccccctccccagcacggtcccccactccactctccagcacggtcccccactccactctccagcacggtcccccattccctccccagcacggtcccccattccctccccagcacggtcccccactccctccccagcacggtcccccactccctccccagcacggtcccccactccctccccagcacggtcccccactccctccccagcacggtcccccactccctccccagcacggtcccccactccctccccagcacggtccgccactccactctccagcacagtcccccactccctccccagcacagtcccccactccactctccagcacagtccctcacccgctcaccagcacagtccctcaccccctccccagcacagtcccccaccccctccccagcacagtcccccaccccctccccagcacagtcccccactccactctccagcacagtcccccactccactctccagcacagtcccccactccactctccagcacagtcccccactccactctccagcacagtcccccactccactctccagcacagtcccccaacccctccccagcacagtcccccaacccctccccagcacagtcccccaacccctccccagcacagtcccccaacccctccccagcacagtcccccactccactctccagcacagtcccccactccctccccagcacagtcccccactccctccccagcacagtcccccaccccttccccagcacagtcccccaccccttccccagcacagtcccccaccccttccccagcacagtcccccaccccttccccagcacagtcccccaccccttccccagcacagtcccccactccactctccagcacagtcccccactccactctccagcacagtcccccactccactctccagcacagtcctccaccccctcctcagcacagtcccccactccactccccagcacagtcctccgccccctccccagcattgtcctccaccctgcccccagcgctggaatttgcacacagacttccagaagtggcggtcacctgcacctgacgaagaccagcttagtttccgctgctgctggagcatatacatgtgcatactgaatttgttccctctgcctttttttgggtgggcgggggagagggtgggtgtgatctgccttggactttgggagacagtaccacacccgtcctgagagctgctcttagtacagaaatgtggttttaaaagctgtttggggatggagtatcctgggaggaggtttttctgttataattcgcaaaatgtttttaaattcatgaagacttgtagttcacagaatgtttcccaggatgccttgtgattttcacggctgctcctgttcccgcggccctgacgctgttgtgtgttgagtggaagttagttccctcacagaagtggcggcctgaacactcacagggactctgggtgcagaggaaaggaaggaaatcacttctcttatttcacagataaactgacttaccttagttcactttctccgcgtcaccactcagcatgttcagggccaggaacagagttcggtccccgacccctggcctctagccgggagtagggagtgatttacccccttaggacgtttaccagtgtttggaggcattttttgattgtgccattattgaaaggattgcccctggaatgtactggggagaggccagtgatgctaccgcacatcctacgatggacaggaccacaccccacaaagaatggtccagacccaaatgttggtagaaacaaggccgagggaccctgcactaaaccaagcgcacactgtgtttggtttgaatgttgttagctggggaggggtggggagtgaggccgaggggagtgtgagggcctaatcttggatgcagtccctggcccactttaatctctcttgatgtaagggttgtgtttttgtggcgattgtcgggtgtctgatttttattggtcactgtgtgctgtagtcgcccgtctgtttcctggtgggattcagatgtcctcagacctgtgcctgctgtctgtgtggtatgtaccagaattaaggagttggtatggaacacactgggaggcctaccccagaggccctgggctttctctgatgtttgtttgtttttgagacagagtcttgccctgtgtcgcccaggctggagtgcagtggtgtgatctcagctcactgcaacctccacctcccaggttcaagcgattctcctgcctcagcctcctgagtagctgggattacgtgcctggctaatttttgtatttttggtagagacggggtttcaacatgttggccaggctggtcttgaactgctgacctcaagtgattcacctgccttggcctcccaaagtgctgggattacaggtgtgaggcacctcacctggctcagaggccctgggctttcttgggaggtaaaacccatatgttctctctgtctcagctgggagggctggggctctgaggcccatccatgtgactccatggccgcaggtgctgtctggacgaggtctggacaaccttgtctggcggggacagcgcctcttcctgcccctgccctcggtggggaaggaggggttctgactctgagatctcatttcctttagggaaattcacggaatttctgcaattcttctgctgagatgtggccaaaataaatccttgtgtgcaaatggtgttttgggggaattctaatttttatgataacttttatagtaagtggcaccttcgaagctgtctaggagcagagctgaatggactgtttatgaattttggcacaaagaatgatcaggcttttggaattatcttactgaggaagataggagcagcctggggatcagctcatttgagcccaaatttcctctctggcaccctccccacctgccccagaaggtgggaaatcctagtgaacgggtccatttcttcaccttcctccagtgtagcccaggcacctacctctgggcgtcttgggaacataaattctcatggaccctcagaccgccaggactttgtatgagtggtgggttctataaccagctgtagcaataaatgttgaatccatttatggtatcatcattttgctgttacagatataaaaatcctgtatctttcattcttttttttttttttttttttttacattatactttaagttctagggtacatgtgcacaacgtgcaggtttgttacctatgtatacatgtgccatgttggtttgctgcacccattaactcgtcatttacattaggtatatctcctaatgctatccctcccccctccccccaccccacaacaggccccggtgtgtgatgttccccttcctgtgtccatgtgttctcattgttcaattcccacctatgagtgagaacatgtggtgtttggttttttgtccttgcgatagtttgctgagaataatggtttccagcttcatccatgtccctacaaaggacatgaactcatccttttttaatggctgcatggtattccatggtgtatatgtgccacattttcttaatccagtctatcactgatgggcatttggggtggttccaagtctttaattctaagatagaaaacacactaaaatctgtgagtgttttcctaactgggcagcaaagccccggctgacctggagcgcgttgcctgggggtgatcccgtcacccagccgaggtgacggctcccacctctctttgcaggggtgggtttgatgccgtgcactcccaagggcccagagtatgggtgcagtaacactcactgctttttaaaacattttttatttttaattattatggatacataatagttgtacctatttatggggtacatgtgatttttttaaaatttattttattgaagtaaaatatgcatatatcatttaccatctttactatttgtgggcatagagttcagaaatatagtcttcttcccttttatccttgcttttccccacccctccccttccatacctctgataattgcagttctcgtctctatgagatcaactctgttagctcccacgtatgagtgagaacaggcaatgtttctctttttatgcctggcttatttcttatttctttttccatacagagttttgctctgttgcccaggctggagtgcaatggcccagtcttcgctcactgcaacctctgcctcccgggttcaagcgattctcctgcctcagcctcctgagtagctgggattacaggcacccaccaccacgcctggctaaatttttttatttttagtagagatggggtttcaccatgttggccaggctggtctcaaactcctgacctcaggtgatcctgccctcctgggcctcccaaagtgccgggattacaagcatgaaccaccacgcccatatgcctggcttatttcacttaacagtaaagcactttcatccccattgccacaaatgatggggttttctcctttatgggtgaacggtgttgtgttgtgggcgtgcaccacgttttctttgtccatttatccgctgacgggcgctgattccacactgggctgttgtgatggggagtgaatgtaggagtgcggaggtctctttctgccgattccctttctcggggtatatgcccagcagtggggctgctggcttgtgggggagttctatgcatgtcatagtctcatacaagcatgcaatgcatcatgataaaatcagggtaagtagcatatccatcacctcaagaacaatcatctctttgtgttaggaacactccaattttactcttttagttattttgaaatattattttgaatatatattatgtatatattattatacattatgtataatatgaattatatatgtattatacatatcgtatacaatgttatacattatgtataacattattatatattattaaacattattatacattattaactgtagtcgctccatagtatcactcatccctggattttattccttctatctcaaactgttttttacccattaaccatccttctttacacccctgcttccttctacttttcccagcctctggtaaccatcattctgttctctgtctccacgagatcaatcctaactctgtcttcatgagatcaattttttatttaagcttaaatgtatgagtaagagattgcagtatttgtctttctgtgcctggcttatttcacctaatttctgcctgttccatccatgttgctcagaatgacaggattcattcttttttattggctgaataatattccattgtgtatcaagatgtggaatcagtctaagtggccatcagtgggtgcgtggataaaatgtggcgtatatacgcaatggaatatttttaagccattagaaaacctgctttttaaaatcccaagtcttctgagtcctggcctgcctctcagacctgggttttgggtgagccatcgtgggcctgcaggacgtactgcagtgactgtggatgcataaatcaacctttcatttctgtgtgctcatctgtgcagtagaaatggtgtttgccctcctgtctccctggtagaaaggacttggaaaagtctgagactaacggggcagaggagctgtttgactgcttttcagggatgagacgcgcatgcctttgactccatgggtgtgtggccaggtagggaaacggggtctgcacctgaacacatctattcacagatggctctgcactgaagaggctcagccccctccccggcctggtctctgcgtcatacccacaggctgggcttctctctgagtgtcagggcgatggcatctggggtgggcaattcttggtgggcggtcctttgactctcaggatgcggagcagcacccctgtgtccacctaccccatagtcatgacagtcaaagatgtccttacagtatctccaacatcggcgaacgtcctatggggggaaaatcactcttttgggggaccgctgttctagacctatttgggctcaaattgaggggatattatgttttatttttttaaggatgactcagtaatttatccaacagatttttttcacctatactctagtttctaacctagagctctctgggttaccaacagaccaggacagttaaacaggttactattaattaaaggggtttgttttttccttcagtagtgcatgtgtgaagaaagtattaacctgggaacagtggcgtttctgctgaaagcctggccttcatcgagggacctctgctgtctggccgctgcttgagctcctataaacctgggccaagcctacgtgtgaagcatgccaagccttgggctgcattccagggagactcggggagggtttgccagttaacccattcctttctacctggtgaaccaattgttgcttctttcttttttctcttaagctaaggtttttccttagaagcctacaaatggctttagcttcttggagatgatgatactaagtatatcagatgctttgacccaaaggccatgcccagggtaaactaccctggctctggtgggtccaaaccaagctggggcgagtcagttggttaatccagggctgccactgtgtctgcaggaaacagtcggctccttgcatttggtttcattcatgaatttcatatcctgttgttgaatattcttctgcagatttcagaaattgttcatattattatagctcttcaaatatgactcacttaagattcttgccgagcaccgtggctcatacttgtagtcccagtactttgggaggctgaggcggatggatcctttgaggtcaggagttaaagaccagcgcggccaacatgacgaaactccgtctctactaagaacacaacaggtagctgggcgtggtgtaatccttggaaggctgaggcttgaactcaggaggtggaggttgcagtgaacctagattgcgccactgcattccagcctgggtgacagagcgagactgtgtcaaaaaagaaaaagaaaaaagtcttttatcttaattttttgtttgttttaaagtttggttctgctctagacagctgtttgtaaacaatatcagagctgtctttgtcatagtccacaccctaaagaaaggctaggaataattctgatcattttatcgctagttttttccatgattaaaaataacacattcaaaaggtgtcagataagtgatgcctttttatgttgaaaggataaagggtgttggtacagcatcagcatccagcctctggtcttcccagatgtgctgccatggagcctgtgccacctgacccccgccaccggcccccaagcttagctcaggtgcccgagggtctccatctccccatggcccccggtcagcagccctgtccctgcacccagactggccaacccttctgagcttgaaatatcagcatgtgatcttagcttcccttgtttcagccctgagcattacagcttgacttactataccaataaacaaaccattaacttatcaatgaattgattggcatcatgcttcccttctttagttggtctcgtggaggtagagaggaggatgtagatagcagaggctgggaagggggtgtggacaggaggggatgcagagaggtggatgggtgcaaacatatgcttagataggagtaggttccagtgttgatagcggagtaggctggctgtgttagcaacagcgtattatattaatgtatttcagagcagctgggggagaggactggaaatgttctgaatgggttgaagttaaaaatacccagggtgacagacaccccagtaccctaatttggtcattacaggttctgtgcatgcaacagatactcacatgtaccccacaaatatgtaaaattatatgtgtcaataaaattgaaaaaatatgggggaaaaaaacctttcccttcctgatagaaacccttcattcttcattagccataggaaatatttcttttgggttaaaatgaagctcctgcttttacaatttttaaagtgagaaatctcacacttgtgacccaaaataaacaccttttccccagaagtgctggtgctcccctgtctgaggaaaggggtgtgggggacctctcctaatctggaggatgcctgagctgctgggatgtgtagatgggggtggccacggaagcctgagctcctgggatgtgtggatgggggtaggggggtggccatggaagcctgagctcctgctcctgggatgtgtggaagggggtggccacagaagcctgaactcctgggatgtgtggatgggggtgaccacggaagcctgagctcccgctcctgggatgtgtggaaggggctggccgtggaaactagttggcaagacaaagagcaggtgacagcattggccctgacttctgggactgtgtctgatttttttttttttaaatctctgtctcacccctcccatccctgactgtcacccccaccttcccccaacagtgttgaaagaccaagcaaggttgtccacatcccgttcagtcacatctctttgatgttttaaacataactatttctgcccattaacttccttgaagtgaaaactactcaaccactccacttctgtctaaaaataagtgatgcttgagcacagcactgtgcagtttcttacgtgtagctgttcccgacctgactctacagggtctttaccagagcccatgccttccactaacacgcgtgcgtgctcaccgagctggctgactcctagaagaccagttgaggtggcctggttctgctctgcactccctgcctatcgttggaacattgtccaacaaaattgacacatccagggtgacgataaccacaggaacaagcattatctttttttttttttttttttttttgagacagagtcttgctctgtcacccaggctggagtgcagtggcgcaatctcagctcactgcaagctccgcctcccaggttcacgccattctcccgcctcagcctcccgagcagctgggactacaggctcccgccaccacacccggctaattttttgtatttttagtagaggtggggtttcaccgtgttagccaggatggtctccatctcctgaccttgtgatccgcccgccttggcctcccaaagtgctgggattacaggcgtgagccaccgcatctgtcgtagcattatcttttattacatgtttatatgccagccaggtcccatgctgaattcttcatgtatgatctgccttcatcccaccaccatttacaccattgcctgtggcttcagacaatctagtttcagtgaacatttcaaactgcagaagagcaccatctcccttcaccaccacctccccaccactgtggtcagctgaatgagcctcaaggtggggtttgctgtaaggtcactgccaggccagtgcttgggaccctctctctacaggggaggaagggcgaccggcctcgctcctgctggggctgttggttgtacaacttaccggaattgtgcactcttagctttggcttaaagaaatctgtgatgccagagggctaaatacatcatgctgttgcattattggtcttccaaagaagcaagtgcaggaccacatgatggtgtgtcgtgtgctaacctattttagaattttacagttgactgagtctcccaagaagaaatcctgaggctgctctatagaaattttctatcaagtaatgaaatcagtgagggtgctttgctggggtgattggtagggtctctggacaagagcgttccttcagagtgttggtggggaggtgagcagggcttgggatgtgtgttggtgtggggctgtttaatctcaggctctgcctctgaatttcctagagacaggataaagccacgattcctggcctttgaaaaccattgacatagtgaaattcctgccgcctctctttctcgcacacctagtttggaacgctggtgtttcccaagtctaagcctagagagccgttcagagctgacctctgcatgcatgctctgaattctaaaagtgaaatgctttaatttattaaggaatgttgtagctttaggttctgtgggggagggaaaaggattaaactagggaaagcttgattctgtaggaaacaaaaaaaatagtatttactcagaagcagcaaagcccctacatctctggatgcagtaactatgtctgcaggaagctggtgataacactatctggaaggcacttttaaagtctgttatctctaggagcttgttttattctggtagttggaatgttcaccatttggagttagttgagtgaagaattcaggaaatcagattggaaaaaagcattatccagttgagaagacacatggacccatgcaacaagcattctgaaagaaaaagcctactgctgcaacacaacggtataatttccctttgtctgtaactttaaaaaaaaaaacttacatatgagacgtccgagaaagccacccataggtgaactacgcgcataggtgaactagcttactccatttatgatggattcggcgattgcctaaaaattctagtcaaaaccacctctacatatagaatgatctcctacatggttagaaggctggttattttgacacagctcaaaacaatttcgaataagttgaaatgacttcagagcctgtggcatgttcttagatgtgatcgaatgactcaacgtaaaaaattctgtccgacgatggatccgatacagccaacgaggagctctaaggttcatcttgtgagtcagagtcaacaagacagagaatgttactttggccaaaaaactgagataaggttaaaggttttatgctctgtttttcctatgtgagtcataaaactggcttggaaggcaaattccaaaagggtgttttaggaaacgtctgggctttggctgtagtaagataaatattcagccttctaagaagacttcaaaagagaaaactcatctgaatttctacgttgtagtacgtttgggcaaaatgagtcttcctaatttagtaatatcttccttgttggtgaaagacggcttagaactgcggctggtagttgcttttcacatgttccatgggcgtcgtgactttgcaaattaaagaatgagtcatttcctagcaacttagctcacgcatgcactagacagggagcattggaggtggcactcagaaagccctccctttctattttttaatggctttctttgccacatgcatctatgcaacacaaaataatgaaattactttcagagaacattttacttttcaaaatgttgtggtttgcagagcagttttcttactactccagaagcaagaggattcgttaacatgtttgattaaatccgtatttaaattctgtgaactcatgcagggaaaggaaattgtatggttcccactatggcatattaactagtaaaatgctgggtggcggttgacttggaagcagcgtccgggatagcgcgtgctccaggaatactctgaaagctgatgccgttaggggtgcatggttgactcctgggcctgagacggcctcaggatgctgcagcggccttggcatcctcttcagcagggtggcggccggaactggcaccttccccccggtctctttatttaccaaaaaactgcatgcacagaaatgaccgcaacagctctgggtgtgggaatgtaggaactgtctgtttcagttttgccggagccccaggtttacggccgctctacatcccagtcctctcagggaggtcccggtttctgctgcagttcaggccccatcatgggtcatcttttctctcctcctgagatgtgggcttggaggatgggaggtcgtgcctctaagaagggtccgtttcacggtggcccaggctacatgcctgcttccttgtttccttgcccccccgagcttcatggaagtcaatctggaaagtcaggatcactgcagatggcagtttgttcagtgttgctcccagacctgaagaatggagcgctctgttgtgcttgcagaatgaagcataattcttagcagaaacctgggaggccgggtgcggcggctcatgcctgtaatcccagcactttgggagtccgaggcgggcggatcacgaggtcaggagatcgagaccatcctggctaacacggtgaaaccccgtctctactaaaaatacaaaaaattagccgggcgtggtggcgggtgcctgtagtcccagctactaaggaggctgaggtgggagaatggcaggaacccgggaggcggagcttgcaatgagccaagatcacgccactgcactccagcctgggtgacacagcgagactccgtctcaaaaaaacaaaaaacaaaaaaacctgggagtttggggtggtagagatcactgaaactgcaaccccaaggctaggttatctctttatttatgtatccacccacccgcctacctacctattgtacttacaatattctgaggattatggcctccaagagtcattcatggctttgcacatgaccgtctgttaccagtgagtccttgtgtggacagagcatccgcagcaggacagaacataaacggtgcctcccagggtgccctgtgcagaggcgaggtctgcatccgacctcacacttgctcaccctcgccctccgggggacggctacactgggctcatctgcactgcaagggaaatctgttttcagagcaaggggagacaataataataataataatccctagagtgagactgggctgtgtttagaagatgttctgctgttttgccatggaggtagggggcctggtgatgggcagtccctgtaccagcctgtgagccagggcctgggtgcctggggggtctcgggaggtgcagacggggctgccagcgctgaaatgaaccagctctgttttgggttctgttccattccagactgttttctcctttcttgtttattacatgtatgacactaaattataaacacacatgtggccaggcatggtggctcacgcctgtaatcccagcactttgggaggcccaggcaggcagatcacttgaggtcaagagttggaaaccagcctggccaacatggtgaaaccctgtcactactttaaaacaaaaacaaaattagccagatgtggtagtgtgttcctgtaatcccaagtactctggaggctgaggcaggagaattgcttgaacctgggagatgtaagttgcagtgagccgagatcgtgccactgcactccagcctgggcaacagagcaagactctgtctcaaaaataaaataaaataaacacacatatatatataatatttctggtagaaatttataaatataagtatacaaattggccagctatcaaggtgcctgcactattgattaatttatatatagaactccataatctatgagtcatttcaattttaaaaacctttcttttttctgtcctccggaccttcactaaggtgggcttatggatccaacaataatctatcatgaacttttctaaatccttaatagttattccttcttaagattaaatgctgtggaaagtgagttatgtagatgaagttacccgtgggcattgctgcatttcctgatcttgtatattccgtggagaaaaagatggggatgcatttagcattgaaaggtaattgttggccaggcgcggtggctcacgcctgtaattccagcactttgggaggctgaggcaggcggatcatgaggtcaggagtttgagaccagcatggccaacaaggtgaagccccgtctctactaaaagctacaaaaattagccaggtgcagtggcaggcacctgtaatcccagctgctcaggaggctgaggcaggagaatcacttcaacccgggaggcaggttgcagtgagccgagatcgcgccactgcactccagcctgggtgacagagtgagactccgtctcaaaaaaaaaaaaaaaaaaggtaattgtccttgggcttcttctatcaatgtgtcctcacatattgatatctgattccctaatgcagcaccgtgtcattaatggagggtaaggcagacaattattattcagctgtgctgtttaataatattcaacatacatcccaagtggcgcagggtgccttggcaggcggagcccctgacaaaatgctcccatgtatgtcccgtgctcgacagtgctgtgtgcctgtgagtttgtgctgaagtatgataaacacgttgggtgaaagtgacccctttcaacctctagcgaaacacgaccctttcaacctctcgggaaacgctgggccataggagaatggcttgattcctcattgcactgtgaggctgagtctaggcagacgttcccattactagggactcaaggtgaggactttcccacaattcactgcttttatccagtgctggaactgccctgtcttctgaccagtggatgctgaggaactgacattcactgtcatttttcccgttttatataatttaaggatcacttcccatttagtgaagtttatctcatttttaaaagattctccctttctcccctagggctaccagggcatggtggacggaggctcaaacatcgcagaggccgactgggagagtgtctccagcatcctgcaagtggtaggtactgggctgcgtccacagggttctctgagttagagactcttttatgtctagtaaattcccagaacacttgagctcagatcagttgcgaaatagagattatgtggacagaacagactttgtgagcagctctttacttgtggtttgatttttagaaatgcatgtgttaatctgtgagtcactttgagtacttgttaatagaaataatccaaatcggtgcctccccgctgaagacgctcatggggcccacaccttcgtgctggtccaggctctctctgcattgggcgcctcctgagctccgacacatcagaagagaggtggagggaattttgacaaccacggaagttaggtggagcaacgtttgcaaaacatcaggagagtgtgggctgaattcacacaggggagcgtttccattctgcggtcgtgattgacggaggaagataagatgtgaacggagagttgaagtgcgtatgtgtatcagtgagtctgtgtttctgtgtgtggtgtatgtggtgtgtgaatctcggtgtgtgtgtaactgtgtgagtctggtgtgtgtctgtatgtaggtgtgtgagtctgagtgtgtatgtgtggtgtgcccgtgtgtatgtgttaactgtgtgaatttctggctagcgaatgtgtatctgtgtgtggggtgtgtgtatatgtggtgtccttgtatgtgtaggtgtgtggtgtgtgtgtgtgtgtgtgtgtgtgtgtgaaagagagtgagtgagagaatgggaatggcacccactcctctgcagcccagttatcctggtttcgttcctgagttgcggccacctcgtctctttggttggagtttctgggttgctggctctagctcccattgtgctggctctcgtgctgccccccaggtttttgtccaggcagagtccagagagcacccctgccctgctctgcgcccccaccctcacttgccttgggggttgggttgtaaatggtctcggtcacacttggtgccagtgacgtaggatcgtgtggagtgaatttcagtttttgtaaccttttcataatgttttgataaattaaatggtggtaggtttcatgtaaaaataggagcttttctgggatttggaatattagtgagtctctgtgtgtgaaaatgagctgtgtgcgtgcaccattggtgtatcgaaacacgcactcacgtcactgcaggggtctcctgggagctgcctgcagaccgaaggcagggagagcttcgcctccagtgcagagacaacccctgctgtgcttatgagcaccttgcttgacaaagtcagcacgcgcttagggatcccgtacggatggagttttttggtgcattcatggttttatttaaagaaatcttgcatttgtggatcccaccaacaattcttagtttttggaaaaccaagtgtgacgaatcatgatctatgtcccctggaagtttggatgaaagaatttaagatcctgaagatatagctctttaaaaggggcagcgagtatgtggtgcaaaaaaaaaaaaaaaaaaaatccccctggccccaggttcctgctggttttacttgcaggtgctgtaaggggtgactggagggagaagcctggctgctggtcacaccgcttcccttgtcctggccggcatgctctggtggtcagtgggcttgtctttggttccacgtgcacctggttgagctcgttggccggtgctgaggcggctgctgtgacaccgcaggctggttcctgctccatgtatttaactgctggctgccgtgtgtctggctctgcaccctccctggctcctcctgggtgtcacgcgcctgtctttgtccatggaatgctggtctgggactaaaaacaggaaaatcacagtctttcatagctagttactaactcacaagatgaaaatgagaaaaatgtaaattctagcaccccatgtttatagtcggcctgtgtgtgccatccacctggcgctctctcagactgagaggagataaattagctggtgtctttcccagggcgggacgatcattggcagtgcgcggtgccaggccttccgcacgcgggaaggccgcctgaaggctgcttgcaacctgctgcagcgaggcatcaccaacctgtgtgtgatcggcggggacgggagcctcaccggggccaacctcttccggaaggagtggagtgggctgctggaggagctggccaggaacggtgagtggacacctgctcctctgtcctgcgggttttcgccctgtttcagagctttggaaccgacaggtttccctcttcactgtggcagaagtacctcttctcacagatcttacaggtcaccatctcaggactttttaggatctcaaaaaacaacagcaatgatcgtaagaatgctagtaatttaaccttaccatgtgccaggcacccttcgacctttcacacagatagctttatggaatcctcacgacagccatctaagccaggttttagatcatcccatttacagatgaggaatcaaacggccactcagccgtggggcgagccgggtccccagcagcctgggacactagcatccgcctttcagccctcacactgtgtccctccagctcgctggggtcctttaaaactgaagttgggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgaggtcccgccactgcactccagcctgggcgacagagcgagactctgtctcaaaaaaaaaaaaaaaaaaaaaaactgaagttgccacaggactttaatttatttagacgataaatctctgccaatacatcatccagtaccaactttggcactacttaggaaagcgtttctgagagccctgtgtgtatgtggtttatttttgttttgtttgattgtttgattttgtttgttttgagacagagtctttctccattgcccaggctggagtgcagtggcacgatctcggctcactgcaacatctgcctcctgggttcaagcaattctcctgcctcagcctcccaagcagctgggattacaggcatgcgccaccacacccagcttttttaaaatttttttatttattttttatttttagtagagatagggtttcgccatgttggccaggctggtctcgaactcctgacctcaggtcatccacccgcttcggcctcccaaagtgtagtttttctcccttgaagcggttatgtaatttcagtgcaatattaaatatgaccagggaagcatattgtttaacagcaactcgatgagaggcggcattgaggcaaagcagctgtccccaggtttgtgaacatcctcgtaggggatggagaaggctgcccgttggaagcagccaggcctcacggttcccgcttgtccacctcatcccgtctggcacagcacagtgagtgcacagaccgggacagtggccacaagtccgggcccaagcttgcccctggcccttcagtggttccgattccctttatgcagaactgcccagcccaggtctgtcctgagtgcgaggcagatgctcacccacgatccagcttcccacagatgcatgagaaatcagtgtgaagatggcctagtgtcttagattcttaattccgtaattgtaacgtatcctgttcaaagccgtgtcattctctgaagctgttgccaggaagtactgagatgtttgtttaccgattgcaaatgtggatcctttcttttatttttctaatccactgctcttgtctaagtgccaggtgacagagtccattgtgtgtaactgctgccagctttgtctggcttctctttccttaactatgcagaatccggttgccttgagttcggagaaaataaagaatcggccagggcagtggctcacacctataatcccagcactttggaaggccaaggcagaaggaccacttgagcccaggaatttaagacccgcctgggcaacatagagtgtgggtctacaaaaaaaattaagaaatcagccaggcatagttctagcttctcaggagactgaggcagaaggatcgcctgagcccaggagttcaaggctgcagtgggctatgatggtgccactgcactccagcctggtcaacagtgagaccctgtctcagaaaaatgataataaagaaatgataccaataacaaagagtttagaatggttgatttctctacccatggccattctgcctcacccctagtggggcaccccccgaacgcgccatggttacggcgatgagacgtgctgtttgctccccgcgcaggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagaggtaaagcgctcagaggaaccggcgggaggccagtggggcccgacgtgtgcccagctcagacgttaccacgggctctagaacattctgcagattgggtgtcctggtgctggtctcgtaacttgacttttaggagctattgccagaacattgttctctggtctacttttcatttttaattttaaaacattccttgtttttaacctgatgatagaaaacagtttattagaatttggaaggaagaaacaaagtaattatcctctaaatgtcctacccaaacatctccagaaggagtggcaagcaggaaactgttgtgtggattttccacactactcattagaaacgcagccagcgatgtcctgccctgtgtaacctacggattcacgaagtgtcgtgggggccacagcgtttgatccgaggtgctctaggctcagcaggttatcactaaagactgtggggcgcaccgtacaatttctgaagcaatttgcatgaaaaccatgtggaatggtaaatagaataagtgtctcccctttaaggacgaggtgctcgagactgggagagtgcccgaatccagtccccagcatggcgcctcccagtcctctgtgtgcgtgtcctgttcccagtgacgcctcactggacattctcagtgcgtgggcgtgaaccccacagttggtggaaaatcaccgagttggaaggctgctcggagcagttggatttttccattccctgggaagacccacagtctctgggcattaagcacttagtgagtctggcactcacttgtttccgtgggagagatccagccgtggctgtcgacagcagctgccgactgtgcccaatagagaaggtatctgggaaagagcccagcacggggccggggagtgtgagtgtgtcctggcacaggcaggcagaaggtgtccaacgtgcaactggagagcgcagaggtggctcaagtccccttcctcgcaggagtctggaaggctactgcatagcgtttgccttagtagaaaatggaccatttttgaagcctaggtccctgcaggcctcctggctaactcggctgtcaaagccccttttctctgctttctgagctgtttccaggactgagtgggtgctccctctgtttctctgctttctgagctgtgtccggggctccctctgtttctcttccagccaccagaggaccttcgttctggaggtgatgggacgacactgtgggtacgtacctgcggtgggtccggtggacgcggttcaggtgggggaccctcagcatcatctccctgaggctgcaccccacatcctgaatgctcccgtggaaagtcctgaaggggccggcatcccgcttcatacctggcgttaggtctgcacgtctgtcgctgagcggggtgcctgggctgccctcgtgggaaggatccttctggggtgttgatgctgttgccttgtccacataggtacctggccctggtgagtgccttggcctgcggtgcggactgggtgttccttccagaatctccaccagaggaaggctgggaggagcagatgtgtgtcaaactctcggaggtaatgcgggtcccgtggccgttgatagcgggcgatgctggctgcattgctttaatcaggatcccaagtgggacggcattttaagcaagtgaaaaaatttctctgtctccagtttgtcacactttgtatttcactctatggactgtgagcgtggggcatgttttcctctatgaaggctgagactcaaggcagaagaggtttcatttaagacctgaggctgagacagagtgagcctggttagaatgccccatgcgtgcctaactccggcaggcagacttcaggcactgttggctccaggctccacacagccacccctatcattttctatgggtgggtctttaatttggggcttaatagaaagcgagtccattgaggatgagttaatccacatcatggagtggtcgctatgttcctttcatgacctctttaggctcacgtgactgccgtgagcataggaaggacgacggggacagcagccacggtggcccagcagtgtgaggcctttcgggtgcagctgcagctgccagaaacccactgtctgggccctgtgtccgctcacgccgttttctctctcccgactctctgctgctggagcctgtgtgcaatacaacctcatcccagtggccaggcttcggggcctcccctgggagggccggggaggagtggttcacagggagatggcaggaaactctggagggaggcagaaagcatggcgtgcacggggcgcctgtggggcgtccacctgtgtgtccttccccatgggaggcagaaagcatggcgtgcacggggcgcctgtggggcgtccacctgtgtgtccttccccatgggaggcagaaagcatggcgtgcacggggcgcctgtggggcgtccacctgtgtgtccttccccatgggaggcagaaagcatggcgtgcacggggcgcctgtggggcgtccacctgtgtgtccttccccatgggaacccctgtcaatcacaccagcaccctccacctggggctgactgggggccacatttctatctgcggtggtgatgtgagctcccagtcccaaagagctctcttccagtgagccacagccgccctgctccttcacccctgcccctctcctcacccctgccactgccccttcacccctgcccctctcctcacccctgcccctctcctcacccctgcccctgtcctcacccctacccctgtcctcacccctgcccctctcctcacccctgcccctgccccttcacccctgcccctctcctcgcccctgccccttcacccctgcccctctcctcgcccctgccccttcacccctgcccctctcctcgcccctgccccttcacccctgcccctctcctcgcccctgccctgccccttcacccctgccccctcctcgcccctgccccttcgcccctgcccctctcctctcccctgcactgccccttcacccctgcccctctcctcaccctgcccctgccccttcacccctgcccctctcctcgcccctgcccctcctctcacccctgtccctccctgctgtcacccagcacacctttcaccaccttctgatgtcattgggaagcagctcttaggaagttaggcaaagattcctgcccagaaagaggccagttcagtttgagacagacttctgtggttttgttgcatttgttgctaagaacaggattaggaatttgagagctttaattttctgtctccacagaaccgtgcccggaaaaaaaggctgaatattattattgtggctgaaggagcaattgatacccaaaataaacccatcacctctgagaaaatcaaagaggtgagtgtgtgtagctgctcactttctctcggtttctgcctggaagcaggggaggctagcgtcatgggcaggcttggtttagaacattgaattattaactttttatccttgatatttaaaacattttcataatgactcagaagttggacggcaggggaaacacgcagctcccgctcctgggagcccattccgcttacgtcacctcttgccgagcccgtagaggttccgggactccccagcagacagagggggtcagctcgagtggccacgcgtgttctttggattagaatgttccggctcttaaacatgagctgctctgagaatgaggactgaccacttggcagccgacccgggcttctgtttgccacagtgggaaaaggcggcgtcttgctattccctgtgccctcccataacccagagcatcagctgagcacattcttacaaagccactgtgtcctcgtggccctgcctgggaacaggctttggcaggctttggcaggcttcgtgccctgggacttgctcaggccagtgcctgcctgtctggagaggactctgataccatgggctgtgcccctgctgtagacggggctgcaggctgccggggctggggatgggctgtggctccagcagccacggggcagaagacgtccccacctggctttgcaagtcggcttctttattgtgctttgttatggtcagttaaggagcaaagcatatctctggatatgaaaacagtgatggacacctgggaaagacatctgccaatatttataagtggtcatccataaagtccaggcaaagattttatttcccgcttaactgtaattaaattataggacaatggaccgagaaggaaccaaggaatttacgtagcccagccccactgtccttacagaggaataagctgagttccagagacagtcagtggcctctccagatcaccgggccggtgtgcccatgggctggggcgaggggaacgccttgattgggctggcttgtgctgttcaaatcacagctgaacaaattaaagctggttcaaggaagatgtttacattttttgtaaaatataagtaatagtttaaatgcaagctactgaaacgttacttttttatttttcttttttaaagcaacgaacatattacttgtattcattttctaggtgcgagccaagatcttgtctggtaacaacagtattatttttaaaaccaattttcagctgcctgttatatacactaaacgttctgctaggaaacaaaatttagaaataacttttcccatttagatctgaagaaagagcgaaaaaccttttccagtgcccagtacctccttccagatctgggctgctgtgtccgcatcacagttccgcatcctaacgagatgtttccttgcagcttgtcgtcacgcagctgggctatgacacacgtgtgaccatcctcgggcacgtgcagagaggagggaccccttcggcattcgacaggatcttggtgagttgggaagggttgggcatcttcacaaggtctctaggaggaagcgtttctggagaggcacaggcaccagccggccacagaggctggcaaggtgctccccgagagatgcccgcggcccggccctcatcttaacgatccttgagacctttggtgtagaccagtctctaggcctgcagccattcagatgcggggagagctccctaatgtgggaaggcagtgcttggtgttggcacgacgtggaccccagagggcacaatcccagggcagaaaggctgtgtttctagtgagtttctggaaactgactcagggcagcaggaatcccaagtacaaaccctcagttcttaacactcctgctctccatgtgccctgacctcctctctgttcccgtcttgccagttctaaaggagtggaaatcgctttgctctaaagagttgggctggaagcgggaggggctgtgagcacctgactgaggtcattggacgtcatggaaagataggaggtgacagggacagggcaggacgggaggctgcccctgacccacatggacctggtttccaggccagccgcatgggagtggaggcagtcatcgccttgctagaggccaccccggacaccccagcttgcgtcgtgtcactgaacgggaaccacgccgtgcgcctgccgctgatggagtgcgtgcagatggtgagtgggcagcccatggccaagggcagggcggagacggctgggacagaagctgcttgtcaggccagcctgggcaccttgggtgtctcgtcggtgcacgatgcattacacggcctttctgagaaggaggtgagctgcccgtggggagggagaaggcttatgttctctcccacacctgcagagcctgcgccgtcttcgctctttggttttctaagttaccatccatctgtgtggcacatagtcgtaacctcccctgagtgggggtctagagcatcgggatcctcaacagtcgaggatccaggtggccccagtgcaccaggtgctgcagaaggacagagtgcagggaggcagccgagagagagagatccgtggacagactgcagggaggcgggcgtgagagagacccatggggcagagggggcagggaggcagggaggcgggcgtgagagagatctacagggtggtattttgtaggggaaggtgggaccttcccaaacttctccagtttcagccatttcctgtcctcctatccccaaggacattcaggtctgtgatgggacacagggaaagctctggtcacccgaagatacacccacccttcttgggccagggaactgtctgcctgcaaatgaacaaagggaaaagcagttccagcttttcaggcattggttcagtagtggaggtggctgtggagttagctgcatttgaagttatttaattaattaatttatttatttagagacggagtctcactgttgcccaggctagagtgcagtggcgtgatcttggctcactgcaagctccgcctcctgggttcacgccattctcctgcctcagccttccgagtagctgggactacaggtgcccaccaccacgcctggctaattttttttttttttttttttttttgtatttttagtagaggtggggtttcaccgtgttagccaggatggtctggatctcctgaccttgtgatccatccacctcggcctcccaaagtgctgggattacaggcatgagccaccacgcccagctgttgttttatttttcagagttcattcatgattcgtgactcctgttttgttgcctcttaacacacacaaagaagtcgtgaagcaatcaagtcagggacttgttgaaagtcaccttgtaaacataatttccaaaagcccaagggagaaaatagtatttgtgtgtatgtgtgtgagtgtgtgcgcaggcttgtgtctctgtgtgtatgtatgtatatgtgtgtgcatgtgtatctctgtatatgcatatacatgcaggtttatgcatatatttatgcatgtgtgtgcatgtttgtgaggtagtttgggtctgcatgtatgtgtatgtttatatgcatgagtatgcatgtttgtggtagtatgtctgcatgtatgtgtgtgcatgtttgtgtgcatgcatgtttgtacgtgtgtgcatgtttttgtgaggtagtgtgtgtgcatgttagtgtgtgtgcatgtgtgtatatgcatgtgtacatttgagtgtgaggtagtatgtttctgcatgttagtgtgtgcatgtatgtttatatgcatgtgtatatatgtgtgtgaggtaatgcatctgcatgtgtgtgcatgtatgcttatatgcatgtgtgagcatgtttgagatagtgtgtgcatgtctgtgtgtgcatgtgtttatatggatgtgtgtgtatgtttgtgagaggtagtatgtgcctgcatgtttgtgtgtgtgtgcaggtatgtttctatgcagatgtgtgcatgttggcatgagtgtgaggtagcgtgtgtctgcatgtttgtgtgtgcaggtatgcttatgtgcatatgtgtgtatgttggagtgtgaggtagtgtgtgtctgcacgttagtgtgtgcctgtgtgcatgtgagaggcagtaggcttaaaaggctcagagcactgaacgacatgcggtacgtgtattttgagcctgtgtctcatgtctctgcttgtctagagacgaccgtggtaggtgtcacttgccctgaccttgaaaccacccttgtgtggctttgtttttaaagctgagggaccactactgtgcacctgctgtttgtcaggcgtcttcctgagggtctgacatgcttgaataaccttagagatagctggaagtaggagtatttttctcatcttacagatgaggaaattgaagttcagagcgagaaagaacttgaccaagatcctgacgttgcccagggctgcctggcgtgcatcagtcccagccccgtgtcccagggcctccatccgggcccctctgctcccccgcccgctgtgacctcgctcccatcccacatcccccagtgagctggtgtgttctgttttgtttttccccaccataatcaaattgagaattccttagaaccatgcctgagagatttcatttcctctggctttgttctcttggagttaaatcttcacagtgttgtgtccacaaacagcaggtgacaccttctctttttcctcagaagcctcctgagctaagcagtcccagggctctgacctcacagccgggccgtgtggggctggctgccaaccagcattaggacacacttggcggccggtcgtctagaccattaaccctggggctgctggctgcccgggtcagactggagggggctggtgggaaggaccgagccagtctctacctaccccatccatgatgcaccaggtcctgacacattctttcttcttttcatcattgttttaaaagactcaggatgtgcagaaggcgatggacgagaggagatttcaagatgcggttcgactccgagggaggtgaggtgctttggagaaagctctgccctgtcaggaacacacacccctcaggcccagccactgcaaacgtgcttaggggttgtgcttattccatgtcactgtgaaaaatcagaaagtcaggcagtactcacagcaccgctcttgcagtagcaggccctggtgactggttagagagaaatcattttctaaatttgccattggtcctttttggtaaggtgatggttgtttaggagctaatgagattaaggcacaaggtgacttgtggccctttaacaacaaaccaaaacaaaaaaaggagtctccttctgttgcctaggctaaagtgcagtggtgccatctcagctccctgcaatctctgcctcccatgttcaagcaattctcatgtctcagcctcccaagtagctgcgactaccagctcgtaccagtgcatgtcaccacatccagctaatttttgtatttttagtacagacggggtttcaacatgttggccaggctggtctcaaattcctgacctcaaatgattcacccgcctcagcctcccaaagtgctgggattacaggcttgagccaccgcacgcatgtcttgcaagagaaagttatgaagtgtagaagcgtgcccttttctcttagtccatttccaccagacacggacagcaccgcgggtcgcggctaagggctctgccatgcacatggaaccctggggcctcctccttctgcccagatagtcgggcagacacattgagtgctggcagataagccaccttttctccacatgagccctgagttgtgtccggtattctcgactccggtccaacgacacccttttcctttaggagctttgcgggcaacctgaacacctacaagcgacttgccatcaagctgccggatgatcagatcccaaaggtaggtggccggcctcccgcgatgccccgacctctcctgcgggcctcccctcatggcctctgcctcagtgaatgaggccacctgttttcaggcctggcacggcatgagccactgccaaagtgtgcagcaaatggagctcacgtgtgcccgtgacccagcactcacctgccttctgttttgcagaccaattgcaacgtagctgtcatcaacgtgggggcacccgcggctgggatgaacgcagccgtacgctcagctgtgcgcgtgggcattgccgacggccacaggatgctcgccatctatgatggctttgacggcttcgccaagggccaggtgagtcacccaggatgccgtaggcaggcagacaccctggctgtgagcacagtggacgtggcggcgggggggtgccctccatggccctcataccttttcatgcctcagtccgggatcctgtgatattgtgactgaagcattgcttctggagtaaaatctcaccctaaggtaggtttcaggccctcagatggagcccagggtatgatgtgcttttgaattttctgaaaaggtgctgggggatggcagtgcctctggggtctgatggccctgacattaggtgagaaggaaggtggcgttgtctcggaggctgtggtttgtttaaaccgggcactggagggaaagcaggcagtgtctggtgtgcacaagcacccactgaaatacaaaccttagtgaacacaggtaacaccccttgatgtgtgctgtatccagttgttctgtgggattgacatgtgttcacccatttaagcctcacactaaatctaagatgttatccccattttcctcacaagaaaaccgaggcatagggctgggtgcacgagggaggactggaaacaggattctgagctcctgaccaggggctgaacttgtggctatttgtttatctgattagccaacaaatacctactttgtgaaattcttttttttttttgagacgaagtctcgctctgttgcccaaactggagtgcaatggcgtgatcttggcccactgcagcctctgcctcctgggttcaagcgattctcctgcctcagcctcctgagtagctgaaattacaggcacgcgccaccacgcccagctcatttttgtatttttagtagagatggggtttcatcatgttggccaggctggtcttgacctcctgacctcaggtgacccacccaccttggcctcccaaagtgctgggattacaggcatgacccaccgtgcccagcctcctactttgtggaattcttatgctgaggaattaaatgagtgagcaaagcagacacaactctctggttccgtggagactgcgtttatagatggggagagaggacagtggctgaggatcctcctgctctctggatggtgagcagtgctcagaggcatgccgaggagggcctgctggagatcccccagacagcaatgctggggaaggtgctcccaggctgctggtggctcatggggccctcaggggacactcatcccaggtggagggaaaggatgctctggagctgatgctcacaggggcgggggctccaagcccgcacagggcagtgaggatgggaactgcaggggcagggccggcttctttgtgggcagcctgaggaggttggcttttatgttatgtgagattcgaaggtcctgagcagggactggcccacaccaagagctttctaaagggacccgctgctgttcactgaggcaggaggcagggctcccagccggggctttgcagtcacctagcaagagatggtgggtccagactggctactgtgcagatggcgagaaaccttcaagggtctggaggtatggagggcacggagggcagatggggtttgcttgctaagtacacgcaggcataaacagaggaggcaaggatcactccattcctggcctgagcacatggaaagggtagagttgcaatttatgaggactaggaagccctgagacacacttcttgcaggtaggatgaggagcggagactcatgaggccagggtgaaagtgtgtgtcccacggccgaggacaggactggggatgctggggtgaaagtgtgtgtcccacggcggaggacaggactggggatgctggggtgaaagtgtgtgtcccacggcggaggacaggactggggatgctggagtgaaggtgtgtgtcccgcagctgagaacaggactggggatgccggggtgaaggtgtgtgtcccgccatggaggacaggactggggatgccggggtgaaggtgtgtgtcccgccatggaggacaggactggggatgctggggtgaaggtgtgtgtcccacagctgaggataggattggggatgccagggtgaaggtgtgtgtccctcagctgaggacaggactggggatgccagggtgaaggtgtgtgtcccgtggccaagaatgtgcagtaagccgctgtgtcccagcatcttcaggagggtttggctgagctcatgggtttaggaatcttcagcgtctccacgtagttaaagatgcagaactcacagagcttccctgagggcctgagtgcaggcaggagagagagaaggtccaggactgattcctcagggcgccattgttaagagtagggtgggaagaggaaaccccagcccaggagactgaggagtggcagagaggtggggtggagatgccctgtggcatccctgggaacacagatgatccaccttccaccaccactgcccgcccttctgtgttggcccatccacccgcatctcagcagcaggaaccggatgaggaaccgttctgtcctgggtggatcttgctttccccgtctttcttgttcagacttgtgaagattaattggcttaaaactggtatttgctttatttaaaaaatattgccttcaaaactgatttatgtgggaaaaaaaagcctgatttatatggttctgtcaaatatatatatatatacatacacaccttgtacagtatttaccttttgatgtagaatgatcttttttctaatgtaatttacctggagatccccctgcagcatggcagtgtgtccaccacatccgtgaacttacccagaatctcgtgaccggaagctgcggagctggggttcgagccccacgggttctcctcctgcagtcctgccgtcctcgcagtggcatcctctttctgcgattaccttagtttgcttagtaatctgttttccttttttctccctagtttgtaagaaaagaaattttcccttaatcttttaccaacttagaaaccatcatgttacttttcttttagttgccggtggcgggatacggtgagctgatgtatctcacacgtggctcaggatgagacacagaggccccgacaggcagggagaacgcagcccctctgctgctcttcatgagttgttaaccttggacttctgcttctcaccttgattcatccgggcatcgtgataaatgctgtctcatacgcctctcaaatctttaccggaatgcagcttgttgaaaagtacagaaagctatttttagcactttgcaacttgcctttcattgttcactttagctgtttcgttctgtgtttgcacattagatcaaagaaatcggctggacagatgtcgggggctggaccggccaaggaggctccattcttgggacaaaacggtaacttccaaatctcaactctatgacctgcttttaaggaagaaggaagagccgtgttctgggagagaatcgctgggtgccgacgccagttggattcctggaaaggcgtccctaagggaggggtgcaggcagttaccggtcctccctccagtggaactgcccgtgttccagggagctggggatgtgtcccagggcgtaagagagaagaggaggtaacttgtgaatgccttcctctaattcatatttccattcatttgaaaagccagctggcgagcctaaagcctccacttggaggtcataaagatgagtggtgtcacggagccgtggagatggcactctaagcaaaccctaaagcagcctggatagcaggtagcattggtgggaagcatagccctgagcagctgtgactcgaggctcagatttccacagccgaggaaaggacccaaggaattctagtctaaaaatctctttttcagacctacagtaagcctggcgtccctgcatccctggggacaatgggatttcctaatgtagatgaagcctgagtaattctcacctttgatcatgtcagaggtgcgaatattaatctctgtcatcactacacattacaatttcacatggaaggaaggtagtttttggcaaatataataaatgatggattccatgtaattccggcttattgttccaagggagttagctgcaccctttgctttgctttacagccaggaccctggtactcccagccactggtgggatggtgggagcctcggagctgggttagctctacagctgcctcccggctgttctcatgagctctgtgtgtgggtgccctggacggtaaagctctaggtagaggcagatgcatccctcggtgtgcgttctggggctgaggactggctgctgacaccccgggcacaggtgcttgatagggccagggcgttgctctcgaacgtagagaggactcgctggctgttgtgggctcgtcctgaagaggcttaagaaacctcaccttaggggccagcacaggtttgcacttagctgcattcacttgtctgctctgattgcctggcctgaacgtttttgccctacggtgtcttataaatctaccaagagtacaagtacttcacttcttccaatcaacatgaaacctttggatgggcttgggatgggatccagggaggggcacagtctggtgttgcacttgttagccctgtcatgtgacattggtgagagcatgggggagggagagcaggtatgagcagatgggattttaaatgagatcaatagtggataatgcatatgtaagttatttggaaactggaaatttccatttaaacaattattgggcacggcggctcacacctgtaaccccagcactctgggaggctgaggcaggtggatcaggaggtcaagagatggagaccatcctggccaacatggtgaaaccctgtctctactaaaaatgcaaaaaattagccgggcgtggtggcgggcgcctgtagtcccagctactcgggaggctgaggcacgagaatcacttgaacccgggaggcggagcttgcagtgagctgagattacgccactacactccagcctggtaacaaagtgagactccatcttggaaaaaaaaaattgttattaattataacttcttaattttattttttctaatggggcagtagagttctttttaggtcaaggtatgagctgaaatgctttattccattttctcatgaaaacactgttttgagatgagattcctggtcattctgccatctgccagccacaacggcatgagtgaaaaggcagacgtttaccgctccttaattaaaaccacagactggggaaggcggccgggtggggaccggcgtggcgtcctgcggaccgcgtggagtttggggtgtctgacatcgttctccacgtggctattttcagcgttctcccggggaagtacttggaagagatcgccacacagatgcgcacgcacagcatcaacgcgctgctgatcatcggtggattcgaggtacgttaccgtttctctcttgccggtcttgcaggtgtgagccgcgccctgtgttggctaaacattaagctacttgttggctactggccacgatccgagatgataggttcccagacccagcggccactggagaattgtagaacagcaggatagcaggtggtaagacgtggcctacgagtggcccagttccagtaaagcaacttaaccgagaagcaaaagcttgactccttaacccgggcctcatctattcagtgagctcttaatgtatttcaggcctgtggaagtaattctatctcttgagtccagagtccagtggctacttagagactaaggtagttatacctagaattttgtttaaaatcacatattggactgtagaccctaatattttttctattcatgaagattagtcccatggtaacctttccatttacttttagaaaaagtaaaaactggccgggcgcggtggctcacgcctgtaatctcagcactttgggaggccgaggcgggcagatcacctgaggtcaggagttcaagaccagcctgaccaacatggtgaaaccccgtctctactaaaatataaaaattagccgggtgtggtggcaggtgcctgtagtcccagctacccgggaggctgaggcaggagaatcgcttgaacccgggaggcggaggttgcagtgagacgagattgcaccacctcactccagcctgggccacaaagcgagactccgtctcaaaaaacaaaaacaaaaacaaagtaagaacctcagaaatgagactcttacccatgagaggtttagtcatctaaccgatcatgtctgtcctgcgccctttgtgcttacaacctgccgatccttgtctgtggtcttaaggcaactgtgtgttgatctcggagtgttttcgtgatgccccagtgtgctccctgcgtgctgtggtggaggtggcgctcccagcctctcccagcgagaccctctcctccccagcttccctctcgccccacaactcccacgcttgtctgacaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacgtaagtccgtgtgcgccctgccaggcgggcgccggctgacgctaaccccggggccccggccctttttatctaccagtgcgctagaaatagccttttacaaataccctgaatgagagcttctcgttctttttttcccccagaaaagtatgttttaagactctgaaaatttttgatctcactcccagagagttttaccacctcttcttctgtgtggccaccagggggacgtagtgtggccgagactccaggggtgcccgtgagcacccgaggcgctgaggagggctgggtcgcagtctcctgtgattgtaccagcattaaaaatcgctgtgtgtgtgtgtgtgtgtgtgtgtgtgtgctgagcctaaattttctttgagcctccaatacccattatgatgaacccctgccttgatgctgagggtagaaattgaactgaatattttataattttattcattgccctgaatgcaccattgcatttgttatctctctggtcttggctgttgacctcattttcccctttgtaaactggggatgttaaattacctctaaggcaataattggtgctactttagtttttttgccaagagacaataataaaacatagaaatatattcttctttttttctttgtgggacggggtcttactctgtcacccaggcttgagtgcggtggtgtgatctcagctcactgcagcctcgacctcccgggctcaggtgatcctctcacctcagcctcccgagtacctgggaccacaggcatgtgccaccattcccggctaaaagaaatatacacctattcccatgtttgtgtgtcacgcttggtaattgatgtgggagtttgaagatccgtacctaacacagaaagcatttcatttttttaaaatttgatgtctaaaagtttgtagtaattctcaagttttaatttttcttgtgagacttggttctcatgaatatttttcaaagatattttttcttgtaaaaccttggcatgaaacttatttctagcactggtaaataaaaaaacaagcttttaacatacagctcatatggtaagtaatgcttagcactcgtttcttgcttttctgagcgttttaaactttcttcactttctttgcgaaggaaacctgcccaggttttcctgtgttcactggctttgggggcaactttcaccttatttttggcagttgctaatctctgacctagacgttgcttctgttctcctggtggtgggtgtcacggctttgctgctgcggggctggcccggctctggacctaccttcgcactgtgaatgtgaagatgagcctctttcacagactggattccgtcattgctttcactgctctttcgcctgctttagctagatttttgggtctgtgaaagttgggtgtgcaatgggagggactgaagcttcttttttccctaattgttacctaattggaactcgcccagagggaacgggtggagaatttgagagcggtcgctgcagttagctgagtttctttttaattccagggtcctctgctataaataactgttttttttttttttttttcagattgtaaatatgtaacaaatgcatagggtcaaatttatgaaaaccaaaatacgtggggcaaaaacaccccacaaatgatcatttccacctgcttttacttcccttggagggattgtgtgatttattatgcgattgttttaaatgcagtttttcattcattcgagtttctcgaagctaggttaaacaatttctttttttttctttttttttttttttttttttttttttctttttttggagacagggcctcactctgtttcccaggctggaatgcagtgctgcaatcgctattcactgcagcctcgacctcccaggcttaggtgatcctcccacctcagcctcctgagtagctgggactacaggtgggtgccaccgtgcccagctaattttttgtatttccatagagacggggtctccctgtgttgcccaggctggtctcaaaacgtctgggctcaagcaatccccctgtcttgggctctcaaagcacaggggttacagggatgagccaccgcgccgggcctgaagttaactgattacaatgtctgagaaagaactggagcgtgtagttagttgagcctcccgttggccaggcacagccaccttggtaagtgcatgtgtgtgtccttgttgcccttctgatcctgagctccaaggaacaaggctgtcttgggagtgcggtggttctagtctcgtgatgggtgagtggcgccgtctgaccgaggtcaccctggcgaatgctgtggctgctggggagctgggacagagaagagaaagccgctgagggtccctctgtggaccctgaagggagagggaccgatatgtgaacatggcagctgttttctccagagccctgtttactgacggccgaacagtgtgaatcctgagaaggtttggatttgggtctgaactgggctcgtctggccatagaagaacatgagctggtggcgtcctcaggaaatcagggtgtgaggcaactggacgtggatggctccgggtccccccggccactgtcctgaagccgccggaggctgaggacgcatgggagtgagcgtctcttccctgtccggccacaccctctgtgactggtgactcatggcatggccctgggcagcatttaggtttgaggtctgtagatggctccagtatactggcttctattgttcagaaaatttggtgattctcatgggggcaggggtggtgattttgccccaggggatgtttgcaacgtccagggaggtttctggttagaagtgggaaaagggatgctcccagcatctggggctggagacaagggacgctgcggaacgtccctcagagcacagggtgggctccataataggagtctggctcaggatgtcgccgtgttgtgcttcggaagccctgggcggggctgatgtggtgaagcctcatcttctctggacacgtgcgtcctcgtcctctctcatgatttccttcttgccagcattgatgcttagcccctcagaatctatgcggtgctggtgagtggtcctccgggcagagcagaaggaatgagatacctcagagccggtgtgacacgttctcaggatacggctgcagggagtttcagtccgaccctttcattccttagcactggcccattactccgtcctgtaagctcgataaggtcacatcagaagcacagtaagctgctgccacgctgccgtcagctgccgcgaaggtggcagtgaccacagcctcgtgactgattcacagcctggctgcgcttggtcttgagaattttatgttttgctgggcagggtctcccccgtattgaagcttcccttcccttttttggagactgaaggaaggaaaagaggagtgatagggaagaggggagagaggatttgcagcattgtggctgtccccacagatttcaatgtggagttaagctgccgagacccccacctgccctcctgtgtgcctcaggcccctcctggtcccaggtcacccacaccgtctggcttccagcgagcgcttctcggagaaacagccggctccccacagccagtcttggtcagtcctgagctcgggtattccacagtaaagtgagcgacatcacctgtctgaaaagcataaggagactcccacgtggcggtgctgaggggccacatcctgggcaccaggccagccagtgccccgacatgagtgttgctggctgggaagcagctggcatttggattgaagtcctgcaaaaactgccatggccagagcctgccaggcagagcctgcacagagcggcccaagagctgggcacgtgctgggcctgggtggaggtggaggctgtgccatggggtgcgggggaccctgctcacagctcaccttgtggtcacccagcactgaccccgttcacagctcgccttgtggtcacccagcactgacccacccgccccaccctcctatccaccgtgctgtgaactcacctgccacgggtctacacccactgtccgaagccctcggcccacacgggctccaggccttgggatgctttgcgttgcaccagggctgcagagcccagatcgctcactgtccgactctcccagggaggtgtgggcgccgccctgtgtcccaccagtagcatttctgcagcagatgtggggatattcacagtaagacggacacgtccaagaccataaatagttggttttgccaccacgtggatgtcaaaaacaccttgctgtgtggggccacttggaggtgggaacagtgggcgtgtggacctgtcctgctgtgactttggttaacaccctgaggtggagtctgaaaaaccccggtgtacacgggctcaagaaccgctcccctttctgataccggagcgcatttcccagtggaaccccagagcagcaactcaggttcttgctcgcctgtgcggctttgtgtgcggcttgccgagggcagaaacggcagcttccgcccggagagcagagatgtggcgtggggctgagtgtggcccaccggtaatccagctgcatgcccccttccctgcctgcacctgggcgccgcctctgcacgatgaaggcgggcatttggtgtggtccttacagccgtgtgccccatcccactgatccttgcctgcctgcagaaagctacaggattggctttgcctttaagtgtcctgactgccctggcctcccttacctaccatgacacgccgagagctgagctgtcccactcgtgactaactcgccgttgcctgcaacctgctccgttgcctgcctcacaccaccccgctgtgctgcctgcaggcaccccctttcatgaggacctgggctgtgcccaggcggccccctgtgttgctggggcctgtgctgctctcgcacggcctccagagcctccctcggccccttgacccgcatgaaccggcttcccctggtgactcagtcccctcccgtcccttcctggacctcagcacaggccctggggctggcaggtgagcacccggcacccccgctaaccgcttggccctgctgcttcaggcttacaagagtgcgtgcgacatggccgaggcacgaggccgccaccaggagctttgcatccccctgtgtgtggtgccggccacgattagcaacaatgtcccaggcacagaaataagcctgggctccgacactggcctgaatgctgttgttgaggtaagagaaccccgtttcctctcattgcttttccgtcatttattttagcaacttgtttcttctgtgctaaggatgagccggatttattcttcttcttttctcccctttgttagcttggctttatgtcacactggccagaacagggtaaaatttttttagcttctctgccttagggagagcctgtctttattgattaaaagtgagatgatatatccagtccttgggatcgtgtttctatcccacctagactaggggagccgcaggtaccattgctctggaggctgcctctcctgcccacgctgagtagtgaggctgcagggccagctgtgggagcctgcaggaaggggtgtaaatgcccggtaagtacgagctccaggacagagccgtacccactgggggccgctgcctggaaaacagccttcctggtgagacaagaggctctttagagagccgaaatcacgccctcctgggcaggcggtttcaccaacatgtgccttgggaggggtggattctgccagtcgtgggtgtggtgctgacacccacatggtggcccctccggtccctgatactctgacctacctctatggtcataagctggacatgaagacctatggtagttccacaggcctttgctgcagagacggtcctcactcagctgcagacaggacggtggccaccgtgacatgtggggtcacgtccgtgacttggccacctggtgcgagggacccacagcaaagcagaactgctggccggggtaggcctgcatcgcgtgcggggacagcagccactggcctttaccttacatcttgacgtccaagccagctccggagtttgcagtgaaaactcccagtcctgctggagactccttagttcagcttagcacagaacctcggaagacagcagttctattccgggtacttccttcagagctgagttacagtgcagggaagggagcagaggagccatgaggtcggctgcagcttcctgtgagtccgagcctcagcctcccactcgagctgaggggcgtgtcctggccatctctctcctaggcttctccctgtgttccccagtgctgtggtggtcttgcagaggctggccctggctcattcccaggacttccttgggccccgcacttgacccctgttgggtgaatgccattagggtccggccatcgctggcttcactctcctttagcaccttgtagatgtccatgcacacttccaccctcgcgccccacacgcgacgcagccctaccctggccagcagctgtgctttgctgcgggttccatgctgtagcagggacaggacccccaccccctgtcccgtctggccaccgacttcagcagaggctcggctgccgtgagggataccagtcatgggaaaactggcctccctgcagattcacagagcaaggtggttctcacagagaagtcagtggcttttttctacgttaatgctgtagcaaacgccaccttttctttcaccaccaatttatatttcttaacacccatggagcaaagtgtggtgatgtttgaactgtagcctggggctctcgctcccatgggactcctcggggaatttctcagcagcaggatcgcctctgcgtccttgcagggggtggcgtctgctgggggcacatcccatcgtgcagggggaacggctgaggtcacaggctttgcctgacaagtgccactcacagctgctgtccacgtgccagccctgggacacagccctctgccatccttccacccactcggaggccagggaggcacctccgtgccacactgcaggcaggcagggccgcgcttgggatctgccgccttcttgtcagtgctgctttgactaattgcctgaggcacggccggagtgacttgctatttttagaagctaattcaggcttcagatgccatctaggtaatgaggagagagttcaggaaagctgtatctaagctccagcaaaggcggcctcttccgtaccagctgtcgctgcgtttacactgagacgagcacacagtcgggggcgtggctcaggtgtcagggctgcgctgttccacagccccctggggcagcctggcgggaccagaactcagacacgcctgggcacaaatcagcctcttgggagagctgctttgcccgcagaattcttttgccattaagcggttgatgtcattctttgaatgagtgacagtaattccccacctcagggtgggctgcgggggagattcagttggaaaagtaacccatgaggttttgtgcctctgggggtcctgaggccccacccgtgcctgggattctctaagacaaaggagaagtcttaaagccttacagcgtcttaagtcttagatcacatttagagagacccggtacaggtggaacagtgcaaccctcagaattctgcactggcccttcaagaaggcagttgtgggctctttggacccttgacggggatctgtcctctgtcctcctaagcacaaagatgggaattcttcccattgcctgtttctctccccatctcggcttctacacaatgcaaagtggcccgctaactagagtccgtgttcagttttgaatacatcaaccaattattttgggaagaaaagaatctgccaaagaaactggaaatacagtttggaatcatttaatcaagcctgcatttattaatcaaagtgcacttttagatttcatccgaagtgctcaagtgaacatttcccaatgggtgttaaacttgggtgcacagactctcacgtggctcctagtctcaagtccacacccccacttcatgctcttactcttggctgagtcccatggaggcccattagggaatcctgcaggatcagccgttgaccaggacggacggacggctggctggggaataccatgcttatgtcattcagagacaagcatttcttgagcgcctgctgtgggggctcggccgggtgctgctgatggtgcactggtgtaagcccagcccacagttcctgtcctcatggaatttgcagcctagtgaggaagatcctcccaagtcaaataaccacaaggtaactgcagggagagacaccgggataatttctgtgaagagaggacatggggtggctccgagagcccctgacagagggaactttgtggtcctagaaaccaggtggtgttttcctgaggaaatgacattttcctctggatcagagctgaggaaggtgcctctgtgtgtcccgtggccgctgtgacactgaccacacacctggggctggaaaataatactctctcccacagctctggagcgcaggagccatgggctgaggccagaatgtttgctccaggagcgtccctcgtggcccgttcaggtgcccagagttgcgggccttgcacgccttgtacgccttgttccctggcgcctcctccttccatgtgggtgtgcagcatcccgctccagggccttcagcctctgcgcccctcatctgctgatgcaggtgatggcatttaaggcccacctgggtactcctaggattcacctttatcaccgcatgagggagcattcccaggttccagggattagggataggactgggattcctttgggggctgctctcccgcccaccactgtgccggaatgtgatgcacacagcggccagcatatccaaaggccccaggaggacctggggtggctggaacaggacctggtgccgggagcaggcggggccggggattcccgacaaaggcttgatgtgtacttgaagtgagcaaagggttttgaataaaccaagaactggatcagatttatgttttttatagatggggtcctttctgtgtgaacggattggagggtcccggggtgggagctgaggcccaggaagagggcgttgcagccggactgatgtatgggtgggaaggcggccgatgcatttctttgccatttttctccccgccgagcttgggtcctcatggagggcggatggcagacatttcactctgggatccgatgcctgtgcatctggaagacttccccaggtgcctgggtctaagaaccaccatctgcctttgagtagagtttccataaatgtaacattcgccaatggatggaagatggccgcacctctaaaatcacagggagcttttcagaagaaaatagaatagcacagcggttctcacggactaagctggcaggggacagtcccctaacatctcagctaacacctaacggtgtctgtgtccggtgaaagcggcttcagcagggacagtcacagagcagcgtggagtgagctggcttgtggggtcgtcttttccgtccccttctatggggcctgggagaagggagcggcagatggccaggcccccaaaacgggacatcgaggtcacctccaggtggctgccatggtggggttgcgggggaccacgttcacacccactccgagggcacatcctggctgctgcacacccttcacctctgcgggatgctgggaccgcatgtttgggcgcggtgggggggccttgctgcactcactcttgggggagctctgggatggtgggcgcgccccgggcctgggctggagtgactgatcgcttctctgtgaccagacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcaggtatgtgacggggctggcctcagggcccgtccccttgggatccactgggtgctgcggagtgaatcatcgtgtctagggtggtttgctttccaaggggcatggagatggagatgctacagaacatgccacgcttgatacacttcgcatcgcccaggtgcccctactgcgtgtcaggtgacggtgggtgtgcctggttgaggacaccttctagtctcatgtgtgaaacacaagcttgtttgtttgacatagtctgttgtgtagttaatgttgtctcacttatgtcaccaatgatttgagaacctccgctgacagtcaccacccacgtctgcgacaggctctgaaggttgctgcagcttcttttaaatcctgaggcccctgatgctgcgtctgcctctaaacggacacagacatgaccgtggtttctcggcatctgtggctcttttagggaagggtgtcgctgaccccgcggtctgcccctgcttggacgacacagcagaatccaggcctggaccctgcaacattcaaagttgctaaacttcatgcaagatgacaggccttggcagataaaatgcaacttgaacaattgtctttatttagagagggagtcttgctgtcacccaggctggagtgcagtggcgtggtctcggcttactgcaacctccaactcccaggttcaagcgattcacctgccttagcctcccaagtagctgggattacaggcacgtgccaccacgcccagctaattttgtatttttagtagagatgaggtttcaccatgttggtcaggctggtctcaaacttctgacctcgtgatctgcccacctcggcctcccaaagtgctgggattacaggcatgagccaccgcgcccagcaccattgtcttttaaaaagttaggatgttacttgtttctgagccaaatagatcaagtaaaaagggccttggcactaattatgtgacatgtgaatcacgaatttctttaccatgtcaaatatttgtggagtcattcactgcatcatgatgtttctgtcaacagtgggtcccataagattataatggagctgccccaaacaggtgcagttttttatcttttataaaaacatatctttttacatatatttttataatatatattttataaaaagatgttttttatcaaaaaatatgtatctcttactgtgcttttctacatctagacatgtttagatacacaattgcctgcagtattcaacagtcccagacattcaggtttgtagccaggaacaacaggtgtgcagcaggctctgcctcctgggtttgtgtgagttcactgtaggatgtttgcgcaaggcttaagtcacctagcaatgcatttctcaaggaacatatccccctgttacatgactcatgaccgtatttcagaaatctatccaaagatcctgcctcaccagcgctcagcatggcaagggcttaagagaaattatgacagatttttattttttgctttaatttttgagatggagtctcgctctgtcacccaggctggagtgtagtggcacaatctcggctcactgcaacttccgcctcctgggtttaagcaattctcctgcctcagcctcccaagtaggtgggactacaggcacctgccaccacgcctggctaattttttgtatttttagtagagacgggggtttcaccatgttggccaggctgctctcaaactcctgacctcaggcaatctatccgccttggcctcccaaagtgctgggactacaggcatgagccaccatgcctggcctcctactttgtgaaattctgccattgcgcccagtgacagatttgattagatgtaaaaacctccattttcttaggatgaatcattagagaattacctccctcttgtaatcctcctaacatgatctgaaatggggatgttcttactctaagaccatcttttccttaagaaatctgtgtatgaatgtgagtctacaaaattctttggtcagacactgctcatcaggccgtcacatgagattccatagaaaggccacaggtcactctttcctctgagagcaccgagaacatcgtcatgcaaataaacaaggagcaatagagccatgaatgatcactaggcaaagcacggaattaccattttcagagggaccctgttgactctggaaggtgttgctagtggccgccgtgagggctgctcaccgtgccctgtcctcagcgttcatcgctgcagacgtgtcctccctatctgggaggaggctccccaagacccaagccgcgagagctgcagcctccttggccacgctcactgccacacttggttggcacttcccagcctgcagtgcctggcacacagtaggtacttagtagaagtttattgtctgattaacaaaatactctcttccagtccaacgtggagcacctgacggagaaaatgaagaccaccatccagagaggccttgtgctcaggtgagagagagagaccaggggctgatcttaccctcaccgccacaccctggttcttagattctagtctgtgacttgggctggatgagtggtcatttctttgccgctagagtgcactacacacactgagcaggtgcagaagacagctgtggtgcattgctctaaaggcttgcctgcatttagacaactaatatttttgctttatagtctcttattctttgatatcttgcaatcatttccctaattagcacctgatgtttatgaagaaagaaggaaatacagtcatccctcttagcctcagggactgtgtcccaagactgcagtgggtgtctgaacctggggatagtacccgccccctgtatacacgaggttgcttccatctgataaccaaggtggctactgagtgactcgggcaggaggcacagacagcatggagatgcagggcacagggatgattgacgttctgggtgggacagcaagagagcacgagatttcatcacgctactcagaatggtgtgcaatttaaaacttacatatttatttctggaattttccatttaatatttgtgggcctcagttgaccactggaccatgggtaacaaactgcagaaagcaaaaccgtgaactggagggactggtgttgatgtagaatcaccatagggttgggggatgcgggagtccagcctcccagggccatctccccaagcagggagccacgtgcccactgcacgctaaacaaagtgactccttctcgctcgtttcagaaatgagagctgcagtgaaaactacaccaccgacttcatttaccagctgtattcagaagagggcaaaggcgtgtttgactgcaggaagaacgtgctgggtcacatgcagcaggtaggcccgagactgcatgaggggccacaaagcccctgtcatgtgacttttaaaagattagtgtcttattttagccattgtggggaaaaatgtataagtaaattccaagatgataaaaaacatctgaactttttgagacagagtcttgctctgttgcccaggctggagtgcagtggtacaagcttggctcactgcaacctccaccttccaggttcaagtgattctcctgcatcagcctcccgaggagatggcagtataggcacccaccaccacacccagctaatttttgtatttttagtagagatggggtttcaccacgttggccaggctggtctcaaactcctgacctcagatgattcacccacctcagcctcccaaagtggtgggaatacaggcctgagccactgtgcccagccaaaacatctgaacttttaagtgatgccaaacatcaccagctttaggattcttttgttggtgaggtttgagtaatggggattttaagggaactgtcagctttcatgaaaacagtgatacccccattacttggaaatgcttattcaaattaaacacttcatcaagttaaaaactggagcttccctaagatttaaaatggattatcagacatgtagtatacttgacaccccaagtcagaatgacctggaatgagctgcacacaggcacacacgtgttatgagctgagcctgggacacagggtccaggcctcctaacttgcacacactccttcctcaccacctcctattcttatacttttaagccagagcccatgaatcccctgcaatgatgatgaaatagtaggcatatgtgtgatcttcttaaagaatccacaacggttatcagattaaagctgtgacccatccccagctcagatgagttcatgaaatcctgatttaagattttaaaataatgaagattgttagttgacttgttcggtttattaaaatcctcatcttactgagcggggggaacacttgatactttttcttaacaggccaagttcaggctacgggaatcacaggttttgttctgttccaactataaggacctagaaataaaaacatgaattctgcaaaatagaaattgtcatttctatttaacagcaaagtgttactgtataactggtatttcatataactctaaccaccaacagggtggggcaccctctccatttgatagaaactttggaaccaaaatctctgccagagctatggagtggatcactgcaaaactcaaggaggcccggggcagaggtaaggggtctggggagggaggccacagcctcgtgatgcaggccgtcctgccttggtgaaaatgctgtcctatcggggagaagtagggtgctggttccttcttcagttcagtactgagctgcacgtgatgttttactcctgatctctgagtgttgctatttaaccaaccttggattcctgggataagatcagcttgggtatgacatgttctcttttatcactgctagatgcagtctgcagttcttttgtgcaggctttttgctctagagatcctgaacgttggccagcaatttcccctcacagtttaagtggggccttctattttttgaatgtttgctaggacaacctccttgtgactatccatcaaaacttccagttttgaggaagatctgactgctgaatgaattgttcatgtttgtagaactgcatgttcgtagaactgtgcatgttcttccttaaatcagttctgtaagttacatattctaagaaatctttaaactgaagtttcaagaaacatgacttttttataatactcttgttaatggctccaacatggctgttccccactcattcctgagtggctctttgtgccagcatctttctcacccccacccccctcagctttcttaatcagtcatagcagatgtgtgcttttattccggcaaaccactatcactgccagtgtccaacttagaaaaatgacagtctataaaaaccagtgatgtgaatagtttcaatgggtttgtctttttgaagaactgactttggctttgattctttctacagcgattttcttttgctaatttagctatggatgctttttgcctctcagtgtgtgtatgtgtgagcataaattagtgtcctgtaatttaagctaatttccctattccactatttagtgaaaaattctctccactgggaggaaaaaacaaaagctgctttccaggaagccctcggggcagtcccacaggagcagagctgcacgaggccaggtgctggccccactgcgcggctgttctcagtctcactgggcttccaggccgggttcagcatggttctgaggaatctcagttctcatctcgccccgtgattctgctcccccacctgcccatgttgacagggtgttattaatcttttttaaaatcttttataggaaaaaaatttaccaccgatgattccatttgtgtgctgggaataagcaaaagaaacgttatttttcaacctgtggcagagctgaagaagcaaacggattttgagtaagttggctgggttccctgaggcaataagaccccaatgtgagtacgggacaggggaatggccattgctgttgctgtcggcaactcattcaggggtttgaggaactggcttttctgaagctcagttaaaaaaatactaggtcttggctgggcgcggtggctcatgcctataatcccagcactgtgggaggccgagacaggtggatcacaaggtcaagagatcgagaccaacctggctcatatggtgaaaccccatctctactaaaaatacaaaaatgagccaggcatggtgatgcacacctgtagtcccagctactcaggaggctgaggcaggagaaatcgcttgaacccgggaggcagaggttgcagtgagctgagattgcaccactgtactcaagcctggcgacagagcgagactccaccactgggtcttcgggaataattttaaacaatggtttcatttgatcctgaaattggctttatcatctagttgattcagccgaccctacaaaccctgtgtttctggcaagaccgctcgctgtgctggccaggcggaggcatctcccgccagtgactgcaggcctcactgctgtctcctcttacctccacaggcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccacctgctccagtgcgtgctgtctgtggagtgtgtctcatgctttcagatgtgcatatgagcagaattaattaaacatttgcctatgactccaaca

SEQ ID NO: 128 - DNA, 40849 bp, Homo sapiens
agtgcgtggcagcgggacctgcggccccgtcgcgaagtttccagccctgcgagcgccgccgggtcggccgatcgtcccccatacctcggccatgcggcccctgctgctactggccctgctgggctggctgctgctggccgaagcgaagggcgacgccaagccggagggtgagggagcgaaggccgggggcgggagcgcggatccgggcgggagggctggtgtcgggctgcctccctgggaacgacctgaatgggaggcctgggctggagagggagtctgggttccggctccttgtccacttaatcgctggtgacttgaacaaatcacttcccctcttggggctgcggttcctgcttcgggaaggaaagggtgacagctgagtcccattcagcacagaaaggctcaaataataatagttttcataataataaccgacaatggctattctgcccagtgctcactatgggccaggcatcagttaggcatgattgctaccctggtaagtgtttccttctattatccccgttttccagctgggcaaactgaggctccagagttcattcacttgcccaagatcatacaacttgtgggccttggaaccaggatttaccccacccacccaggtgtctggttccagagccaggaggcctcatgaccatgggaatgaggggtcttgagggggacaggggaggaatgggggtagaaggtgtggctcactttgtggataagtttgtgctttcatccatgtcccctgtggtctgcttagcccctgccagggtggtcttcctctctgcagtttattttttttattttacttaatgtattatttatttagttatttatttatttttgagacagagtcttgctctgtcgcccaggctggaacgcagtatgcgatctcggcttactgcaacctctgcctcccaggtaaaagcaattcttttttttttttttgagatggagtctcgctctgtcgcccaggctggaatgcagtggcacaatctcagctcactgcaacctccacctcccaggttcaagtgtttctcctgcctcggcctcccaagtagctgggattacaggcacgtgccaccatgcctagctaatttttgtatttttagttgagatggggtttcaccatgctggccaggctggtcttgaacttctgacctcttgatccgctggcctcagcctcccaaaatgtttggattacaggcgtgagccatcgcgcccggccggttcaagcgactcctgtacctcagcctcccaggtaggtgggatcacagacatgtgccaccatgcccagctaatttttgtatttttggtggagatggggtttcaccatgttggccaggctggtcttgaactcttgacctcaggtgatcagcccaccttggtctcccaaagtgttgggattacaggcgtgagccaccacacctggccctctctgcagtttatacttgaggaaactgaggcccagacaggtgaagtgactgtccagggtggtccagacagaggtggttggtccgaggtcagctgggctccagtctagcgctctttctacttcctcaaggcagattggattgcagtgtgtgccccactgtcctgagtgggtgcttccctcctccccagccctccctggcatgggccatctccagggctgtcccgagaagggcatagactgcggacagtcccagcaaagccaagcagaagtggcggtactttccatggcattctcctccttcagcttaccctcctggagaacctgaaactgtatcaccagaaggatcccgggttctttgggtcaggaatgggaaccaccatttattttattttatttatttaatttttttttgagacagtgtttcactgtgtcccccaggctggagtgcagtagcatgaccttggctcactgcaacctctgtctcctgggttcaagcaattctcgtgcgtcagcctcccaagtagctgggattacaggcctgcaccaccacgcccagctaatttttgtatctttagaagagacgaggtttcgccatgttggccaggctggtttcaaactcctgacctcaagtgatcctcctgcctcggcctcccaaagtgctgggattacaggtgggagccactgcacccagccaggaaccaccatttcttttcttttctttctttttttttttttgaggcagagtttcactcccgttgcccaggctggagtccaatggtgcgatctcagctcactgcaacctccgcctcccaggttcaagcgattctcctgcctcaatctccctagtggctgggattacaggcggatgccacaacgctcagctaatgtttgtatttttagtagagacggggtttcaccatgttggtcaggctggtttcaaactcttgatctcaggtgatccgcctacctcggcctcccaaagtaccgggattacaggcgtgagccaccgcgcccggccaggaactgccatttcttgagtacctccctcggaccaggttgtgcccaaggccccacgtctcccagtggtaaagccggcggtgcttgctctctgtgaggcttggtgttctagcctgcaagacccggtgatactacctcacgcctggagctctaacaagaattccaggggatgaagttggggagagttcagctcaatgcctggcccatgaaaggccctcggcaaagggcattttctctcccagtcccagggctgctggcttacagcagggcagtaagacagctcagaaagtccagtgatggaaacgctgaccaccgggctgtgcaaagggctctcggcctgggtcccctcactggccaggagccctgttgtggcctagttttctgggcctttgatccccctgcttctgctgacatggggtgcctgcatcccagaccatcccaggagagaaaccgcagctgcccatgatgaagcccggtgagttgaattgaagagggaccagactgatgacagggcgttaggcaccctgatccccagcaagtgacaggaggagggcagagcagatccaaggaagccttcacagagggtgctgctatgggcggaggacaggatcagtgtgctactgaggtaacccaggtagagcacctggtaggtagaaagcacatctgtgctcactgatgcacaagagagcagatccccaggcctggggctaatgtcaggccagtctgagttgggccctttgcttcccttctccatttggatccctccctgttttccatttttttttttttttttaagttttcattttctttttttttttttctttgagacagagtctcgctttgtcgcccaggctggagtgcagtggcacgatctcagcgcactgcagcctccacctccagggttcaagcgattctcctgtctcagcctcccaagtagctgggatcacaggcatgcaccaccatgcctggctaatttttgtatttttagtagagacggggttttgcaatgttagccaggctggtctcaatcctgacctcaagcgatttgcccaccttggcttcccaaagtgctgggattacaggcctgagccaccacgcccggccaggatccctttgctaagtaagaaatcatcaactccattttggagatgggaagactgaggtcctggtaggttaaacatctggtctctcattgccagagctggttggaggtggggtcattgtctggaactcagacctactgttcatttctgcacctctggacgggaagggggtgctgttgcctggaaatgctgcctgggggagcctgctcagctcccccagacccagctgaggtgtgacctttagccagctggacaggaggacagagtgggttgctcatcttccctgcaggtcttgcctgagcatcccactgactagtgtgtgtgtttggtggggggtaccccagcagcccccaaagaggccagctcttccctttccctggcagatggatgggaggaggcagctactgaggtggattcagctggagtagggaaggggatttgctgtggagtctcggggagtgagatgggtggggtgctgtcagcagcttgtctgtcccctcacccaaaacgcatggccttggtgcatggagagaaacatggaccgttttcacttttgggggctcccaatgagaggggggtacagagcacctcacttcagtagacaccccacgtctgagggaagagatgttgcgccatcctgggggggcttccagaacaagatgggagacacaagaaggcttcaacaaagcaatatcttccatcacagggaactgggagaataaaaggcaacatccaaacaggcagatatccctagagccgaggtcagatgtcccacagcccttcctcccgtttgtagaaacttctagcagatctccagctcctgcctttccctgtgggccttgatttggccgtggtgagagaaggacagctgcagagatcagaggctcagctggccgttcaggtcatgctgttccctactagagaacagaagggtcccaggagtcagtcaggctgcactggatggtgtgggggtggggccgggtctggggagacctaagtgggcagctggccccggggaggctaaggttggctcccacgtgcagggcatcccaagctcctgccagaccctgttcctggcttcagttcaagcctggggtggggatgaaggatgggggaggggagagggcggaagggcttcattcattcccgcctccccagggagcagactgggtgtgtcatgactgtgccttgactcaggccacacagtgaccacccacgccttgggctgggactgcttggggaggagggggcatccggtggcacagtcaaaccaggggtgcccagaggtcccattcttccaggagctcatcacatacgcacaccccaaccaagccctcaccgtcagtctctccacatcattctttttctttttctttttttgagatggagtctcgctcacctagtctggagtgaaatggcatgatctcagctcactgcaacctctgccccctgggttcaagcagttctcctgcctcagtctcccgagtagctgggattacaggcgcccaccatcatgcccagctaatttttgtatttttagtagagatggggtttcgccatgttggccaggctggtctcgagctcctgacctcatgtgatccacccgccttggcctcccaaagtgctaggattacaggtgtgagccaccgcacacatcattcttctcttaaaagtttttctaaattttatttttttgtacagacagggtctcactgtgttgccccggctggtcttgaaccctcaggctcaagtgatcatccccaccttggccccccaaagaccgggattacaggtgtgagccactgcacctggctaattcctgtggcccagtagcatgactatagctcactgcagccttcacctcctgggctcaagcaatcctcctgcctcagcttcctgagtagctgggcctagaggtgcgtgccaccatgtctggctaattttttaattttttgtagagacagggtctcactttgttgcacaggttggtcttgaactcagggcctcaaataagcctcctgccttggtctccctaagtgttgacattacaggtgtgagccaccccaccctctgcatcattcttgctctcaggaaggcagctcccctttattcctgacccccagggcagcatctaccaagacacagctcccctttaggggaggcaccctgtcgccagaacccccccgcagctaccaaggcaggcactgtgccaagcgctttacggcattggctcattgaatcctcatgaaagtctctggagggaggtactatcatctgtattattcccattttacagatgagaaaactgaggcacggagaggctaaattccctgcccagcaatctgtctttagcaccctctctgttgtatctcattgatttctgctgatcctggatcacgggttcatctggggaagtcattgctggactttgggcagtaggtggggagggctgagagctctgggtgccaggccttggccttagcccaaggcagctggctggaccagacagaaagcagatgggaggggccttggtactcgaaaatgaatcttccacatccatgccttaagggtttctctggcctggcctaacagtgagctgggaaaagacctcaccacgtgactgcagttgggtgcttgtgctgcagaggccagagagaaggcactggaagcgctggcttttgtctgcagccaggagtctggcatcttaggatgttgggctcttggacagggaaatgaagacaagagcatgggcatttagaattccaactcattcccatttcacctaaaggttctgtgactttgggtcaggtatttagcctctctgtgcctcggtttcctcacccgaagaagcagtgataaaaatatcaccttcctcgtagagtgttgaccgtgaaataagataatgaatgtaacatgcctcatacagcacacggtatctcaccgggttcagtggtggtagctgttcctaaaagtactttgtttgtttgttttgttttttgttttttgtttttgagagggagacttgctctgtcacccaggctagagtgcagtggcaccacaaaagtacaaaagtaccttccatgttgctgcttttttttttgagacagagtttcactctgtcacccgggctggggtgcagtggcacaatcttggctcactgcaacctctgcctcctggtttcaagtgattctcctgccttagtctcctaagtagctgggattattattattattattattattatttttgagatggagtttcacttttgttgcccaggctagagtgcaatggcacaatctgggctcattgcaacctctgcctcctgggtcaagcaattctcctatctcagcctcctgaatagcagggattataggcgcctgccaccatgcccagctaaattttttttgtatttttagtagagacggggtttcatcacattggttaggctggtctcaaactcctgacctcaggtgatccgcccgcctaggcctctcaaagtgctaggataacaggcgtgagccaccgcgcccggactagtagctgggattacatgcaccaccgtataacttgcagtatgtaatatgcaccactgcctggctaatttttgtatttttagtagagacggggttttgccatgttggccaggtgggacttgaattcctgacctcaggtgatctgtccaccttggcctcccaaagtgctgggattacaggtgtgtgagccactgtgcccggcctttttttttttttttgagacagagtttcaccctgttgcccaggctggagtacagtggcacaaccctggctcactgcaacctctgcctcctgggttcaagcaattctcgtgcctcagccttctgagtagctgggactacaggctcttgccaccacgtctagctaatttttgtatttttagtagagacggggtttcaccatgttggccaggctggtctcaaatttctgatctcaactgatctgcctgcctcagcttcccctcacttcccaaagtgctgggattacaggtgtgagccactgtgtcaggcctcacgtagctgcttaaggccagaatgtacagtgtgtcttggtcatgcccagtcccagccatggtgagggagagggagaccaaggaaataaagatgtggccctggcctggcagagggagaaggagcaggtttgtaccaatacgtcaactactgggcaaaccaagactgcacgtgcaaaggagtgaccacatgggatgagattaaggagggcttcctggaggaggtagactggaggcctctttaggggaaggaatgtgtgttgcagacaggtcaagggaatggggtgcaggctgggtttactgaggctgtttccttggggatgttaggaggtcatgccagggtctcttgttggagggcttgccttcagttctcttgttgtgaaccgcctcccagacccctgcattgcagcccagtgtcagcggaccaaggggatggattggaccagtgattcccaaatgtggctgacatcagaaatcacctgggaaaggtaggaaaaatccagactcctgggcccacctcagacccctagccctggggcctaggagcctggattccacaacctctcttgtgatgctgatgtgtgggcaggtttgggaccctctgaactggacaatcacgtgggatcctcaaccagagaggcaggctctgcgtggcccaaggaacccgggagttttttttgtttgtttggttttttgttttttgtttttgtttttgagatggagacttgctctgtcacccaggctagagtgcagtggcattatctcggctcactgcaatctctgccccctgggttcaagcagttctctgcctccacctcccgagtagctgggattacaggctcccgcccaccaccatgcctagctaatttttgtatttttagtaaagatggggtttcaccatgttggccaggctggtcttgaactcctgatctcatgatccacctgccttggcctcccaaagtgctaggattataggcatgagccaccgtgcccggctttttttttctttctttttttttttttgagacagagttttgttcttgtcgcccaggccggactgcaatggcacagtctctgctcactgcagccgccacctcccgggttcaagcgattctcttgcctgagcctcacgagtagttgggattacaggcatgtgccaccacgcccggctaatttttgtattcttagtagagacagggtttcaccatgttgaccaggctgctctcaaactcctgacctcaggtgatccacctgcctcagcctctcaaagtgctgcgattacaggcgtgagtcaccacgcctggccacggaacctgggggttaaggtcccagtgtgggctctcagcagcactgtttccctggaaaacagggaatagacaggttatagggaggaaagtgggcatgtggggagggcacagctagacagctcccttacatagatagagagacagggccctctcaacagatggcctggccaccgtccctggctgggcagtgcatgcatttaggttaagagaggagactctgggttcaggcttgtgtccaagtcctggtgctgctgcttcctagctcccttgggcacattactcgccagctgtacccttggtttcctaactggaaagtcgggggttagtatgtgtgaagtgcttggaacagcattggctgggcacggtggctcatgcctgtaatccagcactttgggaagctgaggcaggcagatcacctgaggtcatgagtttgcgaccagcctggccaacatggtgaaaccccatctctactaaaaatacaaaaaattagctgggcgtggtggccggcacctgtaatcccaactatttaggaggctgaggcatgagaatcgcttgaacccaggagatagaggttgtagtgagacaagatctagccactgcactccagcctgggtgacagagcgagactctgtctcaaaaaaaaaaaattgtgtctggcacacagaaaatgctcgatgaaggtaagccattattgttgctgttattgagaagcaggaacctgagaaaggggctttgagccacgccaccccatccccttcccccacccctgctgctggagttcaagagcctgttccatcaagaatcctgaattgcgcatgcacgcgtacacacacacacacacacacacacacacacactcactcacatgctctcacgctggctttttccatccatgaaatgtgacactcttcctgtccccagcagccccctgttgccaagagggcctcagagctggtggctctggttctcttcacctggggagagacttcaccgtcctggcaggagctcgggggagcccttccccaagtgtgagcagcatccctcgtttctggatcccaggttcaggtagtgaggcctctccttcccacacctgcctggtgtatccaccccctcctcccccagcaccgcagctaatccctgccaatccctgctgggccgcctggcgccagccctctgccctggggccagctccctgccccggctacccctgccccagctacccctgccccgccagctctggcaagccaggcccctttgttcctacagtctaggttcctcctgacttcctgaggtggtgggaggggagggccttacctgcctgctgtcaatctggccaccaggtgagaagtgtaagctgcagaccctcagggagctaagactcacccagggaaacaatgatgagcactgcagtgtgggtcttgcctctgtggcttggaggccagagagggcaggagaaatccgagaaggcttcatagaggtggaagggacgtcattgtcactggccctgggacctggaggaaggttagagaaaggagacacaggccgggtgtggtggctcacgcctgtaatcccagcactttgggaggccaaggtgcgcagattggttgaggctgggagttccagaccagcctgagtaacatggtgaaacctcatctccactaaaaaatttagctgggcttggtggggtgcacctgcagtccctcccagctacctgggaggctaaggtgggaggatcacctgagtgcaggaagtcaaggttgcagtgagccatgagccatgattgtgcctctgcactccagcctgggcaacgggagtgagattgggtctcaaaaaaaaaaacccaaaaaacaaaaacaagaaaggggacacagagggagccatggtcccttgcatgggaggtcccttgcatgggaggtcccttgcatggtcccttgcatgatcccttgcatgggaggaacccagcaaggagagaccccctccagttggaggagggcctgcatgatggagagggatgagtatatcacccgccagatcagagagggccttgaatgccaggccaaggcatttgcttctcattaatcagcaccagtaatacctctttatttttatttatttttatttttatttttgaggtggagtcttgctctgtcacccaggctggagtgcagtggtgcgatcttggctcactgcaacctctaccttctgggttcaagcaattctcctgtctcagcctcccaagtagctaggactacaggcacatgccaccacgcccagctaatttttgtatttttagtagagacggggtttcaccatgttggccaggctgttctcgaactcctgatctcaagtgatctgcctgcctcagcctcccaaagtgctgggattaccggtgtgagccactgtgaccagccttcagtaatacctcttcatgtgtgccgagcatcccaataaagattttacatgcctgatctcatttaattactccagcagccctgagaagtaggtactattattatccctgctttccaagggggaaactgagtctcagaagggctagggacttgccccaggtcacatggctattaaggagcagagctaggattctaaccaggcaggctagctccagactcctcgcttctcagagaacacagcttcaaagtgtgctctgagaggggcttccccagggctccctgagatgctctctggggagttatttccagaagattctgttgcagaggcaggccacactacagagcctgggagaggttccttgttaaaattgtaggaatggctgccctggccaaaggtcagcagtggaccagtagatttcaagtcagtttccactctgggccgactcattggttctaagagcctcaagcatggtgttgggagaatctagagccatgtgatactcagcaagaaagactgtgagatagattagcaatgtctgtcctgggttaggtatggagagcagggacctgtgagccatgtatttgctgtccctgggctaattgtctatcattggccagagagatcttcctggtggtcagcattcagagtaatcttccttccacaccctctaaagccagaaactcagtcctataatgtagggtgtagacacctctcctgtctacagcacatgcttcatgacatgttggtcagtgtatttgtctgttttatgttgctgtaaagaagtacccgtggctgggtgatttctcaagaggtttatttggctcacagttctgcaggctgtacaagcataccaccagcatctgttctgcttccagtgaggcctcaggaagctttgactcatggcaggcatgtcacatggtgagagctggagcaagagagaggaggaagtgcaaggctcttttaaacaaccagctctctgctgggcacggtggctcatgcctgtaatcctggcactttgggaggccaaggcgtgtggatcatttgcggtcaggagtttgagaccagcctggccaacatgatgaaaccccgcctctattaaaaatacaaaaattagctgggcatggtggcgagtgcctgtagtcccagctactcaggaggcggaggttgcagtgagttgagattgtgccactgcactccagcttcggtgacagagtgagatgctgtctcaaaaaaaaaaaaacaaaaacaaacaaacaaacaaaaaaaacaacccagctctcttggtcgggcatgatgactcatgcttgtaatcccagcactttcggaggctgaagcagatcaccagaggtcagctgttcaagaccagcctggccaacgtggcaaagccccgtgtctactaaaaacataaaaattagccaggtgtggtggcacccgcctgtagtcccagctacttgggaggctgaggcaggagaatagcttgaacccaggaggtggaggttgcagtgagctgagatcatgccactgcactccagcctgggtgacagagtgagactctgtctcaaaaaaataaaaaccaaccagctctcacatgaactcagagcaagaactcactcattaccaaggagatggcaccaagccattcatgagggatctacctctgtgacccaaacacctcccactgggccccacctccaacagtggggatcacatttcaatgtgcaatttggaggggacaaatatccaactatatcggtcagttactgggtggagggagccctggaggagactcaggagacctgggttatttcctgctctatcatcctttcttccctgggccctgttctgtaatgggttgacatgaagacacttcctgccagaatttgacaggtcactgggaacaaagacctcctccctgtcacctccctcatcctccattcccattcaccataccctcctctgtctgcagacaaccttttagtcctcacggtggccactaaggagaccgagggattccgtcgcttcaagcgctcagctcagttcttcaactacaagatccaggtaaggggtttcctgggtgaggcagagacagtgaggggtggcaggaggatctaggagctagtgtcctttccaaactaccacgtctcttaagatagacttggggccacaggggaggcttctggaagcctgaaggatgaaaatgagttagtcgggaatgggaagacacagcagaggacacagcatgagtctagggggtgatggagagggaaagagttggctaaagaaatgctcagatgttagtgtgcaggagcctcagctgagaggctagtttagaggacagggcctcgggatcagcatttccacaagtaccaccccgtaatttggggatgggcacggtctagacatcttcccggtattataaacactgctctaaagaaacatgagtggtcccgcacaggggctcacgcctgtattcccagcactttgggagtctgatgatccactgaggtcaggagttcgagaccagcctggccaacatggcgaaaccccatctctactaaaaatataaaaaaattagctgggcatgatggcacgcacctgtaatcccagctgcttaggaggctgaggcgggagaatcacttgaacctgggaggcggaggttgcagtgagccgaggtggcgtcactgcactccagcctgggcaatagagtgaaactctgtctcaaaaaaaaaaaagaaaataaaagaaaaaagaaacatgagctaatgcccgatcgaccactggcatgggcttggtgtcatctgtgtgcagtccatggggctgagccctgcagggagacgagtatcctgagtgcttccttatgtcaggcacaaggttgggcactggcaatagggtgatggacaatacagaacatgtcattgcttacacagagcttgcaatctagtggcattaagtcagcaagcaagtgtatcagctcacatgaatgagggttgcagcagagggttgcttcaggcatggctggatccagggattcaagcagcaaagtgagggccttgtgtttccatctctaggccctgtttgttttaatcgtggtggcaagatgaccaccagccacagattcatgtgccccagtttctcaacttcagcagaaggagacaggctttcctttttaggaaaggcctgcagactgttctgtttttcacagaacagtcccagggaaggcgctgataggccatgctggggtcacatgctcaaatctccggatgtgggaggggcaggaagggtgggacattctgattggacaggcatggtcacatgaccaccaggaaccggctaatcctcatacaggtggagaatggtttccttacaggggagggtcagagttgctggacccacaggagcaaaaaaattatttctttttctctttttttgagacggagtgttgctctgtctcccaggctgaagtgcaatggagcgatttcggctcactggaacccccacctcccgggttcaagcaattctcctactttagcctcccgagtagctggaattagaggcatgtgccaccacacgccgctaatttttgtgtttttagtagagacagggtttcgccatgttggccagtctggtcttgaattcctgacctcaggtggtccacacgtctcggcctcccaaagtgctgggattaccagcatgagccaccacggccagccctggaaaaatatttctttaccaaaagcccgtgttaaggggtgtttctctccaggcgcttggcctaggggaggactggaatgtggagaaggggacgtcggcaggtggagggcagaaggtccggctgctgaagaaagctctggagaagcacgcagacaaggaggatctggtcattctcttcgcagacaggtaggtgggtcagggcttcctagcctgggcccctccgcggaagatagaagaatattctaaaatgaggccctcccagaacatcggggaagaagggggaccactctagctaaggttgcctagttttagggtgtccattcccggtcttagtaaagcccattcccaggcttggtgaaaagataaagaggaggtgacccatgagtgtgatgggccccctttaagtaagagaagaatgacatgttgtggggaccatctctttgcccagggtgcgggtgggaacatggcaggcagggctgcagacagagacaggtccatttcccagatggtggcccaggctggcgtgggcagagggccatttgtggagcacttgatccctggtccctcctgtctgtgccctcactgggcccctgctcacccttgccctgctccgtcttctcgctgctctggccacagctatgacgtgctgtttgcatcggggccccgggagctcctgaagaagttccggcaggccaggagccaggtggtcttctctgctgaggagctcatctacccagaccgcaggctggagaccaagtatccggtggtgtccgatggcaagaggttcctgggctctggaggtgagaggcctgggtgcagggcgcttggcccagcagaggggtccatctactgcctttgtggggaccccccttgtttgacgtgcaatctgggtgtctcacaggtctccagtgcagaatgtcctgaatagagctcctgacttttcaaccccaaatgtgctcccctgcagttctgatctcattcaacagacacgcagccccatagacagaacccaggagtcactcctgactcctcccttgccctcctccacctacgtccaatgccagtcacctgtctactactttttaaattttgagacggcatctcagtctgttgcccaggctggagtgcagtggtgggatctcagctcactgcagcctccgcctcttgggctcaagcaatcctcctgcctcagccatccaagtcactgggattacaggcatgcaccactatgcccggctaatttttgtatatttagtagagatggggtatcgccatgttggccaggtgggtctcgaactcctggccttaagtgatccacctgcctcggcctcccaaagtgctgggattataggcatgagtcaccacacctggccacctgcctcctacttcctaaagatctctggaatctgctctctctggcccacagttcactgccaccattctcactgggctcctggccgttggtaggagcctccttactgctctgccattccctaccctcatgcccttccaggccattctccatccagcagccagaggtgtctttaaacgatgcaaatccaaggccaggcgcggtggctcacgcctgtaatgtcagcactttgggaagccgaggtgggaggatcacttgaggccaggagttcaagaccagcctggccaacatggcgaaaccccatctctactaaaaatataaaaggtagccgggcgtggtggtacacgcctgtaatcccagctacttgggaagctgaggcaggagaatctcttgaacccaggaggtagaggttgcagtgagctgagatggtgccactgcactcaaaaaaataaataatttttttaaataaaaaataatactatatttttttataatgtaaaatatattatatatattatatataataatttatataatatatataatatatatattggtggctcatgcctgtaatctcagcactttgggaggccgaggtgggcggatcacgaggtcaggagatcgagaccatcctggctaacacgatgaaaccccgtctccactaaaaatacaaaaaattagccaggtgtggtggcaggcgcctgtagtcccagctactcgggaggctgaggcaggagaatggcatgaacccgggaggcggagcttgcagtgagccgagatcgtgccactgcactccagcctgggcgacagagcgagacattgtcttaaaaataaataaataaataaagatgcaaattcacacacatcacttaatgactttccactgcacggagaataaaatccacaggcctcttttcaaccttagatggggatctgccatctgccctcaacagacacttttttccactggtccagagtaagcacagtccagatggccttgccctggcccaggcccaggagtagggatgtcccattgctcttgtggttgcttgtcaccagtctgtactctagccaggggcccatgtgggcttccccactatgccaggtctcagcccccaaggcactctgtgagcttggcccagcctttcccttctctgggccaggtttcccagataactgtaaaaagggacaccaggcctgtatcctcccagccctgctctccaggggctcctcgtacaatccgtttcttcaccacctatatggtgcccagcactgaacagtacagcttagtgggcaccattggtcttattcttggggtcattaggaactcattaataagtgacattcactggcagccccatttccaacctgcagccccacctcctgtcaattcaggaggacttctgagaggtgacagggtttgtgggcatatgagtggaggtggataagagggaagggtgggaggaggcccctgacttagaggctggaagctaagggtccgtcttggtgtccccacccaccaaccttcaggcttcatcggttatgcccccaacctcagcaaactggtggccgagtgggagggccaggacagcgacagcgatcagctgttttacaccaagatcttcttggacccggagaagagggtaagaggcagtgggcgggccaaggagagggggctggggatccaccggccaggctgcacgggaacagctcctctcaggcctgaacccctgggttggtgtcttagtctatgcaggctgctctgacaaactgccataggctgggtggctcccaaacaacggatgtggatttctcatggttctggaggccggaagggtgagatcacagttgggttctggtcagagccctctaactggtacagacacagctgacttctctctgtgtcctcagatggtggaagggggtagggagctcactggggcctcattgataaggacactaatcctatttttttatttttgggatggagtctcactgtattgcccaggctagagtacagtggtgcgatctcggctcactacagcctctacctccctggttcaagcgattctcgagcctcagcgtctcgagtagcggggactacaggcgtgcaccaccacgtttggctgatttttgtatttttagtagagacagggtttcactacgttcgccaggctggtctcgaactcctgtcctcaggtgatttacccgcctcggcctctcaaagtgctgggattacagtcgtgagccaccgtgcccggctgtcgggtcttaaagaggcagcattgttcattggttcagaataaggacttcagggccaggctgcctgggttccaatcccagctcaccatttactagctgtgtgacattgggcaacttctctgtcccttgttttttccgttatgaaatgcaataatgggccagacccagtggctcatgcctgtaatcccagcactttggaggccaaagcgggtggatcacctgaggtcaggagtttgagaccagcctggccaacatgatgaaaccctgtctctactaaaaatataaagattagccgtgcgtggtggtgggtgcctgtaatcccagctactcaggaggctgaggcaggagaattgcttggacctgggaggcggaggttgcagtgagccgagattgtgccattgcactgcagcctgggtgacaagagccagactccatctcaaaaaaaaaagcaataatgataatactttctcacagagatgttgtcaggattaaattgattaatatatgtagaatagtttatttatttatttgagacagggtctcactgtcacccaggctgatgcgcagtggcagaaacatagctcactgcagcctcagcctcccggactcaagcgatcctcccacctcagcctcctgagtagctgggactataggcctgcgtcaccatgtctggctaattttaagatttttttatagagatgaagttttgctatgttgcccaagctggtctcaaactcctgggctcaagtgatccttctgcctcagcctcccaaagtgctggaatgacaggagtgagccaccgcacccgactcgtgtagaatatttggagtagcggccaggtgcggtggctcacacctgtcatcccagcactttgggaggcggggggcgggggcggatcacctgaggtcaggagttcgagaccagcctgctcaatgtggtgaaatcccatctctagcaaaaaaaaaaaaaaaaaaaaaaaaaattagctgggtatggtggcacatgcccgtagtcccagctactcaggagtctgaggcaggagaatcgcttgaacccaggaggcggaggttgcagtgagtcgaggtcgtgccattgcactccagcctgggtgacaagagcgaaactctttctcaaaaaaaagaatatttggagtagctatgtgcgtgtagtggagtgcttggcaggtgctggttactcttaacggccgtcattgttgtaggtgagccggctgcattcttagattccttccagttcagagtccctggttttctgtgagtagagccactagactgtagaccccaggagcttggctgctggccttctctgggcacctagctgccctgatgtgacgtggcagagtcggtgtggggaatgagggctgaacttggggacagattccccacactgggtgagatgtagccccagcctcccccagggcctgtccctgctgcagtctggtaccttctttcctgcaggagcagatcaatatcaccctggaccaccgctgccgtatcttccagaacctggatggagccttgggtgagcagcccccacggggaggggtggatcctcagaggggtgataggaagaattccaggcagggcccgagcccagggaggagaaatgggctgcttctttctggccattgtgctgagaggtcactggcctcatccccaggtccccaggggccacttggatatcctggcgcagagccatgtctctcttgggggcgggggacaagtgagcattcagcctgggaggagttgggggatgcgcacagcaggtgctggaccccctgccctgcataccaggtccttacaggtgggccctctttccccactttcccggccctcccaccttccaggtgaaggagtcctgggctaggggcaggaactcagctggtgggacaggcagcttgggaagcaaaaggctacttgacccttgatgccgcaaacatccctgggcctggcctcatgtctgtggctggtgatgacattgctttgccgcaggtcttcctgtcttcctgagtgacctcaggcaagtcacacctcctccccacaggggactcagttttcttatctttacaaaagggaagtgaaccggatccactgattgctgattttgtggataaatgggcccttttgagaatctgatgaaagctacggctctgctcccagagaaacgcagaaaatgccctttgcctgtggtttctgggggttaagaagcactgagttcagatccacgcaggtcaggagctatctgttttcctttttttttcttcttttttaagatggagtcttgctccatcgcccaggctggaatgcagtggcgaattctcgactcactgcaacctccgcctcccaggttcaagtgattctcctgcctcagcctcccaagtagctgggattacaggcgcacaccaccatgcccggctaatttttgtatttttttagtagagatggggtttcaccatgttggccaggctggtctcgaactcctgacctcaggtgatccacctgccttggcctcccaaagtgctgagattacagacgtgagccatcgtgcccagccctattttaatttttaaaatagagacagggtctcactatgttgcgcaggcttgtctcaaactcctgggctcaagtgatcctcccaccttggcctcccaaagtgctgggattacaggtgtgcgccagcgtgcccagctgaaatacccattttcctatgtgcagactaatagggtcaaacatgggtattgggggccaggcactgtaatcccagcactttgggaggccaaggcgggtggatcaccagaggtcatgagttcaagaccagcctgaccaacatggtgaaaccccgtctctactaaaaatacaaaaattagctgggtgtggtggcatgtgcctgtaatcccagctactcaggaggctgaggcaggaaaatcacttgaacctgggaggcggaggttgcagtgagccgagatcatgccactacactccacactgggcaatagaatgagactccatttctaaaaaacaaaaaacaaaaacacacacaaaaaacatgagtattggaaccctgctgcaggggctccctccactgggacaagatctgtcctgatcatgcccaggcctcccctgcatgtggctctggcattttctcagtgctgctctgcctactcagagaaggcgcgtcccagaccctttctcttggggcttctctgaggtgcctggagctgggatgttccaggtcttcgttcttctcccagcccctgcttctgactgtaagtaaccacaacaagtacaggggttgccgtggattctgtgctcatgatgggccaggcttggtgccccacgcttgttcaacacaaatcctccccctcaccccatgaagaagggattattcctattttatagatgaggaaactgaggcttagagagaagtgacttgcccgaggacataatctactcactgcacagctgggatttgagcccagctggttggaccctgagcctgacctctgggtctgatgctgggtgggactgtgctttctgacccccagatgaggtcgtgctcaagtttgaaatgggccatgtgagagcgaggaacctggcctatgacaccctcccggtcctgatccatggcaacgggccaaccaaggtagggggtccccagcccctggggagtgtgggagggggccagagccctaatttcattctcactgtgaccccacagtgtctccctggggccagggccaccttcctggggcctgctatgaactcactgcctctgtcctcacatctgagctcagcgtgatgccttcttttcctgctgtggtggtcagtggtactctgtctgttcttgctggtcacaggacacgtaggaggctgccatccccttccaggcctaggctgggctaccagagccatctgcactgtcaccccagggcagagtcacttattcactcagtaaacctttatttcatgtttgcaccagacagtaagacatagtcataagcaggacggatgtcctgcattcatggtgacagaagggactgggtgcagatgcggccagggacagaatggacctcactggtccctggggaactggctcatagctcatagcatatttgagtgtggtccttcaccgctggaatgagggagaggaaggaggatgtgatgtgtttaaaatgcaaatttgctgatttcacccaggatctgttcagatggaatctctgagcggggtgggacccaggaatctgcattttacaagctctcgggagaagcactagagtgccaagccctcccctgccctctctcagagcggcttggtgatctcctggggatggagcattatctccaagaccctcttagggagtgggagggggctggatggtgctgacccactgggggcccagggagatgtgagtcagggctatggcaggtggggctggctggcttctctgtgaccccacgtctccccgacagctgcagttgaactacctgggcaactacatcccgcgcttctggaccttcgaaacaggctgcaccgtgtgtgacgaaggcttgcgcagcctcaagggcattggggtgaggctgcgcccaggcctgtgcctgagggacacggggggctcagtcccctgagatggcgagatgggtgattctggaatagactccattgtctttggtggaaagtgaaggggtcacctccctgcctggggttctatcccggttgccacccaagtgcctcctcctggaagccctctcagattgcatgtctctagcttcccccgagatgtccaggttctggtttcttctgcctggtccttcaggctctcctgcagccccctccccatcccatgaacctcatcctcatttatgactcacctcgaacaccacgccagccacgatctcctgacagcaggccctcaaccgagtccttgttccaggcctgggctcctgctgctctctccccggggcaccctcctgctgcttccctgcccccccgtaccccctgactggagttccccggcccgggcacctttcttgggaagtctacatgcttctgattctggctctgactcccttgggccaccctggggtggagtggcagtgctgtgactggacactgctggactcttgtgccgccctccctggtgcaggatgaagctctgcccacggtcctggtcggcgtgttcatcgaacagcccacgccgtttgtgtccctgttcttccagcggctcctgcggctccactacccccagaaacacatgcgacttttcatccacaaccacgtgagtaacaggcgctctgtggggtcgtcatgtggcttagatccagggcccagcttcacaaggtagcccgagacctctgagggtctcaccgaatctagcttatctgggccaaatgacaatcaccagtggactgtgtccccaaatcactgagttaactttggagtcagactgggtgagtttgaatcccagcgccgctattttattggctgtgtgaccttgggcacattactcaacctctctgtgctttagtttctcatctataaaataggcataaaagtcgggcgcggtggctcatgcctgtaatcccagcactttgggaggcccaggtgggcagattatctgaggtcgggagttcgagactagcctgaccaacatggtgaaaccctgcctctactaaaaatacaaaattaagctgggtgtggtggcagatgcctgtaatcccagctactcaggaggctgaggcaggagaatcgcttgaacctgggaggcagaggttgcagtgagccgagattgcgccattgcactccagcctggacaacaagagcaaaactccgtctcaaaaaaaataaaaataaataaataaataaataaaataaaatagggataataattgtgcaatcacacagaattgctgcaagggctaagcaagctgacatgcgaagttcgtaaaaggtgcctggtgcacaggacgcatctagttgcttctaactgttgtcatcttcacttccatccctgtcactgttaatccttcctaccttcctaattgtacctggtggcagtcaaattggttttcttttctttttttttttttttgagacagagtctcgctgtgtcacccaggctggagtgcagtggcacgatctcggctcactgcaacctctgcctcttgggttcaagcgattctcctgcctcagcctcccaagtaactgagactacaggcatgcgccatcacaactggctaattttttgtatttttttttttttttttgagacggagtcttgctctgttgcccaggctggagtgcaatggcgtgatctcagctcagtgcaacctctgcctcccaggttcaagccattctcctgcctcagcctcccgagtagctgggattacaggcgcctgccaccgtgcctggctaattttttgtattttagtagagatagggtttcactatgttggccaggatggtctcgatctcctgacctcgtgatctgcctgcctccgcctgccaaagtgctgcgattacagccatgagccaccgcacccagctggatggttgtttttccttttttttttttttttgagatggagtcttgctgtgtctcccaggctagagtgcaatggtgcgatcttggctcactgcaacctccgcctcccaagttcaagcagttctctgcctctgcaacctccgcctcccgggttcaagcagttctctgcctcagcctcctcccgagtacctggaattacaagtgcctgccaccatgcccggctaatttttgtatttttagtagagacgtggtttcaccatcttggccaggctagtcttgaactcctgacctggtgatctacccgcctcggcctcccaaagtgctgcgaatacaggcgtgagccactgtgcctggcctggactgttgtttttcaaagcgaagttgaggatcacctggcacattttgtaacaaagtggatctctgggccacacccaggaatcaacaatgtctctggatgtgggatcctgagcgtggtggcggagctctatcctgatgacagaggctcttaggaggcctgacctggtcagaggagaatgggcaaaggatggccagggaagggtgttcctggcacagggctggcatgggcaaaggtctggagacaggaaagcagatggccggggtgccagagatgaaggggcacagcctggcagtgacaggaggtgctacagtccctgggtggaagctgtgtcctcctcctcacccccgcatccccttccccatccccaaccccaggagcagcaccacaaggctcaggtggaagagttcctggcacagcatggcagcgagtaccagtctgtgaagctggtgggccctgaggtgcggatggcgaatgcagatgccaggaacatgggcgcgtgagttgtgggccacagtactctccactgacagtgggggcaggggagctgtggctgtggtaaggagcagcaggctgagtgacaggagttcagaaggctgtgtgtgctctagcaagttcctgcccctttctgggccttggagtttccatctgtcaaaaggggaaatagcctctgtcctgccaacccccggggctcctgggcagggctgagccatgttatttgggttcaggaagcaaatcagagaaagaggaaggactgggggcaaaagtagacaaaggctgactattagggagccaaccttgaatgttttactttattatatataaaaaaaaaaggccgagagcagtggctcatgcctgtaatccctgcactttgagaggccaaagttgaaggattgcttgaggccaggagttcaagagcagcctgggcaacatagcgagaccctatctcttcaaaaattaaaaaaaaatagccaagtgtggtggcttgaacctggggtcccagctactgaagaagctgaggcaggaggacctcttgagcccgggaagtcgaggttgcatgagctatgattgcaccactgtgttccagcctgggaaacagagcgagaccttgtctcataaagcaaaacaaaaacaaagaaagaagtaatttgtgttgcttgtagaagagtcagacagtccagatcaaaggttggcaaacttcctgctaaggattagatcataaatctttgcaaattggctctgccggctctgtgacaaccctcagctctgccctagtagcacagaggctgcattccagcaaaatttcatttatggacactgaaatttgactttcatgtcatttatttttttttctttttgagacttggtgtcactcttgtcatccaggctggagtgcagtggcaggatcatagcttactgtagcctcaaacccctgggttcaagtgatcctcctgcctcagccccccaagaagctgggactacaggcatgtgccatcacatccagttaatttttaaatatttatttatttatttatttagagactgagtctcactccgtcactcaggctggagcgcagtggcgcgatctcggctcactgcaacctccccgtcccaggttcaagccattctcttgcctcagcctctcaagtagatgggattacaggtgcttgccaccacacctggctaatttttgtatttttagtagagacgaggtttcaccatgttttccaggcctgtctcaagctcccgaactcaagtgatccgcccgccttggcctccctaagtgctgggattacaggtgtgagccactgcgcctggttaatttatttatttttattttttgtagagacaggatcttgctatgttgcccaggctggtctcaaactcctggcttgaagttatcctcccgtctcagcctcccagagtgctgggattacaggcatgagccactgcacctggtgatgaccttcacataatttttacatcttcttttgatttttgttttcttttttttttttttttttttgagatggagtctcgctctgtcacccaggctggagtgcaatggtgcaatattggctcactgcaagctctgcctcccacgttcacgccattctcctgtcttagcctcccgagtagctgtgactacaggtgcccaccaccatgcccggctaattttttgtatttttagtagagacggggtttcaccgtgttagccaggatggtctcgatctcctgacctcgtgatccatccacctcagcctcccaaagtgctgggattacaggcgtgagccaccacgccctgccgatttgtttttttcttgaaacaacttaaaaacataaaatcagccaagtgcagtggctgtaatcccagcactttgggaggccaaggattgcttgagctggggaagttgaggctgcagtgagctatgattgtgcattccagcttggctgacacagtgagacccccatctctaaaaaaggaaaaaaggccgggtgcagtggctcgcatctgtaatcccagcactttgggaggccgaggcgggcagatcacctgaagtcaggagttcgagaccagcctggccaacatggtaaaaccctgtctctactaaaaatacaaaaattagcctggcatggtggtgcacgcctctaatcccagctacttgggaggcagaggcaggagaatcgcttgaacccgggaggtggaggttgcagtgagctgagattgtgccattgcattccagcctgggcaacagagtgagactcgttctcaaaaaaataaaataaaataaaaataaaaaaaagaaaaacataaagctgttcttagcccatgagctgtacaaaaccaggcagggccagagtttgactcacagaccctcgtttgctgagtcctgtaccagataaacaaaagtaacacagatttttaaggcttttggtacaagttaccaaattgcatttcagaaaggcagccccagcttactccccaccctgggccatgtaggcacctgtgggctgtgttcttcccagtaccaggattttcagggcacttgataccagttgccaacctctgggccttgggtgagagagcccagcagtccaggggtttgggactcagagtcgggaggaacctttgaggctgctggtgtgacctctctaaagccccttggctgatatgtggtgaagccagactgtggtcacagatgtgagcagccaccagtagctccaggatcaggtgcactgaccctgtgtcctcctccttgcagagacctgtgccggcaggaccgcagctgcacctactacttcagcgtggatgctgacgtggccctgaccgagcccaacagcctgcggctgctgatccaacagaacaagtgaggctgctccgtctgcacccagcactgctcaggactggcctggtcctggggtggcagccctccttgccttcctcctcctcctcctcatccacctcctcttcctcctctttttccttctcctgctcctctttctcctcctcgtcttcctccttgtcttcctcctcctcttcctcttcctcctcttcctcctttttcctcctcctcctcgtcttcctcatcctctttctcctcctcctcttcctcctcctccttggcctcacctattacccagagctgtggatccccagcctgataccccaggttctgatagagaaggtgtcctgccctgtctgctcctggctgccccatgggagggagcaggtaccagaagagccaaacccccgacaccccggccaaggcactgcctgtctcagtgaggtgcttggggatccctgcgtgcaggttgaggggcacctacctccccccatccctggttagtgctgtctcctactcccagtgggcagcgacctcctactgaggtgctcccttccctcaggaacgtcattgccccgctgatgacccggcatgggaggctgtggtcgaacttctggggggctctcagtgcagatggctactatgcccgttccgaggactacgtggacattgtgcaggggcggcgtgtgtgagtacctgcagggtgggggtgggtgggggacaccttcatctggcttctgcctgggcttgtggggctccctccctattattcctgttcttgttaccctcaaattcctgttgaacctgaagcaaggaagacttcagttagacacacagaaggacttcctgacaaataggcccatgtgtccagggcgggggaatcaaatcagcacaattgtgcccccctagcctgtgacttcccttctcacacccagactccaggctatgactccccaccaccaccctgtgaccccctccatcttccccaccaccagcctctgacccccacccgctttctgtctctcccacagtggtgtctggaatgtgccctatatttcaaacatctacttgatcaagggcagtgccctgcggggtgagctgcagtcctcagatctcttccaccacagcaagctggaccccgacatggccttctgtgccaacatccggcagcaggtcagccaggagcgggcagcacaggacgccctctggatggggcaggcgggaaggtgggcctccagctctgaccctcatggtgggccgccttgtcaccgtaggcctgggagctccagagattctagcagggcatctcggaagccaccagggcctgctggaggaatgggggccgtcgggcacgagggctggtcctcaggggtctgcagggaccattttagctgacctggtttttataccatctattttatttacatttttggaatagcccaaagaaaacggaactttccacctaaaggtactccaagtgatgtgcccgagagacacctcaccctgtctctgcgccccaccccatatatttttgtgactttttttttttttttaaacatgcagcaagatgaagttttcccctgtgaccaacatttcaggaccagaacacgctccttttcttttacgcattttttctttcattctgtgttcagtcctctgggaagacttccctgatcacattcttagtgtcaggcctgggctgggccctggggacatagcggtgactgcacttggtctctgatattgggaacttcagttcggcgggtggaggaggctgcactgttgcccgtctgggagcgtgcaggggaggggtgagggcaggggaggggtgggggagcgcctcttccaccgggcctgtcctccccaggatgtgttcatgttcctgaccaaccggcacacccttggccatctgctctccctagacagctaccgcaccacccacctgcacaacgacctctgggaggtgttcagcaaccccgaggtgaggccagggtgggcacataggggctgggagcaaaggggcccagtgatcctgcagtcggagggacttccctctcagagtcttacaacagccaggacccctgtaggccacctgccaccctcccttcaccccaggaggctatagggcaggatttgggtagggagagaagggtgtccagagaggcaacaccatctattggaggagggaccaggactcaagaggcctgggtttgtggcctagatctgccatcatctgggacttagttgagccttccagctttggggaccttagttatcttagctccaaaatgggtatactgtcccagcctgtcttacccatgagggtgttgtgatgatcagaaggggagacagttgtaactgtttctagacgttgggagctcacagctgatgggtgtaagcacatgcctgcacacagacatatacacacaagcacacacatgtacatacatgtgcaaacaccacctcctatgggcacacctgtgcacccagacaacacacacgcacccagtgggtgcaggtgaacacctgcctctgtcaagcacgtacaccttcactcccactttgaggggtctgctctgagcatccctggcagttgagccaatggtgaggaccctagcctgcttcccacttcccacaggactggaaggagaagtacatccaccagaactacaccaaagccctggcagggaagctggtggagacggtaagggccatggacaccctcttggaccagccttgcctgctgcagggggcagggcacagaagggaaactgcttgccctggggagtgggggacagcaggatgggagttgggggtggagggatgggagttggggggcggcaggatgggagttgggggtggcgggatgggaatgggggggcggcgggatgggagtggggggtggtgggatgggggtggggggaggcaggatggcccctctacctgttggcactttcctgctggaggctgtgggagtctgcagggcctctctacctggcccaggcaggaaggaggaaaacatcctggatgtgatggccactgtggcccaccatgcctggaccacttcggggagtggctgcttctctccactcactaatgtctgcttcccccgagcctggggcctctgccccctccctccctccatgcccatgtttctgtctgaccttggcgctggtagctctgtgacctcggctgggaaagtctgtctctgggctctgcctcctcctccccactcagtctctccaggattgacaaggccctgctccccggggacactgggagggctccctggcttgggtgtgtggccctgaagaggaaggaggattctgtggtgccactgtggacccccttgactgagtccctgccctccccagccctgcccggatgtctattggttccccatcttcacggaggtggcctgtgatgagctggtggaggagatggagcactttggccagtggtctctgggcaacaacaaggtgggaccctgatgcctgggctggggccgcagggaggctgcctctccatcagtgccgctcactgtctggggtcttctggcaagctggcctggccaccctttctgggactcttgacataggggtgctggcatgggtatctgcaggcaggtaggagtagagggattgagaaacctgagatggagtttggtccctgagctgctgttgccaccgtgtggctttgagttgccttgaccgtaagctactaggttttcagttcctggtttgctattggaatggcttagcttggttccctagacttcccccaggtggagctggggaggaaagggccaaggtgggatgaggggcattaggaagggctgtcgggtccaagttcatcagacagcaggagcaggtggcctgctgagggtgctaggccctgtgttctctccgtgagaatcccaacacctgttcctgtcctggaaagttcaggtaccatttttttttttcttttcatgtgtgtgtgtgtgtatatatatatatatataaaaagaaatatatatagattttatttatatatatatatatatattttttttaaataatagagacggggtctggctgtgttgcccaggctggttgtgaaccaggcacaatttcattttatttattttaattaattaattaattaattaatttagagaccgagtctcactctgtcgcccaggctggagtacagtggcgcaatcttggctcattgcaacctctgcctcccaggttcaagagattctcatgcctcagcttgccgagtagctgggattatagacgtgtgccaccacgcccagctaatctttgtattctttatttatttaattgtgtgtgtgtaaattttttttttttttttaaggcagtgtctcgttctgtcacctaggctggagtgcagtggcatgatctcagctcactgcaaccttcctttcccaagttcaagcagttttcttgcctcagcctctccagtagctgggactacaggcgtgtgccaccatccctggctaatttttgtatttttagtagacactgggtttcaccatgttggccaggctggtctcaaactcctggcctcaggtaagctacccacctcggcctcccaaattgctgggattacaggcgtgagccaccgtgtctggcctaaggcacctttttattttatttattttttttattttaatgatcccagaacatttatttccataggattttgataaaagagcacaatcttgaataaaaatacaccactgtacttaaaggcaacattacctactaagcaaactctgtccttagccctttcacagaagagaaactgcagaaaggaatttttcgtctcctgacagttttacaacattcatatctcctatgtacttcaagccccaacccacctctgattttcttttttcttttttttttttttgaatggagtctcgctgtgtcgcccaggctggagtgcagtggcgccatctcagctcactgcaacctccgcctcccaggttcaagcagttctcttgcctcagcctcccgagtagctgggattacaggcgcctgccaccatgcccgactaatttttgtatatttagtagagatgggtttcaccattttggtcaggctggtctcgaactcctgacctcatgttgtgatccacctgcctcagcctcccaaagtggtgggattacaggcatgagccaccgcaccgggcaccccacctctcattttctacgtcctttttttttttttttttggtgaagtggagcctcgctctgtcgcccaggctggggtgcagtggtgcagtggtgcagtggtgcgatctcggctcactgaaacctctgcctcctgagttcaagtgattctcttgcctcagcttcacaagtagctgggattacaggtgctggccaccatgcctaattttttttttttttttttttttgagacggagttttgctcgtcacccaggtggagtgcaatggcacaatctcagctcactgcaacctccgcctgagtagctaggattacaggtacccaccactacgcctggctaatttttgtatttttagtagagacaggggtttcaccgtgtttgtgaggctggtctgaaactcctgacctccggtgatccacccaccttggcctcccaaagtgctgggattacaggcgtgagccaccgtgcctggcctcattttctaagttgtttaacagaaatgtgtgttcccaagtttaaggcaccgtttttaaaggcacatgagaccctggacctgtgtgccaacctctgacctggcaactggactaacctgaagttctggttatcttcctaatccacatgctttggttgctgagctgatctccagaagccaggaactggactagcccgtgcattctgggggctggctgatgcttgtgctccagtgacagggccagacctcggaccccagctgactctggccctggaacaagttttcagtgctctgtaacaaatgactgtggctcagaataacacccgtgtgttatctcctggtttctgtgggtcaggaatctgggcccagtttagctgggtcattgaggtgtcagctggggttggggtctcatctgaggcccaggattccattccaaactcacttggttgttgcagaattcattcccctgcagctgtagaacttaacttgcttcttcaaggccagcaagagacagaatctctcttcagtatcctcctttagccaggcgcagtggttcatgcctataatcccaacactttgggaggctgaggcaggaggatcgcttgagtccaggggtttaagaccagcctgggcaacatagtgagacctcatctctacaaagaataaaattagtggctgggtgcatggctcacgcctgtaatcccagcactttgggaggccgaggtgggcagatcacctgaggtcaggagttcgagaccagcctggccaacatgatgaaaccccatctctactaaaaatacaaaaaaaaaaaaaaattagccaggcatggtggcgcacgcctgtaatcccagctactcgggaggctgaggcaggagaatcacttgaactcaggcggtggaggttgcagtgagctgaaatgacgccattgcactccagcctgggcaacagagtgagactccgtcacacacacacaaaaataaaaataataaaaataaaattagttgggcgtgatggtgcgtgcctgtagtcccagctacacgggagggtgaggtgggaggatcacttaggcctggaaggttgaggctgcagtgagctgaagttgcgccactgcgctcttacctgtgcaacagagggataccctgtctcaaaaaataaggtctttctgcagatgactcacctagtaggtcaggcccccccaggataatctcccttttgattaacccaaagtcaactgattaggagccttaattgtatctgcaaagcctgttcagttttgtcatgtaatgtggtccggtcacattcccgggtgtaggagaggggagtagacagagcctgggggccatcctagaattctgcctaaacattcacctcggtcacctccaggacaaccgcatccagggtggctacgagaacgtgccgactattgacatccacatgaaccagatcggctttgagcgggagtggcacaaattcctgctggagtacattgcgcccatgacggagaagctctaccccggctactacaccagggtgggcaagcctggggcatagccaggatgcggggacagttgggtggggtgtcagtggagtggctgggactggtgggggtagggtgggaggtggagaaactgggaggggccgaggtggagtgagggtgtggggagcgtgggaggggcaagggtggggcatgaggtagagggactgaggggtggggatggggttgggaagagcaggggtggggtgggaagtggtagagaagctgggaggggtggagaggagtagggagcctgggaggggcaggggtgagtgggagtggaaagcctagaggggcgggggggcaggggtgagggagtggagagactggaaggggcaggagttggtggggaggtcgaggccagtgtggggcagggggatggggtgggaggggtagggtggagtggggggcttgggtggaagggccaggggtgggtgggggctggagagtctggcaaggggaggggctggggaaggggttgggttggagtacgggtggaggaacatcccagcttatgggagaggcctggatatttggtccccaggcaggagtgaggtctcaccgcacacaccccctccatctagtagcgtgtgggaagacagggtgctgggctgggactctagggccggctagttggcctctagcctgagctggagtctcactcagcctcatgagtagctgggattacaggcacctgccaccatgcctggctaatttttgtattttttgtagagacagggtttcaccatgttggccaggctggtctcaaattcctgacctcaagtaatccgcccacctctgcctccaaaagtgctgggattacaggcatgagccaccgtgcctggccgacctcagctcttttgaatctttcttccttgtcattaaccctgcctcagtggctcctataccagcccaccaaaaaagcacccctgcccaccttagctggccagcgtgcccactccctccctagccacaagcctgtgccccacgcctgggccctgcttcgtccgaagcagccttcttccaatagtgaggaaaaccctgaactcctgttactgacagttgtcattcatcccttgaatgcttactgtggttccccggaaacaattacctggctggcctcggttaattctcacaattctttccagtgctatcactcatgtgtctgtccactgctaccttggctttctccaaggtactttctccaagactcagttccttccttggtctctggtttctccagatacctgcccatggcgtgcctgggtcctgcctcagggaatccagcctggatagttgccagaaagggttgtgaggattggatgcccccctttgtctttgtcttttcattcattccttcgttcctttcttcccttccttccttccttcctctctctctctctctctctttctttctctctctctttctctttctctgtctctttttctttcttttctttcgcacttgtcacccaggctggagtgcagtggcgcaatcttggctcactacaatctccgcctcccagattcaagcgattctccggcctcagcctcccaagtagctgcgattacagacgcccaccaccatgtctggctaattttttgtaatttcagtagagatggggtttcaccatgttggccaggctggtctcaaactcctgacctcaggtgatccgcccaccttggcctcccaaagtgctggaattacaggcgtgagtaccatgtccggcctccttccctttcatttcttctcttccctttcatttcttctcttcccttttcctcccttcctccctccctcccttcctttcttccttcccctctgttctcttccttccctccctctctcccctctgtccatacatttttgttgagaaccttttctgtgccaggtagttgcaggcactcgagcatagagccccatgtagacctggcccctgtaagctgacctgcagcaggccagaccaggccccatgtgtgcaccctcctctcctggcctttgtgtcctccttaactaacacgggctctcttgtccccctgccttggtacaggcccagtttgacctggcctttgtcgtccgctacaagcctgatgagcagccctcactgatgccacaccatgatgcctccaccttcaccatcaacatcgccctgaaccgagtcggggtggattacgaggtgagcaggagccagccggggtcaaggggccggcaatggggatgaggagggctagctgaggagaggcttcagggtggttgaggcagaggggccccaggtaaccagtgccagagaaccagaaaaaaaaggatgtgggtctgtgggagggcttcctggaagggttcacagtctagcaggaggaggggccaggctcttaagctactattttaagagatttttgggctcggcatggtggctgatgcctgcaatcccagcagtttgggaggccaaggcaggcagatcacttggggccaggagtttgagaccagcctggccaacatggcgaaaccccatttccactaaaaatagaaaaattagctgggcgtggtagcacacacctgtaatcttagctacccagaaggctgaggcatgagaatctcttgaacccaagaggtggaggttgcagtgagctgagatcatgccactgcactccagcctgggcaacagagcgagactctgtctccaaaaaaaacaaaaagaggttttttgaacttagccctgggctgggtgctgtggagaacactcataaaaacagctataatccttttttttttctttttcgagacagggtcttgctctgtcacccaggctggagtgtagtggcatgatcacagttcactgcagcctcaacctcctgggcccaagcaatcctcccacctcagcccccccaagtagttgggaccacaggcgtgtgccaccatggccagctaattttttttcttgcttttagagatggggtttcactatgttgcccaggctggagctataattttttgagagcttacaacaaacatatcaggcatccctaatccaaggattctcaaccaggagcaactgtggcctgcaagggacattggcagtacctggagacataattggtttttacaactatgaggggctactggcatctagtgggtagaagtcagagatgcccgggacagccttccacagcaaagtgtctatagtggtgaggttgggaagcttgatcctcagctctcaattgtaacatctcatttaattctcactatcctgttctgtttaaccctcattttacagaaggggaaactgaagctcaggttggtcacagttagtaaagagtggaggtgatgtctgcccagggctgcctgactccaaggacagagctcttgatcacttactctttgggtttttttttttttgagacagtctcattctgttgcccaggctggagtacagtggcgcgatctcggctcactgcctcctgggttcaagtgattctgtctcagcttcccgaatagctgggattacaggcgtgcgctgctacacccagctggtttttgtatttttagtagagatggggtctcaccatgttggccatgctggtcttgaactcctgacctcaggtggtccacccgccttggcctgccaaagtgctgggattacaggcgtgagccaccactcctggccactactcttcatttagtgtcttccttagcagcgcttgtggctgtcactccagaaggcatccccaggcaggcagtgctgagggccacttggccatgacaggagatcatgacgggagaacagacgggcaggggggcggtggggaaaggccactgatgctttctgtctcccagggcgggggctgtcggttcctgcgctacaactgttccatccgagccccaaggaagggctggaccctcatgcaccctggacgactcacgcattaccatgaggggctccccaccaccaggggcacccgctacatcgcagtctccttcgtcgatccctaattggccaggcctgaccctcttggacctttcttctttgccgacaaccactgcccagcagcctctgggacctcggggtcccagggaacccagtccagcctcctggctgttgacttcccattgctcttggagccaccaatcaaagagattcaaagagattcctgcaggccagaggcggaacacacctttatggctggggctctccgtggtgttctggacccagcccctggagacaccattcacttttactgctttgtagtgactcgtgctctccaacctgtcttcctgaaaaaccaaggcccccttcccccacctcttccatggggtgagacttgagcagaacaggggcttccccaagttgcccagaaagactgtctgggtgagaagccatggccagagcttctcccaggcacaggtgttgcaccagggacttctgcttcaagttttggggtaaagacacctggatcagactccaagggctgccctgagtctgggacttctgcctccatggctggtcatgagagcaaaccgtagtcccctggagacagcgactccagagaacctcttgggagacagaagaggcatctgtgcacagctcgatcttctacttgcctgtggggaggggagtgacaggtccacacaccacactgggtcaccctgtcctggatgcctctgaagagagggacagaccgtcagaaactggagagtttctattaaaggtcatttaaacca

SEQ ID NO: 129 - DNA, 3323 bp, Homo sapiens
gacatcatgggctatttttaggggttgactggtagcagataagtgttgagctcgggctggataagggctcagagttgcactgagtgtggctgaagcagcgaggcgggagtggaggtgcgcggagtcaggcagacagacagacacagccagccagccaggtcggcagtatagtccgaactgcaaatcttattttcttttcaccttctctctaactgcccagagctagcgcctgtggctcccgggctggtgtttcgggagtgtccagagagcctggtctccagccgcccccgggaggagagccctgctgcccaggcgctgttgacagcggcggaaagcagcggtacccacgcgcccgccgggggaagtcggcgagcggctgcagcagcaaagaactttcccggctgggaggaccggagacaagtggcagagtcccggagccaacttttgcaagcctttcctgcgtcttaggcttctccacggcggtaaagaccagaaggcggcggagagccacgcaagagaagaaggacgtgcgctcagcttcgctcgcaccggttgttgaacttgggcgagcgcgagccgcggctgccgggcgccccctccccctagcagcggaggaggggacaagtcgtcggagtccgggcggccaagacccgccgccggccggccactgcagggtccgcactgatccgctccgcggggagagccgctgctctgggaagtgagttcgcctgcggactccgaggaaccgctgcgcacgaagagcgctcagtgagtgaccgcgacttttcaaagccgggtagcgcgcgcgagtcgacaagtaagagtgcgggaggcatcttaattaaccctgcgctccctggagcgagctggtgaggagggcgcagcggggacgacagccagcgggtgcgtgcgctcttagagaaactttccctgtcaaaggctccggggggcgcgggtgtcccccgcttgccacagccctgttgcggccccgaaacttgtgcgcgcagcccaaactaacctcacgtgaagtgacggactgttctatgactgcaaagatggaaacgaccttctatgacgatgccctcaacgcctcgttcctcccgtccgagagcggaccttatggctacagtaaccccaagatcctgaaacagagcatgaccctgaacctggccgacccagtggggagcctgaagccgcacctccgcgccaagaactcggacctcctcacctcgcccgacgtggggctgctcaagctggcgtcgcccgagctggagcgcctgataatccagtccagcaacgggcacatcaccaccacgccgacccccacccagttcctgtgccccaagaacgtgacagatgagcaggagggcttcgccgagggcttcgtgcgcgccctggccgaactgcacagccagaacacgctgcccagcgtcacgtcggcggcgcagccggtcaacggggcaggcatggtggctcccgcggtagcctcggtggcagggggcagcggcagcggcggcttcagcgccagcctgcacagcgagccgccggtctacgcaaacctcagcaacttcaacccaggcgcgctgagcagcggcggcggggcgccctcctacggcgcggccggcctggcctttcccgcgcaaccccagcagcagcagcagccgccgcaccacctgccccagcagatgcccgtgcagcacccgcggctgcaggccctgaaggaggagcctcagacagtgcccgagatgcccggcgagacaccgcccctgtcccccatcgacatggagtcccaggagcggatcaaggcggagaggaagcgcatgaggaaccgcatcgctgcctccaagtgccgaaaaaggaagctggagagaatcgcccggctggaggaaaaagtgaaaaccttgaaagctcagaactcggagctggcgtccacggccaacatgctcagggaacaggtggcacagcttaaacagaaagtcatgaaccacgttaacagtgggtgccaactcatgctaacgcagcagttgcaaacattttgaagagagaccgtcgggggctgaggggcaacgaagaaaaaaaataacacagagagacagacttgagaacttgacaagttgcgacggagagaaaaaagaagtgtccgagaactaaagccaagggtatccaagttggactgggttgcgtcctgacggcgcccccagtgtgcacgagtgggaaggacttggcgcgccctcccttggcgtggagccagggagcggccgcctgcgggctgccccgctttgcggacgggctgtccccgcgcgaacggaacgttggacttttcgttaacattgaccaagaactgcatggacctaacattcgatctcattcagtattaaaggggggagggggagggggttacaaactgcaatagagactgtagattgcttctgtagtactccttaagaacacaaagcggggggagggttggggaggggcggcaggagggaggtttgtgagagcgaggctgagcctacagatgaactctttctggcctgccttcgttaactgtgtatgtacatatatatattttttaatttgatgaaagctgattactgtcaataaacagcttcatgcctttgtaagttatttcttgtttgtttgtttgggtatcctgcccagtgttgtttgtaaataagagatttggagcactctgagtttaccatttgtaataaagtatataatttttttatgttttgtttctgaaaattccagaaaggatatttaagaaaatacaataaactattggaaagtactcccctaacctcttttctgcatcatctgtagatactagctatctaggtggagttgaaagagttaagaatgtcgattaaaatcactctcagtgcttcttactattaagcagtaaaaactgttctctattagactttagaaataaatgtacctgatgtacctgatgctatggtcaggttatactcctcctcccccagctatctatatggaattgcttaccaaaggatagtgcgatgtttcaggaggctggaggaaggggggttgcagtggagagggacagcccactgagaagtcaaacatttcaaagtttggattgtatcaagtggcatgtgctgtgaccatttataatgttagtagaaattttacaataggtgcttattctcaaagcaggaattggtggcagattttacaaaagatgtatccttccaatttggaatcttctctttgacaattcctagataaaaagatggcctttgcttatgaatatttataacagcattcttgtcacaataaatgtattcaaataccaa

SEQ ID NO: 130 - DNA, 71470 bp, Homo sapiens
gtgagaactaggagcctgtcctccatgttttataagtattgacattacacagtgttaacaatgcatccacagaggtaagctcgactttttaaccatcttttttccccctccctctgagacatccgaattgtgggcgagcagtgtgatttctctgtggctggccgtgccacactcacccccagagcacttatgttaacttggaactgtttagagagaatttttttgctttcttgggtcacatggctcagtagccattagccatagcttgattttgcaaactggcaagggcctggcacacctttccttccaccagggcatggtgtttctggaagagtttgaagctagatcctggtatgccaaaaaagaagcttttttttttccttctttttttttttttctttccctcttccctctctcttcccctctctctctctctgagcagttccccccctcccacccctgcactattgtcttctcttttgccacatgccctgctgggggaagaaaatggaaggtaagcaaacaggctcctctccaaggagagctcatggcagacagcagagcaggcaagtttgcctctccaaagaggttctgggaaggctggataagttttgacaagagaggagcgtgtttgcaaaagaattgtgccctcagcagagcagtgctaaggagagtctagctcctggggcctaggtgggtggtggtgtctgtacacggtcttctcttattctacagagcttctgcacttgaaactacattgttcagcctgttttcctgacttaggttgctacagagtgttctgcaagccagcctacagccagcaaatgtttctgaaagtgttttctaggctttggaggaagttttttggagtagggatggggactggggggtggggggagagatcttggacaacatcctgcaaaaaaaaaaaaaaaaaaaaatctgcaaggattctgaatcccttagctttctactcttgcatgattttcaaggaactaatgttaccttttatccttgttttcattttcctgtcccttttatacattgtatcctcctctcttctcctgtgtcatggagtgtagaggaaataaaatcatgtctgtggctcatgacagcattccatattcagttgttgggttgtgttgttgttgttgtgtgtgtttttaataataccatgtaactgtttaaaaaaatttcctttttgatcaagtcccaaatctgccagcctgttctctcttcctaactgtggaaaaatgagacggttgcttgaacatttgttgggtaagtaaagcaatccatttcctctgtgaccatgtttgaagagttttgcgaacatttggggtctgtttgtaatagtgggtcttggctacaggagttgggggcttcattagcaggaacaaaataagggctttttaaagagtgtcttgattttaggtgactgtttgaatccactgtttttcctgataacctgcagctaggattgaagattatacttcctgtttaccctgagtcaggggagaaatgttcagttcattgtgacttgactctagacctttaatggggtttgtttggatattcaaactgtgagtaggtgatgtgcttgtgaaatgtcatgaaactgcttgttcttagaggtgcagagccctaaaaacattggtggtgtagaagctggtggtggtggtggtatgtgtgtgttgggggggtggtgtcagtgtgctcatgttttaggacttatgtatagtgcaaaatctcatctaccaccagactgggtttgattcaggactcactgaccaacacattttggccttttttcaggtctcctccacacatctgtatgcatgctggccccacataagatttctcactttttacatttcccttgaccacttaaggctgcagctagaagttaagtgggaaaagtagagtcttgtttagcagtaccttcagaatttccctagaagttcagtacataaattttcagcttggagaccaatccgacatgaccgtaaatgcaggaaatatattcaattgctgtgttatgtcaactttatggagtcagtaatcttttttctttcaaatgagtgtccagtagcccactttctgacaccgaattggaaaaaggctcatttaatcagcagaaacgtaccacattctaagttgagaaaagtctgtgcaaggcaggccagcttagcttcttagagtaaaactgcaggcagttaatgatgttatatacttaaaactgaacagtgccactgccccaaacaagtaagttcagacactcagctattttctttgttcttatctccttgctgtaaatggaaattacatatcgaggttcttgtggcctccctagaagcaatatctaatcataagactcctggtttggtgccttcaacgtttgcataatactgtgtttgttgggctggaagggaacttaagggcaaggcatttgtcctctaaaagcttgcattaaaatggctcccacaggtttggagagccaagatctgttttcaaatgtacagcccccagcaagttcccaaccctggaccaagctagccacttttcctctggtactgtgacccctaccaagcatgagtctgtaaaaagttaattgctttcaaagtagcattattttccagtttcaggaaagggggaaaaaaataaatgtctgcattgcagcaggactaggtagggacggcagtactggctcccagagcagcccaatggggttcttctactctagcttttaaaccaatagacttggaggaaaggttaaagattgacaattgcagtggccgaactaagaacgggccttctggaaatttctaccatctttgttccttttaggaaaagcagatctgccaagcagaagcgtctcctaccttccattcctaggtcatctcccttccctgcttccccccaaccccccttctttttctcatcaaggtagaatgttctctctgccacgtttgtaaattgcagaaggaggaacagaatgttgggctgttttcctttttccttctgcctcctcagtccccaaagaggatacacagctgcaaggagcaaacacagacacactgaagcttttgattcctctccttttttttccttcaagaccctccaggatggattcactttctgctttgggaaattaagtggcattcacgtgggggagggggagtaactgcttttattagctccagaaaatggtcagtgttcagtctgtaactaggaattaattatatataatcactcagtaaactttctacagagtttttctaattgctgagcctgatcatagttagcccgttggcgccaagtccagttacttttataattaacagctcaaagatttgagtcagaaagaaacaattgggggcctcttggattataaattagggatgaaaacaatagctttttttcctttctttcttgtcatcccttttattttcaacaaaacatttccccttttctttccctgggagaaccagtggggagactgcatcaggtcttaaataggatgaggggggagacactttttaggaagtggggtgacagtaacctagaaaaccctggaggcaaaggtaggtttttaaaagtccagccacttgcaacgcgtgatgtctttgtttcttttgccctctttccccttctctctcctgtggcagaggcagcagacatttgtcagcctgggaaccctcaatctggctttgcctctggttgactctggaaagaaagatacattcaaaggggccttcgctactgcacagcagagatttaaaaagggaatatgtttcagaaccctttggttactcttaaaatgcaagatctgagcaagggttcacccttggcttcaggttgctaaggttatggtcaccctccccgctacttcccactctccttgcagacaaacaaacaggcagtggccatgccagctctgcagccagtgtgctgccagcctgtcccccccatcccgattaccttacctaccggccggcgggggccagtggcccgtccttgccctggcatggccttgggcactgtgccctcctttctcccctggagctaaaaagcagtcaccttgaaactcctcactcccagcaccagaggagttctgaggccaatgctcagacctgtaacagtaaatgacgttatccactcaggctgttagttcggcctctgaaagcgggttttgcaaaacccattgttaattctcaggctctgttgggggtggtcagaaatctaatttgtgagtatcctgtgcattggataagggaatgttttccttgtgtttctcctctgcagactcggattgtctttccttgatgttaactgtcttaggactggctgcttcagagggctgggtatttggtggctgtttgcaggcttataaacagcctttttattttacctttgccgtagactgaggtgcagccctttagcttggcttttcagatgcctgctgtccttgaagcactttcattttacctagcgcctttttggtatggatgcaaagctggtttctaatagactgagaagagaagggggaccgggcttcctccttgccttcccccaggctgctccctgggaacatttttgtgtttgcacagacacctgtccgtctgcagtttgtgccacggggctgcacgattcctaaccttctacccacctaatttgagggcaagggggcctcatcacagagcctcatgttgaaggctcaggatctacaagagaaggcttttccttaggaacctgtgacttcacaaactctccctgtcattgcagagttttttttaagcttctaaacgttgggttgttggtgtcctttggttcagcttttcctagttctggtatttaggaaggtggctttgaaactcgcagggctgcttaaacaagagctacagctattgaacaaactgctaccattttagcttcaacacaggaatgaggcagtgttgccagacgccattttaagaatcctgcataaatagcttagctaccgatgactctgcctgttttaggtgagtgcttatataaagctgctctgctaaccattcccccccaccccaatttcttaaaaaattaattgtagatttagggaagcatggtttttaattttgatgttcactattttgtaatctagaagaggaagatgttatgccttggggattaaatatttcttacagcctggaccattttggtattttgaatgaaaagtaaaaaccaggaaaagtcctttcgaatgatgcatgattcttgaattgctgtgcgatgatcctcatctgtagaaccagagtcttgtgcatgttggttatatattctagatggcttagatactcttctttaaaagtcaaatagtaggggcacttggggaaaagaaatatgtgggcattgtgtattcaggcatttttctgtcaaaactagatgctttcttttttctctctcttggaagtgttgaggagatgagattcctgggaattacggaccatccctgagtcctcagaattaacaatcagaaggcttaaagcatcctggaggtgcagtagttcatctgcaacttttaattgctcttttttcagtgcatgcaggttaagaagtaagcataggttttcttgctcaggcactgggggagaaatcttttattctttttgggatgggatggggtggtcttggttatctttgcaggtactgttatttctttgaattgcctcaaatgtatcagtttgtgaaatctgcaggcaaatgacttgggtaaatgtgagtgtaagaggtggtggtgtatacaatgtatctaactagttgatggtgtattttcctattggagtgagaaattgtttgcttttcagctaattttacccttttctgtagcgggcccccagtttcctcaacagacctttaaagggaaaaaagtaatgtcagtttgaaacaagagcttgttgtcccattgtttttgatttaaatcatcagggttgctggaagctagcagatatggaaggaaataagctgtctatgttctaagactttaatgtgttaatgacagaagttcagagtattttctccagatgcagctgccttttctttttaagaattatttgactgttttttttcccccaaatgactgaacagttcttaacctaaattgaccaacatcagtggggcaattcagacaggtacagatcttttcttgcgcctacttttgatgtaatattcatttttttttcctaataacatactagttcttaacactaaatcaaaaaaaaacacacacacacacacaaaaaaaccgaaatcagtggtgtaggaaaaaggaagtccctttagatgtggctattcaaaatgactaattttgcattctggtctttgcttttgtaaatgaagttttttttttttttttttttttttctccttttaatgcatagacactgcagtttcctttagtcaaatacaagttaattgtgtgtgtgagtgtgcgtgcatgtgtgtgcacgggttccttttgaaaggatggtttgctgatctgtgaaaaagatggttttcttaaattgttgtgcttgaaatgctgtgctaaagctggtggtgctattgctaaagttgggtgattatggtgcccacttgtaatacttggaaagataaaacagcttaacttttttttccctctctcttctgctccagcattgattatcttaaaactcagaagcaaatagccaccacataactagtttgcattttcctcgtctctcagcagcattcctgcctgaagtattcagctcctctaggctgttacaagccaaataatggttcccttgaatgcagccttcctccatgatcaatacacctttgaatgttttcatcgctgcagaaatccttcaagtgggttttttttggctcagttctgcataattgtttccctcaccactgtagatttcagttggatcacagattagcgttttctctattactcaaaatatgggatcggtttcaagaagtttagaatttcacatacttcatgctagagagggaaacagaattctagttgctagaaaagatcaaggttgctatttgttcctttgaagttaactgtctacccatctccgagggctgcatggggctttttgttaagatgtatttccagtcaccccaagccagaacccatcaacagcatccagttggacaacctgtgtatgtttcaggcagagtgtttctgagttgagaatgttttctccttaagttggaatagaaagcattagtgctgaaataaccttcaataaatcaccgttgtattattgcatataagcgatgtgtttaaatttagcaggctgctttctcctgatgaaaaccatttgtgacaacatgtcagttgtttctttggtgatttgtgtcacaggctttctttacagatgcggtgtaaatgaaattgttaacggggttcaaaatcagatggctaaatgtgttaatattctcatttaaacccaactacctttcttcgtctccaagcccctataatttaactctgaactataatcttttccattctatctagctcccatcctaagtcctctcctcctaacgtggaactctcctaaaatcttctccttatactagggttcgagacatgaggctgtctttttgggccttttgcgttgtcacagtcccagaccacggaacattctctcttccccaggacaggacattctctcttccccagcctccttcctgtcctggcgttgagtcttccaaatggaaaattccagccatatcaattggtgatgcacccatttcttcctgtggaacgacagtctgatggaattgcttctggagtaaatgcccagcttcttaccacttcagtgtcagcctgaatgtttggaaagttctagcacctcaaaccatttgcatctatgaaagcagaactctattttttccctttggtttagcttgtgagttctctgtgggaggaagatctgatatggccggctctctttcaaccctagttccagcagagagagagagagaatgttctgggtgacggaccctcccagcaaaggggcttgctttatttgcttctctccccaaccctccactcttagcctttgtcttttgaataatccttcctcattccacttttgtggtgggggataattagtcacaactcagtagtaagccgtgcctgctgtagagaggaagcattcagggggttggaagtgtggagaccccagtctgattgctggaatcagtgctcctcggttcagtgttttgagaccaggtctttagcttctagctgggcatatttttctgctttgtaatttaacctgtatcttttttttcccatgttcctgcctcatcagggaattgtaagatttagggggaggtgtgggaaatcttactctttgccctaaagtattcagcgatcagaattctggataccctgcaaaacacctccaacctccctgcctttgaaccctgtgttaacaatgagaagcttgtttatttgaaggctgggttctcattggcccacaggggtaggttgtaattgtgtgtctaaaaaattgccttttgcattccccaatagcatgacaactggaatagtaatttgacttaaaaaaaaaaagaacaacctagtgttttaaaaaactcctttaggactcttcacactttgttgaaatcaggtgtgggtttcctcccccagccctggataaggatgagggaatgtctttaaggtgtgtttgttgctagaacttccaaatagctgcccccatggggcaagttctcagccttcctaaacatgaacataatttgctctgtttcagcttggctgaagaggaaataaaaacagaacaggaggtggtagagggcatggatatctctactcgctccaaaggtgagtaaaaatcttgtattatctattctagagctaaggaggaaattggaatttctttttgttgttgtagtgcagtgaagtgtgtggctctctgagccgacgttgtaactcttcttggattttcagatataagattttttgatggatgaacctaattgatggagaactctcctccttttggttttctttccctggtgcctgtgtaggggtcctgacagtgaattttacctgtgtgtcatgactgagggtggctggctacctctccgcagggtgactttcaggagccacagtttaaataaagcatgttctggaagccaccagagcctctagctgctgctcgttttctgattttaacaacagacctctttggaatcccagaagtgggatgaagtcagcccgcttcactggaaagtggtggtcttgggttagagataaaaaggaaatgtagagcttgctgggatgccggggccagtgtttgcatttagttcaaaatttagcaaattaggacaaacacaatttatgcgtttattcacaagcctggagtagactcctgaatatcttctaattgagggattggtacttttcatttggtctttgtgaaagagattttatgaggcttcccaaaatgaagcagttattcacttttaccttcagggtgctttcacaaatgagctactggagtatttttcgtatctttggttgatgaaaaggctcatctccaaacttaatggttgtaccaaggtgttttcattccttcaacaagtcactgagtgctttcttggaacacacagccttgcactgggggttatggggagggaggaagaggctggacagggttactgcatactgccggaaggagattctcatttggctgcagagtgtcgcacaaagtgactccctaaaggcgtctgaaaccaaaagcattttgaggattgttacaagacagcgtgtcgccaggcgtggtggctcatgcctgtaatcccagcactttgggaggccaaggcggaccatcacgaggtcaggcgttcgagaccagcctggccaacatggtgaaacccccgtctctactaaaaatacaaaaattagtcgggcatggtggcacgcgcctgtaatcctagctacttaggaggttgaggcaggagaatcacttgaacctgggaggcggaggttgcagtgagctgagatcgcaccactgcactccagcctgggcgacagagcaagactccatctcaaaaaaaaaaagacagtatgtcattttggggcaaagttgagggtccagtagtcaaggctgggacctgggaagcagaagctggctgctgatctctggcaggggtcacagaaggggaggcaccctgggtgggaaggcctggcttactgggtgggtgctgtgtgctggggagcagcaggaggaggctgggcggaggcagagggctgctgccccctcatcacagcatgacccagcctgtgctgggtggcaggaagtttcagtgccattgatggtgaagagagctgagccaccagggacttcagagcaaggaaggtaccttctcacagaggtgtttttgatgttgcaggagcacgtgcctctcagccacttctcagcccccttgttgtggtcagaatcaaatgtggtccatcaggagacggggcaaagtggagagggactgaagagagggggccaggagggtgggggtcttgtccctgttctgctgcttaccttccccagggggcttggacactggctctgtcccttcatttttgtatttgtgaagtggggtgttggattagattctatccaagcatgaccaagctgagtgaccattgtctctttctctcttttctcctactcccatcctcacccttcagcagccagaatgcgcttcaaaaacgtggattggggtcaggcacagtggcgcatgccaatcatcccagctacttgagagactgaagtgggaggatcagttgaggccaggagtttgaaaccagcctgggcaacttaacgagacccccccctcccgcccccatctctattaaaaaaaaaaaagtggacagagtgcgttggctcacgcctgtaatcttagcactttgggagggcgaggcgggtggattgtctgagctcaggagttcgagaccagcctgggcaacacggtgaaaccccatctctactaaaatacaaaaaaattatctgggcgtggcagcatgtgcctataatcccagttacttgggaggctgaagcaggagaattgcttgaacccaggaggcggaggttgcagtgagccaagaccacgcctttgcactccggcctaggggacagagcgagactccgtcttaaaaaaaaaaaaaaaaaaagtgggtcaggttctgtctcattttgctaactccttctgatgattttccagtacccttccactcaggtctgaagtcaccgtgacctgcctacctgggccggccctgtttacctttgtttcctttgtgatgttctgttcaccttgtgccatttctcccccaacttcacttgagctccttggcctccttcctcttggttccttccttggggcccctgtgtgtcttttgccaggagcaggctgcccatttctcattgtgatctcagacttatctcagatggtggctcctcaaagaggcttttggtggccacggagtctgaaggagtcatttcattattttctgttttaaatatatatataaaagacaacgtctcactgcactgtcctggctagagtgcactggtatgatcatagctcactgtatccttgatctcctgggctcaaagctcactgtagcctcaatctcctgggctcaagctatcttcccacctcagcctcctgagtagctgggactacaggtgcacaccacctcacctggctaattaaaaaaattttttttttgtagggatgaggtcgcagtgggttgcccaggctggtctgaaacccttggcctcaagtgatcctccctctttgacctcccaaagtgctgggattataggcatgtgccaccatgcctggccaattttctattacatttttaaaatgaacttttaatttaacagtagtattagatttccagaaaagttttgaggatagtgccaagagttcccatgttagcccctggctccacacacacaatttcttctattattaacatcatacactagtgtggtgtaattgttacaaataatgcatcaattttgatatgttattaccaactaaaggccatcccttattcagatttccttcggtttcccacaaaagtcccttttccgttttagaatcccactcaggattcctcattacatttagttgtctgcctgggctcctgttggctgtgacagtttcttagacttttcttgtttttgtggaacttaccggttttcaggaatactggtcgggtattttgtagattgtcctgtcaattgggatttgtataatgtgtttctcatgattagactctggtaaactgtggttatgggttttggggaggaagaagactacagagggtaaaatgccattttcatcatatcacatcaagggtatgtattattaataagatctatcactgttggccttgtgcagtggctcacacctgtaatctcagcactttgggaggccaaggtggggggatcatctgaggtcaagagttcgagaccatcctggccaacatggtgaaaccctgcctctattaaaaatacaaaaattagctgggtgtggtggcaggcacctctagtcgcaactactcgggaggctgaggcaggagaatcacttgaacccggggtggagggggtggagacggaggttgtagttagctgagaccatgccactgcactccagtctgggagatagaatgagactatctcaaaaagaaaaaaaaaaaaaaaaaaaaagatttatcactgttgatgttgaccatgaccatctggctgtctttcttctctttccatcctctgctctttggaaggaagtcacaaggcatcacccacacttaaggagtgaagagctatgctccacctcctcgaaagcagaggcttgacataaattatttgggggctggatgtggtggctcatgcctgtaatcccagcactttgggaggccaaggcgggcagatcacttgaggccaggagttcgagaccagcctggccaacgtggcaaaatcccatctctactaaaaataacaaacattgtatgcctataatcccagctacttgggagactgaagcagaaaaatcacttgaacccgagaggcggaggttgcagtgagccaagattccaccactgcactccagcctgggtgacagtgacactgtgtctcaaaaaaaaaaatttagaattcttctgtatggggtattagtcttttctccctcatgtatttattcagtcatttatctctagcagtgtggactctgggatggttactttatactgtgggttgtaatccaatactacttatttattttattgctcaaatcattccagctttggcagttgggagctctttgtgttggctcttgtgtccccttgacagactccatcgttgtggggtttatttatttgttcgtttgagacagcctcgttctgctgcccaggctggagtgcagtggtataatcacagctcattgcagccttgacctgctggactcaagcagtcctcttgcctcagcctcccaagtagctgggaccacaggcatgcatcaccacagttggctaatttttgttctttttatttgtagagatggagtctcgctgtgttgcccaggctggttttgaatttcccaggctcaagtgatcctaccactttggcctcccaaagtgctggggttacaggtgtgaaccaccatgcccggctggcctatttatttatttattgagcactttcttgtcttctggcactataagatgttccaggctcattttgtatgtctttgcctcagccctaaaatcatccatttctctatggatcctggtttctttctttcttttcttttttttttttttttgagatgtagtcttgctctgttgccgaggctggagtgcggtggtgtgatctcagcttactgtgacttccacctcctagttcaagcaattcctctgctccagcctccatagtagctgggattacaggcacatgtcaccatgcccggctaatttttttgtatttgtagtagaggcggggtttcaccatgttggccaggctagtctcgaactcctgacctcaggcaatccgcctgcctcagcctcccaaagtgctgggattacaggcatgagcctccgtgcccagctttttttttttttctttgagacagaatctcgctctgtctcccaggctggagtgcagttggcgcgatcttggctcactgcaacctccacttccctggttcaagcaattcccctgcctcagcctcccgagtaactgggattgcaggagcgcaccaccacgcctggctaatttttttgtatttttagtagaggcagggtttcaccatgttggccaggctagtctcgaactcttgacctcaggtaatccgcccgcctcggcctcccaaagtgctgggattacaggtgtgagccaccgcacccagaggatcctggtttcttttattggagaatagtattagaaaccaagatgtgggcactaagtgtgctcgtttttgtttgtttgtttgttcgtttttgagatggagtttccctctgttgcccaggctggagtgcagtggcacaatctcggctcattgcaacctctgcctcctggtttcaaatgattctcctgcctcagcctcctgagcagctgggactacaggcacacaccaccacgcctggctaagttttgtattttttttttttgagacggagtcacgccctgtcacccaggctggagtgcagtggcgcgatctccgctcactgcaagctccgcctcccgggttcacgccattctcctgcctcagcctcccaagtagctgggattacaggcgcccgccaccacgcccggctaattttttgtatttttagtagagacagggtttccccatgttaggcaggatggtctcgatctcctgacctcgtgatccacccgcctcagcctcccaaagtgctgggattacaggcacgagccaccgcgcccggccaagttttgtatttttagtagagatggggtttcactatgttggccaggctggtctggaacttctgaccttgtgatcctcccacctcggcctcccaaagtgctgggattgtaggcatgaaccaccgcacctggccaagtgtgtgctcattgctactggaatgtctttgttctagattctttttttttttttttttttgagatggagtctcgctctgtcacctaggctggaatgcagtggtgcactctcagctaactgcaacccctgcctcccaggttcaagcaattcttctgccccagccttctaagtagctgggactataggtatgcaccaccatgcctggctaatttttaaatttttagtagagatggggttttgccatgttagccaggctagtctcgaactcctgacctcaagtgatctgcccacctcggccttccaaagtgctgggattataggtgtgagccaccttgcttctagattttctcagtagacaaggaaggatatatagacatactgtgtaaacatttttacatgtatccatctgtgtctatatcagctaaacatgagttcattctctcgtttgaccttttcgcattaccacatggatcattctagccttattccctggtttctctgtaacctcctcctccaacagtgagaaggctggcttctactgtccaccgtttgtttactattttctggtacattttaacctgatctacagtgttcagtctgatgaactttaacacacgttcgcactcatggggccctgacccagatcaagataattaaacatttccagcatccagagcgtcctctatccctctgattttgtttatagcctttgtcctcactttgtattttcttatttgttactctgctagaatgctggctgctgtattttttttttttttacattaaaaaaaatactttttgagacagagtcttgctctgttgcccaggctggagtgcagtggcttgaccttggctcgctgcaaccttcatttcccgggttcaagtgattctcctgcctcagcctcctgagtagctggggcatacgccgccacacccagctaattttttaatttttagtagagatgggttttcaccatgttggccaggctggtctcgaactcctgatctcaagtgatctgctcgcctcagcctcccaaagtggtgggattgtaggcgtgagccaccacgcctccggcctttttttttttttaagacatggaatctcactgtgttgcgcaggctgcagtgtagtgcagtggttattcacagttgccatcatagtacactatagcctctaactcctgggctcaggtgattctcttgcttcagcctcccgagtagctgggactgtaagtgcgcaccatggtttcaagttccctctttaagcacccctggaccaccattcttacttaccccaatgatttgagaggcaaggtgtcattgagatttaaaacacctggcttctggctgggtggcttatgcctgtaatcccagcactttgggaggccaagcactttgagaggcggatcatgaggtcaggagtttgagaccagcctggccaatatggtgaaacccagtgtccactaaaaatagaaaattagctgggtgtggtggcaggcacctgtaatctcagctactcaggaggctgaggcaggggaatcgctggaaaccaggaggcagaggttgcagggagctgagatcgtgcccctgcactccagcctgggtgacagagtgagactccgtctcaaaaaaaaacaaaaaccacctggcttctagagccagatttcctggttctgtcttgccccctttctagctgagttattccttgtggctaggtttccttttgtaaatggggatgataaagatagaaggttatggctaagatgaactttgctcacacagatagaatgctcagaatggttcttggggccgggtgtggtgcctcactcacgcctgtgatcccagcattttgggaagccgaggtgggcggatcatgaggtaaggagatcgagaccatcctggctaacatggtgaaaccccgtctctactaaaaatacaaaaaattagccaggcgtggtcgcgggtgcctgtagtcccagctactcaggaggctgaggcaggagaatggcgtgaacccgggaggcggagcttgcagtgagcagagattgcgccactgcactccagcctgggcgacagagtgagactccgtctcaaaaaagaatggttcttgggacagggtggctgctcaaaaatgttagctatgatttgcatcaacttagagacagtgaatttttattgctaggtctgtcaggtggtgagaatgactgttctgccatttcccccacttgcagcctctaggaagaaggtctggaggcagatgaggaaaccatgcccggaagaccccctgcttagagggggcacagtgaagaattgtgggccgggcactgtggctcatgcctgtaatcccagcactttgggaggccgaggcgggcggatcacaaggtcaggagatcgagaccattttggccaacacagtgaaaccccgtctctactaaaaatacaaaaaattagccgggcgtggaggtgggcgcctgtagtcctagctacttgggaggttgaggcaggaaaatggcatgaacctgggaggcagagcttgcagtgagccaagatcacgccactgcactccagcctgggtgacagagcgagactctgtctcacaaaaaaaaaaaaaaaaagaaataattgtgtagggttgcccagcaggcaggctcgggaccagataggaatttgcttctctccatctaggagtccagtgctttgcactgccctgcaagcttcctgtcctgttggcctctgtgacatttgaagaagccattctgcaggtgtttggaaggattttctcgggtgcttgggaattcttgctttggtagggaatcattgaggggaagggatcaccttgttttgagggagaactttccccaaggattctctggggtggttgtcgttatgtgaaactgagctctcgtgccccatagtgagtggcggtggtggtagcttctgtttccagagcacctttctgccggagccacttggcttaatattcaaagtcctggggttaagattggggttgctgaggttcccagagctgaagtctgcatggtgaaaatatgatgtctgtgaagctgaccgggatgaagccttatctcttgttcagtcccagtgatctcagcgtccgcagtgggatgatctccaggctcagtgaacatgtttttttttttcctccagcctgcttttcttgggaagtttagggactctgttcccctgtgacatgacccgggtcagggtccttcggttctgagcaggaaagggatggactgcaggtggtctgttggtgtgaagctgctcccactgcattggtgggaaggctggaggtccaggccactctcgggagtagagccagcccggagcctcctcagggacaatagcgcaaagtccatgtgcacgtctctggccagggaagggctaatatcctggacacctggacccaccaacgctgtccccactgggaaagagatgggtcctcaaaaggagataaggtgaccactctaccatcttatgaacctggcaacgtgtttttctctacttgcacttagaaaacaggtgctgagccgtcctcttcttgggaaacttagaaactctgacaataattggtgcagaattcctcagtcctattcctacatctagtccatgtgacctttcagtttctctaactgaatttcaatttttacgcccctctccccttgacacatactcacttattaactgagtaattcccaagccagtcattgccattatgccagccttggcatttagtagagcgttttagctctcaggagacaaagctttcgagctttcaagatgtcaggttgacatttgtgtccgagggtaatgatcctgctgaaagatgctcctacatcaatgggaagtgccatctcgatgccaggtgtgtttgcgtggctaatattttctgagtacttcatggcatgatatgcaaattacttcatttaattttcatactaattccatgatgtgggtgtgtcattcccattttacagttaaggaaactgaggctcagatgaattaaggaagtgtcaaagtagggatggaactagggtcaggttttatctttatttatttattaattatatagagggttattgccgtgttgcccaggctgctcttgaactcgtgggctcaagggatccacctacctcggctttccaaagtgctaggtttacaggcgtgagccaccactcccggccctttgatttattttattttattttatttatttatttttttgagacagagtctccctccatcacccaggctggagtgcctatctcggcttactgcagcctccgcctcctggattcaattgattctcgtgtctcagcctccggtgtagctggggttacaggcgcctgccaccacgcccggctaatttttgtatttttagtagagacagggtttcactgtgttggccaggctggtctcgaattcctgacctcaggtgatccacccgccttggcctcccaaagtgctgggattacaggcgtgagccaccgtgcctggctggccctttgatttttaaacctttttttttttttttgataagagtgtttaatgtccctagattttaaacctttgtacttaaccatgacctgtattccaagggttgcaagtcaaatgcctgaagggcccagcaggtagatcagtgattgtggctggcatctggggatgcagggggaaggggagctttggtgaatgggagagtgtgccaaagtggggagggtgcctccatctgattgctgaccagcaggaatatggctcatccgctgtggccagctgggattttcttttcccctgtaaaactgcctcatttagaaatgtggtctgtgtagactggcttctctaaagatcatgcgtgaacccaacaaaacgcatttccgggtcagaagaagccgagggctgtcattttgcattccctgtgcgagactggccaaggcacaattcattgcagaatttggcctcaccatgcgtgagtcagaacaagcgccttgaaggccagggatttgcagcctgagaaatgatgtactccgcgggttgaattcacgtctccatacaaaggctcccctgtttgggctgcttgcgtcttgatcctgccatgtgtgcgttttgtggtagtgcttgtggtgtgtggatgccagcctgccaaagctgaaaccatttttaaaaatgtctgtgtaatgtcaccggcacaagggaatgaacgacttggaaacacgcacagatgcagcggaagcccaggatattaaaatcttgaacagtatcattcttgctgagatttgctgggggtatggatgtgttttcagagacaggatgctagagaatgtacaattatagcaatttgctaaccagccccagaccttaattagcacaggatccttgttctcactgttgtatgtaaattaagactttcacaaagggattgtttatgaggacggctgtgagatagagaccttctgtcatttttcaaggaaactctttcagaaaatataaccacaaacacttttaaatcacagcgcgatgcagaagtgctgagaatttttctttcaaaaaatgagcatcagtatttttaaccgtattttggctcctctctatctctgacagcccaagaagtgccatccgtgtactgtgcagtggaaagaatttatttgtgagttagatgactaccagattgttcctctcctaacaaggtctaaaatatcccagaactctgaagatgtctgattatggttttgcaaatgagaaatcttctaccttctcttggccagcatcgtctctactgtgcatctgttcatggaatcctgtcggcagtgtctgtgcaatttagctttgtggttcactcatgcaaaccttgtgtttgccccatttttgaagcatgacccacgttatatgtttgtgtgactattattattctagaagactgtgatctaaaatcgaccgtttcaagcttagtttaaaaagaaccatctcttctttttcctctctaaatgcctgtagaataagcatatcagggctgaggccttttagagatctgggtactttttattgccttattaaagtcgtcattccttcattgttctctattgatagtggatcctttaccgatgacttgaggtgatcagtttggaaagaccaggtgtcatggctgtgggggggtgagggtgagtggaatgataataagcccccttcaacttcctgtgactcccctcacctatcctgggctttcctgggaacctagagatccagcgctttatagacttaaaaaaaaaatacctttattgacatataattcacataccatacaattctcctttttttttgtttgtttgtttgagacagggtctctctctgtcgcccaagctggagtgcagtgggacgatctcggctcactgcagctttgatttcctggctcaagcagtcctcccactgcagcctcccgagtagctgggactacaggtgtgcactaccacccctggctaatgtttatatttttttgtagagatgaggtttcactatgttgcccaggctggtcttgaactcctgggctcaagcgatcctcctgtcttggcctcccaaagtgctgggattgctggtgtgagccaccactcctgggcccagttctccatttaaagtgaatagtttgatggtttttaatatattttcacggagaccgggtgtggtggctgacgcctgtaatcccagcactttgggaggccgaggcgggtggatcacctgaggtcaggagttccgaccagcctggccaacatggtgaaaccctgtctccactaaaaatacaaaaaattagctgagtgtggtggcgtgtgcctgtaatcccagctactcagcaggctgaggcgggagaattgcttgaacgtgggacgtggaggttgcagtgagccaagatcgtgccactgtactccagcccgggtgacagagcaagactgcctaaaatatatatatatatatatatatttttttttttcacagagttgtgcagccaacagcacaatcagttgtagattttcatcacccccaataagaaacttcatactcattagcagtcacttcccattcccccgttacccctgtgcctggcaagtaccagtctactttctgtgcctgtggatttgcttatgctagacatttcatataaatggaatcatacagtatgtgaccttttggtctgagttcgttcacttagaataatgttttcaaggctcatccacattcttgtagcatagatcatcagtacagacagttcctgacttatagtggtgcggaagtgacagttcagtacaaacagtacttggcattttggatttttgatcttttctctggctagcatcagtatgagactctcttggggtgccaggcacctcccagtcagccacatgatcacgagggtaaacaaacaatctatacgaccattctgttttcactttcattatggtattccataaattacatgagagagtcaacactattatacaataggcttcgcattagatgattttgcctaactctaagtgttctgagcacatttaaggtaggctaggctaagctatgatgttccctaggttatgtatattcgatgcttatttatttatttattcatttattcattcctccctccttccctttcttaatttccttttttttcttttttttttgagatggagtctcactttgtcacccaggctggagtgcagtggcactatctcagctcactgcacccctctgcttcctggttcaagcgattctcctgcctcagcctcctgagtagctgggactagaggtgagcaccatcacgcccagctaatgttttttttttttttttttttttttttttttttgagacggagtctcgctctgtcaccaggctagagtgcagtggcactatctcgtgtcactgcaacctttgcctcccaggttcaagcgattctcctgccttagtctcccgaggagctgggactacaggcatgtgccaccacgcccagctaatttttgtatgtttagtagagacgaggtttcaccatgttggccaggatggtctcaatctcttgatgtgatccacctgcctcggcctcccaaagtgttgggattacagatgagagccactgtgccctgccatgtatttttagtagagacggggtttcacctgttggccaggctggtcttgaactcctgacctcaagtgatctgcctccctcagtctctcaaagtgctgcctgccttactttctgatggggtctcacgatgttgcccaggctggagtgcaatggtgtcctcaagggatcctctggtgtagctgggactacaggagtgtaccactatgtctggcttaaatgcatttgtgtttttttatctctctctctctcatatatatatgttttgtagacccaggggtctcactgtgttgcctaggctggtctggaactcttgggctcaagtgatcctctggccttagtctcctgaagtgttgggattacaggcatgagccactgtgtgtgacctcatttttgacttctggtacttacattttatgggtttatcatctgtaactccatcgtgagttgaggagggtctgtagttcatttccttttatgactgaataatgctgcattggatggatatgctacactttgtttatctatgtatgtgttgatggacgtttgagttgtgtccactttctggctagtagggataatgctgcggtgagtgttcatgtctgagtttttgtgcagacacgacacatcatttctcttgggtatagatttaggagtgaaattgtggggtcatagggtaactattaaccttttgaagaatatacacatttaaattttttgtgttgtctttatttatttttttgagataggggcttgctctgttccccagacgggagtgcagtggcatgatcctcgctcactgcagccatgaacttctgggctcaagcaatcctcccatctcagcctcttgagtagctgggactacctgtacatgccaccatgcctgactaattctttaattttttgtagcgacagagtcttgctatgttgcccaggctggtctccaactcatgggctcaagtgatcctcctgccttggcctgccaacgtactgggattataggtgtgatccaccatgcttggagtcacagacttttaaaggcacttgtctcccctctctgctgtcttgacccccacatctttcctactagcaactgctgtatttctgtcctcttcttcaaagccaaacttattttttttttgagattgagtctcactatattgcccaggctggagtgcagtggcacaattttggctcactacaacctctgcctcccgggttcaaatgattctcatgtctcagcctcctgagtagctgggattataggcgcacgtcaccatgctcggctaatttttgtatttttagtagagacggggtttcaccatgttggtcaggctggtcttgaactcctgacctcgtgatccgcctgcctcagccttccaaagtgtattttttacactttttgtatttttagtagagacggggtttcaccatgttggtcaggctggtcttgaactcctgacctcatgatctgcctgcctcagccttccaaagtgctgggattacaggcgtgagccaccgcgtccagcaagccaaacttcttagaagcgtctgtattcctgtctttgtcctgcaagctccaatgtggcttccaccctgaccttccacattcacatccccactgagcttcctggagactctgtgttgccttttccaggggaggttttccatcctcatctgctgcgctgtctctgcagtactggagatgctgattattcttgtggacactctctcttcctttgccttctttgccaccgcagtgctgattttccttctgtttccctggcaccttctcctcctctctctggccattaaatgctggagttgctgaaagcttggccctgtccttgtctcgcctagcacgttccttctctgggtgatcttacccacatctggagctttatgactcagacatttatgtttccaacctagattgcttctgagtcatggtgcagagggtcagctgcctacctgacctccctgcctgttcatgggcgtctcaaactcaagatgtccatgagagattttacatcttcacccccagagatatggactcattccccattcttctgttctttgcccttttgtgtcattttcttacaatatcgtatcctaaatgtcactccacttcaaccagcctatcaccattgaactacagtggcctcgtagttgttctcactatctctatctgccgcaccctcccagtcttttgaaaggaacatcttcctggctatcccttcctactttaaactcttaagtgtttcctccttggcttttagattcataattgcaaaaccctcctgtgctggcctctgcccatcttgctagtctctgttctctctgtgttccattctctccgtgttccgttctctctgtgttccacttctctccgtgttccacttctctcttctccagccacactgactgtgcagatccatcaaagcctcagggcctttgcccataccttgaaggtcccctccttgccttcctctccttactccccatcaattttaaggctcaaaatgaggatgagttctgccttttgtttttgctcatcctgttttactaccaccttgcctgctgctggtgagcgtataataaatatttttttgaatgaacaaatgatttagctctatcagatgggtagaacttctatcctagagactgaagtaaaagcagcctttcggcgagagaggatggctttgttttcagcattaatccagtgcctggagattattacccagctcaagtgtctgttctctgcaaagcgactggtggcctgtcttccttttccctctagggacatagtactctttgaaatggccctttccccctggtttctttgctttctgacatattagtataacttctaatgggcgccttctaaaacacaagtcagattgtcccactctcctttaaatttgcagtggctccttaagaacacagccttaagggcatggtgtctcacgcctgtaatcccagcattttgggaggctgaggcaggaggatagcttaagcccaggagttcaagaccagcctgggcaaagtggcaagacccacccgttcctacaaaaaaaaaaaaaaaaaaaagcaaaaaacccaggcatggtggcttgtctctgcagacccagctacttgggaggctgaggtgggaggatatcttgagcccagaaggtggagcctgcagtgagctatgatcttgccactgcactgcaggggtcctgcagcatctgtctttcctggacagactgcacggccttgtgagagtcctgtgatgtgcaccttgctgagacacacttggcattgccttccagactgaccttcgtgaggaccatcctcactgtgtccatggagacccaagccctctcttggcctgaaccctttatttacagtctcccacagagaagttcttttaggttccaaagtcaaaaatcactcttcaaagtaccttaaattgcccacgaaagtattcagctttgatcagaaattcgtatgcatactaaagagttaacaattgccaggctagactaaaggagtgaaaggtgaatccatattcacatttccctgcatccggtgccttgaattcaactactcagtccctagaggcaaattgggatgggtggatgattgtgcagtgtcctgcttgcttgccaggcatgcttctttgtcttaatattaagcttctgcagctgtgctgtccaacacagtcgccactagctgtacgtggctctttaaatttacattaacaagccaggcgtggtggctcacgcctgtaatcccagcactttgggagggcaaggtgggtggatcacctgaggttgggagtttgagaccagcctgaccaacatggagaaaccccgcctctactaaaaatacagaattagccaggcatggtggtgcatgcctgtaatcccagctactcaggaggatgaggctggagaatcgcttgaactcgggaggaggaggttgcggtgagctgagatcacgccattgcactccagcctgggcaataagagcaaaactccatctccaaaaaaaaaaattagatttacaaaataaaattcattcctcagctgccctggccacgtgtcaagtgtctgacagccacaggtgattagaggctgctgttattagacagcactgatagagaacagatcgagaacattgccatcattcgagcaagcttgattggatcacactgttccgtagccttagtagattaatggatttgttgtgcatgctgtgctgaatgctgtaggtgaagctatgtcgccaggggacacagcactgaacatgttccatgcatgattattgagttttaagttttgcttggtcattgcctcctgagcttgcctattctttgaaaagttgtgcagagaacacagtcctctttctatctttgcaagttggtgtgttttgttcaggccctgctgaattccctttttgccaggccccttggcacctaggcctgactggggtaaagttccacaggatatgccagggagctgggcggtcctccctccagccttcaacatgctttaccgtaattatgcatttacctgtgtgtctcttctagactgatagaccaaataactctcacctctttagactaacaagggactggcatttcatggtagttgcccattaaatgttttgtgaatgaaggatctcttccaagaactggaaactaacttggccaggcacggtggctcatgcctggaatcccagcactttgggaggccagtgcattacctgaggtcaggagttcaagaccagcctggccaagatggtgaaaccctgtctctactaaaaatacaaaaattagctgggtgtggtggcacgcgcctgtaatcccagctactcgggaggctgaggcaggagaatcgcttgaacctgggaggcagaggttgtagtgagctgagatcatgccactgcactccagcttggacaacagactctgtctcgaaaaaaaaaagaattaactttttgtggggtggcagaggggttaaggtttattggattttcctttcaaatgataaaaatcagtgtatctccttgacaacaagccaaagtatacaaagaaaaagctaaaaatcttctcctgccaggtaaccagtgataacagtttggtatgtttttgtctataccaccctctccatgcttataaaaatgtcaaaaaacttatgcaatacctataatggggttgaactttctaggacctggccatcctagcaaaacatcccttgtctctgatccctctctttaccttattatccttctctgcttcccctgtcctgttacaccctttaagggcctttcaagtttagatttaatgatctagggtagtcatggtagctcatgcctgtagtcccagcattttgggaggccaaggcaggagacttactggagcccgggagttcaagaccagcctgggcaacatagtgagacctcatctctgaaataaaaaaaaattgctgagcttggtggcatgcacctgtagcctcagctacgtgggaggctgaggccggaggatcacttgagcccaggaggtcaaggctgcagtgagctgtgattgcaccactgcactccaggctgggcgacggagcaagacctgtttctggaaaaacaaacaaaaaaacaataagttatagatttaattatctgaaagttaagaataatggagacctcggcaaacagggattctggagttctacccaaagtgggcaggcgggaggattgttccatgtgggaatagggggccctatgtggagggatcttgtgattttcttttctttcctttttgagtcttactctgccgcgcaggctgaagtgcagtggcacaaactctgctcagtgcaatctttgcctcctgggttcaagcaattctcctgcctcagcctcccaagtagctggaactacaggtgtgtgccaccacgcctggctaatatttttgtatttttagtagaggcagggtttcatcatgttggccaggctgctctgaaacccctgacttcaaacgatctgcctgccttggcctcccaaagtgctgggattacaggtgtgagccaccgcacctggcctattttttctttaaccccttgtttcatctgtgaatgaccttattttaaaagagaagctagagcttctctttaaaggcggtggctcacgtctgtaatcccagcactttgggaggctgaggtgggcggtcgggagttggagaccagcctggccaacatggtgaaaccccatctctactaaaaatacaaaattagccaggcgtggtggtgcatgcctgtaattccagctactagggaggctgactggtttcctggccactgattgctccttttccagatcactggttcaccgcatcagctgtaagtagtgctctcttcctaataaggctgacctggttttgcgcaccacctccttaatgaccctcccgtaactccccatccccagacttcaagtttgggtacagtcacttcaaaccaggttgctatttcttgacttgggaccagatacagtagcagttgataagagccgagggactgtgttgtaagacaaatatttatcttgaaaatctagacccgtcttatgcctggtgtgatgctgacactctgagaagctcgagggaactagatggagacaggaaggagcagactgaatatctcttgactcatttccatgggatgcagggaagatgaacttgaaaaataattttttgcttttcccagtcgaagctgagcctgtctgcacatagatcagtacctgtatctgatccctgcttctcatagcaggggcagacttggagaacccagagggagactgaggatctacggaggttttggaaaaagagatcctcagactcagacgtataagaaaaagggcccagaaccaagactgaagatttggttaaatggccatctcagtggcgggtctcctagaagggaatatgttttccctggagaaagtcatgcctcttttatttttattttttgaactgctaaataattctgaaacaatagctctcctcaagaataactgggaggccgggcatggtggctcacgcctggaatcccagctctttgggaggccgaggcgggtggatcacctgaggtcaggagttcgagaccagcctgggcaacgtggtgaaaccccatctctactaaaaaatacaaaaactagctggtgggctggatgtggtggctcatgcctgtaatcccatcactttgggaggccgaggcaggcggatcacgaggtcaggagttcaagaccagcctggccaacatggtgaaaccctgtctctactaagaaatacaaagaattagccgggcgtggtagcgggcacctgtaatcccagctactcaagaggctgaggcaggagaattgcttgaacttgggaggcagaggtttcagtgagctgagactgcaccattgcactccagcctgagccacatgcaatactccatctcaaaaaaataaatagataaataaataaaataaaataaaattagctgggtgtggtggcatgtgcctgtaatcccagttactcaggaggctgaggcaggagaattgcttgaatcaggaggtggagattgtgccattgcactccagcctgggcaacaagaacgaaactctgtctcagaaaaaaaaaacaaaacaaaatggaaaaagaataattgagagaatgagtaaattggttgtcttagaaaaacctcctgagatatccccctttgatttttcagtaattgcatttagctgaatggccccatcccattcaagttataaatctttacttactcccctgcttttgggggaaatgggttctttaggcaagagaatggctgagtacctgttgaaaggagaatgtcctgttctggggtccctttcagaggccgacgtgaccaggctcccatttgtgtaatcttccctgttgacttcgctaccctgctgccttcctgatttgctggaagaaattcttagactggggaagaaaaactggagtttgctgagtcaggttggctggcccacctgtacagggctttgttaaccctgtacagtcgctcagttagtcggtctgatatgtactttggggtacttccgagccaggccatgtacctggcactgggctacagcaaagaaggatggacaagctgagattgagctcacactctggagggagagacacaataaaccagtgaaccagcagaagaggaaaataatttttgataattttcaactatgggccaggtgtggtggctcacgcttgtaattgcagtactttgggaggccgaggtgggtgaatcacctgaggtcaggagtttgagagcagcctggcaaacatggtgaaaccccgtctctaccaaaaatacaaaaattagctgggcgtggtggcgcacgcctgtagtcccagctactcgagaggctgaggcaggagaatggcttgaacccaggaggtggaagttgcagtgagccaaggtcacaccattgtactccagcttgggcaacagagcgagactcctcaaaaaataaaaaataaaaaataattttcacctatatatgactgtaatgaagggaaaaaaataacttcaggattatataataaggagtctggaggctggaggctggggtggtcagagaaggcctctctagggcagtgagccaaaagatgaagtggcagctatggagaggactgggcacagaacattatagatgaaggggccagccgcatgcgaaggagcttgtctaaggagctgaaaggaggccattggggttggagctgagtgaatgaaggagagaaggtgggcaggatcaggtcaccaggggcactgcaggtcttcataagaccttaggtgtctacagtaagctctttgagggttttaagcagggagtgcactatcttattgaggtttttatttacttttttattttttgagacagagcttcttgttgcccaggctggagtgcagtggctcgatctcggctcactacagcctccgcctcccaggttcaagcgattctcctgcctcagcctcccgagtaggtgggattacaggcacccgccaccatgcctggctaattttttgtattttttagtagagatggggttttaccatgttggcctggctggtctcgaactcctgacttcaggtgatccacctgccttggcctcccaaagtgctgggattacagacgtgagacaccacgaccggtaaaggtttggcattctttttttttttttttttttgagacagagtctcgctctggcgcccaggttggagtgcaatggcatgatctcggcttatggcaacctccgcctcccgggttcaagtgattctcctgccttagccccccgagcagctgggattacaggcgtcctccaccaccacacccagctaatttttgtatttgtagtggagacaggttttcaccatgttggccaggatggtctcgatctcttgactttgtgatccatcagcctcggcctcccaaagtgctgggattacaggcgtgagccaccacgcccggccaggtttggcattcttaataacacttggcagatgactaggactctgaggctcagagaggtgaagtaacctgttgggacacacagccatgtgagccaggaccagctctctccctagcttgatgagcctcatttgagtggagaggggagtgcagttggaggagtcctgggggaaggtcagtggaggtggggtggggctgggattgtgggccatctggagaattctgctttgattttcaaggaagttctgagccctggagggattttgagcctggcttccttgagctcctgacagcctgagggggtttattgtgaatatttgtgtttctcatcagtgaaccctttttaaaaacaggcttggaagaggtagtctggtgaaggtacagaaagatttgggggccaggtgcaacagctcatgcctgtagtcctagtactttgagaggctgaggtgggaggatcacttgaccccagaagtttgagactaggagatcccatcgctacgaaaaataaaaaattaagtggtcatggtattgcacaccgtggtgttagctacttgggagcctgaggtgggaggatcgcttgaacctgggaggttgaggctgcagtgagccatgactgtgccactgtcctgcagcctggctgacagagtgagtccctgtctcccccaaaaaagagaaaagttgggggaaatgagtttgaaatttctcggttattgcctttttctgtgccctggccccctcttccccccaggagaataatggtaataaagtatggtgctttgatgtgccagatgcctttcattcactttgtatgcattatcttatttaatcctcacaacccttttgggaagagcctaatagttccaactgaatgactgagtcacagagaggctaagaaacttgcccaaggtcacacagctggcaggtgccagcacctggattcagacctagtagtctggctccagagcccacacactgaacgacaatgctgtgttgacgttggccaatgccaagcatgccctttgtgatggagaattaccaggtggcactcacaagcctaggagagacagttgacctgtacagtgaagggctttagagtggaactcaaccgtgatggaggtggggcgtgctgtgtcgatctgcttgtcttgaagcatataaatgactttgcctctctgagcctcacctataaaatgggtacagaaataccatcctggctgggtgtggtggctcacgcctgtaatcccagcactttgggaggccgaggcaggtggatcacgaggtcaggagatcgagaccatcctggccaacatagtgaaaatgggtgtggtggtacgtgcctgtagtcccagctacttgggagactgaggcaggggaatcacttgaacccaggaggcggaggtcgcagtgagccaagatcgcgccactgcactccagcctggagacagagtgagattctgtgctgaaaaaaaaaaaaaaaaaaaagaaatgccatcccaacctcttgggattcttgggacagtttgtagcttctcagtaaacaatagctgtgaaccacatgaaacccttctgcaaaggaaatagaggaatatttccctgtctatcctcacacctgctaggtgtgttcacaaactcctgatatttttcctgttcagtggtttgtccatctgtaatcagtttctcaatcattctgtacttaatagccgctttaccatgggcctggttttctctgggctttcattaccttatcaatgaaacagggaggctgggtgaggtgggtcacatctgtaatcccagcactttgggcggctgaggcagagggattgcttgagccctggagtttgagaccagtctgggcaacatggcgagaccccttctctacaaaaaatacaaaaattagccaggcatggtggcctgtgcctgtagtcctagctacttgggaggctgagacaggaggatctcctgagcctgggaggctgaggttgcaatgagcccagattgtgccactgcactccagcctaggtgacagagtgagactctgtttcaaaaaaaaaaaaaaaaaaaaaagggcggcgagttttaaataaatcgatatttgtatttctaacaatgcctcccagatagtaactgctcaataaaaggtagctgttacaactgtgtttctagctgtccttccatcagggcagaggccttcctgggacagttttcctgatagcccagatatctagttgttgcctagtgactatttgttgactgactggtcccattattttctttgaagtctgaagtcagggccaccaggtgaaacatcaggaatcattttccttcttaatgaatacatgcacctctgtgggtggtgtgtttacacatggtgagacctgcctggtagctcactgaagtttctttctaccaggatttctcagccttggcactgtggactttgggcctgatcattctttgtcttagggctgtcctgtgcattgtagaatgtttagcaacatccctcacctctacccagtagatgcctgtcgcaactccttttcctgcccagttgtgacaaccaaaaatgtccccagacattgccagatgtcccctgggtgtgctgatactgctttccactcttctaaacacctgagccccgtaaaagtgtttgtttgatgatgggggcgtgtactgagctcctgctgtatgccgggtacaagggatacagacgtgatccctggctgggcagtgcccaggatgcagtgagtgttccataaatattgtcattatcacccagtttccccaaagccattaataaataccttcgttaaatatgtaaacatgatcagaaataattcagaggagtccagcgtttactgggtttcctgggtgttcctccatgtctctgcaaacccagaagcctcagagaacaaacttttaccctggttctatttctggtctcctttcacttggattttggaccatgcccgtctatgcagacgggattccatctttattccattttatggctgcatcatgatgtttcacatatgggcatcaatgttggttcctgtctgacttttctacaaagccctgttgcagtggctaccccgtctatccttctgtgcacccatgagccctgtagacaataggacatgttcttagaatcaccccactactatctgagtgatgttaagcatctttatttatttatttttgagatggcatcttgctctgtcaccccggctggagtgcaatggcgtgatctcgactcactgcactccagcctcctggggtcaagcgattctcctgcctcagcttccccagtaggagtagctggtaccacaggtgtgtgccaccacacccggctaatttttgtatttttaatagagacaggatttcgccatgttggccaggctggtctcgaactcctgacctcaggtgatccgcccgccttggcctcccaacgtgttgggattacaggcgtgagccaccatgcacagccgcagcatctttacgtggtggctggccagggtaatttgggtgacatgttgggtctgaactcttcgctccccaaaggaatgtgacaaggtgactgtggagggcctgtcccttcgtacctggcgtttcagtagagaattttgccttctttaggtggcttttagagataccatccagggcagatggggaccttggttggttagcagtggcgcctcttccttcatctgccccctttctgaagctaatttccctttgcttctcccaacccacttctgtgcttcaaatgctgccagcacagaactgtctttttgtttctgaattgccctctgacgccgcgattccccattgcagtttggaagccactaccaccggagatttccagaacccaagccaggcaggggctggataaatagtgccaacgggtgtcagccaccagaaccagctcctcagccagccacaatgtaaaggccagaggcaaccggtttctccacattctttgtggtgttccggtcgagtttgaagggcctcatgtacacatgttggagggagcctttggggcctgggcctgctgagggggtgggtgggtggtgggcagtgcgttctcacagggagtcggatcctgcctcagtaaaattggaaagaacttggcattcttgatccaggaaattcctgttgcgatgttgtcgtttttccagagggcctcatcccagctggggaggagaaagggccgcggttgctattgcctctagttgttgagggctaaacactgaattcaattgtaaatcagcctcttttctgtagattgaagcaatttctgtcctgccaggcgagtttggaagttcgccttttacatatgaatgtgccctttaatcaccacttctgcattattgagagaagggtggaggaggctgtgtctagtgggaaaggattatacctcaagtataaaagatgggttttctcatttctaggagaggggcatcagaactggagaatctgaaacaattactaaaaatgttaaaaacaacttcaaaatgcaaaccacagctgtttccctccccccaggctcccttctgatattgtcacctcggccagcagaacaactgcagttcctcgtatttattcacaatcccacgaaatcaatggctcttcggtgcactgcaccggagactttcagctcagccgagctgctgttgagggtgataaattataggcgaaagcccggggacatgaaggcaagtcgctgggtttcagactgcctgattgcaaagaggtgacagtgtccttgccccgccgggcgacctaatgcgtacaagaccggggctggcctggtaagtggtgactcttagcctgttctctttgcttcttcctcctccccctgggagaggccgctgaggatccggaagcaggaatgtctgctgtgggtgagcctctgttctcttttgaacaagagaggctaggccctctgagcagccgcactttctcaatggcaggtaagtgcctcctcttggcgttccctgcccctcgcatgttctgcctccgaggtacttgatgttcctggtgaaatgccattttccccaagttgagagtgacctttcattccacagcctcatttccattccagccctccctatcccggctctggatgagaagttcctgttgatttgcagagattctttataagcacagttcaggccagtgcagtcctctggaggagagggctcagcccggcagctctggcaggcccaagtcagccagggtgcagaccggtcctcgagtttctgtgggtctaagagacggtcagcgttggaggaaataatcatttgctaatgcgagcggttttcatttacaagttcctcctggcttaggcattctctgctgcgaggacaattttgcttcctccccacccccaacctttgctcctgatttcttacttctatgctctgccaggaggaaattccggacttttgtctctttatgatgtaattactggttggggagggccccaaatattcctggggaagggaggcctgtttgggtacctgctctgtgtctttgggaaacgctttgaagtgattaaccatgctctgctttgctgcttctgggggagcagcagtgtgtggtcatgtttgaagtaggccaaggggaggactggtgattacgaaaagggctgtagagcaggcctctgcttctgaccctgccttcacagttactgggggaaacctggcattttcagtctgattgaaatgcagaaatcctgtcctgggctgattctggtctccagtctacacaggccggtgttttccatagctttgaacttgtggaattgatttaacatgctccttccagaaagcaagctgtgtttttggagtggggggcggtagtcggggaggaggtggaagagaagcaagaaaaggaggaagagtgattggttaaaaaaaatacagttacccattagttaccattgaataggtgcttactatttgccaggtattatactaagagctttacgtgaattaactcattgacttcttcgataactttacaaggtaccacttgtaaagtggtaaactctctgaggcacagagaggttaagttgcctttttacggtcacactgcaggggagagcacagccaggttctgcatgcattttgacgccagaaagctgattccccaccactgtggcatcctgcctctctgtcgtttgcaacctggcccatgagagcatatgccttgacctatgtgtcctggtttgcccgggacccagctaagcacatggttggttgccctactcctgtggcctgtcatgcctgtctcagcctgtggaccaagcttctcttttcgttcaggccccagcaggcttgctgtcgacatcattaaggaaattaaacacccacaaaaacacaagaagctcccggcctttcagctgcggccctttcccttgagggaggagacaattccctgtaatggtgtgtcatttcctagcccctggagaacggcatgtgctgtgactcaggcaccggatgtgggggcaggagtggggtggagggcgggtacctgatgtggcctgctggggaggcctagccttgatggaggctggaaaaggggaggtgagttggccctggagcccccagcctatttcagggactgatgccactgtttggaaattgggaggtgaatgtgctttctggggactgcctttgagagaacggtgtcatcagtgaatgacacgactttccaccttttcccagttcctgaaactgtttgttggaccttctctgtccctatacttccatctgcagtttaggggaaaaaaggcaaaatgagagtgtgctcttaaatcatagaccctaaattagggagtcctcttgctacagggctgaggatgaggccctcctggtacaaggccatgtggtacagagattagaagctggccctcggagtcccactgcctgggttgaaatcccagtactgctctggccctcggagcctcactgcctgggttcaaatcccagcactgctccttggtagctttgtgatctcaggcaggtgacttagtggggactacaggaaatgcattttgaacattgcctagaatatcacatataataaaagaaactcttagctttctttctttttttttttttttgagagcgagtcttgctctgtcacccaggctggagtgcagtggtgcgatcttggctcaccacaacctccacctccctggttcaagcaattttcctgcctcagcctcccaagtagctgggattacaggcgcacaccaccactcctggctaatttttttgtatttttagtagagatggggtttcaccatgttggccagactggttttgaactcctgacctcaggcaatctgcctgcctcggcctcccaaagtgctgggattatgggtgtgagccaccacacctggccgaaactcttagctcttcatactcttggctcaggaaagctatgagcctgtgttatcttgaattaagatgccccttaaatcaaaagacatccaggaagtgctgagctccaggatgatttctggtggatcacaggcttgggaaggatctcctcatatgcttggttccttttttttttttttttgagacaaagtctcgttctgttgcccaggctggagtacaatggcatgatctcggcttactgcaacctccgcctcctgggttcaagcaattttcctgcctcagcctcctgagtagctgggattataggtgctcaccatcacattcagctaatttttgtatttttagtagagacggggtttcaccatgttggtcaggctggtctcgaactcctgaccttgtgatctgcccaccttggcctcccaaagtgctgggattacaggcgtgagccaccgtgcccggcctcatgcctggttcttaatacccagtagaccttcccatattgttacaatttcagcaaaatgtcacaaggagaggaaaattctgctgctttccgctccatgccaagctgttttcctgagtcactgctctgtcctctccataaggctgcattcctccctcacccacgttaactcattcagaaccactcatttttgggggatgggtgagaggcagagggttgtgagtgagccagccgggcggggtcacaggtcctactccctcagaaaaggcagcagaaaagtctttcagatccagggtgaaccagtggttcagtcgacagtggctgtttgtcattgttcaaagtttatagatgaaatgcactgggcaatacatccttgtcagaattaaatcattaaagaagaaaaaattgactcagctttctggaaagggtccttatggagcctgggtaccacggctacagtcaggtgtacacccaccagtccatcatcaccagaggcccagcccccactggagtggggggcatttaagtaataatgcccccctgctgtctcatccctccgaaggataccgaatccagcaggcatttcctaattcttctccctacaacccttcattgaaatctcctgctgttgactgatgtgtctgttgtttggaacctatcaaatttcgaccccttggatacagtcactgaactctcatcaactccagggggaattggtgtttgtaacagcaaacagaattggggtttttatgttttgctgaaactagaaggtttggaatactctcaggtgtgggcatgcttgggctaggacccacctccccctacctcttgctgagcagaacctcagtttccccctttgtttcctggtgggcttgggtgatagtcccttgccaactctaaatcgcttacaagtatattactgtctagtgattttttttcccactttctcattaaattaagtaatgttgaagagggacttttaacatcctctgggggccctgaagtttttaatcattggagctgaggacacctttgcaaaggtgaaggaagctatgactccatgtccctagaaattgcactcctgtatacagtgatggcctgttcaagggtccctggagcactgtctggtctttaaacaagaacttctagtctagtccctttctcccggctcttcccattttgcaggtgaggccctgaggccctgagaggtggagacttgcctggggttgtttcctgtttagcctcattctccagcctgactcccttgcttagcttctatcctgagtcctgaaccaacccctcaaataatgtctggaagtagaggccattggctctggctcgccagtgtggaacaggattgtgtagagttgagaactcagaccccatctcctaaacacatacacataccctagcgttcctcaaactagtgtacctcccagtcttcgggaggacttattaaaacagattgctgggccctaccccagagtttctgattctgtagatctggggtggggcctgataatttgcattctttttgttttgttttgtttttaaagatggagtctctctctttcgcccaggctggagtgcagtggtgcaatcttggctcactgcaacctctgcctcctggcgccaagtgattctcccgcttcagcctccctagtagttgggactactggagcgtaccaccacacctggctgatttttgtatttttagtagagacaggattttaccatcttggccagtctggtctcgaactcctgacctcaagcgatctgctaacctcagcctcccaaggtgctgggattacaggcgtgagccaccgcacctggccaattttctttattttcgtaacgtcatccagtcacatgataaataagtacacaagggtatagagtggaaaataatccttccctggactccccttccctggactccctgcaggcacccctcccaaggcaaccagtagtccccaagtcgagctttgttgtacttttgtgttcatccaggaatattctaggtttatgcaaacattgatgtgtatattaaatctttttttgggaggaatattggtccattaatggtgctagatacactttatttattattaatttttttgagacggagtcttgctctgttgcccaggctggagtgcagtcgtgcgatctcagctcactgcaacccctgcctcctgggctcaatcgattctcctgcctcagcctcccaagtagctgggactataggcacgtgccaccacacccagctagttttttgtatttttagtagagatgaggtttcaccatgttggccagtctggtctcgaactcctgacctcagatgattcgcttgcctcggcctcccaaagtgctgagattacaggtgtgagccaccgtccccagcctaattattattattattatttttttgagatggagtctcacccctctgttgcccaggttggagtgcagtggtgcgatcttggctcactgcaagctccgcctcccaggttcacgccattctcctgcctcagcctcccgagtagctgggactacaggcgcccgccaccacgcccggctaattttttgtatttttggtagagacggggtttcaccatgttagccaggatggtctcgatctcctgactttgtaatccgcccgccttggcctcccaaagtgctgggattacaggcgtgagccactgcgcccggcctccagcctaatttttatattttttgtagatgcggggtttcaccatgttgcccaggtgtttttagatctttttaaagaacttaaaaatttttataattaaatttttttttttttttttcagagacagtgtctctccttttcacccaggctccgacgtgatcatagttcacaataccctcaaactcctgggctcaagcaatccttccccctcggcctctcaaagtgctgggattacaggtgtgaacactgtgtccggccatgtgactgtaatgtattcttagagcagtcctctgtttgcagacgtttgtttcaagtgctttgggtacagcccacagtgctgcagtgcagtcatcttgcctttgctccttttccactatgtttgtagaatgtgtttctagaggagattgttgggtcaaaggccaagtggagaaaaagttttcaggaacagtggcgagagtcgggtgaggacccatgtgggagggaggggaggtttctctgggggaatgtgctcaccccgggctgcacctctctctcttttttttttttttttttgagacggagtctcgctctgtcgcccagactggagtgcagcggtgtgatctcggctcacagcaacctctgactccagggttcaagtgattatcctgccccagcctcccaagtagctgggattacgggtgtgcgctaccatgcctagctaatttttgtgtttttagtacaaaagtacggggtttcaccatgttggctaggctgacctctttgtctctttcgtgagttttcccactaactagctgctgtgtgcctttggtccagcgctttgggctctctgggccgcccttttgatgtctgtggtttgatctctggactctcaggtctgttcaccctcaaggtacctgttgttagcatttaatttccactcatgactgggtctccacgcagccccctgaatatttgttcaggattgtccagaagcttgcatggtgaggctggagagttccatcctgtagattgggttttgggaaagtgttcattgtcttcctttgtgaatctgctggaagatactttgccttttcatgaaagtcaaccactaggaggccttgcgtggaccacgttggatgctgttaatctgctgtcagtgaccctcctacagacagggagacagatgcaccatgcagcctacatgctgagtggtaaaactggggcaggagcatctttggtaattgacatcttcgcagatttcacatcccatcccaccccatcccccctatggtcttggcacagctcacccctcttgtggtatttgtagctttcgttcctcaggatgtcaggtacaccaggctgtgtcattacatcgtccctaagttaagaagaccaccattgggcatggagtggattcaagtccttggaggtgaagattgaatggatggtagtggaagtgtacctgtgtttatgtatttttattattatttttgagacagagtctcacttttgtcacccaggcttgagtgcagtggtgtgatctcggctcactacaacctctgcctcctgggttcaagcgattctcctgcctcagtctcccaagtagctgggattacaggtgtgtgccaccacacccagctaattgtttttgtatttttagtagagacggggttttaccttattggccaggctggtcttgatctcatgacctcccgccattgttcgtgaaaactttttctccacttggcctttgacccaacaatctcctctagaaacacattctacaaatacagtggaaaaggagcaaaggcaagatgactgcattgcagcactgtgggctgtacccaaagcacttgaaacagacgtctgcaaacagaggactggttttaccatgttggcccagctggtcttgatctcgttaacatggttttaccatgttggccaggctggtcttgatcttgtgacctcaggtgatccgcctgcctcggcctcccaaggtgctggggtttataggtgtgagccaccgtgcctggctgaagtgtacatgtgtttaaatgagatgctgaaagatgaaaagaaggggtgcatgaacaagagtggggctggtgagaatccacaaggatgtaatttgtattgatctttttggaggagggtctcaaacacgaggcccagaggcggtgggagcacgggaacttcccggtgggtggggtgtgttctttccacacaattacagttcatagcctattaaacacgaataaatgatgttgttttccacaaaggagaatgtatgccttcatttccttgaagtatggccttcctggtctatcttctttggtttcctgcttttgcaatcaggcatgggcatggacaagtcgtatttctttggggtaagaacaatactggtccctgtgtgatgactgttggcaggttggcctcggtctcatcagcagggacgtagtggggaagagtggcgattgcacatgtttccatctaaaagtggggtagctgttactcagctgtatctggtgctataggggcctgcaggtcctaatctgtttttttttttttttttttttcacgtcggaggcttgccctgtcccccaggctggagtgcagtgacacaatctcggctcactgaaatctccgcctcctgggttcaagcagttctcctgcctcagcctcccgagtagctgggattaaaggcatgtgccaccacaccaggctaatttttgtactcttagtagagacggtattggccaggctggtcttgaactcttgaccttgtgatctgcccactttggcctcccaaagtgctgggattacaggcatgagccaccgtgcctggccctcctaatctgtttttttaagaaaagtgaaaaatctaggttattacatgaaatttcctgatttttgtatcttggcaacaagttaagattttacaaaaatgttacataggtcaaagaaatacttgtctgactgttgaagcagacagtgaagaagggggcacgtatattctgggaggaggaacactgaagtggcttcgggagttgggggacagaatgcactctgttcccacacttggttcctccacacctcctccctgtggggcccaggcctccctgactgctttaaaacctgtggtcctgtatctctttcagatcctggctctgcagagagaacagcccagaaaagaaagttccccagccctccacattcttccaatggccactcgccgcaggacacatcaacaagccccattaaaaagaaaaagaaacctggcttactgaacagtaacaataaggagcaggtaaagcagccgctgggaacggtgtcctcactggtgggacagaggccagctagtagcgctgaacctctggatccttgtaagcgccggctttcttggatttagttagctgccttgcgctggctgtcatttgccttggacaaaaaaagatggctaaaaatgggcctgtgtagaaatttccagtgggttttcagatctgtttcggggacagagcagggacccagatgagatgagggtatataattctttagggtttggggcgtttccttgtatttgtatttttttttttttcatgcttttaggactgttttccccatgtggcctgaggagttttcccctcctgggccatgcccacaggactagttctcagctctgtctggaagcggttgcttggcttgaggcaagttcccttctggcctcagttttctcatctgtaaaatgaagggtttagaggctgggcctggtgactcatgcctgtaaccccagcactttgggaggccgaggcaggtcgatcacgaggtcaagagattgagaccatcctggccaacctggtgaaaccccgcctttactaaaaatacaaaaaaagttagctgagcatggtggcatgcgcctgtagtcccagctactcgggaggccgaggcaggagaatcgcttgaacccgggaggcggaggttgcagtgagccgagatcgcgccactgcactccagcctggtgacagagcgagactctatctcagaaaaaaaaaaaaatgaagggtttaggttctttggtaagaggcattgccaggggcaggcttaggtaattggtcacagttccttttcgtggaagcacagaggattctttccagagcccaccctcccttggcagctagcaccagtcagctagataggaaaaatccgttcaccgtttggatcttttctaagggacattctagctttagaattctctggggcaggctagatactcttcagattacaaaaatggagaggcactttagtggacttactggtggattgtatctatccccctggactatgaggtcggatctcatagcactgaaggaaacagtgtcccgttggttctgatgccacttgttcttcagcagtgattcctagggatgcattcatccactttgtgcattattgagtagaggagtgggccctggggatggaaagttgaattaaacgagattgttgctttcatggaaggagacctagcaacggttaaatacccaggcctgtgagaggtgtgtgtttctgagcatgaatctattttcactctcaaaattacatagtgaaatgccagccctgcttttgctccgtggctgtgggcaagttaacctcttttgtgcctagttttctcatctactgaaatggggataatgatactaccacaaatttcacagggttgtgaacattgagctaaatgccataaatagtgatattaaaaatgaaacataaagtcagtttctctgctaagtagaataatcatacaatctttatatgaaataaacaattcctgtaaaaatgctcatgtctggccaggcgcggtggctcatgcctgtaatcccagcgttttgggaggccgaggcaaacggatcgcctgaggtcaggagttcgagaccagcctggccaatgtggcaaaaaccctggccctactaaaaatacaaaaaattagccgggcgtggtggcacatgcctgtaatcccagctactcgggaggctgaggcacgagaattgcttgaacctgggaggcggaggttgcagtgagctgagatcatataattgcactccagcctgggcgacagagcaagactctgtctccaaaaaaaaaaaaaaaacctcacgtccaagatggtagccacaggtcacatgtggttcttcagtacttgaaaatggcaagtgactgaggaactgagtttttcaattttttttttttttttgagacagagtctgactctgtcacccaggctggggtgcattggtgtgatctcggctcattgcaacctccacctctcaggttcaagggattcttctgcctcagcctcccgagtagctgggattacaggcgcccgccgctgtgcccagttaatttttttatttttagtagagatgggatttctccattttggccaggctggtctcgaactcctgaccttgtgatccacctgtctcagcctcccaaagtgatgggattacaggcgtgagccaccgcgcctggccttatttatttgagatggagtttcactcttgttgctgaggttggagtgcaatggcgcaatcttggctctctgcaacctttgcctcccaggttcaagagattcttgtgtctcagcctccacgtagctggaattacaggcgcctgccaccacgccctgctaagttttgtatttttagtacagatggggtttcaccatgctggccaggctggtcttgaactcctgacctctggcgtgagccactgtgcccagcctaccctctttttaagagatggggtcttgctatattgctcaagctggacactcaagttatccttctgcctcagcctcctgagtacctgggctttccggtgtccctttatttatttatttatttattttttgagacggagtttctctctcattgcccaggctggagtgcagtggtgtagtctcagctcactgcaacctctgcctcctgggttcaagcgattctcctgcttcagcctcctgagtagctgggattacaggcatgcaccaccacacccggctaattttttttttttgtagttttggtagagacggagtttcgccatgttggccaggctggtctcaaactcctcacctcaggtaatccacccacctcggcctcccaaagtgctggtattacaggcatgagccaccgtgcctggccaagttccggggtccctttttttataagggcactaatcccattcatgagggcagggccctgatcacctctcagggccccacttctctaatgccatcaccttggggttagaacatcaacatagaaatttgggaggtacacaagcattcagaccatagcactcagcaaaatctagcaaccagctggagctgagtcaagcctgcccctttagacacaggcctgtgcttgcttgtttgccacactgcccaccattccctgttgtctcatactcagcctgctctgctcatttcatccacctctgaatttctttccatgtccatgttcttttgactttggcatatgtgaagattctccactgtcgtcttctttttcttcactttagtttctcttctttgttccattgttccagaaagaaagctattctcacctcataaagagcaaataggctgggctcaggactgtaatcccagctacttgggaggttgaggcaagagactctcttgaacccgggaggcagcggttgcagtgagctgagatcgtgtcaccacactgcagcctgagcgacagagtgagactctgtctcaaaaaaaaaaaaaaaggcaaataatccatatatttccatttttggtagagatgttttattaccatgtgaaaatatgggatgagttttaagtttggtccctattccacccatttatcatatattaggaattcattttagggaagtttatttttatttgtatttttattttttgagacagggtctcactctgctgcccaggctggagtgcagtgacatgatcacagcttactgcaacctcaacctccccggctctgcaggctcgacctccccggctcaagcaattctcttccctcagcctcccaagtagctgggactatcggcacatgtcagcacacccggctagttttttttattttgttatagagatgggggtctcactttctttcttgccctggttggtctcgaactcctgggctgaagtgattctcctgcttcaacctcccaaagtgttgggattacaggcatgaaccactgcgccgagccaaaagtttaaagagctttaaaacacattttattttcagggtttaaaagcatcctaaggtttaccatgcatttttaaaagacctttggtccagtgttttcaccccttaggaaggtttgagaatgcctgggaagatgctctcggcgttttgtggaggagggtcaggttgctaaatggatgtcctgtagtatatggggcaagaaatgccttgccccaaatgacgtcagggtctttacagataaataccactctgctctttagttctgacacatttgagttcaaacatcctgttgggaggtgttttggtttttttcccttgcattaaaggattgagaaataacgtgccagcagatttgtacagaatggccttaggtgcatctttgatcaaatatagcaaagaaatgatggggcccctcttcaccttctctgaggacagggtgtctgcatatcatgaatgagtggctagtacttattttcttgggcccacatgttgccctaaaaactgggacacttgaagtctttttttgcttgcttttttttttttttgaaagaaacaaggctttgcaggcccaggcctggtggctcatgcctgtaatcctagcactttgggaggctaaggtgggcagatcacctgaggccaggagttcgagaccaacctgggcaacatggtgaaacctcatctctactaaaaatagaaaaattagccaggcatggtggtgcgcacctgtaatcccagctgctcgggaggctgagacatgagaatcgcttcaacctcggaggttgtagtgaaccaatatcgcaccactgcactccagcctgggtgacagagcgagactctgtctcagaaaaaagaaaaaaaaaaaagaggcagggctttgctctgttgtccaggctggagtacagtggtgtcattgtggcttactacagccttgacctcctgggctcaagtgatcctcccacctcagcctcccaagtagctgggtctacagctgttccccaacatgcctggctaattttttttttttaactttttgtagagatagggtcttgctgcccaggctggtcgcggactcctgggctcaagctgttctcccacctcattctcccaaattggtgggattagaggtgtgaaccactgcactaggcccacagaagtcttttgttgggctgagacagtgtattaacagttgagatagttcaggggagtgcagggattgccagtttctccccaaggtcaggcaacactaggagtttgtgtctgcccaactccttggatcactggagctgagtgggggctgcctctgtaagatgggtctgagctctgcccagccctgctgtctcccccactgcgaggttgaatgccagtgcatcctcacactccagggctaggtggttctttcttacatacttcacagtattcatgcttttaccagatgtaggagaatgatagctgaagctatggtttttttcactcaggtatggtccctgtgtggcctctgtaggaactggagtctatggtcctcatcgtccacacatggaccttgtgtttacacacagccagagcacccatactctggtttatgtagaccaggtgtctgcaactacagcctgtgggctagatgctgcctgaagcctgtgtttatagagttttattggcacacagctacagtcattcatttatgtactgtctgtgtgtgcttttgccctacagtggccaaattgagtatttgcgatagaggccttatggcctgcaaagcctcaagtatttactatccttatagaagcctttataggaaaagtttgccggttcctggtatcattgaaggtattccagaagcaaatagacagggccttttctactttcttgttagccagcctatggaagcagggaaataagaacattttctcttctgcagtatcccttaataacctgcaaatattccatgataacacaggttgcaacctgtttccctagttatcaaactggtaacacacattatacatgtaggggagaaaaatcatatctcagaaatgatttgctttccctttttaaaatgttccatatttgttatcagattatttttatggaacaggaaacacttacaagcagcagataaggaaaatatctgattgataaggagattaaccaggcatctagctctcagcaactgctgctgtttcaggaaaggagaaaatcttctgaaaagagtacagagcagccaggcagtcctcgggatcctcctaggggcagccagccccagccaggaggtggtggggttgggaggggagcaccaggagaaacttaattttggaggatcagtacctcggctactatcagacagagaggatttgagttgctggttagggagatgtacagtcatatttgattcttccagcttcttttttttttttgagacagagtcttgctctgttacacaggctggagtgcagtggtgtgatcttggctcaccgcaacctccacctcccgggttcaagcacttcttcctgcctcaacctcctgagtagctggacaggcgcccacctatagttttagtagagacggggtttcgccatgttggccaggctggtcttgaactcctgacctgaggtgatccacctgccttggcctcccaaagtgctgggattacaggcgtgagccactgtgcccagctgattcttctagcttcttaacaactcttcctattgtattattaacttactgaaaagaagtcagatactgaaaatacggctgactgttatctttcaaaaaccacagtagcatcctagaagacctcactcggggtagaaatagttctgaaaaaaaagaaaaagaagggaaatagttctgcttgcttggtatgtatagcttatctttcaacaggagttccccgccctctcttccccttcctgctgctcctcacccatctcctctttagcacccccatacccctacaataaattcgaagcaaccattttcctaggcagagagcagaccctctacattagtggttctcagctagggacagttttgacctccaagggacgttgggcaaagtctggagacgtttttggttgtcctaattacgtgtgtgagggtgttagagtattactggaatctagccaggtatgcttctacctgccctgcaatgcacaggacgtctcccacaacaaatacttttctggcccccagtgtcaccagtaccaagattgagagcctgtgccctggatgctgtccccttctgtcaggtttttagtagtcatcttatttttcagatgttttttcccctctagctttgtgcactaatctgaacttagtttgcattgcagataatgttctctgagggggtctctaagtcaacacacactctcctggattcaacgttgtcttatgagggctatagggaagagagagtgtgctgggagacccaggtttgagtctttgctctgggctccaaggtcagataaatatctttaaccaagtaaccaagtttttctacacatcaagtaagactagtatgggttgagtattccttattcatcttgggaccagaagtgtttttttttattttttaatttggaatatttgcatatacatagtgagatatctcggggatgggacccaagcctaaacacatagatatatatttttttgagatgatgtctcgctctttcgctcaggctggagtgcagtggtgtaatcttggctcactgcaacctgagttgaagcgattctcctgcctcagcctcctgagtagcaggcatgtgccaccatgcccagctaatttttatattttttgtagagatggagtttcaccatgttgcctaggctggtctggaactcctgatctcaggtgatccacccacctcggcctcccaaagtgctgacattacaggcgtgccaccacgcctggcctaaacataaaattcatttatgtttcatacatactgtattagtttgtttgttctcatgctgctaatgaagacatacccgagactgggtaatgtataaaggaaagcagtttaattgactcacagttcagcatggctggggaggcctcaggaaacttacaatcaaggtggggaggggaagcaaacacgtccttcacatggctgcttcgaggagaagtgcagagcaaagaggaggaaaagctccttataaaaccatcagatcttgtgagaacttactatcaccagaacatcatggaggtaactacttccatgattcaattacctcccactgggtccctcccatgacacatggggattatgggaattacaattcaagatgagatttgggtggggacacagccaaaccatatcacataccttatacacatagcctgaaggtaattttatacaatattttaaataatatatgtgactcatcacaagagatcacttgtggcttcatgttagtgctcaaaaacttaaggattttggagcatttttgatttctgattttctcattagggagtgctcttagtacctttctgggtggttgtcaggataaaatgaagatggtgtgtgcaatggcatgctgaaaatgtaacatgaaaaaaatattgtagcagtgatattccctggaaaccaagtagagctctatcttaaaagttggtctgacacagggaaataactgggctaaagaattatgcagctgggagcagtggccaacacctgtaatcccagcactttgggaggcagagacggacagatcacctgaggtcaggagttcgagaccatcctggccaacatggtgaaatcctgtctctactaaaaatacaaaaaattacctgggcgtggtggtgggtgcctgttatcccagttactcaggaggctgaggcaggagaatcgcttgaacctgggaggcagaggttgcagtgagccgagatcacgccattgcactctatcctgggcaacaagagcggaacaccatctcaaaaaaaaaaaaaaaagaattatgcaatcacatttataagtattagctacttactttgcagaaatgagaatagagaggcttagaaacattggtttacaaaggtctactaagcaagcatctacaaggctcttcatcaaggattgtggaaataccaggcatttgggaacagtaaaacctcttaataccagcctgggtaacatggtgaaaccctgtctctacaaaaaaaacaaaacaaaacacacacacacacacacacacacacacacacacacacacacacacacacaaaattagttgtgcatggtggcgctcacctgtagtcccagctacttgggaggctgaggctggaggattgctggagcctcagaggtggaggttgcagtgaggtgagatcttgccactgtactccagcctgggcgacagagcaagaccctgtctcaaatactaaacaaaacctcataataaaagctgggaacaagatatgggtgcctgccttcttggcaactcttgcacattattttggaggtcctagccattaaaaagaaaagtcgtgttaaagtatatgataggaaaagacaaaactgatgttacttagagtaatatgattttcagtcaataaactattggaactgtctatatatgaggtctgtattagaaatctgacagcatttctgtctatcaatgataaccgtttagtaaatccccattcgtagtatcatcaaaaagtatgcaggatctcaccaacgtagaagatatttgtggaggaaaccatcatgttttactgaaggacagaaaagaaacatgttatacagtgagatttattcgagggtagggaatatggttgtggctaaactattctctgtggttttattgccagggaattgaggctcaaagtgggttgagtcactttcttaaggtcacatagctagttaccaggtctttttgaatcttcccacaggacttacatgtgtacttcctaaataggatttcgtatttgtttctgatagacattttcattatgagtttctcctgagtgagtttttgtgttcaagtgtggctttgctggattccataatataccataatattccataatataccaggaagaggtcgacctcccatgagttggccacccatctcatctttctgccattgctgatgtcaaataagagatatgtctccctagcaaaaacaaggacctaccatgctcaagaattatggctttaggaagcctcttgttggctcataaatgctttatgtattgggggtaaacttaaaaattagataactggccgggtgcagtggctcacgcctgtaatcccagcactttgggaggccgaggtgggcagatcacgaggtcaggagattgagaccagcctggctaacatggtgaaaccccatctctactaaaaatacgaaaattagccgggcatggtggcacacgcctgtagtcccagctactcaggaggctgaggcaggagaatggcttgaacccgggaggcagaggttgcagtggagccaagattgtgccactgcactctagcctgggcaacagagcgagactccgtctctgaaaaaaaagaaaaagaaaaagaaaaaaaaaattaggtaaccattttttggtgactgaaaccctattgatctattctctaaatgtctgccatttgaagaatcccagggcaaactactatgcttttattggctttgtaaattgggacttccataagttgggcttccaaccacattagcattgttagtatggtggcattttgataaacaggcatacattatatcaccccatttaatagcaacacagtaccatgaagtgttaggcattatcatctccattttacagatgagaaaattgaagctgagaggttaagagacttgtccaaggtcatgcacctggttaatggtagagttaaaatctgaacctaggtagatgtgggttataggcaatgtgccattctgctagggctgccttgtaactcttagataccagcttttaatcgtggcctcttaaaatagaaaaaagaaaaatcctcataattttaacaacttgctaattatatatttagtagagtaacctaagatagtttggctttttaatgaatttgtgaaatgctgttattttcttttgttgttattgatgtacttgttcaaattccttttgagaatgcacatttgttttgaaaccaaacctgtctttttgcctacatttcagtcagaactaagacatggtccgttttactatatgaagcagccactcaccacagaccctgttgatgttgtaccgcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgaggttagttcctgatgaatgaatgcattacctgcctcgtttcctctcctttctctttcttccttttatttttaaatttacaaataatccagatagatggaaaagagaaatttcttgctttccacctgttctatcctggtcacccccttcttgaccaacaccggcagtggctgcagtactgcagctcttggaaagacaattgcacggaatattatttctgatttctcatgagtccttggattccttggagatctgtagtcgtcatctctgcatcttctatgatgaactttttgaaagttaactcccaaatcatgaacggctcacacattttgaaaagatctcattctgttttctccgtcttggatgttgttgcctgccgcatcattgaatcatcagcagtagccaagctgagaagaccacgtttggttgcatgttccctgtagtggccgtctggtgctttcttttgtgcaacaagtatttcttgagtgcctattaggtgctgggaattcgacagtgcacaaaaacaggcatggatcatttttttttttccagcagaaaaggacaaaaaccaaaataaataaagttccatataatgaattaaaagaaaagtgctgtgaagaaaacaaattcaggatgggaataggaggtccaagggagtgcaaggtgttttcattttgaatgtggtggtctgggaaagcctcactaaaatttgagaaagacttgatgaaagagaggagtgagccatgcagccatttgggggacaacttccaggcagacggccggaggcagcagtgcatgggcgtagtcggggcagtgtgtatgcctcctgtgtagcaaaccccaggcaccctttattaagccaactattagggtttccactgtttggaggtggctcctgttcttggagacccccaactctgatgtttttttggaattgctgaaaataaaaatgtcatctccacaattatttaatgtggaatgtctcttggattcaaagatacattggaggctgagcgtggtggctcatgattgtaatcccagcactttgggaggccgaggcaggagaattgcttgatcccaggagttcaagacctgtctgggcaacatagggagacccccatctccacagaaagtttaaagaaattagctgggcatggtggtatgtgcctgtagtcccagctacttgggagggtgagcttggaggatcacttgagccgagatggttgaggctgcagtgagctgtaatcatgccactgtattctatcctgggaaataaagcaagatcatgtctcaaaaaaagaaaaaaaaaaggtacattggagtttgatctcaaatgtggaagctttctatgtgtgaaatggaaagatcatccagatgtctttagtagggaaaaaagccagctataggacagtgtctgtcatacttttgtgtagggagaggagaaaaataagaaatacataaaaagaaagtagacatgaaatcaatatgatgacgatgatattgtaatggtgtcctctctaaaatggcaaaaggcggctgccgttctctttgggttactctagatggagaaatatgtagggtttgcattgtacagcggcgccctcctctgcacgcagaggctgacctcattctactacatttgtcatgggatctggaaccttcaccaattttctttagtcttggccaacttttcccaattgtttaatgatattacaaagatgacagcagctctgataggatgcttttgctgcaaataatagttcttttatttttatttgagacatggtcttgttctgttgcccaggctggagtgcagtaacgagatcttgctcactgcagccctgaccacctgggctcaagcgatcctcccacctgagcctcctgagtacctgggaccacaggtacacaccaccacacctagctacttactaagttttttgtagagacagggtcttgctatgttacctaggctggtcttgaactcctaggctcaagcgatcctcccaccttgacctcccaaattgttgggattataggtgtgagccactgtgcccggccaacaaaatatagttgttaatgcaagcactagttcctgatagaagggggctgaaacaatgtggatttattatcatcagaacctagaggcagggccaggccagagtttattcagagccagactctttccatctcattgttgaggtgacatgttctccatggccataagttgactgctagggttcaggtattatgtgtggatagacaaaaattctcccaaaaggaggatgtctctccttgcatctctttttatcaagcagaaagattttgtccatcatcccccagctgatttgcccctgggctcattggtcagtattgcatcaccagtccttgtacaaaaaagccttgaaaattgcatatgtggtgctttttgtgttgtgggaaccaggcactgccagccaggaagaaggagtggggggtgagagggaatgaatgatagttgggcaggcagcccaagtgtttgccatggataagttacctggaaacaaaccagaatcaaacaaacaggtgctctgtgtctaagattcggggctctgaatttcttccagggatgagttgttacggcagtcaactgggaagactgaacgttgcaaggctgtggtagctaagcaaatagatgcatgcgtcatgcactgttttcagcttctgagtgactcttgtgttggccttttcctcgacaaccaacgagacacatctgagagttccttttggaggccccagagatgtgaaaaatggaaacagaatccaaattaattggagaaaacttttctcagctctccctacacagatggttaaagagtgtttcctgacatgatcagaatttgctatttttgttgttgctgctacataaggattctgaagccttaagatgtagtaccagatttacatagcagaatctggtttcagacgttcctttgggtctcttctttgatgggaatttcccttaggagctgatatctattacccatggagatagacagttaggttaggttgtgctccttgtgtactttgacacagtgccttaggtgggttcaaagtaagggagatggacaatgaagtcatacgtattattagtccactgctttcccttgtaatctttctgcagggaagtctgtccctttccatcagtgatgtcattgaattaatgccttgtcagtttcctgaatgacagcccagaaccttaagaggatcaggataaatggttgataagtacccatcctgtgaagtaatcaccctgaaatcatccgtggcctttactttctttttttatacatacatatttttgagacagggtctcgctctgtcacccaggctagagtgcagtggcacaatcatggttcactgcagcctccgcctcccaggctcaacccatcctcccacctcagcctaccaagtagctgggactacggatgcgtgccaccatgcctggctagtttttgtatttttttgtagagatggagtttcatcatgttgccaggctggtctccaacactggggctcaagcaatctacccacctcagcctccccaagtgctgggattacaggcgtgagccaccacgcccacctggcctttgctttcatatcccattcttgaaacctaaaggttataataatgatgatttttcaggcccctgtttagccacatcttttctcagatcatgtcgtcttcctgagctaaaaatgcttcctgataaggaaatagattgatacgctttttaatagttacccactgatctggtacattttgttccaggagtctttgctaagtgaaacaacaagtctcattgggatgagaattgctttttgtctgtcagttgactgaaaaaatagaaatcagtacatggatggtaatttcttttttctaaccggacgtttatgtatgactttgactttgtagaaaattacagtagcagaatgcatcgagacccagagtaaagccatgacaatgctcaccattgaacagttatcctacctgctcaagtttgccattcagaaaatgaaacagccaggggtaagaagaaagttcctcttggtatacgcgtaaatgaacgtaatgacatatgttttgttctgttaatagcttagctttttaggtacctgatgtattctttgggcctccttgcatccccaaattcaagtatgtgtaaatcacacatgaggtatgatgccattcagttaattctctgtcgtagtaagcactgtatgtcccagaggagtttaattggtacattagtctgttttcacactattgtaaagatattacctgagactgagtaatttatgaagaaaagaggtttttttttttgtttgtttgtttgtttttctgagatggagacttgctctgtcacccaggctggagtgcagtggtgtgatgttggctcactgcaacctctgcctcccaggttcaagtgattctcgtgcctctgcctccccagtagctgggattacaggctcccgccaccgcactggctatttttttttttgtatttttagtagagatggggtttcaccatgttggccaggctggtctcaaactcctgacctcaagtgatcctccagcctcggcctcccaatatggtgggattacaggcatgagccactgtggctcgccagaaaagaggtttaattgactcacagttctgcatggctagggagccctcaggaaacttaaaatgatggtggaaggcgaaggggaagcaaggcacgttttacatggcagcaggagaaggggggtgggaagtgccaaacacttttaaaccacaagatcttgtgagaactcactcactatcacgagaacaggatgggggaaaccacccccataatccagtcacctcccaccaggttcctcccttgacatgtagggattaaaatttgagatgaggttgggtggggacacagagccaaaccatatcaattgggcaatgacatagtaaaacgttgagggggattgaaaattctgactggttgcaaagtgaaacctcctataacacccagcaaggggagctttgtgctccttcccatgggagttaggaaaatccatttcaatgaggaagctgagcacaacacagtttatttatgtcccagatctgatgatggaaccttcaaggaaaactcaaccagtgacttttctgtagagggtgagaatttggttagttccttcagttttgagatgagatttgatatacagcctttgccccttgaggaaaatctgcatgtgggggaagggttggccagttgtgtacctcacagtggtgcctcacctgtgagtcccaggtcaaaccatggccactgtggtttgtatatttatcacaatacttttcaggaaaatggcagaaaaataacttgtttttgaagatagtattattttgacaatataataagcatattatgacattttttctatagatgaatattttcctttcctccctccctctgtccttccctccctccctccctccctgcctgcctgcctgcctgcctgcctgcctgcctccctccctccctccctccctccctccctccctcccttccttccttccttccttccttccttccttccttccttctttcctcgtccctccctccctccctacctccctcccttccttcctttctttttttggaggcagactgttgctttgttgcccaggctggagcgcagtcatagcttactgcagcatcaacctcctgggctcaggcgatcctcccacctcagcctctcaagtagctggaactatagatgcacacaccgccacacccagctaacttttttattattattattttttgtaatgacagggtctcgctatgttgcccaggctggtcttgaacttctggccttaaatgatcctcctgcctcagccttccaaagtgctgggatcacaggcatgagtcacggcgcctggcccctacagatgaagagaaacttgcggacatgatgccccctacctgatttgcacaaaggcaccataggggctagtggtgaccctttgtacaactcctgagagtactgtacagaaatgtagattcttggggctaatcactgtggttttatatctttaaaaaaaaaagaagcttttgctttgagattatattctgaaattttgaagagatgataaaaaaaatttagagcatgctgattggatatccttcaattgagaacctttaacaaattggactcttttaaacaaaatctcaatcagtggaagcaaaaggtgtagccttagtttggtttgcacaatttttttgttttttttttgctatggtataatttttatgttgagtgtggcaaggaattaccttcgattttcataggctaaattatatgtgctaatgactattaacaaaaagaatgagtcatgtagatttgtcagccccatagaattaaaaaccaagaagaaaaattgaagagggcgttaatttctcaagtaaatcgttgaacgtcaaatcagtcaggggagaaagtgctgattttgttaaagcatctttttaacttacagtgcgtattgtaattgtcaatcttaatgtaagaggacaggatctgtttcttgagtgtgtattgaaaaccaagaataaaattggatcacaattgggcttataattatcaataaccaggcagaattagaaggtagaccaatttggagctccccacggtcatcctttatggaaaactttagaactatattgtctgaaaagttgtctcaatttttcaagccttttgttagcattaatgcttggttttccatagtaatgatgggttcgttcctctgcatatcttctcttttatagacagatgcattccagaagcccgttccattggaacagcaccctgactatgcggaatacatcttccatccaatggacctttgtacattggaaaaggttggcctccgtcaaagaacctcaccattctagcccacagttgagatgcctaaggctcttccctcactgcctatgctctatcacaagttggacataacaatcttaaattgtttctctatattttcattgctcctttatttggatagaagaactcttgattctctaacgtctttcctttgtaacattcttccaagattgcagtggaatgttgaaattctttggtaatacttttgcgatgattctagctttttacctgcaaaagccatagcttctaagagttagtgatttgattgacttgagcgttacctcctctttctttcggaggtgctaatgagagcagcaggaaggaagaagagaaaattaagtgtctgggaagcctccagattagcaataaagatgtggcttcttagaatttgacttactctactgattaggttttttcttgaatgcctgaaggttttaaaagttcatgctaaaattccacgctgaaaattacacttggaacactgtagattgtgcacattattctgatgctgattttccaactatttgcagcaaaatatgggcagtgaaatgcatccacgaggaagaaacattacttcatattgtcttccccaataactcccaaaccataaatccagtctgtttttaggaaattgcacataccttcatggtgtggtggaaaaaaggaggcattcaaaagagatggagttggaaacctgactttatattaattaagttaagagctgtggaactttagatacattccttaacattactgtatctcagtttgcctttctgtaaaatgggtatgataataagtacttcattaaattattgtgaggtttgtgtgagaccatatgactaataataaataatgtataaatatatgaaataccctgtttggccgggcgcggtggctcaagcctgtaatcccagcagtttgggaggctgaggcgggcggatcatctgaggtcaggagttcgagaccagcctgaccaacatggagaaaccccgtctctactaaaaatacaaaatgagctgggcatggtagcacacgcctgtaattccagctattcaggaggctgaggcaggggaattgcttgaacccgggaggtggaggttgcagtgagccgagatcacgccattgcactccaacctgggcaataagagcaaaactccacctccaaaaaaaaaaaaaaaaaaaaaaaactaaataaataaactatcctgtttattggaagaagctacatgataaatgacagctactataagatgagaaaattccagttattgtgttaaattcaaagagtgcatttttatagggttatagatctcaaaaataaaagcattctttagtcggggtgttgtaggttaaaaagaagcatcttgggaaatgaatagaagaacactaattgatttggcaaatgactgctacaaaaattatgtggggacacaagagtcactgactgtggcttgtctagactcactgtgattatgctccatcgcttttcttcccagaatgcgaaaaagaaaatgtatggctgcacagaagccttcctggctgatgcaaagtggattttgcacaactgcatcatttataatgggggtgagtggcttagatgactcctaagaaagagtatgctgtgtatgtgttgcacaaattcctgtccttcatgaaaaatcaggctcttaattcatattgagaatacttgcgtatagattgtgctaatatatgtgaataggaggcagtgaccaagttcattttaaggtatgagctgacatctaaagtggcttgcagctgcatggtgctgctgccttttagtgttatttctacaaaccttattttaatggaagtataattgcataaaataaaacatacagattttatgtttatattcactgaatttgacaaatgtgtaaccacaagatccagaacattcctatcagcctgttggattctcatacatgccattttctaggaaacccactctcaacaggaaccactttctgctttgtgttaggatagattaattttgcttcttgtagaatttcatataaatggagtcagagttagtgctcttgtgtgtctggctgctctcatgcagtgtaatattttgaggagtcatctgtgttatgtgttattagtggttcctttttttttgttgctgatttttttttttcattcgatcaatatgccgccattcatccatttaccttgttgatgctcatggatatttgggttgttcttagctttgggctgttaggaataagctgctgtgaacctgcttgtgcaagtctttgcatggacataggtttttctttctcttgggtaaatacctaggagtggtgttgccagctcagtgagtaggattttatttaacttactacgtttcaccaaacagtttttgcaaagtggttctatcattttacattctaccagcagggtatattagagttctcttttgctccacacactataagggttgatattgtctgccttttaaattttacctgttcttgaaggtgtaaagtattatgtcacgatgttttaatttgccttttcctaatgatcagtggtattgcgtatcttttcctgtgcttattagtgacttgtatgtcattttttgtaaacatctattcagatattttgttcattgcaaaaataggattatttatttatttatttatttagagacagagtctcactgaatcgcacaggctggactgcagtggtgtgatctcagctcactgaaacctctgcctcctgggttgaagcgattctcgttcctcagcctcccgagtagctgggattacaggcgtgtgccaccacacctggctaatttttgtatttctagtagagatggggtttcgccatattggccaggctggtctcgaactcctgacctcaagtgatttgcccaccttggcctcccaaagtgttgggattacaggcattagagaccacgccagcctgtttgctagtgtttaaggaaagatatatgcatatctgctttacgcaccatattgcattactaactatagcagggctgagagtgcaaggaggggaaaaaggagaggcactaggcattaagaatgtgtgggtcaggtgcagtggctcatgcctataatcacagcactttgggaagctgaggcgggcggatcacttcagtcaggggttcgagatcagcttggccaacatggtgaaaccctgtctctactaaaaatacaaaaattagttgggtgtggtggcgcatgcctgtaatcccagctactctggaggctgaggcgcaagaatcgcttcaacccaggaggcagaggttgcagtgagctgagatctgcgcccctgcactccaacctgggtgacagaacgagactccatctcaaaaaaaaaaaaaaaaaagaattggtgtaaagattataaactcaaatatatagaaaggccccgcctatcaaattatataaacaagtggatgaggtcaggtagaagaacaaaaacattagcacaagccaagaaggctgcaggtcaagtgatgtgctgtggatcatggagaacagaaaactcctacctggcctggaaaggtcgctgttggcagctccagtgctccattgattatagttactggatcttctgagttttcaaggcaaaccagaaatgtaggtatattgtgtgtttgtgtgtgtgaaatcttcgtgtcaacaaatttacaatttctaaaaataccataaagttcaaagaaaacatgactttggaccatcttgtcgtctggtttagtgtagagttagacctggggctagatggttactttattagctaagtaatgtaagtggtgactcctgaaccttggcatactcattcattaaatgggcacattttgtccctgcttcctagtatgacttcttgaggagctgagaagaaaatgtgtatgtgtgtgcgtgtgtgcgtgtgtgtgtgtgttgtttttttctagaggtggggtctcgctatgttgcccaggctggtcttcaactcctgggctcaagtgatccctctgcctcagcctcccaaggtgttgggattacaggcatgagccaccacacttggcccaagaagaaaatgtgttttgaagcactagccacaccagagctattcaagaaaatgtcttctttctcttgtattcttcttgggttggcgtctgggacaatgggtagaataaggccttttttcattaatttgagcctttagaatgtcaaagcattttaagaatattaatccatgatctctagggaaacccacataaattgctcagttgcagagaagatgacatcgaggcgccaaagagtcgtcgacattgatgggaggaatcacataatgtgaattactattagaagccaggaacctctggttttagcctttaaaagcttaatcctgggggaaaagcaagtaaacacattgttagcggaagtaaagtccccaggcccggtgttgcggtatttccattagaattaatcctgttttcttattcccttaggaaatcacaaattgacgcaaatagcgaaagtagtcatcaaaatctgtgaacatgaggtatgtgtttcccactgtcctgttttagatgcacccagaaggaggggatggggcagctgaagtttccatttgcagaatctcctattaggtagccgaggtgattttggaatttgttgaggccacacccctactcttcaaggaaagtaaaaagaacaaagaggggcccgagtatattataaaacacccttactgtagcaatgatctaagggagatggaaaggattttttgttttttacccttgagtcaccagtaagcaccgggcctcctgtcttttcctgattgcctagatagaattcgtaatttctgaccttggccccacagcctggtattgtttcaggtcccttttggtcctcttgcagaagaggatttgatatctgggggcatggccttgactgcttctgggagagtggcccaggtgtccaggagaacctgttttcttgcaaatgcccataattgtgatggcgtggatggaacagacctcttaggcgtgtgagctgtgaggctctggtggttgtgggacaggctggcagccaaaatggtatgagggagcttttctttattagatctcattgtgagaataaaaaaatgagatggaatgaccttcaacctgtcagtgtgctcccattcattcataaagaaaaactgttcagatagcactgggacccatccatgtctttttatatatggatatatagatctagatctagatatatccagatagatagatagatgatagatagatagatacctggccaggtgcagtggctcacacctgtaatcccagcactttgggaggctgaggcagggagatcacttgagtccaggagttcaagaccagcctggccaacatggcaaaaccccgtctccactaaaaatacaaaaattagctgggtatggtggaacatgcctgtaatcctagctaaactgagaggctgaggcagaagaattgcttgaacctgggaggcagaggttgcagtgagccaagatagcaccactacactccagactgggtgatagagtgagactctgtctccgagaaaaaaaaaaaaaatctatccttataaatttatatctatatatagatatagttatctatgtattttttgaggcagggtctcaacatggactgggtgcaccatcacacccagctaattaattagcctggctatttctttttaaattaattattattattttttttgtagaaatggggttttgccatgttgcccaggctggtctcaaactcctgggctcaggcgatccttctgcctcagcctccaaagacgctgggaatataggcctcagccaccaagcccggcttatgtctgtatatttatgtagagagagttttataaactgctttctcacttagtttattttatgtattttctctgtttcctaggtaattaaactcgtaggaagaacagaatttttcatggctgtatagtattacatacaacacatggacattcatttaattactcctcttgtcattaaatagtacccagttttatcagcatcttaagtaacaaggtgatgaatatcattgcgcatttgatgatttccttagtttaatttttaggaataaaactactatgaggctgtgaacatgtcagatgttccagttacaatgaggctatgtcctttccaatattgggagttgtaattacaaaactatatgtaaatatgtgcccccctgccccaacgatgtgatctgtaaaaacggtaggcatcttactgtgattttagtttgcatttccttgaagaaagtcatacaggctgttttggatatgttcctttggaatagctcagaagtagagtgggcttagaagcaggaggtgcactctgccatccatgcatttgtttgcacattcattcgcttacttactcgctgacctgtgaaatctgttagtcttataattattgagcacctgttaaatatgtggcaccttgcatgataagagttaa

SEQ ID NO: 131 - DNA, 52213 bp, Homo sapiens
atggctgatgtcaaaacgcctcgcgggggcagcccaggggcacggccgctccgggggtcccctttcgtctggagaaacacagaggcccaccatcacctggccgcgccgtgcaggcctctgcgcggacccccgcccctgtctccaccttccccaggcctgcggggcacgtgaggcctggccacacggacccgggcggagggctgcgggggtgaagggagcccccgccccaattctgcacccctggcctcccgcctgcctccttgcggccgagcagcctccgctgcctccgcgcctcccgcccgcccggcgttcgtccgcaggctcggcccggctcctcctcccgaccccggtaatacgaaccgccggcggctaacgcggcctcgctccctctcgcaaacctctccctcctcctcctccccctcgcctcagctcctcctctcgggcgggagcgggtagccaggggtggagtgggggagggcggggaacgcggccgccccggcgccggcgggacgtggggcgggcagcgggctgcagggctgcgggcgcttggttcggcctggcccggccggcggctcctaacaccgggcgggcggctgcggcggcacttccgggttggccttctccatgttggtctcgggaacgtgaaggggcggggcctcgaggtcaggggtcagcacctccctggttgccgtggcgactggaggcgcgcgacgcgggcgcaatggcggggacccggggcttgatgctgcttgggcctggcccagtggcgggtcctagggacgtgggtacctgcagaggccggcaggtgagccctggggagggctggggaccgctcgtgagaggaggtcatcaaagacccggagacgcccctaactagggcgtctttgagggcaggggatctgtgttcgctgtgtcctggatgcccagtgcctggcaggagcaggtccataaatggtgttggaacgaatcaggcctcttcactgaccgaaaggaaacttttctccaatctcctatccacccttctctttttgaaaagtccgtaaattgactgaaaatgacatcccccacccagacgaagggcgatagggaagcaaatagtttccacagggagtagagatgtagggaggcactgggctggcatcagaagacctggttccggccgcgcctctgccgctatcagtgtgtgtgaccttggccgagtcatttcacctccatgagcctcagtgttttcacgagtaaaaaagccagttctacctcatgtctaagactccatcacgactctatgggctcgacgtcaaaaggacccccgtggggactcacactgtggtggactgtgcaaatcatgtggagaccatgccccaaacacgggtttcgagtttcaggggataatacatgtgcctttcctagcacaatgcggcacataaatctccttttgcccctctatttctcaattggaagagacgcttatgtaccaccccattgctgttaattctgttcgtgtcttaccttcccaaggaaattctaagttttgggactgccttgtctatcatgcagtcccttcatagtggctagcatgcagcagacaatttactgaattacttaatgccttttttccctttacaagactaattttgagagtaaaacaatatgatacatgtaaatgcacgtttttttaacttaaatggccataaacatgtaaagtatcgtgtttattattttcaagcaaggtttaaaacttctcattcaaggcagaatttttcatccctgggagacagtgtatgaaaaggccatgtgtggaaaacagaacaaaatcatcgtactgcgaatatagcatctggatcccagagtgcacagttgtcaactttaaagaaaaatattcttagggatttttaaacagtacgttggaacagtcaatggtggaatttcaccaggatctctaaggagaaataatttgacacctgaaacttacaaaaaccaaataaacatcatgaaatcaaatttaattaagtttagagttcttatacattttaaaagtcttcatgtctctattaaaggttgtaattaaacaatagaaaattataatagtggatgtgtatttctgaagagcttaaattggtaagctttattaatgattataaacttgtttacaaatataatttcactcatctctgaaatatagccatctctagggtagaagttggcagcagtagttcacagcaactcaataacatactccaacacaactcagagaatactctaaaggcaagagctgaacaattggaattactaacctctctttctgtagcacctaaatttcttttgagttttcccaacagctggctagagccaaaattgtttagttttactggtgaaatcagaaattatgacttaaaattttttaagccagaataagaaaataacatatttttgcccccggggaaagcaaataaacaaacaaaccaaatgagctaaatagaatctgggattgcattataataaggaaatgacttcctatagaatgttttccttttttgattatattaagagaataaaaatatgacagtggagtcaaagatatggttggcttatagtgaaaaataatgacaattacataagatctgggatcaaagtgcttctcccaaaatgtttattgttttacagttttaaaaattcttttgactaattctaagatatacatggacaacaatttaaaaaggaaaggattgcgtgtgtaaggacaacataccagaattgaagagagtcactttttaaaaaattatcctatgactaatgatacatccggaaatgtatggtacaattccaaaatcaaagtcttgggaaaataatatattttagaaggaaaatgctgaacattctaattttaaactgttaacaatgcctacagcaatgaataagaatgctttgaccagaaagttaaaatagtcaatatttattccccatgagtagaggatttcacagatgaaaatatttactacatgttgcccctttcagtcccataaagaataagtcccataaggagacctattccagacattgggggagattttccctttggacaaaggcatctctaaaatcacatcttgcaaatctgttgcagaacaattataatgctctcatgtttaaatagcccactgggtcaagcgtgttaatgctcccatgtacattatgtaatggatattaattattttccagatggagattcagaaacataaggacaacaagaaacttccccaaggtatcattatagtctttagacttcagacacacaccacacctcaaatatatacacaactgaaaggtatgtaaaattcatatatatgtacatatgacaaagccccagagttatattggagatacatagatagatgatagatagatagatagatagatagatagatagatagatagatagatcaatctccttgtaatcggttgaaaagtgaaagagtatttggcaaattgacttgaaattattatggcaatgaactggcatttggggatttttggggattgttttgttttgttttcatcgctggactgatcaatttctcttctgggattgggcagtgtgtggatacattttgtgatgcccaagaagtaacatggtatgtagtgtaaagagctctagtcagcagcctgggtcttaatcccagggctgcctattactagctacatctctttagggaagtcatttttcttctttgggctgtcttgtaaaatgagacttttatagcagccaccaaaggatcctctaacatttaaagattctacatagtatatccacaacgcaaagaagcaaattgcattataattatctaactgaatttggtcaatatactaaagcagatttcctttttatgtaacatattaataaagaattctctaattcaggagaaaaaaattattttttaagatttcctgacagctctgtctcccaaatgaaggtaattaatgatcacagaaagcaagtgaatataagttttattaataggctctgcatgaggcaattgacaccaacagctcaagatttggaagaaattgcatgtatgtgcaagtggttttgagcagccttgaactttttaattgtagtaataagtttataacttctatctgtattatttgtagcttttttgaactgtgaaaatatgctgagattggtaagaatttacggagcaaaatacacatttgcatataagaaggttttgtatgggaacatctttcaatttccttttcatagtatcatagtattccattgtataatttttattcctacaacaaaatgcatattaatgcatagaacacgaattgattaactttaactggtatatggcattgggtgagatgaataagccccatttgatcttttctccttccaaaggacatttaagttatttccactttttcaattatcataaacaatgctgcataaacatctatatatctcctatgcacatatgcagggatttgttttggtaattgatgatgaaattattgggagtttgtgaatgagagtatggaacacccatgggcctgagtattagacttgaattctaatcctggttctacaaactaaggagttatagacctggcaagccatattctgtctgtgcctcagggactccttccaaatccagaattctcaaactccttttgttatatttactgagaagcagagattattgctattggaagaagattttgtgactactttggtatttgtcttcaaatttcaattgtctcatcatcatgagtctttctgaaatcttccagaacattgctgcttctacagatttaggtgcgggttaataagggctggagagttttgattattcctgaaggcaatgattagcagagttatataaacttatcatatttgtactttgtaaacatctgctaaattttttatgttcaattaaaatccaagacagggatattttttaaacaaagaacggggtattcaaattataatatttctaggacggcctggaatccataaaatttctgggataatatttctggaaatacattcatttagagagcattaaaccggtgggcggatggcaaaaacattttgtggtggtggttttttcccccatgtgagatcgactgttctctgcctttctacttatttgatctatgttaaaaaaagtaaagggcttttgttgtgttttgttttatttgttatattttgtgtgtttgatataaagcctgggggaaaatgacattttgaaggatagatccaactcttcttgttccagggccagattttaaacatttctcctaaagcaactttcaactgacctgaacaatgttttagtccatctggatatctgatcataaaagcactttgggcttagaactgtatgcttatcttttacacattctgggttaggtcaccttcagtgcacctataggttgttgccagtatgtattataatcattttctggttattggaatgatcatggctgatctgtacagccaaaactgagcataagatgttgcttagcaatgtatacctaaaggagatacctcatttcaggaattatgtagtatagtggacagaaatcttctggcttaaaaaactaatgttgtatatgaccttgagcaacttaaagtcctcttccagaaaacagtgaattttacatttcttctctctccaaacttggatcttgggttatccagaatggcttcccaatagattcaaatcaatgagaaaatgcattttactgttttttttatcaagtttatgcaagatgagaaggtatatggattgtgcaatttgtgcccataactatgttcttttaacacaggaaaattaaggaagtttttcaaagaaccctattccgagtaagaagtgtgttgcatgaatttctaaggtaggttttgcccagatcacctttataattttgatggtcttcattttcctttctgtctacacttggacattggaaaaaaaaattgagcaagctagctttgtaaaagtgaagtcttctgaattaggcacctcaggaatcaagggcttgtaacgctttctgaaacaagatttgctgcaaagttccttggatggagacactgaacactgttgagtattcaccctgtggtagatttttgtccccgggcactaataacagtgtgaccttgggcaaattgtgtaaaccttccaaatttaggtttcctcatctgcaaagtgggttgttgggaagattaaataggggaatcaggtaaaagtacagagagggcctgacacataggaagtgctcaaaagatgcttgttgctgttggcttgatgatgtgtcccttcttttccaagtacttactttcctcctatctgaaggcaaaggctacacagcaattggtctggactgttcctcaccaaataattaaggatcctgagctgtggcaggtgcccctgtaacccagcaatggagaccctgagttatttttgtttcaagccaaactcaatgttattggatactctttttctaaacaaaagtaacatagaataagcccttaatagtatttcaaaccttcttttaaaattcaataatgactttctaggtatcattttaacaactttataaaaatgaatcagatccttgagttgaagaaaaataactccttacattatatacctatacgtagcaaaattggaaatttatgtagtagatcatgtaccaggtagtattttaatattctagattttcacttcagagagaattatgataaatttaaaaacaaaaatataacgtcctgtgaatcttacaacaaacattctgctaaccagtgtatccatactctccttccctttcctctccctctcctcctttcccctccccttttcccctttcccctcccttcccttccccttccccttccccttcttctccttctcctccttcttctccttctccttctcctccttttccttccttccttccttccttccttccaacagaaatgtatttctcacaagtctggagatgggaagtcaaagaccaaagtaccagcagaatggttgtctagtgagggccctcttcctcctagatgacagtctttgcactgtgtcctcaagggtagaaggaatgagccagctctctggggtctcttttataaaagtgctaatcccagtcaagagggctctgccaggggccctgcctcccaatattatcaccttggtgctaaccaatattttctaacttccatttgctactctaatgttaactctgttatctcaattttaataataataatagctgacatttgctgatgacatgccttacactgcattcattaacatctcaatctcatttaatttgaaagagataaagcaacagccaatacacacattaccactttttttcctatcctgttacaaaggagatgaggttgtgggagaactctctttaggcattgttcacatcaggacacttgagaaacagatccttcatatcctttggacaactcttgtacttcagttggctttaagcattatcagagcatccttgacatgatgccaggtcctaacaccgcttcagtgaaagctcagagacaagcaaaagataattgatctattttgtgccgcatgacatactcgatgagcagcaacatatactgtggtgtttggcctccataaactgcagagaaattgaaatatagtaataaactttatgcacggacaaagggtgacctaggatatcactgaactcttctgccttcataaccaaatgtcaaaatgctaatagtctgttccttgtggaaaaatgttgagttttcattcgggagatcaggacttacacactaactcaacctacagtagacacttgctagagaataaaacacaataatgcacgtagaatcgttctgtaaactgtaaagaattttacaaatatgaaattttattatggttttagtcttgtatctattaaatgtatacctattagcatgcacacttttttcttctagcatcaaaggttgcttaaaataacagtggaacatttaaaagcaagagaattctaatttaccatcattcaaattatgttaaatccaactcaactttataagctaaggaacatgtgaaggataaataaaaatttgatagttaagaagataaatatatgcagataaattatgtgatgagtcaaattgattattacaggacaatatactgtattaataaaacagactaaatttaaatgtattgtgcaatggcaaacctagtgccttcttggaaaaacatgccttaacaagctcatgtggttgcaaggttgataatatcttgataataacttatgttgttcttattcctagtaattgctggcctccttatgaccttccgcctagtttcaggcagtagctaggagagctagactaactgctccagagaagtgaggccaaggcatgcaacagagtcacttctccgcttttccatttcaaagtagacaataggggaagatataacaaaagccaaaatttatgcagtaaagaaaaaattggggaagaatgcaattaatgaaagacctacactatacaaggatttcactggacgaagtgaagaatagggagcttgtaaagaagatcaagatagttggacaggtggaatgtctccaagacctttccactcgcctccccacttgttgagcatgggagctgggcaaatggatgatagaccatccagataaattttggcatctaaaagtaattgtcacttgcatcttgtttctcaagaaggaccttgaaagtaagcaaactcctagagctccctaatcccatgcaccacattggcttggagcagcaacagtagcagtagaatagcagagcagggggactcaaggccaagacggtcttgttacaggcaactccctgagcctccttccatccgagaggtacctgagaacctctaaaaatttcatttccccctgaaaggtgagaaagtgactgagagagggctgataaactagggtcctccaggtcgggattgggaaaattcagaatatacatggataaagaaccagggactggccatgataggacctacacctattacttcatatgacttgctaataggagtcaatgctgacagccatagaccttcctgggcttctccctggggcctcaatttcagtccagcgttaagaacttagttttggtctcagggagaaggatagggagatggaaattttacctgagtttaaaaacctgaatttatgcagatatgacattttctggatacattttgacaagagtagaactaggggaatcaaaatagagattatgttgagtaacagggaaatagagttacagttcttgcctatcatctgagtatatggactgaaatactgtacctgctacatacattgtaagcaaagtgaggtcatggccagagcccaagggtttgaggagccttctatgacgtgatgagatggtcttgggtcccctatatgattagcttgtggtggtacattaggactaaatattccaaatgcattaacataaagctgaagtgatgtccttagtgaacttggtcttaaaaattaagagcattttggttgggtgacctaccaacaacatacagggaagagatacaggatcttggttgattctcactgcagtagacattgattttgtggtgtagcagcttgtaaaattaatgcaaatttgagatgaactaataaaaatatagttcatgaaggtgccccactacttgccctacctctcctctcctgttacaatagatcacccatctttgttcccatctgaggactcaggtaatggacttcatctcttcttgtcttctcaaggattttgcatctgccattatcctttctccctcctgtatcctcagttgttttcttctctactggatcaatgtcatcaacatacaaatattatctagtatttctcatattaaaaaaaaaacttaacttgcacatacacccctgtacctcctccagctacctttctgtttctttttagagcaaaacttattgaatgaaaaacttgttcatatttactttctctttctgctctttttctctcgaacatacatcaatcagatttttgtcgtcacccctctacggctacacattgtcacagtccatatcttatttggccaattagcagcacctcacacagtttgttgcttatttttttatggattaggtaaaatgagtgtttacatttataaagcaggacatcttaggagaactccaaggtttggattgatggcctgttctattgtaatattttgtatattatagtttagtgtcattatgattcatggtgataagtagtaaagacttaaccccaaagctggcttactatgcttatttaatgtatttttttcaattatatttaaaatatattttctattcattcagtgcatccactataaaatttattagataacttgaatgagctgcttctccaaaaagcatgatcgctaaagagcactcttagtttactagctgtaacaagggatttgaagctgggacttcaggcataaatatttgagtcttggaacttttctctggttttgtgatatatatagtaacctacaattttatacacataatatgtaatattaacatactatatgtaatttctatgtttagtattgtaaacttcttagaaacataaatacattgtggtatacattgtgtactattataaatataattcataaatatataacataatcacaaacaatatatactaattatgttataggcatatatagttaatatgttgaattttatatgtatgtatataatttatatattctttggctgcaggaacctgagactcataccagttaatttgtttagaatggttttgttatattgatatatgtggagcaaattagaggtatggaatttcatggatatttaagcctaggagtcagtcctggcctaggtgtcctggagtttagcgggagtttgaggggtcttggcagcaggaattcacggcttatacaggtaatccactcctgacgtgcctcgctccttctccctatgtctccatctcctcactgtcacctagtgctctgtattttggctctccctcccagcccctgcctactcctgttctgcttcctcctcgtaatgctccttcttcttgccaggatttcttgtggcactgacttacagcttttagccttaacttccatggttgagaggaagcatcagcttttcttgaggcaggacatatcatagcagctctggctccgtgacctgtggttgggtggagggagagagctagggctctgagatctgcataggatttccctttacttagggatgtgggcgggaccagttcacgtgaatggagctgtggtaggcagatgtgatgactgacatataaaacatattaaaacatagtcattgaaagcttctgatgtggttcaaatttcagggtcaatcttcatttaagaacaaaaatacattctactcagtttaaatgaaatatagtgttcaaaatcactaagtataagctcttataacacagatgctgtatgatagaagcacatatcactccattttttctatattaatgtttgtagatttttttctttaaattgttggactaataatgactttgtaaattataattgctaatattctctggagtggaaggcttttcaaatcaccttccacattaatacctatttaaattaaaaaaactgagttgcatttggaatttctgggtttttctgtttgtcatgcaaacattcagctctgttctttttatgataatatgaaataaagtagtttctcacagtaacattgtaaatcatttgctttctattacatgcagctggttttgttactataatgattttctatgagtgcatattgcagaacacataagatgcaatgtgatattcctttactcagaatttgtatgcaattattgtttgcccaaaaataatgagaaaatttggaaatatagtaatttattgtaatacatttctttttaatatgtatctacactgagggaaaaaatctaacttaaaaaaatgacatgccatctttttttgttacatagactagagttttcatctcatggaaaattcagaatcaaaatcaaaaacagctgaggtagttacttgggtgccttccttcagcttattcaaaagaatataggatgaacagtaagaattaagtaaaccacaaattattttggagtgtctggtttatgttataaataaatttttcactgctggttgttttttcaaagataatgcctgtatttttgatattcattcctgtgatctaatgtaaactctgtcctgccagtttggtgtattggtagttcatgactaaactttttttattacactcatatgctataaatatttctcactctgctcttttgaatctccctaaatggcaatagtctttaagacatgtcacggaaaatgttaagagaaatgtcccacttttgtgtgggtacatattaatttcacaccttgaatggagcctagtttcatcaataatgaagcatctacttttcagatgctgaattaaaaattattttattattaagaagaaacaacaacagcaacaacaaaaagtagaagcaacaacaacaaaaacagtcaaaatgaattgtcactgtggcatcaatgttttgttccttattggtcttgactagaattttaaaagacttgatggtaaatccacatttgtttgtagtttaatgaaatcatagtacgttagattttggttttaaagtataaatgtttgtgaaccttttcttatatacttaaaaaaaatactcatattttcattcctaactacaaaggtaccatcactaacatagtgcattgcatgtaatagggaagacagaagattactagttattgcctgtgtgccacatatattagtagtgtgtttaattctcactacaatgttccgttattagtctcatttcctcagtagttcctgtggctccatagaaaggagcacagagtttataagagggggcagagtggggcaacattgcaccaagaaaaggtttcagaggcaagaactgatggagagggtgatcccttaggagtgagacatcaggttgagcgtggtggccatctgtaatcccagcactttgggaggcccaggcaggcggatcacttgaggtcaggagtttgagatcagcctggccaacatggtgaaacccatctctactaaaaaaaaaaaaaaaaaaaaaatagaaaaattagctgggcatggggcgggtgcctgtaatcccagctacttaggagactgaaggagaagaatcacttgatcctgggagggggaggttgcagttagccaagatcatgccactgcacttcagcctgggcgacagggcaacacttcatctcaaaaaaaaaaaaaaaaaggagtgagccatcagtgatggagaggccagcatgatgctcactatgacctaagaacatatggaaccagccagagcagccaaatgaaaaagcagccctccacactgctgacaattaagtaaccagttacccaagaagatcccttttccctggaagtgttaggtctccaaaggaagtagggtcatctcaaaccaaatatcccctccacctcctgtcccactcccatttaaagagaagaccacgctacctccccattccaagttccttgagccacccatcgagggtgaagtaagattgggcgagtgctttcgagaggatataaattgaactttgtaagcctgaacagatatgtatgtgttttaattccagtgtgctcagaatattatgaaacctgttgaagatattgttaagggatgtgtctaccataaaccctcttaaagaaaaaacagaaaaatctgtagatcaagtgaaaagaagtttattagatctgcagagtcttagtggtaccttaaagtgagggaatgaggaaaaggtgctgggaccttggttggttgttttaaggtagatattgcaaggcaggggtgggagtaactggatgagcttgggcagtgtgacataatagctttgatcagtttaaagcaaggttaggggcttgaagtgaatcctctgaggaagttgctagtcttaatctgtaaactgtttagttgacagctcaccttctagaactggtttatagtactctctttcagaacagtcctcttctagatcaagcagccatgttattttgcttggtctcagtattgttgaacacagggagagagaattattcctgatctcagtactgttttaacacagggacaagaaatgataagaattttagctctcaaatgagaacagcagatttgcccaaatcagtgctaaaagtggtgattggacaaaaataaagctcttttacatttatacccccacttcactgaggctttgagataaataaattacattattacctttatttggaattggaagctcaaagaagttaaaaaattgtccaagatcacaaaatgaatgagtggaggagtcagaattcaaactcagctctgtgtaaggataatctggatgagatatttgctgccccgttgattacctgtgttggtacgatctaactttaaagtcttcccttctcatctccccccacacccactactccaaggaaaacttaaccttttttcttagcagagctttgatacaatttatttttctgttaagggcttaaaacaaaaacatgcccttggcatgaagcatgttggtacttaattacatactctcttccatagttctttgtctcttcttttcaaaaatattgagaaaagctggaagtgcttcttacacttcttttgtatctcccagcacttagaaatgctaagcacagagtagaggcccaaatactccatttaactggactgaatatttgccagtcctccagtaacaatgtctccactacagaattttagctactatttaaggcacagttgctctgccaaatatttgttgtgaagaataagcaaatatttcccaaaatgttcaggcaagcatattaccactgcaaacacgtttttcactgtgaagtttttctcttattttcatatttatatgtatgtgtgtgtgtgtgtgtgtgtgtgtgtgtgtgtgtgtatgtatatagcagtgtctcaactgcatcagaaataaagataagactacagaaacagaacaattggcatttcagttctatgtgttaaagatggttgtttcaatcccctgaccgtaaaaacaaagacagtgactcaggaaatagtggagattgtcctcatatatgtttttatttaaaaaaaaaattcatctcttatatcacagggtatggaatagaagtggagaaaggtggagggcatttgttttcctgagaacgttctctataaccttcctgacctccacaggccaccttcagactgcccttctcttattctttagcgctaccacaaagggtcatgtaacttgatttttcagttggataaaaatattagcaagtggggaccttacacaatgttatttccttaggttcccacattcatctaaggagagccagagctaccaccattttgattaaaatgattcgctttcaataagattctaaattgttttaagatggtggaactgagcacaggtggccagtggtcactgagtgctttcagtggtttagacgattcaggaaacagtgacagactctactgtcaccagttgggtggggatcatggtctgtgttttctttgggaaggcagagaagcaggtagaggtggctttaaccactagtagtcagtgtgtcgtccctggtaaatacgtcgatacaaaagggatatacacatttcagactcgaaaagccatctgttctatgcttccagtgaagatcaactagcagagtgaaatggaaaacgaggcaattactctaggcacaaatgccttgatttgaaattacctagatcatgtatgcttggtatttttgtggttgtcactgaaactaaagcaattctctgaattatttagcaaacaactttatccattcgactaagttaatagactcaatgtcaaacatccaggacattcataaaatatccagctttgcacgaggataattttcaaacctttgagcctgcaatgggaatagattcttctaccttgtgagtgaagtgtgcagccctgctgctcagaggggacccctcacccctcctccctactacctcttaagtcttctcttttctttagtcttttctccacccaccctctccttcctacacaaacttattttgcttttcctagttcagaacgctctgagttatgtagacaaaacattttattgtttgattaaaaaaacttttattcaacgtcacattcaagttactgcctacaaagttgttatagtttttccttacatatttataccacctttggagcttctatgtctaaactatatcctttaaggaaataaattaaaatgaatttccctgaatgggctttgagtgagcaagaacttgttattgcagaacctctaggccacttgactgtcacaacctcctcaggtgggatggctaagaatgtttaaatacagaagctctgcagagaaatttcctctaaccatttgatgcctaagaaagaacaaacacctagtgtctaaagaatgttacctgtccttcagctcttatctctgtttggttttcagggagttggcttccagcctgataacagatctcgcccttacctcgtgacctagccttctggtaccaggtccctgttttgtgccttctcagtgcccactttctccttttgtcttcttgttttgaccttggttcgttaacctcattaactcaggctacacaaacctctagcagaggccaggcacacccctcaagcatgacgctgcccctcctggtctggctgctggagccctgctaactgggaacagacaccctcccttggttccatcttcctcagtaaaccagagttgagttcaagtaggttaaagcattacatttgtaaatttgtaaaggatcaagttgtgaaaagaacggcaatcttgttcttggagactttattagccagtaaatggaatatgatacatttataggagtgaagacccaagctttctgaacttcattgagccagaaagatgtgttttatttcatggagtttatggaatgactacagcataggtgagcttttacacagcaccacattgacttgaggtaatcataaaataaaaatgggcaaggagacccttcaggtcgaagtataatttatatatacatttacccaatccaatgcaaagaccccataccatatgcttttaatttttggttaaatttttaagctcttttgtttgcttttttgatgtaaaagaagtatgattaacctttttttttaaaaaaaagatacttgctgctttccataaaacttgtattataataaaatgcactgactactgtaacactcatatcagcaaaaagtgacacaagatagcattaaaaagtccttcactgtgacaaaataaatcagaattgtgtggtaaaccctttacagcttgttatcattttgctaagaaaatagagctactggcaacttttatatggcgaagctgaacataggctagaaaggttttccagatgatgctaaaatcctcagctatattgacgtaggtcttctatttcttgttatgtcatgaattttggaaaataaaccttctgagagggaaaaggtaaacattttaggaccagaatgaactagcataaactatcaagaacaaatagggtgtataaatagcagggttagagaattgttagattgatgattgattgatagatagagagagagagaagtttcttgttaattttgaatgtttttttacatttatcataagccagaaaattagctcagttagttagttgaaaggaagggcacaaagtaatttaggtggttgattttttaaaaatacttgttaatttttttatttttcaagtgctttttccatttagaatggcaaagacaaagatgataccacttcatttatttctattctcattgtgcattctcagcacacatgagccaaacaaatcaagtcacacacacacagcatgacagtctctctgactccctcctatgtcttgccaaagaaatgatagtcaagagttggatgtgcattctttcagtcttttctatggatttcacacatatgtttacaaacctgtacatatattgtttacataaataagatcataatttatctgttgtgcttcagcctgtttttcactcaatatgccatgagctctttttaaacacgtcaccttttttgttttttttaaactggctacatagaatttcatagcgtggttatgtcatatttcagtttcctattttactacatttattttcagggtttcactgttataaaagtgctacaatgaatattcttgtatattacttttaaaaaagtgacagtgtttctctgggatagcttcccagaaatggaattgctgagtcaaatagtaagcctttttaaagtgttataggttttactaaattgccttccaaaaagcttatttatcttttcattaaatatataagcatacctattttctcacatccttgaaagctcctgacattataaacatttttgttttatctttctagctgtggaagtggagatttatatttcattattgttctaatatttatttacttaattatatggtcaattgtgtgtttatttctttatttactaattatgttttttcctgaattgcctattccattttttatacatttttctttggggttgtttgttttttctttggtgacttgttgatactttttacgtattttggatattaagtctctgttaaatatgtggcagatattttcttccagtctgttgcttttttttgagctttatttctgaatcctgttttagcgtgtaacaatattgctagcacttaaaatttcaataaagcagccagctaactattcgttcagttcacaaattatttaattagttttcattttacttattcagttccacattaattattatttaaataattttaaaacataagcttgaattttatttattttattctgagttgacaaaaagtacttataacttttttctctttattttaaatgtttccctccctttagaatgctatttcgcattatcaccttcatctcttaaattatatccttcttttttttttttagagatagggtctcactctgtcacctaggctggagtgcagtggtgccatcacaactcactttcagcttgaactcctgggctcaagccatcctcccacctcagcctccagagtagctgggactacaaacacacaccaccatgctggctcatttttgtatttttagtagagacaaggtctcactatgttgcccaggctgctctcaaactcctggcctcaagtgatcctcacacctcagcttcccaaagtgctcaaattataggcataagccactgtgcttggccaaaattatgtctaagttttatcttcatatatttagaggaaattatgtctatttttggcatatgaaaaggtaccccaaatatgaaaagtttactttagcacctgtggcacacagaccctaaagtgacccccaatgaactctgctttttggtgtccactcccttgtataactccctccctttgagtgtgggcaggtcctgtgacttgtttctaactattaggacacaacagtggtgatgggctgtcattcccatgattacatcacattatataaggctccaactcactagctctcactctcatgctgctcatgaagaaataagctggaatggtatgagctgcccatggagaggtccatgtggtagggaacagtgggtggcctctacaacctgagggcctcagtcctgcaaccacaaggggatgaattttgccaacaatctgaaggagcttggaagcagatttttcctcagtcggatctccagataagaatgcagcttagccaataccttgattgtagccttgtgaaactcttaacagaggatccagataagctatgcacagacccctgaaccacagatgctttaaggtagtaaatgtgtattgttttagctgctaagtctgcagtagtttgttacacagcaatagataactaatatagcacccacatttgaaatatacatagacatcattaggaacaaaaatagtatggactagagattgaagtattagttctttggcactataatcatgttagaaaaatgtgctatggagtaatacatataatactatatgatacagaaaatgctcatgtttttctagctcttaaaatgtagtctcaatattttactattatattattactgtaatagagaaaatcattagaaactggggaaaactattagatcaagctttaaaactcctagaactatattgcataaaacacctagcataattaattatgagtctggttattggtattttacctgtgcagacactgaaacaaatacagcatctactctagagcttttaaacacacagttacttatatgtttcataaatgaagatctaagtgactttaaaaagtgagaaaacaaagatcagatagttgtagatgtgtggtattatttctgagggctctgttctgttccattggtctgtatctctgttttggtaccagtaccatgctgttttggttactgtagccttgtagtatagtttgaagtcaggtagcgtgatgcctccagctttgttcttttggcttaggattgacttggcaatgcgggctcttttttggttccatatgaactttaaagtagtttttccaattctgtgaagaaagacaaaaagaagaaatggggaaaggattccctatttaacaaatggtgctgggaaaactggctagccatatgtagaaagctgaaactggatcccttccttacaccttatgcaaaaattaattcaagatggattaaagacttaaatgttagacctaaaaccataaaaaccctagaagaaaacctaggcaataccattcaggacataggcatgagcaaggacttcatgtctaaaacaccaaaagcaatggcagcaaaagccaaaattgacaaatgggatctaattaaactaaagagcttctgcacagcaaaagaaactaccatcagagtgaacaggcaacctacagaacgggagaaaatttttgcaatctactcatctgacaaagggctaatatcaagaatctacaaagaactcaaacaaatttacaagaaaaaaacaaacaaccccatcaacaagtgggcaaaggatatgaacagacacttctcaaaagaagacatatatgcagccaacagacacatgaaaaaatgctcatcatcactggccatcagagaaatgcaaatcaaaaccacaatgagataccatctcataccagttagaatggcaatcattaaaaagtcaggaaacaacaggtgctggagaggatgtggagaaataggaacacttttacactgttggtgggactgtaaactagttcaaccattgtggaagacagtgtggtgattcctcagggatctagaactagaaataccatttgacccagccatcccattactgggtatatacccaaaggaatataaatcatgctgctataaagacacatgcacacatatgtttactgcagcactactcacaatagcaaagacttggaaccaacccaaatgtccaacaatgacagactggattaagaaaatgtggcacatatacaccatggaatactatgcagccataaaaaatgatgagttcatgtcctttgtagggacatggatgaacctggaaaccatcattctcagcaaactatcgcaaggacaaaaaacaaacaccacatgttctcactcataggtgggaattgaacagtaagaacacttggacacaggaaggggaacatcacacactggggcctgttgtggggtggggggagggggagggatagcattaggagctatacctaatgtaaatgatgagttaatgggtgcagctcaccaacatggcacatgtatacatatgtaacaaacctacacattgtgcacatgtaccgtagaacttaaagtataataaatatatatgtatttatatatagatatgtatttatatatatatgtgtgtgtgtgtatatgtatgtgtgtatatatatatatatatatatatatatatatatatatatatataaatatatatataaagtgagaaaacaaaaccttctgttcaggaggaatttctgagtcttccatcaccatcctttctctgccttcccccttccccctatttgctgtggtcacttctgtgattgtcttttatttcacattgtcgttctttccctttcttcactttttccttttgctcatcatttatgtaatccatacaatgaggtactacttttttttttagggtattgactaaggattcagctttaaaaaatgtattatcaaataattatttggtcagactcagtagtttttcagattcagcatggtaaaaagtttgattgctaaactgctcaaagataaatgactttatttccttcgtgctctgcagactcccctgagacatgtattctggttcctggctgtgtccctttgcagttgcttgagtatagtgcatgtttatttcaagcttaataatcattgccttttcccagcctccgttcttgtcagttttgatatgaggcttcttttctatagaaaggtctagccagtgactcccatgccacttgacatcttggtcctcaccatttccagctttacccatgtttgcaggtatctgaataaatttccagctcattttccaaacttcacacagcacttttcactttctactttgcttcatactctgtacctgtcttatcttctgttattagaaggcagaatcccatactgctgaggactgtgctttgcaaataataggccctggatagatgactaagtgaatgaaaaattattagaatttttaaagcatagttaatatgctttaatatggattttggatttcagaaattggtggaattataagaaacaatggggaggggccttagaattgccagttttaaatgttgctaagtaaatttagacaatcatttactatcatcattatttcataaaatgcagtgcaaaacaaaaatagggtttataaatgaagttcaacatgcacaaacaaaattcagaggacataatgtcaggataaaagattgatcttttcttaaaattgatagatcaactttaaaatgactagtttactctgttgtcctcttttctcattttgcagcagacatctgaaatcttcgtattgtactagcagagtctatatgttttaaaaatcactgagctagtctaatctttcactcgatacaattatcctctttaaaccatcgtaggtaagatctgcttgtagcatatccaactgttggaaagcttcctgtctcttgcatgtgactagtagtgggtgggagagaaccaggtggacagattcatgtagccatcatcattatttgatacagagctgttccatcaccacagagaaactcgctgaggtacctctttacattgtatgttttaaatcatttattttattcaaatagagtcatcgtaaacatattcatttaaactcggaaggtggtggatgggattttctgagaggtggaaggcaggctttgagccacagagagccactctaacatttgaagattctggtgatgatgctgactgcctggccacctaagaggaagaaaggtttaccaacccatctctcaggctcacagtccatctcccatcacctttcccccttttaataccctttccccagcttttttatccaataaacctttactgggcactattatgtctctataaacttagaagctaggaatgaaaagatggaaaatgaaatccctgccatccacgattttcaattgagtaacaagacagagacctacacaatgaaccacatgtaaggaaagggatgcagtgctacagaagcattgagaaagcaactgattgcgacaggacaatttttacacatgaagtgacatctgagctgttccttggaagaaaagggagaatcaggagaaagggcgtttaagcagcagaaacaaaggctataaacactgggagtcaggagcatgccctgcaagcatggccagtggtctcctgcatcagaacagagggttatgggagggaatgtggctggagagataggtgggagctggatcacaaagggcaacaaacgccttgccaaggagttggggctaagcagttggagaccatcaaaagattttaagtagggatgtgatataatcacatttttcccctaaaaataaagacaataaagaccattctggagttagtgtggagaatggattagaagggtgaaagactggaaactggaagatcacttcagaggctgactttcacaatagcctcttccctctaggaaataaactcatctacctcctggtgaggttcaaattaggaataaacgggtgagttcttttttttttcttatgaaaaactaaagatgaaagtggagatgcctcactacaactagtgctttaattgcaatttcttacagaaaggacagttctaaaacctgcaagtaacttaaatttgatttttttgtcacataacttttgctgggacctcttgtattcaagcatcttcatgggcacttgggagaaaatactcaaatgccaagtgagaatctaataaaattattcttttttgcagtaaaaatagcacttcactaaagtgctgaatgattatttttaagcagcagaaaaaaaaatggagaaggaatcctttagtttcagctggaaaacctgactgttgttacttttctactactcaatagcattgagttttcttgcatttatttgcatctacctctccagctgagccacaataaaaagcacccacctcaaatacctagcactaatggcttaatttgacaatttgtatatggtattcttttattaccctttaggaccttaataattagtttttctttagtgcagtattaaagcattaaaggtcataaattccacagtcacctgtatccatttattgctaatttattatagaacatatcataaaactttccttgacatataggcctcttcataattataaatcttttttcaactgtttagataacttatgcttaagttcaagaagagacctttaggagcaaatatttaaaacatctatttattacacattaatggagcagggtggataaccatgtgaagtattcatttacattcagtatatttatcacttcaaactcttataaagataaatttgttttcaagagggaaaaatgttaaatgtcaagtagccgttttcttaagtgctttaaaatgtccagctgaataaagccatctttctagttaggatagaacaccaaaaagatttccaatgagattaaatttgtcactagtaacctcagttaagcgtaaaaactttgcaaacttgatagttgtctcttcagatggcaaatgtatcatcttagttgatagagaggttgtttcctctgtttcaactatggaaataacatgttgtaaaaaactcagtttctgaatgaatttaccttactgctaaaacttctgtatggatgcgtatttgtggcacacatatattcaaaaagggagaggagaaaatcaacttgctggaaaatccatttgttgaatgagtaatttgctgaaaatcacattgcttccattaatgttgtctaatataatcagtaacgatgatgcatgagatagttgcaacactcatagggactcttttcttgaagctttcattgagcttcagttttctgcagcccagtggttagccaagctagactatcacaggttttatcatactctgactttgggaaatcaaaaattttaaagtaaatattttcaactacaaatgtattgaatgtcttatgatatataaacaatgggatgggtttttttccaacatatttttagtccagccttctgcactttcttaatttaccaattaatcaacccaattcaatatgaacatttgtacacattttaaacatttgagaagtgcccaatgtctcaaatagtaaatgcacatgaacttaacattttactgaactgacaagtccactacaaatgactagagtgaaaagaatacagcagaactaaagctgaactaaaaccaacactttgataactattgaacagttcagccacacaatttgctgaaatcttgctttctaaccggggctatgtcttcttgatagcatgttctacatgcagcagtgaaatgaagattctgagaagggattaccatacctactgtaaatagaacttcaaatttgaaatacattagccataaagaattatgcaagaaagagtaaaattgttgcaaatccctgaggaatgcaataagatgaataaagacacaaatgtaaaataactagaaagatacaggagctaccatattgcaaattaaattctggcctctaacttattaaaaacaataagttgaagttgctataccacttgggaaattggtgaaataatcttaaaaaatgcttctttagcattttcaacagactctttgtctgttgaaacagaaaatggcataaaaatcattttgaaaaattggtagtgtattagtctgcttaggatgccataagagaatactacagactgggtggctcaaacaacaatttattttcttgtagttcctggaggctggaagtccaagttcaaggtgccagcagggttggttcctggtgacacctcccatgcagccttgtgaatggtctgctttctctgtctccttacgtggtctttcctctctgtgtgagcatttctgatgtgtcttcaacatcttgtaaggattccagttctagtaaattagagccccccatccttttgagctcatctaaccttaattaccttcttaaaggccctgtcttcaaatacagtcaccttggggattggagcgtcaacatacagatttggtggagacacagttcagttcataacagtatgaactacaaatttcctgtgtaaattaaaagtcataaatcctgcagttacctgtatctatgtactgatttattatgaattgctgaaaattttggttccttttctgaatattaaatattattcgtaagactgaatagttttatgatctctagcttttgacaaatttaactctcctgttaagctataaaaaacatctctgataaatcatcatccccgtgattaatttacataaactttatgctaggcaaaatcatcaaatttcaagtaattttagtaaattttataaatttggcaaattggtgattcagagactttttattatttataaattattcagccatagaaaaacatgctaggaatagtcataccctcaccagtatcacaattggcagtagaaaggtcttgcatgtggtgatgacaagctagaagaggtctccagaattctttggatatcattttaaatatccctaagggctgggtggtcctaagactataaaagaatgcaagatttcatcaggtcagatagaaaatacatttgcaaatctaaggccttcatcagagccaaaggtctttagaattcgacacatcctaaaagtcaaagaaacgcaaaattcaagcaagggttcaaactgggtaagagttacaggcctctgtgggtagacaaagaactaggcaatgtgaactctgagaccaactactttcacattaaaaaacttaatagcctttttgatatatagttctcttaccatataattcatccatttgaaatatacaatttagtggttgttagtatattcacagatatatgctatcatcactacagtcagttttagaacattttcacctcaaaaagaaatcctataccctatagctaccagtcccctatcactgcatctttctccccccagccgtaagtcaccactaatctactttctgtctctataaactttcctgctccggaccttcaaatgaatgaagtcatataatatgtggtcttgtgtaactaacttatttcactaagtgcgttttcaaggttcatctatgttgtagcacatatcaatacttcatttttcttctggcttcttttaagatttatttatctttggctttctgcagtttcaatatgatatgcctaggtgtattctttttggcatgtattctgcctggtgtacttggaactccctggatctgtagtttggtgtccgacattaatttaaggaaattcacagtcattattgcctcaaatatttcttccgttccttcctttcttctccttctgctattcccgtcatgcacatcatgcacatgttacattgatagttgtcctaccatcctttgatattctattccatttttttcagtcttctttgcctttgctcttcaattttgaaagtttctattgacacatcctcaagctcagagactctgcttagccatgtccggtctactaatgagcccatcaaaagcattcttcacttctgtcacagtattttgctctgtatcatttcttttttattctttcctagaacttccgtctctctgattacgttatccacatattcttgtgtgttgtctactttttccattagagcccttagtatattaatcataattgtcttaaatttccaggctgataattctgacattcttgccatatttgagtctggttttgatgtttgctctttcccttcaaactatgtttttgttttgttttgttttgttttttgtcttttagtatgccttgcaatttttgaaagctagagataatgtactgggtacaaggaactgcagtaaataggcctttagtaatgtgatagtatggtgtggaggggagagaaagcattctatagtaccatgtatgattcagcattggtcttttagtgagcctgggtccctgggctgtgaacttcacaaatgcttcccagtaaccctgccaaacttcccccgccatagtgccatagagggggctggagttgggcatttctctacacctaggttggttaggctctggtaaaatagtttcttttcagggcaggtcttattaagaagaacagagtgctctgcatactccaaaacagttccttttctcctccccctgccagaagcatgaggggttttttctctatctccactgttagaacctggaaaccagtttctggttagaacctgggaatcaggttcaggttagaaccagaaaccagaagtttgttcatgagtttttagagtcaaataatattccattgtatgccacattttgtttatccatttgcgtattgacaagcatttgggttgtttccaccttttgaatattctgaataatactgttataaacattcatgtgtaagtttctacgtgaacatatgtgttcatttctcttgggtatatacctagtagtggaattgctaggtcatatgatgactctacatctaatcatttaaggaatgactgaactatttttcaaagtggctgcaccattttaccttcccaccagcaatgtatgagacagttctaatttctacatatcctcatcaatacttgttgttaccaaactttttgattttttaaattattgtaattgtgataaactacatgccacataagttttgccatattaagcattttttttttttttggagatggagtctggctttatcacccagactggagtgcattggcaccatcttggttctccacaacctccacctcctgggctcaagcacttctcctgcttcacctgcccaagtacctgggactacaggtgcacgccaccacacctggctaatttttgtatttttagtagagacgtgtttcaccatgttgaccaggctggtcttgaactcctgacctcaggtgatctccctgcctcggcctcccaaagtgctggaattacaggcatgagccattgcacccagcccatattaaccatttttaagtgtagtgttgagtagtgttaagtacactcacactgttgtacaaccattctccagaactcttcatcttaaaactctaaaactcggtacccattaaaaaaaaactccacattcccctgcatccccagcccctggcaaccaccattttgctttctgtctctatgaatttgactcctctaggtacttcacattagtggaatcatgcagtatttgtctttttgtgaatgatgtttcacttaccataacgtctcaaagttcacttatgttgtagtatgtatcagaatttccttcctttttaaggccattgaatgtatatcctacattttgcttatccattcatccatcagtggacacataaattgcttctaccttttggctattgtgaacaatattgctatgaacatggctgtacaaatgtctcttggagattcggctttcctcttctttttctttttttttcagagacagggtctctctctgtttcccagcctggagtgcaggggtgcaatcctagcacttcacagcctgaaactcttgggctcaagtgatcctcctccctcagcctcctgagtagctaggacttcaggcatgtgacaccacacccagctaattccattcttttgggtatattcccagaagtggaattgttggatcatatggtaattatattttctgagggactgctatactattttccatagcagctgcactattttgcattcccaccaacagtgcatagggttccaatttctctacattcttgccaacattttctgttttttttaatagtagcccttttaatcggtatgaagtgatatatcactgtggttttgactcgcgtttccctaatgattagtgatgttgagctcaccttcatattttgaagtccatgacatttcaaccatgaaacaaagttcagtgaaactcatcagggtctttaacaagtctagtgcctatgtgggccaaaatctctatgcacatgtgacctaaattacatggcatggtaacaggtttcctttagtgggaaagaatcttttagctctggggagatttaaaattaagtgtaggaaggattgcaataattaaaatgaaagtaataatatttggtggttaagaagaaagctgttcatatttcttattttacaaatttgtcttcttggaatgacagtcttatgacttcagttgaaaatttgtaattgtgtgattttgacttagggcgaccaatttctcctgatttgctcagaattgtcttcattttaaaatagaaagctctgtataccagacatctccctcagttagggatggtttatcactttatttagacttgagattttaaactgaaatgttactaagctcatatacaatattggaccatttaaaagaacttcagtgtcatcaggtttaatgtacaagatataaaacagcttcttaaatatctgctgtaatttctataatttagataattgaagtacttaaaatatagaatatattaaatttagaaacaaagtttaaatatttgaaagtgtttaattaatgagaccaaacattattcaaagcgcacttaaaaataattattaacatttgctatacttatatacagactaaagagatttgtgagctgaacttaatgactatttatctggaagacaaaaatcccatttcattctgtgttgccacaactgaatcttaagtttaaggttttccttagttaaattaaacaccaattgtttaaaccaaaaacaaattgagaaacagtcttttgggaatactaagctactctataggaccaaaaattggcatcaactacagctcatgatattcaaaaatacttccatttaaggagtttcaaaaggactcagattatcctggtaacatggggtatattaatagttgtcaagcaaatcaatagaacacattaattattgtaaccatatatatatttgaaatgaagacatcatttttgagagtctgaagatcaatttaaactgcattttgttgttttgaggacacagctcaatttcactgactgacattttcagctaaaaaatggtctcagtactttccttctcttaatagagcactgcctccgtaatgtcgctaaagattaaagaggattaatgcccattctaacaatttgtaaatatcactacatttaaatattctaaattgcttatacttaaccaggattaaaaggaatgacctcttaagattcacaatttttttttttttgctttatttctctgacaaaaactatttttggaaataaggtttatcctgcaagctttaccaaagtggtaatttcaatagaaagtcaaagaaaacatgacgtccaaagaaccaccaagctgtaggcaacaatatttataggcactcagattcatgcacattcttttcaggctacaaaaggcctgttatcccacttggggtaagctagtcttgaatactgatttgaagtatcacaacgagtgacaattgcttcctagctactccactttgttatatgcttatctctggagtatgttccatctcaagcatggctcatggctactggcctatttagattgaaaacaagagaaaggcagcatgtgtcttccactgtaatctgtgacaccacagcagtttccctggtagggatgtacagagtaaccctgcagaactcacaggttataacaaactgctgctctgttaccccagaggagattaagtgatgatctggaagacaaaaatcccatcttattttgttaccaaaacccaatcttaagaattaaatacttatgaggtcgggcgcggtggctcacgcctgtaatcccagcacttcgggaggccgaggcgggcggatcacgaggtcaggagatcaagaccatcttggctaacacggtgaaaccccgtctctactaaaaatacaaaaaattagccaggtgtggtggcgggcgcctgtagtcccagctactccggaggctgaggcaggagaatggcgggaacccgggaggcggagcttgcagtgagccgagatcgcgccgttgcactccagcctgggctacagagccagcctgggctacagagcgagactccgtctcaaaaaaaaaaaaaaaaaaaaaaaaaaaaaaaaaaaattaaatacttctggggaaaagccataacattccaaaagacaatttattataatagatatgctattacattaaagacaattgcagccttctaattcattcttagtttaaatgtatcatggttgagggaaaaaggctaggttaataatatgaacacatttttatcaacatgaatctgaaatgtttttgaaaagcctgttatatagattattagaaaggttagattttccaaaaggttaatatttatttttaacaagaatgatttcttaaattatagttttaaaacgttaataattgccagtggtttcaaatagacttccttttatcagggagctgggatcttttggttcactagacctccttgatcttaggctgtataaattgtttagttttatttggtgccatagggactccttcaaacttatcagaagcctcagtttaatacagaaaaagagaggctcagacatgtcaatataatactgttaatgttttccacgtttgtgatttcagggtcaaagtcaaacctcttattgtattaataatagcaaagcaaaaataggctttgtagttgtgaattcatggttttaaagaataatttccctatgtttttattaattcaagccatccattgaaccactcaaggattccattatgtatttgaatgatgtatctcatactgtacctttaactttggaagactatgagaatggatatgcgtgtgattctttacagtcatcaacataggatatttcctttgttcaaaagttatgttaattaataacattaaaagttatatttagtaaaataaactttagagcttagcagtaaaataattaaaagccagttttcctctactcattatttaaaagagcatggtttgcaagttagttcatatgctatgcattatgaagcatggccatatattctggattcttttactatctgatttgtagacccagcaataatcagaattttaataaaaaagttccagagaaaacccagaaagcctcagcttaccaagcgctttccttttgagagtgtattgaatccacgttccattcagcactgattagtggtaaaactaaaccaaagctgtcggcgtattgcaaaaggcctttgcttgaccaaagctcttgtttaagacaaagctgccattgatgtccaccccaggtgacaaggggtgagaatggagtgacttggcagcttctttttctacctgtgggtcttgcccttctgtcattcccacctgacacccttccccaccttaaacttgatattggtggatgggagcaggaattcacaatgcagctaaaataaagatgctcaaagctccctcttctgtatggcagacctggattgtgtgcctttgagaggggcaagcttgtctttcctattccctaagaaatatatccttacctagccaaacctatttccccttcctgagggcctatgcaggcatgcacaacacagcagtgttctacgttagattttgcaccagggttcactcagggtctgctggtggctgtgagaagaacctctcagctggaatggttcatgagtgaatggtaaagcctaggtttcaattactttggagaatggaacgtttcttagctttctttcctcatgaacttcgtggtatcatttgtcatgccattttgccagctatgcacttttttacatagttttgtttggtttgcaactcacgaatatcaatcaaagaagttgtttcatttttaagaaatggcaaagaatatcttgcctccttctgttgtttcataggtgagttatatggcatgtggaagctgagaattcaaactcaattcatgctaactctttcctaaaattaggagaacatttctgattataactcatttccctatttacaaggtcaaacattttgacttgtaaggtaccaaacaaatatcatgcttctgcgtttgccagattatgttctaaagatattgactggtacattgtggtcaaataattttgggaacagtgggttaaagagaggtagagatgtttctttactgagtcttagaggcactacaccaaagtggttaggagtgtggactccagagaccccactgtgatctaacttttgattccaccactgactaaatgtgtgatcttgggcaagtcaatatctctgcacctcaatttcctcatctgcaaaatggagtcagaaatagggcatatctctcagagtagttgtgagaattacttccattgatatatatcgtatatataaagcccttagaacagagcctgacacaagataagcaccatgtatgccctgtattagctattattgctataattatcaagtttctaaaggggagataaagcagtcagtctttcccagtcttacctatttgtccatccatccatccatccatccatccatccatccatccatccaattctcttctgaccaatataaacagcctgaagtgagagagagagagagagagagagagtttgaaaagtaactaaaaattgcatcctcgtttgtattatctattactgctgcctgcttttattgggtatttgcttattcactttttcttgttttaaagaatggatcagaacacaatttgagggctatcccatagaaagattgaaatattacattatttatcaattaattcctgcaggcttccccaaagtcctctctctcactcgagaatggacattttgcaaacagaaatcacaaatatactaatgtcctttatttattagccaaattttgtttgagtgcctgctgtgtgccagggactgttctgggcactggggacacagcaatgagtgaaatagacaaacatcccatgtttcatggagcttagattctgtcagtaaccaataagcagctctagaaaccaataatgaagccacaatcaagtcatcaagtccgctacatttctcaaggcttctgaatacattaaaaaaatgaacaaattgcaaaatcagatttcctaaatgttagtgtatttcaaatgatattttataaattattgcgtgtagcacaaaataaatagaataacagaatatttaatctcttttagaaataatctcaaaagtaaagaagtatgagacctcagctgggccataaggggctcttgtaggcgcccccccaacacccgtacctactgaccttatcccaccccaaacttatgctgggtttaagtcttggttaaaactcaatgaactaatctgccatttttcagctaaaataatgaaggtttttttccctctcagcctttgttcagggtaaatttcttagacatatagtttgttttttatctacactagtttttttagtttaaggagcctataaaatagcatatcaacattaaagccttacatcaaatcagaaaaagacagacgtgcaattttttaaaaattttaaagagatatggagccatatatgtctctgtctcagactagaatcaagcactgaaatatgacatatacgatgactgcaattcaactcactaatgttttgttcctgacatgcaattttggtacatgataacattgagtagttgttttgtttttaattacaaatataaaaaatgacacttaaccaggctggatgttggacttttagataattttaagatagggaaattgtgaatacacaaatatttagtgtgtttggttaataaactcagaagtatataatttttctaatattttaacttgtgttttcttcttcttttttttttttttttttttgacagagtttcactcttgttgcccaggcgggagtgcaatggcgccatctcggctcactgcaacctctgcctcctgggttcaagcaattctgctgcctcagcctcccgagtagctgggattacaggcatgtgccaccacgtctggctaattttgttttttcagtagagacagggtttctccatgttggtcagcctggtcttgaactcccgacctcaagtgatccgcctgcctcgtcctctcaaagtgctgggattacaggcgtgagccaccacgtctggcctgagccactgcactaggccgtgtttgcttctttggttatctgatcaacaccaagatcaagcattttatatctttgggaaatgcaggacctcagaattataaatttttagagttagaaggggggcttgaagaccctctcattggacccactccttttacaaatggggaaacataagaccagagtgggtaggatcagttgtcttttgattgaattacaatttttgtcatgagcagaatattttatttaggtcttacataaaataagatccttgtatcctactaaaaccttctgtattatgcatcaaatcatcaaagtgtcagtgaacctgccaagcagaaagtaatgttaagtttaaaagtattaagtactttaaaactgtttgcttttgacatatcttttggctcaaatattcattttaaaaatacaatcaaaacaaaaagtttctgttttctatcgtataaccatttctaactgaattaagaaaaaacacggaataaatgatactcctttctttttctttttctgcatttgtacctggatttctaaatccagccatcattttctatctcaaattaaatgaaatggggggctgagcagttgcccagtgtattagaccattcttgcagtgctataaacaaatacctgaggctaggcaatttataaagaaagaggtttaattgacttatggttctgcaatgtgtacaagcttggctcccagcatctgcttgacttccaggaaggcctcagggagctttaactcatggtggaaggcaaagtgggaacaagcacatcacatggcaaaagcaggagcaagagagagagttgagagagaggtaccatacttttaaacaaccagatctcatgagaacttactcactatcatgaggacactaccaagccattgaggggtctgcccacatgacctaaacacctcccgccaggccccaccttcaatacgggggattacagttcaacatgagatttgatggggacattcaaactatatttttctgcccctggccctgctaacctcatgtccttctcacattgcaaaatatagtcatgcctttccaacagtccctcaaagtcttaactcattctagaatcaactcaatcaaaaatcccaagtccccaatccaaagtctcatctggaaatgagttccttccatgtatgagcctgtaaaattaaaacaagttatttacttccgagatacaatgggggcataggcattaggtaaacattctcattccaaaaaagagaaattggtcaaaagagaggggctaccggccccatgcaattttgaaacccagcagggcagtcattaaatcttaaagctccaaaataatcccctttgacttcatgtgccacatccagggcatactggtgcaagaggtaggctccaagggcttgggcacctctgtaccatggctttgcagagttcagcccccaaaacaactctcataggttgttgagtgccagcaacttttccaggcacagactgcaagctgctagtagatctaccattttggtgtctggaggatggtggcctccttcccgcagcttaactaggcagtgccccagtggggactgtgtggagcttccaaccacacgtttccccactgcattgccctagtagaggttctctgtgagggctttaaccctgcaacaagcttttgcttgggtgcccagggtttttcatacatcctctgaaatctagatggaggctgccaagcctccttcactgttgcattctgcatgcctacaagcttaacatcgcatggaagctgccaaagcttatggcttacaccctctgaaacagcagcctaatctatatcaggggccctttgagctgaggatggagccagagtggccaggatgtggggaacattgtcccaacgttgtgcagaatagtgtgaagctggggggagggtgagggggttgggtaggggtgcaggtgtgagtggggagggtgtccctgggcctggaccatgaaactattcagtcttcctaggtctctggtcctgtgatgagaggggctgcctccaagatctctgaaatgcctttgaggtcttttctccattgtcttggctattagcacatggctactttttacttgtgcaaatctcctaaaaagtggttgctccacagtctccttgaattcatctcctaaaaaagctctttctttctttgccacatgaccaggctgcaaattttccaaacttttatgctcttactcctgtttaaatataagttccaactttaagtcatttctttgcttccacacctgaatgtatgctgttagaagcaaccatgtcatatcttgaatgctttgttgcttagaaatgtctttggccagatagcctaaatcatcactctgaagttcaaacttccacagatcccaaaggcatgaatagaatgcaaccaagttcttttctaagacataacacaggtgacctttgctccggttcccaataagttcctcattttcatgtgagaccttatcagcctgaacttcactgtccatatcaccatcagcattttggttacaatcatttaaccagtctctaagaaattccaaactttatttcatctttttgtctttttctgagccctccaaactcctccaaacctctacctgttacccagttccaaagtcacattcacattttcagatatctttatagcaattcctcattccttggtaccaactttctgtattagaccattcttgcattcctataaagaaatacttgagactggataatttataaagaatagaggtttaattggctcacatttctgcaggctatacaagcatggccccgcatctgctcagcttctacagaggcctcagggaacttttactcatggaaaaaggcaaagcaggagcaggcatgtcacacagcaaaagcaggagcgagaaagagtgtgtgtgtgtgtgtgtgtgtgtgtgtgtgtgtgtgtgtgtgttgggagcaggggaaggaaccatacacttaaacaaccagatcttgtgagaactctttcactatcatgagaacagcaccaagccacgagggattcatctccatgacccaaacacctcccacaaggccccagctccaacactggggattacaattcaccatgagatttggcagggacatatattcaaattagatcacccagtcataaaatatagtcttagaatttcttttatttttttttgttaacaggtgtatctcctatcattgtttaataaaaactgtgcctcaattcattatttcagttactatgttagagtctttacttttagaataggatctcatgcctccaatattttggtgacctcatgtaattaacatgcagtttcacggaggaatgtgaatttaggtaggatgtggggacatcggggtccctttctcacagtgaaaccacgcttttgtagaactgactgcttactctccctgggagacatgaatgtattatccctgctttgttggaaaacaaaggttatatatagtctctgtggagtgtgtcaaggtaaggggttgaaggagaggaaaacatgacagtgggaagggatgctggaataatttaaagcagaagggaacagaaaaagagaagagagtcaccaaggaaagaaaggcagcatcagctatatatactcctgataagtgggtttgtgccatgtcaatgtctgagcctttcatctttgtttgcaaaatcattcaactatgggatacttcaaaccaatgtttccaaaagtgagtggcttttaggtggcaaatatttttctagatataaatgtatctcagccgggagcagtggctcatgcctgtaatcccagctactcgggaggctgaagcaagagaatcacttgaaccaggaggcagaggttgcagtgacctgaggttgtgccactgcactccggcctagatgacagggcgagactctgtctcaaaaaataaaaaaacaggccaggcgtggtgactcacgcctataatcccagaactttgggaggccgaggtgggcggatcacctgaggtcaggagttcgaaaccagcctggccaacatggtgaaaccccgtctctactaaaaatacaaaaataagccgggtgtggtggctgatgcatgtaatcccagctactcatgaggctggggtgggagaatcacttgaacctgggaggcagaggttgcagtgagctgagatcacgccactgggttccagcctgggcaatggagcaagactccatctcaaaaataaaataaaaataaaaaataaaaataaatatatctgtatacacttcatacatactgtttcagaaaaatatgtattatatataaatataatcatacatataatatacatacattatatattcacatttcataatatataatatatacataatatataaatgtacttttaagataaatatataaatatatatgtaaccagcacatctatgtatgatagtgaaagaaacttccccttaacaaaataaataaatttagatttttttaagagtcaaatttgctaacaaggattaaataactcataggtggtgatccttgaatatgtctaaaatcatgaagatcgtatgtgaatgacaagtttaggaaatatatctctaaaaagaccttctgtttgtaggtttatctttcagctttttaaaagtttaccggtgtaagggagtgatcctgaaaaggataagggtgaattcttgccagaactgactttttcaaagtgcgcatgttccctgctcacctccccactgacacattctgacaggtctctattcccttcccagctccctctgactttgcatggtgtggaggcagaggaaacggctgagaacaactaactccagtaaggcattcctagctcattcaggtccaaagaaggaagggggaaacagccacaacaaagcagcccccaatacacacgcaccacacacacacacacagaaacacacatacacactcacactcacacacacagtttctttatccactatattgcaggccattcaatatagcagaaaaaaaatcttgagacaaaactgtctacttggagacatttttgttcagttgattaattctgtgattttacattttttgaacatggaagcccagggtatggttcataatattttcagtctaggaacagctgaatgaagtaacagtcttttaagaagggtcctcaaagcgaagcaggttcattttctagaagaacaaaatccttctgggcatttttgtgtgttccattcaagtctgagataaatccaagaggggcttgacagatgtgattgtcatagtgtactgggaccaaattactctgggtgccaagaactaatgttaaaataaaattggaaagttatttctttccatgctgcccccttctctgaatctccaaagcatttgttttgtaaaatcctaagtagaaacacattttggtgccataatttcaaacaaaccatctctttttgaactctgcagcccagaacacaatagcatatcaagttcacaaaatttcagataaaccacgttcaagctataaaaatgaccccccaccaaaagtcttaatttttcccacatctcctttctttttcccacactactttaaggaagctcagctttgctgtctctttgacaagggttgctgctgtggagacacacactgttgcccagtggctgaatctattcataatttagtttaagttatcttttcctggtggagtcattttgaccacatttaccattttgtgaggcacaaagtaggcattagtgagcgactgaacactcaaagaaagaaatgattggattaaaattggggtgcattaactatcattcacacaagaactgtcttatcaacctgtttttacaacttgctctgagatagaaaaaaaagaaaagtattattgttctgagctctgcattttgcttaaactagtgtgcttaaagcagttaaatactaccatattgctttttaaagtcatttaaaaatactctaagttcaataatccattgaacattcaaatgtcactattattatctatttatttggatacatatggctgtctttgtttaacttgttgaaagtagtaccacattaaaataacctgaataaatgaccagaataaataaaatgacttgaaagttgctcagaataattgcagagaagtgagagaagccagaataattcctcttcaatcaggtacccaaatgttttattattgtacaaatgacttatacacatattatagtagcctaaaagttttaaaaatatggacatcctttagggcaaaaaggtgtaaatctctaagaggtagagtagaaaacatgatttattctgttttcctagcattgctagtttccaggtgttcaccgtttgatccagctacaggcaatgattttctgaagtggtttctgatggtgtctgacatcatttatagtactcttgaacaatcttgtaatgtgctaaactacaccaaattaagtgagttagtggccaaaaaagagtccaatagacccatgggtatcatgagtgttttgctacatgctgcctcttgtattcactgctcagagggaagaagtaaagtttttctgatcctctgatatatcaagtggtggatttggtggagagctatagagaatctgggacaagtaggaatggattgaacagtcttaagcaagtggaagtttacaagttgccagactgtgtcctttgtgatcattcatgtatttattcattcagtcagtcaatcaccaaatatccattgaagtgctgctctctgtaacatgtggcaaaatatgtcgtgtgggaaataaagatgagagagatcatgaccttgagctaaaggagtttatagtgagaaagagagatggcatagagaaatgagttaatgtgaaggcacaatcatgtgtcaacattaaagcaatagcgtgtatacgttcagaggtaggagagattgctttcagctggagtgatcaagaaaatactcactcattcatatgcccattggtttatcacatatacatagtcaggtactatggtaagcactgaatacacaacagtgaaggagagggtaagcaggcagttaaaatgcattcatctgatcactcaaacaatatatattgagggtctactgcatgacaagctttgttccagactctgggggttgtttgatgaataggcaaagcactttctctcacagagcttacattctagtagggaagataatcaacaagcaagtaaatacataataatgcaattttagatcattaatgctgcaaagaaagtaaattggtttagcagggtagatgatgaaaagacatggaaggctattttagattggatggctagggaaaggctctggaagggaaagatctaactgatgagagaagttggccacagaagacccagatgtcatgggaagtgccagtgagagggaggagcgtggggatgttgaggaacagataggcagcccaagaggtcaccataagggaagtagtggaggggaagctggacagtggctggggctagatcttttgggccctgagtccatagtccaagaacttgggaagctactggaagattttaatcagaattgtgatgggatctgagtttaagagttggctggaattgttaagaatggaagaagcaggaaaactacttagcatgttgaagcaacagtctacaagaaagatgaggagtagcttgaacttgtgtagtaatggtggattcagtgaggagtaatcaggatttgggtaacttttttaaatagagaggataaagctgatgcatgggatgtgaagtgggagaaaaagagaggaaccaagaataaatcctatggttttaggcctgaagaacttgtggatttttgcacacttgactgatatgaggaagaccaggaagaaaatggcttgggagaggaaattaagaattccgtttgagcattatattggtttcctagggctaatgtaacaaattactctgaccttggtagattaaaacaatagaaatttattctctcacagttctaggagccagaagtccaggtgtcatcagggccacgctccctctggaggctctaggggagaatccgtccttgcctctttcagcttctagtggctccggacattccttagtttgtagcaacatggctctaatctctgcctccatctttacatggccttctcttttgtgtctatgtcttctcctgtttcttttaaggacatttgtcattagatttagggcccacctggataaactaggatgattaatctagagatccctaacttaattacacctgctaagacattttttccaagtaagttaatggtcatattaactttatgcatggcgttagggttagggcatgaacatatcatttgggggccaccaactcaatcccctactggaatagtaagtccagaggtcttgtaaaaggtcttcctgcctaaaaaggaggcaggaagaaaattaagacagcactgtggtcctggaagccacagcatttcaaggcagaagttgtgaccaacagtgtcagatgttgctgagaagtccaggaacatgagaatagtagactcatcactgggtgtgataatatggtggcctttacatgtgtggtgtcattggaatggtggggctgaaaggcttagcagcatggattacagatagaatatgcagtaaagtaggagagagtgccagaaaggacgtctcaatcaaggagtacagcatgctatgagagaaaacaggagcagccaagatttgggtggggagggaacaagaaaacatttcaggagaactgacatctgaattgagacctgaaggctgagtccccatttagccagcagccagtccaaaaaaaaaaaaaaaataggaagagagttttttagatatctagaatataaggagccaccaataggttttatgtaggacaaagatataaacaaattcgcatttcagaaacatgactctggctgatgagtagtgaatggattagtgactaaaggtaagtagcatagggtgtgttgctccattccaagcaatacctggtggcagcctttactgagaaagaggtggtaaacaggggtgatattaataatactgagtaatcagtgctctagggtcactggccaatcaaaatggatgctagctccaacaactactgtaaatgtactggcacaggaccacagaatataatctgcttgtatacttaggaaggactgaataggtcctagagcaattgagaggttatagttgacaagatttgtttatggattgccttattacttaggagctcagcaggacaagtaggtctgccgagaggaggtgggcaaagtttcaagttcaatttgggtcaagctgaattcaaggagtggtccaggctaggtgtggtggctcttgcctgtaatcccagcactttgggaggccaaagcagacagatcacttgagcctagcgttggcaacatggcaaaatcccatctttacaaaaaatttaaaaattagctgggtgtcatggcacacgattgtagtcctagttacttgggaagctgaggtgagaggatcaccagagcttgggaggtccaggctgcagtgagccatgattgcaccactgcactccagaagcctgggcaacagagtgagaccctgtctcaaaaaagggagtgttccagacctgtaagtgcaaatatccactaggccttggagagggctgggctggcaatatggttttgggcatcatcagcatgtggacaggtaatgaaagccaggagagggaatgagtgcaccagaggaaagccacagagtcaggagtaaagaaggccagggatagaaacaccagcccttgatgcatgagcagaggaagaagaggcttcaaagaagtgagaaaaggagggcagagaagaaggacagaagccaggagaactcaatgtcaaagaagcaaatggaaaaagtgtgtcaggaagaaggaaatggtcaaaggagtcttgtgccacaaagagatctagaaagagaaggaaggaaagattctttgggtggagcagcaacaacatcattgatgagtttggcaagagcagtttcagtgtgatggtggaggtagaggacagacagcaaggaggtgacaggaagaggtaagaatatagaaacagtgaagttggaagttctttcaaggtaagaaggggatgggaaataaagtgttagctggaagggaacgtggagctggggaagacctgagcatgttgaaatgcttcctgtgctcgtggattccacatctttgtttcataaattgggaaggcagtctgtgtcaggctctctggtggctttgggatgggaaaaactcaaaagagaaggacgtattgaatacctaggtggaaaagtgaatactgaagaggctgaagattctgagaagctgggagagagcaggatagcccttagatccgtatgaaggaaactgccacatcccttgaaactaaaaggaaaaacaaaggatgattgccaagatagatttgaaggttatgtggcagaagctgatggggttactatcttgtgttttatattttcatagtcatttggagaaggagtgagactaggtggatgaatcagccttcggctcccatcactacagaactattcttgtcgaggtcgccatgacctccaatgttgctgatggtcctcgtcttattagcagcattggatgcaattgattgttcctgttccttaaaacactgtcttctgtagctttatcagatatattttgtacattacttcaaataatctgggccccacttcttactccagccactgctctgggggaactgttacatatagggttcagctagctttgtccatgcacaagctaaccatgtcttccttctcttgcttcctgtcctggggtttccaggccacccccttccttagctacctagtgctggtgcaatgggtcaatgaaaatgggaggtcaggagaggaaggggagaggacgtgatggcagagatggatcttcaacaggggaagaataacacagacttcctctcacctaggcttatctagctactgccatttaaagttgatattattcatctctttccaatagaatagaagctccatgagggtagggatttttatgtcttgttcattgcccaccatctagaactgtaccttgcacatagtatactttcaataaatatttgttgaatgaataaatgatagaattaataatgtgatttgtttatgcagccatgaatatcatcaaaagggcagtctgggtggaagaaacagcttaagcaaagggcggaagacaagcattttcaggttatgtgtcaagggcaaggattagttgtcccatgttgaataatttgcttacagaactactttttattcagaacttttgatacacttcattgtataacagttcactgtctgaatgttttcaaacaaaagcgagtagaataaaacctggagaaattgtatctggcacataccaagactgttgtccaatgaccaaaaacaaagatggcaaggcttctaaaacaactctttccactttctgactgaaaagataatatagaatgaataaatcggacaaagtagcctactacttagtgtatcttttacctatagcacccagattaactaatatttccctaaacaaccaaacttttcctctcttcatattgcctgtgctaacagtttcttaggatactaattattggactttaataaggataatataaattttttttaaaggcagttgtttttaaaataaaagagaaaatccaagcttctctaacttctaagctattttccagaagcccctagttgtgtttatttttgctcagggactatctcagcttcagtgtggttcagacgtacaaagtcagcttacgtgccccgcagagctacatttatgtaataaatggaacacattgcctccagctccctcactggatacaagcaagactctatgcactgctaggctgggtggcgcttcttgagtttgagaacttattggtcgtcttggaggaggacatgactgcctacttgcatggcgatgcctctgatgaaggcagtgcttccaaactgccctccctcttccctcatccctccctttacatgatgcttccctatctaactagtaatagatcaattaattcttgaaggtgcctgaggatattgaccacacctctcaaggagggaagtacatatgggtgttgactagagttcattaatcctagggctaatctggtaccttccaatggacacattggagtggaagctcctgaggccttcagcagcctagttgagttagaggttatagaaaaaagaaaataacaaggatgatggataaacttttagcatttctgcaatagtaagaaggatattgcatcatttttagggcatttaacagaaattattatagcagtagcatatctgtgtccaccacacaagttcttacgtacatttagttcaaaaggaacatttattgcactttaaagtgcttcttggctggcatggttctctttactttctctaaggcactaaagaacacaaggatcttctttttgcaataaggaattgagtatatggatcactcagtttgaatgccaatctcagtgagtcaaacatccagcatttctgttcccctgaccccatatctggaaaattgcctccattattcatttagtttctttctgtagctagagcatttctttatattttcacttggttatataaatgactttggaagtatacaagtaatttttcaaggtaaacagtccatttttgttgcaaaggaccttccggggaaagcacacagctcccacttcttccagccagagcttttttaacaggcagctccaagatctttatcatttatgtcaacctaattttgttgatagctttggtttgactgagagatggatacctcactttttctgctgttccattcctataccctacaaactgaaggcttctctgaaacaatgagatctgcatagtgttttgtttataattcaaatggacaagttgaaaatgtcattggttactcagctacttattgttagttttattgttaggcatggagaaaaggcatttatatggaatttttgtatagaaagaaatgaggatgtcttagttttatgcacacacacacacacacgcacagaaacactcatgcttattttaaagtactaataccagaggtgattttagggttctttagtacaatccatttattttgcaaaggggaaactgaatccaacagaacttaattagttgcccaatactatagaactaattgttcataaagtcagaattagaacctagacctcctgaaagtttttttccttgctatatagtctgaaatctatgaacagtgtaaatagaaatcatgacctcagatgacatgaggtttactaattcattgattagccttcttatgaatgtattggatcaataaagacacagatattcattccaataattgctcctctctgtccatctctgcttttagatgtatctaagtaaatgtcctctgcatcaatcagattgtggctctcattgtttcttgggtaatagtgctactaatatgccttgtttagaatgtaatatatatgatatctggaaagacttctcttatggatttttttgtaagaagaataatgacttttttatacaataacagttaacctggctctgttttcaaacaaaacgacatattagtatcatttctagttaaccatatcatccaagtattcaattttctttgcagaatagagcacatttacatccattttgatcatataaacaaaaacgtaagtaattctgaatgtaaccatgctcagatttcctcagtcagacagagagctgataagtgtttaatggctggggaataatagggaaggaaagggagggagaccgtccttaaaactcggatataaactagagggagagagaacaggtgccaaaaatataaagaagagtgcctgggtgcacagaaactatcatccttgtgcaaacatcaggttggatttatttattgaaagtagaagtgcacatgtaccctaaaacttaaagtataataataataataaaggaaaaaaaagacaaaaaaaaagaaagtagaagagaagggccattttaattcagggaatatcctactcttcagaagattcacctcacgtcatagaatacatggggattatgaatttaaagatcatggtagctcttctctgatgatgttagttttgttcatactaggccatctttgtgattgctggaagctttccagaaaatgtagtatttaggaatttcagtaggtcttatctgtattctcatgaaagagcagattatggttatttctttaagcatgtatgttacatacttttaaaaataaaccgggggatttcctgttatgtaaaacatacatattaaaaaaggagggaacgtcgtgtctccagttaatgtttttccactcatacttcttgtaattttttcctagtcatttattcctttatttatatgtggattaattccaaacaaactgcctaccataaaactatgcccttctttagaaacaaattaagtctatattatacgaaaaacaaaacatataatcaaaaacataataaaatgtaataaacaaaaaagacatatggagtgaaattttggaactagatttggagatagttatatcaaaaaatctgacacatatttcaccacgactccttttctaactttgtaaatgaagaggtgtagtccacatatcattaatttttctgaaagacatttctcatcctaatgtttttatgtacctttttgcttttcccccacaggtcaaagatgttgattcattcatagtgtgaggcccagaaatcggcatttttaaacaagtacactggacatttctaaagctggctaaagtttgagagacactatccaagggaaatttctccgtaactctttttctcagaagaaaagtaaactaaaagtaaaaataagcagtaccactaagtttcaagtgatcttctcctaaaagaagaaaaggcctatattcaggcacaagaaaagtatattctcttttatccatgcagaaaacagctagtggttgaaaatcaacacttcagacctcttgtctacataaagccaact

SEQ ID NO: 132 - DNA, 144397 bp, Homo sapiens
gcttcgccgaggctgatcttcgttcaagtgtgagctgcggctgagcccagcgctcgaggcgcgaggcagccaggagggcccgtgcggcgcggggagccagcgagcgcgccttcggcattggccgccgcgatgtcagctcagtgctgtgcgggccaggtgagcgaggccgggcgcagcgcgggggttgtcagatcggagaaccgggccaggagtccaggcgtggaggacctgcctgggtgcgctcccagctccgcggccgaacgtagggcccgggtgggtcgctcgggctggccccgcggcgctcagccgtccgggaaatcctgtgccctgggcgggcgggaaggggcagggggaagcccgagaggctaccccggggtcttcccgtccggcctccgggactccgcgtggagcggggcgtgccgggctcgggcggaggatcccgactgctccaggggcgtgtcgcctcttgcgccgagcactggtgaatagcgctgagctccgtagccctctccactctgcttgtcggatgaatccaggaagaaaagtgggtttaggcaccgtctcctttgctatgccctgaataaaactcgggtcaaacaacccaggcaggttgcgcttggcatctcgtagtcgagcgtgggctctgtacctttgagaatgtctcgaagcctgacttccaaactaccgggcgcaggtctgggcgaagggaaaactcagccctgcttcctgaatttcccgacccaaccctggctcggtactagcacgactgcctgggtagggctggaaccttcctgcctctctttgcaaataaacttgttcgaacctgttttttaactctcgcctatttaaacctatgatgtcttaaaacattatgtctcctaccagttactgcatcagtgtagaattagtacgtcttagccctgtaatgctggtttcactccttcctgcagagttagaaaaaacgaagtaggtgagtctcttggatgtggagctcttttctccctttacatgtggattatcagcgtttcggtacagagttttaatggagtgttttcacgaacgaatcagactctagggagcatcctggttcggggtgttcttgctgacactcagcctttccacaatcgaggccagctgtaagtgatggagtggttaaactgtgggtttctgtaaccggcgattatactggcagataatctgtcctgtttagagtggccacgtggagctgtcttggtttttgaggtctaatactgtgcttggcatacattaaagctggccttttcagagttgaggaaattgaggcttttgacgactgagacgaaatgattttttttccctgtgtcaggcagagagagaaagagaatgagaatggtcaccaccttaccaggtatttgagaacaaggtggaccaggaaagactgttttcagaaagctctgcaaatcttttattcccgttttgaaatactttttctccaatatgatgcgacactttttattacgtagtaatgatacagctctttaggggcatctgtcctggtcccttgaagtccccttgaggctctttctgccattcccaagttcctaatttagagctctgtaattaccagtattcaaatgggttttgtaaaagaattattttgctgttgatgttttagcaggtttctaaagtctcccctcttaggactttggaaagaaccaaatcaaagttaacccctgctttcccaggcctgctggaggcatcactgtggtgggcctcagtgctgtgtgatggtgatcacactgtgatttcctgtggatggggcggtaggaagttaaaagaaaagcaaacaggctgggcgcagtggctcatgcctgtaatcccagcactttgggaggcagaggcgggcggatcacctgagatcaggagttggagaccagcctgaccaacgtggagaaacctcatctctactaaaaacacaaaattgccgggtgtgatgacgcatgcctgtaatcccagctacacagctaaggcaggagaatcgcttgaacccagaggcagaggttgtggtgagctgagatcacgccattgcactcaagcctgggcaatgagcaaaaagagcaaaactccatctcaaaagaaaggaaagcaaacaaaacctcacagcaccgtcagaagttaccaattcttgtttgtttctgtgggcacctgccttttgccaggagcctgctatatagtcataagtcagacaagcatctctgctctcaatggcctatctgggcaggggagatcattcataaacatgtaaacaatgaaacaatgaatatggtactggtactgtcagaaggccgtgtggtaagcagccttgaggagggttgccgagggagtctgagaagatgcctgtggagttgagactgctcagtgaggagaggcaagggagtctagggtggctggggtgtcttagatgaggtcagagagaagagcaggaccagaaatggccagaacctgtcagctgcctttggactttggatttaattctggttgcagtgagaggctgtgggaggattctgagcaggggcgagctgtggtttgatttgcacttagaagataattgggatgtcgtgaagactggactgtaacgggctagagtggaggtgaggaaagcagttcgagttggtcatgaagcagttggtgaggaaaacctaagtggatatttgcctcttaggggcaagcagtgttctaggcttcggcagtgaacaaaaatcctttcctgatggagctcgaatcctggcaatctgctgttgctgtagtcccaggaggagacagcgtggtaccttaatttaggctatggctgtaggagtgagtacagtgggacatcattggctttgggtatatttcagaggtagaactggatttgagcaaggattagaagtgggatgtgggaatgagacaggctcggtttctggcctgagccactgggtagatgatgatcgcattactgaggtgaagtaggaaattgttaggaagaggacatttggtgaggaaaacccaagtttcttggcttcgttacattagagatgcctattataaatttaatggaaatggcaagtcaccaattaggtatttaggtcgggagaagtttgaggtcggagagagacattttggtgactttctttaactgcggaccatcctgaacaatatgtaacccataaaagagcctgggctttggactcaggcctgggtttcaatttggaaatctggacaatgaggactggtgtgactggatgagttacttaccctctatgacctcattttacctcaactattgaatgggtacttcttagggttattgggaaaattacatgtgatgataagtgtaaagtctgtaatataggatttggcagagtgtgaggaaccccccaaatcttattagtggccattacccatctgcatcaggataatatccagatcagcttattttatttttgtatctactctgatattcactttggttttgcttaggctgttggctaatggatgctaagaaagtagagattacaggggagtggtcactcaacactttatgggttcaaagttctgtgctaggcccctagagacacggtaatgaacacagggcttccttgttctcctttaacttaagggctatgtggaggtgggagtgttgggggaagttagctacagaaaatgacagtgcaggctgggcatggtggctcttgcctgtaatcccagcactttgggaggccgaggcaggtggatcgcttgaggccaggagttcgagaccagcctgggcaacatggtgaaaccctgtctctactaaaacaaaaattagccaggcgtgatggtgcacgacctgtattcccagctacttgggaggctgaggcaccagaatcacttgaacttggaaggtgcaggttgcagtgagctgatattgagcactgcaccctagcctgagcaacagagtgagacgctgtctcaaaaaaaaaaaaaaaaaaaaaaggaaaagaaaagaaaatgacagtgctcactgtcagagcggaagtgaggtgtgtgcttggaaaatctagacaacctttccaaggcagtttgacaatagggattgggagggcttgctgcaggcaagtataggcatttatgacaataataatgctgaaattaataggcttcttgcctgaaaagttcacccgaggcagatgcgccaacattctagtaggcaagactcagctaatgtctggttggtgggcagccaagactattgcaccaggaggatcaagcctgtggttgccattctgagtaaaggttcactctgtctttttttttttttttttgagacagcgtctcattctgtcacccaggctggagtgcagtggcgcaatcttggctccctgcaacctccgcctcccgggtccaagcgattctcctgcctcagcctcctgaatagctgggattacaggcacttgccactacatctggctaatttttgcattttcagtagagatggggttttgtcatcttggccaggctggtctcgaactcctgacctcaggtgacccgcccgcctctgcctcccaaagtgctgggattacaggcatgagctactgcgccggccctattcactctatctttatagccagtttatgcaaggcaggaatgcccaggcccaggtatttccagccagatcctatttctagatcaccaagattttcctcaatgaaaacccatgtatgtatgtatgtatgtatgtatgtatgtatgtatgtatgtatgcatgtatgtatttaaagatgggatctagctcttgcccaggctggattgcagtggctcaatcatagctcactgcagcctccaactcctggggtcaagcaatctttctgcttcagcctcccaagtagctgggactacaggtgcgttctaccatgcctggccagtttttaaaaatttttgtagagactgggtctggctttgctgcccaggctagtaaaactcatttctgatgtccgttatgttaattaacaaagccttgaatgccaccaggaactatccatcatcaaagataaacaaagcgggacattagttaaagcagtaaaaacacgtttattcagtaactattgactgtaggggaaagagctgagctccattcgattttgtgcagaggtgactaggccttttaaagtgagcataagggagtaaggaggggagtgagcggtggctcaagagtcaggaaagtgaaaagttacaaagggttggtcgctgtaaatgcaattaggccagctgtgtggcctttgattaaatgtttgctggaataggggtcttatcagggcaactgatgcccctataatgcagcttaaaacacacacccacatacacagagtccatgaagaagacttatttaaaaaataaattacacaccacatacaataatgatgattccaggccgggcatggtggctcacgcctataatcccagcactttgggaggctcaggtgggcggagttcgagaccagcctggccaacatggcgaaaccctgtctctactaaaaatataaaaattaactgggcgtgatggcatatgcctgtaatcccagctactcaggaggctgaggcaggagagtcgcttgaacctgggaggctgaagttgctgtgagccaagatcatggcacttcactccagcttgggcaagacagcgagactccgtttcaaaaaataataataatgatgatgtttcccccaaaatgtccttccttcttcactgtaaaacccaaatctctactttgaggtcccagctcaattaatgtttcctcagtaatgatctttctcttgttttgagagtcctcacagaatttctgcttcgtggacttgattgcaccacttagtactgggtcatctgatgcattggaattaaatcctggctactgcaaggatgtttcctctcttcttataagcagagcacttattgtgacctagctgaaccccctgttgagctcttttggttacagaactcttgttccctattgctctttgtttatagtgattggaaatgttaggtcctcattatattacatggtgcttccactggaagggatccaattacaaaaattcattatttccatgatgatacttttttgaacaatgtgggaagtatttgtgaaacagagggaaatcacacatatcattacccagagagaaccacattttgatgctttatagtcagttacttatatttaatatttattattttatttttttttatttttgagacagagttttcgctcttgttgccgaggctggagtgcaatggcgtgatcttggctcactgcaacctccgcctcccaggttcaagcagttctcctgcctcagtctcctgagtagctgggattacaggtgcccgccaccacgcccagctaattttgtgtttttagtagagatggggtttccccatgttggctaggctggtcttgaactcctgatctcaggtgatctgcccgcctcagcctcccaaagtgctggtattacaggactgagccactgtgcccggccgatatttataattttactttgcaaagttgggattttgttggaagtgctgtatttgatcccactctttttgcataattatgaggtgactgataaagttttttttaacatgcacccaccacttattgtagctgttaatgttttctgggtttacattcatatgtagatagtcttctaccttcaaacttgatggtttctttttttttttggagacagagtctcgctgtgttgcccaggctggagtgcagtggtgcgatctcggctcactgcaagctccgcctcccaggttcacaccattctcccgcctcagcctcccgagtagctgggactacaggcacccatcaccacgcccggctaatttttttgtatttttagtagagacggggtttcaccatgttagtcaggatggtctcgatctcctgacctcgtgatccacccgccttggcctcccaaagtgctgggattacaggcgtgagccaccgtacccggcctgatggtttcttcagaggtgttaatgttgaatgtgtgaaagtcacttaatgagcttttgcattaagaggtttgggtgtgtttctattcccaaaaggacaaaagtaatgaaaaaaaatccctaatttcatctctgttagatggcatcattgacaatatatttctgtcattttcaacattttctttaactttgaccttttctttttacaattactttcacagataacgtctgtccaaatggtggttgagtcactgttttcctgctgtatgatggtggccatctttgcttccactgcattaacattgaggcctgtgtttcttatcactagcactggcacttttattttcctgttcatctttataaagatgtgggcacaatgcagtaaagtgccctataattgttctgtcaaggtggtgttttggttgatgttggctaaatacggtagtacccctttacttgcagttttgctttctgtggtttcagttacctgaggtctattggggtatgaaaatattaagtggaaaattccagaaataaacaattcacaggtttaaattatgccctgttctgaatagtgtgatgaaacctcactccatcccaccgggatgtgaatcaattctggccagcatctccatgctgtctagctgtctacctatgctcctcaccccttagtcacttaggagccatctcggttatcagatccactgtcgcagaattgcagtctttgtgttcaagtcgttcaagtcacctatatttgacttagtggccccaaagcgcaagagtagtgatgttggcatagtgtcataagagtttgattttattatttcttattgttgttaatctcttaactgtgcctaatttagaaattaaacttcatcatgaggccaggcaaggtggctcatgcctgtaatcccagcactttcagaggctgaggtgggtggatcacttgagcccaggagttagagaccagcctgggcaacatggagaaaccctgtctctacaaaaaacaaaaattagccagggcatggtggtgtgtgtgcctatatagtcccagctacttgggaggctgaggtgggaggatcacctgagcccagggaggtcgaggctgcagtgagccatggttgtgtcactgcactccagcctgggtgacagagtgagaccctgtcttaaacaacaaaactttctcataggtatgtatatacaggaaaaaacacagtatatatggggttgggtactatccacactttcaggcatccactggggatcttggaacacatcctccttgggtaaggagggactactctgtatagctcactggtgagctgatacaggaagggtggcttaggagtgtctttgtgtagtgtagctaaattcaggttgtcaggtaatcctctgtcacttaccttgaacagtatggagagtgaaggttgcactcttagttggagagttgcttgatggttgctcattcaaatatgttttcttgggcagctctgtagctgacctgtccagctgacaaatagctttggactgcagcaagtctgactttgtaggcacggttgaggagaggccagtctgtaggcgtggaaggcagcctctgactcatctctctgtgctaattaaataaaaggtaacacccccttccccattgcttgctttccgccctcgttttctgtatagaggctgtagatttcccacagatactgagtatctgggagtgactatgagacacggaagctttactttccagttttccaggtattttaatgtagtcaccagttagagcctcagaaagggcactgcagtaattatggcattgtctacttttatttcagagcagtatgtggccagatcatctgtgataacttgatgttaaaaaggaagtcttcatataagctgatatgtctacagaactagccattggatgtaattctttgaccaagctatttttagtactttaagtggccatacctgcctaattgtaaagacccagtgttttcttagtgttctgagtcaagccgcattgttggtgaattttacatattgctgtttgcagttgaatttagggttatgattggatcctgagaacagtatcaatcaagttacctctctaaatcactgtgattgttcccaaatattaggcatcccaagtagcccagagtaaacctttgctgccctgcttaaaatgtattttaaaacatttacagtgagaatatccccatattcttctagcttatatattaatgatatttcaaaacattttagaacttaatctgagagtcagtatagggcagtaggaaattcaaatactgagttggtgtgattacacagaacatctgtttgaattttaaagggaagcaggattttacttttggcttttcttccgtagtttgccttgtgagattaaaattgctgatgtttaaggaaagcagctgttgtggaaagacttagtgggtttttatcagagagtaaattttgaaacaatttgtgggtttttgaagtaaggttacagtatatagtgattagacagcattttcactctctcatgaaaactgtgtagtcaaaacaaaagtaggaaaaacacatgcataaccccttaaatcttatttatgaaaagataactagcgaagatgggaaaatcagacttgtgtttaagtatcatttttttataaactagctaagtgcattttgaaacaaaattcatgaggtctttgtggaatgccttttccatttttttgttttgttttgttttgtttttgcactcacattatgtctcagcaatttaatggagggctgatttcctaatgctttgatccttggtgagtgtggttcaccccaactagggaggaattcagtcttttgttcttgattccatgctcattgatctcctccactgccattctcagaaacaatggcagtattttgtttccatagtaatgaaactgtttgctctaataggattctatagtggtaatttttctttagctttgctagccttatccctaaggactctaggactttgttggacttattttgttagctgttactcttttttttttttttttttttttaaagagctgacaatccctaaagtaaaatgtcaattgataaatattctctggggccaggtgtggtggctcacacctgtaatcccagcattttttggggctgaggcgggtggatcacctgaggtcaggagttggacaccagcctggccaacatggtgaagccccgtctctactaaaaatacaaaaattagccaggcatgatagcacatgcctgtaatcccagatactcaggaggctgaggcacgagaattgcatgaacatgggaggctgaggttgtagtgagctgagatcatgccattgcactccagcctgggcaacagagtgagactcagtctcaaaaaataaaaaataaaaaaaaataaatattcactgggtgcctagaataatgaagttcagaggctgtatgtagctagccctgcttgtgcttgggagtgacttgtgaatagatgctgaatttgctagcctatgagactgtgcctgggccagtgcttcttcacagactggattgagggtttgtttgcctcagctttgcaccttttatcttttggaaaaggagtagaagctgggggtcccttggcagggacatttgcccccagaagtggatgagcccatgcaggggagcacggggagagtgggtcctctttcctgaatgggctctagagatccatgcaatcctgcagttgcacacacagttgtgttgtttatgtcctgaacacttttccaagaagaaagtccccatcatttctcagcttctcaaggaaatctcacctcaggaaaaaacagctgtagtacgagaaggaaagcctaaccttggaaccttgagaaacatctccaattcaaaaggcacacattccctgtagccaacagggaaataaaggaaattaagtgaaggtagagcctgcctggagggtggggagaggtgtggagccaactggcctggtcagacgacaacttgaagtcaagtgagagaggaagatcgaagatcagtgcctgtggattttttgagagtgctggcttgtctggaggctgaggtgggaggatcgcttgagcccaggaggtcgaggctggatgagttttgatctgcgacactccagcttgggcggcagagtgagaccatgtttctttttttgtttgtttttgtttttttgagacggagtctcgctttgtcacccaggctggagtgcaatggcacgatctcagctcactgcaacctctgccttctgggttcaagcgtttctcctgcctcagcctcccgagtagctgggattacgggcgcatgccactaggcccggctaatttttgtattttttagtagagatggggttccttcatgttggtcaggctgatctcgaactcctgatcaacccgcctcagcctcccaaagtgctgggattacagacgtgagccactgtgcccggccgagaccatgtttccaaaaataaaaaaaagagtaaggccaggtgtggtggctcctgtctgtaatcccagcactttggggggctgaggcagcgtatcacttgaggtcaggagtttgagaccagcttgaccaacgtggtaaaaccccatctctactaaaaatacaaaaattagccaggcctggtggcagacatctgtaatcccagctactcaggaggttgaggctggagaatcgcttaaacctgagaggcagaggttgcagtgagccgagatcgtgccattgcactccagcctgggtgacagaacgagaccccatctcaaaaaaaaaaaaaagtgcttgggggttttggcagcctcagtttccaggcagcagaaggtagagaaatgctggggagctgaggaactgaagccagggaggggaggttattatcttttaagataaaaggaagcacagattaagagcctaaagaggtctgggctgggcctaaaaggatggtagtaggaaaacagcttcctgcccccaaattgcaggatgctgaagtttaactattctttaagttctgccaaaatcgagtccaagggtagccctccatccccttttttcttcagagaaatcccccactttctgtgctcccccaccgtctactttttctatgaaagtttgtggaatctcatcaactgggattcagttctttgaaaaattctgtagaggcaagtctggttctggagagatccaggttttgctgcttgcttattttattttgttttatttatttatttatttatttatttatttatttatttatttaaatagagacaggctctcactatgttgcccaggctggtcccaaactcctgggcttaagcaatcctcctgccttggcctctcaaagtgttagaattacaggtgtgagccaccatgcccagccttgcttgatttttgaggcaggttatggaaccacagaaactcttggaagataccttaaaaggcatctgtttttttttaatgacccatctgaagcttagatgtcctttttaatgcccctcttcagtgtgcatctgtgtttgaatctgtccagtgctggggagctcactactgttcctagttcttaaattttcttgttaagtaggggaaattcctgtcttgtctccctaatgttgttaaagagataaaatcccctttaacaatattagtgattgttgaagggatgcaaatcagatgttttatgtaagagtctttttttatctgtaaagtggtgatgcagtgtgtcagggttcagtgtaggaagccaacatcactctaggtattttaaaaagaagaagatttactatagggaattaggtatgtttaaaaaataattgtagaactaaaggagcaagaatgaaggggccaccccctgggactcttgaacttatgaatgttgcctaaagaccaggggttctctctaggtcctgctgctcagcacacaaaaagcccacgactgagatcgacaaggattgccaaggaagaaggctttaatcgggtgctgcagccagggagataggagctcagtgtcaaatctgtctccctgacctactaaaactagaggtttgtatagcagggaagaaatgtaacaatgtgtaacattttgagatgcagtcttgctctgtcatttaggctggaatgcagaggcctgatcttggctcactgcaaccactgtctcccaagttcaagcaattctcatgtctcagcctctggagtagctgggattacaggcatgtgtcaccacgcccggttactttttttatgttatatattttttttagatggagtctcactctgtcacccaggttggagtgcagtggtgagatcttggctcactgcaacctccgcctcctgggttcaagtgattctcctgcctcagcctcccgagtagctggaactacaggcgcatgccactacacttggctaatttttgtatttttagtagagacaagctttcaccatattggccaggctggtctcaaactcttgacctcgtgatccacccgcctcgcctcccaaatgctgggattataggcgtgagccactgcgcctggcctaatttttgtatttttagtaaaaatgggatttcgccatgttgaccaggctggtctcgaactcctgacctcaaatgatccacccaccttggcctcccaaagtgctgggattacaggtgtgagccaccacacctgacctatttttctaaaagggtcttttttttagtatttggtagatactaatatagccataccacccttttggctttcaactaatctgtctttatacttaaaagtatgctttttatagacgtgatagaactgggtctttcttgctttttaatccaatctgacaatctttgcctttttgttttgtttcactttttttgttttgttgtgttttcagatgggatcttgttccattgcccaggctggagtgcagtgatacgttcacagctcactataccttcaatgccctgggctcaagtgatcctcctacctcagcttcccaaggagctaggactacagatatgcatcacctgacatggatttttttttttttaattctcttttgtggagacacggtcttactatgttgcccaggctggtctcaaactcctgggctccaagtgatcctcctgccttggcctcccaaagtgctgggattacatgtgtgagccattgtacccagccaatctttgtcatttaattggatgcttggatcatttacatttaatgtaattactcatatgtttgagtttaaggctataaattgttgatcagtttccatttcatttccccttcttttttttattcctattaattattttttagcgatgggttctcaccctgtcacccaggctggggtgcagaggtgcaatcatagctcactgcagcctcaaactcctttgctcaggtgatcctcctgcctcagcctaccaagtaactgaaacctggctcatttcctcttctgttctttgttcttatctttttttgaggagagggctaattgaatatttttcactgtgtttatatgcctttttatttcttcttcttattattatttgagacggagtcttgctctgtcaccaggttgaagtgcagtggcgcgattttggctcactgcaacctccgactcctgggttcaggcaattctcctgcctcagcctcccgagtagctgggattacaggcacgtgccaccatgcctggctaatttttgtatttttagtagagatggggtttcattgtgttggccaggatggtctcgatctcctgacctcgtgatccgcccaccttggcctcccaaagtgctgagattacaggtgtgagccactgtgcccagccttgcctttttatttcttaagatgttctaaggattatagtatgtagcaccttgaaaaagggagaagcatcaaaacttttatcattagtgatggaaaccaatcgctaggtaggcagatcaatttactagatactgatttaatcttgaaatgatgaattaagtaacatgatatgaaaactaacttaaaaacaatattttatgctttacagaaatacacggccgagcacagtggctcatgcctataatcccagcactttttggggactgaggtgggcggatcacttgagcccaggagttcaagactagcctgggcaaaatagtgagaactcatctctacaaaatatcaaaaaattattcaggcatggtggcatgcacctgtagtcccggctgctcggcagggggatgaggtgggaggatcacttgagccaggctgaggaggtcgagactgcagtgagccatgatcttgccattgcactccagcctgggcagcagagggatacctgtttatatgatttaattaatcatacaaatgtttattttattttccttttggacatttagtgtaatttttaagaatgaatgtaaatactctacactagagccctggaaatagttctgctacaatacaacatgacatacgcattctaaaaattaccacattaagcagaactgcacaatgaaaccacaggtctcacggggaaaatttggttaagggcacaatattctaaaactttgtcagtgacacatctgaaaaaaggaactgaataaaaatgatatagttttataaatgttaaatggttaagaaatacataactactatggtaaatttggcattttatttgaaaaagtcttcaaattaccttgtggaaatgggtttggagagttaggcttttgagcagttgagaagcagtgggaggaaggttatctggaattggatggaaagttgtaacatcaaatgtgtttggtgtgactcagtgcacttgttgagctgagctgtgtgcattttttgtgtattaccacgaagctcaattcagcttggtgcagttttctacctggtgtttctcagtagacagaaatgcacatcctattatgcctaattgttccgtaacatatccatcctgttggagcaattttgtgttttcaaagtaagtatagaataaatagctcagaagccttggacttgcagagcttcaggaaggctgaccaagccttgctcctgttagctgtctgagggagagagctggccccactgacttcctttggaccacctcccagaaaattggcgctggaagggtcttctgttcttctgacccaattgtgctcgatttcttgtaccataataaacaaacaactccagaggcaggaacttcctatctttgaaggcagctctacttcacccttagggagatctggtttaattcttcttcctgctggcttctcaaggctgtagtgacttgcctgtatcctggggagggatacagctatttttgtataataaagttaaaagaggcggagtggaaggtgggcatggtctgtggctcctggctcatagggtaccacaatttggttgatattcctgtttctgattgtaagaatccagtttcctttttagttcataagcatgatgattgggttttcatgcttgtctgtgagatgtgcctcccttaaatcttgtcatgtcgttggtacattacccatgtgacatgaaaaaaaaaaaaaaaaagaatcccagtgttcacccaaaccataaactgaaaattgggggcatgctgacaagggggattgtgcctctgggtatgagaaatttcactaagaagccaaaatatcagaccttttagcacactccaatagtttttaaggataatggtcaggcagtttgaaattagaaccattgtgggaagtctttggttggcagccagccagagaaagtctcacagctgctgatgaggtttctgatgggcgtaatgcccgttgctccgggtcctgcgttgccattctcagatggcttatgggctgtccatggggttgtgagaatctgggaagtcacagtctaattctggagctagaaggatccttaaggcagtggcatatccacctaataagtttttttcaggaaacaggtcctggagcacagggtatcttccaaggccacacagctagtcagctcacagcaggtactacccctgtgctctcctagcctttgctattttccaatgcccagtacacacttggcctttggtaaatgacgagagcgtgaatgagtggatgttgggcttttcccaaagataatctgctgtctgtgcagagcagttcaacaaagagctcatagctatggattttaaacacagtcttatgatttgattatttgaatctcggattgggttttttttttttttttttttgagatgaagtcttgctctgtggctcaggctggagtgtagtggcaggatctcagttcactgcaacctctaccctctgtctccagggttcaagctattctcctgcctcagcctcccaagtagtgggattacaggtgcctgccatcacgcccagcaaatttttgtattttagtagagatcgggttttgccacgttggtcaggctggtctggaactcctgacctcaggcaatccacctgcatcagcctcccaaatgctgggattacaggcatgcgccaccatgcctggctctggattggggttttatactgtattttgttgtaataaaatctgtttaaactttttgttcccttccttctcttaaactctcaagcagttgtttaagttattttccagaaagttctgctctatgcgtggatgatagaatttaacagaaagcggtttctaagagtgtactatctcaccgttagtgtagttggcggaagttgcaggttgctgagtaaggggtatgaagccatttaaatgaggcactttatgcaaatcattttgcctagcagcggcttctggctggaggctttgaaaagcatgaagctgtaaattatttccttatgatggggggcggggaggaatgagggttgccacgggattgcaatttttcttttttcttttctttttttttttttttttttgagacagagtcttactctgtcgcccaggctggagtgcagtggtgcgatctctgctcactgcaatctctgcctcccgggttcaagtgagtctcctacctcagcctcctgagcagctgggactacaggcgcgcgccaccacgcccagctaattttttgtatttttagtagagatggggtttcaccatgttggccaggatggtctcgatctcttgacctcgtgatccacccgccttggcctccccaaagtgctgggattacaggcgtgagccaccgtgcctggccgattgcatattttttggaagcaagagttccagcagggctgagtctctgacttctttttttttttcttgcagaggggtgtggcagatagctggacccagggcttgagaggaacaccaatgctcatttcatttgcctttcattatggattgcttgagggtattctctgattattagagagaactggcaactggtggggaggtggctcttgcttgtaatcccagtactttgggaggccgaggtgggcggattacttgagcccaagaattcgataccagcctgggcaacatagtgaaaccccatctctacaaaaaaatacaaacattagatgggcgtggtggcgtgcacttgtagtgctagctactctgtaggctgaggtgggaggatcacctgaggctgggaagttgaagctgcagtgagccatgattgtaccactgcaacccagcctgggtgacatgacaaaagacatgaaaaaaaaagagagagaaagccctcttcttctcttcttagcatttcattctccttttttgatgtttgtaaaacaattagagagtcctgtgcaaagctgatatttaacttacccccagatgccaatagcactcaccagtctttgtgaaaacactgcccctgcctttactaccaaggatgcacctgacccctggggcaggcagtgatactgcccagaaaagaaacactggggccgggcgcagtggctcatgcctgtaatcccagcactttgggaggccgaggcgggtggatcacctgaggtcagaaattcaaagaccggcctggccaacgtggtgaaaccccgtctctacaaaatacaaaaaagttagcccggcatgatggcgggaggttgaagcaggagaatcgcttgaacctgggaaatggaggtttcagtgagatgacaatgcaccattgcactccagcctgggcaacagagcaagaccttgtctcaaaaaaataaaaaaagaaaagaaaagaaaaaagaaacactgggccaggtgcggtggctcatgcctgtaatcccagcactttgagaggcggaggcgggtggatcacctgaggtcaggagttcgagaccaacctgggcaacatggtgaaacccccgcctctactgaaaatacaaaaattagctgggcgtggtggcgtgcacctgtaatcccagctacttgggagactgaggcaggagaattgcttgaacccaggaggtggaggttgcagtgagccgagctgccatggcactctagcctggacaacagagcgagaatctgtctcaagaaaaaaaaaaaaaaaagatttaggacttaagctacttgaagtatttgatgggaggaaaaggacaaacctgctttctactgagaattaatttaaacatatttttggtgtggattttttaggcttttttgtgcatatagttcagaggcggtgtagctgagaagttaagagccagttctaatgataggaagcctgagttccggtatgttctcagccatttactggtggtgtgcccttgatcagttacttcatctgtctgttgtttagtttgtacatctgtaaaatgggataatccctaggatctcttttataggattttgcgcttggaacagtggctggcccacagtatgagttcataaatgttagatgttgtagttttggggaggaccgtcactctcccttgggatactgatatccaaattgtaagttgtcagtaggctttctttgaagtttgctccacaccctttccattaaaataagtaatgtgtagatccagtatttaaccgtgataaaatgggttaaaaaggagtccattaaaagtattgagaaaagatgggtgaacttttaaaataatctaaaatggccaagatttttctaagcatgacacacagttattcgtagaacagggatccacttgccttaatttgcacagtgttcttataaatcaacagaaagtacacataacagaaaaatttaaaaggttagggatcatttaggaaaaaatgcaaatgccaacaaatgtgagaaaatgctcaatcttacttataatttaagaactacaattcagccaggcgcggtggctcatgcctgtaatcccagctacttgggaggctgaggcacgagaattgcttgaacccaagagggagaggttgcagtgagccaagatcatgccactgcactccagcctgggcgacagagcaagacttgtctcaaaaacaaacaaacaaaaaacaacaaaaaaattaccattaaaaatgagagagttttcattggcaaagttaaaaagaaaggtgaaagaaaaacctactcttcttgatttgtgtttgttcacttatggagaatttattttgtcataatgtctgaatcataattaaatatgttcttgggtctagcagttcttctatttcttgtattagaagtaaacttggaacatcttaaacactgataatgaagactaatttgaaataaaaagttactagcctttcatacaatgaaatatgttgccgttaaaaagaatgaaattaacaatggaatattatacagccttaataaagaaggaaaacttgtcacatactacaacgtggttgcacctcaaggacattatgctaagtgaaataaaagtatacaataaaagtcacaaaaggacaaatactgtatgattccactcatatgaagtgtctaaagtagtcaaaatcatagaaagtagaaaggtggttcccaagggcccagaggaggtaggagggagaacttgtgtttagtgggtatagcgattcagtgctgcgtgatgaaaaagttatagaaatctgttggacaacaatatgaatatacttaacactactgaactgtacacttaaaagtggttaggatgataagtttaatgttatgtgtgtttcagcatagtaaaaaaaaagagtaagttaaatctgtgaggaacaggtagccaagataacagtgttagttaagtaggggttataaaaagaggaggttaaagaacactgtgtctatgatgaacccaattatggtttccaatttgaaaggcatgtatgtatccatgtatgtaggtacatatatatgcaataattctgagagttttaaagatatcctagaaactgccaccggtggttacagcaatagagtaataataggaggttggagggtaggggataacgttgggggcatttgtttttcattcaacaactttaaagcttattttagcaaacctaaatgtgcgaaattcatcatgttttataattgtatttgctagcactgttttcattttgatatcatccctgccctttgtggtgggagtggtggtagtgtgtgatgtgtttagaagtgggtttggagataacagagtttaacacatttttgcattagaaaggaaacatcaatttggttgcacaactggtatgaatatgtggtgtaatttatttttatcaacattgtctacaatttacatatgtaaatgtagatttttcttaagtgtagtgaggtgaatggaactggaaaaaacgggtacgccaatcctaaaacaatggtgctaagattaaactgtcagatcagtctttgtcaagtgctccagctggctgtggattattaggaagtattattcaaagggctgctttggtacaagacaagaaaattgctggagaaatgactgctctggtgctaagattcagccatttcaaatgtgcagtctcttaaaagtaaaagttggggtcgggcatggtggctcacgcctgtaatcccagcactttgggaggctgagacggacggatcacgagttcaggagtttgagaccagcctggccaatatggtgaaaccctgtctctactaaaaatacaaaaattagctgggcatggtggcgggcacctgtagtcccagctactcaggaggctgaggcagaagaatcacttgaacccgggaggcagaggttgtagtgagccgagatcatgccgctgcacaccagcctgggcgacagagtgagactctgtctcaaaaaaaaaaaaaaaaaaaaaaaagtaaaagttgaaagatctataaaatacttcctgtaaactttacaaagcattttacagcagactaataacttaagaaacatatgaagcaatttcagctcctaaagtcctaggaatttgcttttggggatactttttatttataggatacttcctatttatttataggatacttcctatttaaattaacaagtgttcaaaaaaaaagtcctagttttatttttattcttaaagtggcattggagagatgtccacacttgcacttctctaatgagcagagatgtccaaccaagtgattttagaattattgagttttttttaaacttatcctaaaatggctattaggttatttttaactaaagaaattattattgtttttttgagatggagttttgctcttgttgcccaggctggagtgcaatggtgcgatctcagctcaccgcaacctccgcctcccgggttcaagtgattctcctgtctcagcctcctgagtagctgggattacaggcatgcaccaccatgccctgctaatcttttgtatttttagtagagatagggtttctccatattggtcaggctggtctcgaactctcgacctcagatgatccgccctccttggcctcccaaagtgctgggattacaggcgtgagccactgcacccggccttaaagaaattattgctaaagtaaaaagtagtttcacatagcatatacagcccagtcatttaaagtgtgcaattcagtggttttatagtatatttacagagttgtggaaccatcatgacaacttagtttttgtcacctctatgcttattagcagtcactcccagttccctcccaaactccctcagagccctggcaattgttaatctacttgctgtctctatgggcttttgtagacgtttcctattaatgaaaccatataatgtacagtctttaggactacttctttaacttagtatgttctcaaggttcatccatgttgtagcacgtgtcagtacttcattcctttttattttttttttttgagatggagtttcgctctgtcaccaggctggagtgcagtggcgtgatcttggctcagcacaacctctgcctcctgggttcaagtgattctcctgcctcaacctcctcagtatttgggaatataggtgtgtgccactatgcccagctaattttcatagttttagtagagatggggcttcactatgttggccaggctggtcttgaactcctgacctcatgatccacccgccttggcctcccaaagtgctgggattacaggcgtgagccactgtgcctggccagtacttcattccttttactggaatataccacactttactgaaacccattccttgctgatgatcatttgggttgtttccactttttttttttttttctttgagacagagtctcactctgtcgcccaggctggagtgcagtggtgtgatctcagctcactgcaagctccacatcccgggttcttgccattctcctgcctcagcctcccgagtagctgggactacaggggcctgccaccacgcccggctttttttttgtatttttagtagagacagggttttacggtgttagccaggatggtcttgatctcctgacctcgtgatctgcccgccttggcctcccaaaatgctgggattacaggcgtgagccaccttgcccggcctttttttttttttttttttttaagacagaatcttggtctgtttctcagggtggagtgtggtggcacagtcgtggctcactacagccctgaaccctcaggctgaagtgatcctcctgcctcagcctctcatgtagctgggaccacaggagcatgccatcatgcttggctaacttttttggtattttatagagatgggatctcactatgttgcccaggctggtctccaactcttgggctcaggtaatcctcccttcttggcctcccaaagtgctgggattactggcatgagccactgcacctggccattcttaatgagttaatttttgtctggtatggggaaagggtccaacttcattgttttgcatttgaatatccagttccaccaacatttgttgaaaagactattctttcccagttgaattatcttggcagaattagttgactgtcagtgttaagctttatttctgggttctcgattctattgattttttttttttttaatttgactgtacgttggaagaattattcatctggaatttagacctactggggctggtggtcatgacgctggaggttgtgttttgggaactggtgaccagtcattcttagatggctgactcattttttttgtgaccatgagatttaaacatttatagagatttaattgtaagtaacaaaggcctgcagtagatgctgttacaggcatgagaaatgattttgtttatacagatcacaaactataaatacagtggcagtggtcactggagccatccatatatcacagttaaactgttctcctgagtaatggggttgtcagcactgaagtacacttccttgccatgtggagcagtagccggttctttatttaatattttcatttactaagcaataacttaattggaaaatgaattttgattgggttttctatagttaactgttttttaaaagtactattccctttttctcttttccacattcactttggtgaggtagttaagaatactggctttgaaactacctggggctgttgcagtggctcacacctgtaatcccaccatgtgagaggctgaggtaggaggactgcttgaagccaggagttcgagaccagccgggcaaaacccagtctctacaaaaaatacaaatattagccaggttggtagtgtgcgcctgtagttccagctactcgggaggctgaggaggaaggattgcttgagcccaggaggttgaggctgcagtgagctgtgatcgtgccactgcactccatccagcctgggatagaatactgtcagaaagaaagagagaaagaaaggaaagagagagagagagaaagaaagaaagaaagagagaaattatacctgggtttggaccctgtgctcaccacaaaggagctgtgaccttgggcaatttatttcctagagtccaagtttcccaactggtacagaggagaaaaataataataacagtaatacctgacaggttgggagagattgtgctggtgtcacagagtctgtgacggcacttgtaagggagtgctgcataaatgagagtggcggctgttgttgcattattatttgttttacatggttataaaacttccctcaagccccgtttgaaaagagaaatcagtagttggcaaacaaatttgaagagcaatggtttctttttttttttttttttgtgacagtcttgctctagaatgcagtggcgggatcctggctcactgcaacctcaccctcctgggttcaaatggttctcctatctcagcctcctgagtagctggtgcatgccaccacacttcattttgctgtatttttagtagagtcagggtttcaccatgttggccaggctggtcttgaactcctgacttcaagtgatctgcctgcctcagcctcccaaagtgctgggattgcaggtatgaaccaccgtgcctggccaataggtttttggtcaggtgtgaggtttgggtgatggggttggggatgctagagctgcaagctcctggagcaggctgagcctccaagagggagcgagtccttgggttccttctgccctgggaatttcctgagcagtgggaggagagctggcaactaggtaaatctcccagagtttgaggaaatgagatgctagtgctttggagtgactaggtttagatcccagccctgtaaacctctggccttccttttcgagcacactgagaataatattgacaattaacgttctaagtgccttgaaaacattctcagtcctaataatcctatgatgtaggaactactgttgtctctgttttgtatgaggcagcagaggcacagagcatttaagtagccttgtattgaatgaaatgagcatgcatgcaagctaacattaaacacttacggaccaggcacatgtgctgagcactttacatgggtgatttcatgtaatctttacagatgttcatcattataactttatatggctgaacaggtctgtgttttgttttttccttttctttttaattagttcctgtaagcagaatgtctgtgtttttgtattgcttcactggccaagagatttctccctacattaaggagcaattttttgttgtttacttttaccctttcctagtgttgacttaaacaatgaatgttcaatgtaggtgagttcaaattctagtttgtttatattgatcacttttagttactcaataactttaaaggttggttgcaaaactattttgttttttgcagtctctgaaaagaggattctgagatgttaaattagcaaaaaaaaaaaaaaaaaaaattgtgtaagtatgtaaaatgccaggaatggtggctcacccctgtgatcccagcactttgggagaccaaggcaggtggatcacttgaggtcagcagttagagaccagcctggccaacatggtgaaaccccatctctactaaaaatacaaaaattagccgggcgtggtggcatgcgcctgtaatcctagctactggggaggctgaggcacaagaatcgcttgaactcaggaggtggaggttacagtgagccgagatcgcaccactgcactccagcctaggcaactccatccccaaaaaaaaaaaaaaaaaaaaaaaaaaaaaggtatgtaaaacattggtggtattttgagaaaaaagaaattctctgaatttatcactaaatttgttgtaagcctaagtatagtttttgttttccacctttttcttttgttcttgtttcttgtcatagttaactttgaagagtttggaatgatctttttatttatattagagtgtgaggtattctaatgctatcaacaagaaaaaaccatgaattatgtgggaaattttagacaaggacattttgtgcagaatgatagtgaatgagaatttaggcaacttaaaatttttgtcctggctgggcatggtggttcatgtctgtaatcctagtgctttgggattgaggctgggagtttaagaccagcctggggagtatagcaaacaaaaaataaaataaaaaaactagcagggcatggtggcatgtgcctgtagtcctaagtacttgcgaggctgaggcaggaggatcatttgaggcaaggagttcaaggctccaaagagctatggttggaccactgcgctccagtgtgggcaacagaatgagaccctttcttaaacaaaaaaaaaattcttaatagttgaaagagaaaggcaatgatgaaagatttggattgtgattcaaattttatacatactacaagtgccaaactcagttttcactctgttttatgctgagtgtctatacattttttctttccttccttccttcctcctctccccctccctccctccctcctttccctccctccctccctccctcctttccttccctccctcctttccctccctccctccctccctcactcactctgctgcccaggctggagtgtagtgccgaaatcatagctcactgtagccttcttgacctcacaggctctggtgatcctcccatctcagtctcctgggcagctgagactacaggtgcatgctaccatgcctggctaattttttttttttttcatattatttgtagagatggggttttgccatgttgcccaggctggtctcgaattcttgggctcaagtgatccacccaccttggcctctcaaagtgctgggattacagatgtgagccaccatgcaggccaagtgtctgtacttttaaccaaagtccagaataattgctagaaacttttaaaccttcttaccttgtgtaaacacaggttttttcttttttgtaagtcagggtctcactctgtcgtccaggttggagtgcagtggcactatcttggctcactgcaacctctgctttccgggttcaagcgattctcatgcctcagcctcctgagtagctgggaccgcaggtgttcgcccccaccctggctagtttttgaatttttaactttcaaatgattgactgcaaaaatcaggtagtcaatttaaaaataaacatctacacatgcgattctttttttttttttgtatttttagtagagacggggtttcaccatgttgtccaggctggtctcaaactcctggcttcaagtgatccacccgcctgggtctcccaaagagctaggattagaggtgtgagccgctgctcccggctgtaaacacagttttattatgaggtgtgctgtgactctctagagacagctctgctctagagacggcaccatagcagcacaggaaagagtttagggcctggctgactgagttcctatctcgaccttaggagagacctcagttttctcatttgtgaaaaaaatggaattcgtttttcctttttctctcttttcttcctttatgttttctctacttattttgtcttttcctcatttttcagtcagtatagcttataaaattttttctgattataaaagtagggcataggccaggcgcagtggctcatgcctgtaatcccagcactttgggaggctgaggtgggtggatcaccttaggtcaggagttcaagaccagcctggccaacatggtgaaaccttgtccctacaaaaaatacaaaaattagccgggcgtggtggggggcacctataatcccagctactcaggatgctgagacaggagaattgtttgaacccgggaggtggaggttgcagtgaactgagatcatgccactgcactccagctctgggcaacagagccagactccatctcaaaaaaagtagggcatattatgccaaaaatttaaattataatcctcttacttgtgaaaaatggcaatatgagtatttacttcatgggattattgtgaggatgaagtaaatccatgctaagaactgaggaccctacctggcacctagaaaatgcacaatgcaatttcctattatttaaaaaaattattattagtatcactgccacaaattacaagaagaatgaagaatggctttcggaacggtggtgggatgcccaaggctgtgctgtgttctcgcagaaagcattgggaatggcacatctcaaggtcaggactagccctcacaaggggcagcatccagtgggctcttctgactgctgtaggtgcatgcacctgttttagggtctctcttgattttatgtttctataggggagtaggtggaggaggggtcaaaacagtatattccagatatcctgagatctggtgaaggaaaactggttttggaatcctgttgggctctggaatcagagatcaggattttggtttatcccaaagtggcttctggaaagtcggttaacctctgagactcagatttcctcatctgtcaaatggagattgtgatacttctatcaaagggttatttttggccggatgcagtggctcatgcctgtaacatggcaaaaccccgtctctactaaaaaatacaaaaaattagccaggcatcatagtgtgcacctgtactccagctacttgggagtctgaggcacgagaatcgcttgaagtgggagttggaggttgcagtgagctgagatcgtgctaccgcactccaacctggggggacagagtgagacactgtctcaaacaaaaggcaggggggtggtttttttttttcctttggggagattaaatgaaaggtcttgaaagcaccttagagtagtaccttgatacataggaagtacttaagaaatgataggtaactattacttataatgagtgctgggtagaaggatctccttggttaccaaagacactcacatctttaattttggtgtttcgatggaagcacaggatataattctctgcctccttaaattgttgaacgtgctgcaaagtttgacatttagaaatagaactagggctgtggggctttgttccgtctttagggctttgttctctgcccttgcgtacacactcgtgtgcatgtgtgagtgcatattacacaggtgcatgggataaccctactcttttaaggcagtatggaagtagcaaagctgctgtctttgtcttttcgggtgttgctggtctcctctgtcagcaccatcaaggctttgctgctcattgcactcatccagcagggtgctatcaggaagaaggagaatgagttccaaaaataaggtaacttattcaggcttcacatttgtctctatgttgggaatgatgctactctccctgcctgccttgtggaatggttataaagatagaatgagaggaaggttgtgaaggtgtgatcaaggtgttacaccaatcattaaacattataaagtattgcaaacaaatggacttaggagtcacctgactgaggcagaaattccagttctatttaataggtttgtctgtgttatttgatccactttctcattataatagaggtggatgataacagcatagggctgtgataaacattaaattctgtaacttatgtaaagaatctagtgaagtatatgttgcacataacaggtactcaaaaagttgtgtttgggttagtcaggagtttgagaccagactgggcaacatggtgaaacccagtctctactaaaaatacaaatgttagctgggtgtggtggcgtgcccctgtaatctcagctactcgggaggctgagtcaagagaattgcttgaacctgggaggcagaggttgcagtaagccaagatcacgccattgcactccagcctgggcaacaagagcaaaacttgtctaaaaaaaaaaaaaacaaaaaaaaacaaaaaaaaaaacgctgggcgtgatggctcacgcctgtaattccagcactttgggaggccaaggcaggtggatcacgaggtcaggaggttgagaccagcccgaccaacatggtgaaaccccgtctctactaaaaatacaaaattagctagacgtggtggtgcattcctgtaatcccagctactcgggaggctgaggcaggagaatcacttaaacccaggagatggaggttgcagtgagccgagatcacaccatcgcattccagcctgggcaacaagagggaaattccgtctttaaaaaaaaaagttgtgtttttatacacttttcaagagctgttgcttctgttactattgtttctgctgcctattttctcttttcttccccaatttctcccttctttggaaggactggatgttggctaacatggtggctcatcaaacatgactgtttttttttcttttgagacagggtcttgctctgtcacccaggctggagtgcagtggtgcagtatctgctcattgcagcctcgacctcctgggctcaagggatcctctcacttcagcctcctgagaagctgggactatagtcgtgtgccaccaagcctggctaatttttgtattttttgtaggggtggggttttgccactttgcccagggtggtcttgaactcctgtggtctcaaactcctggactcaagccatctgctcgcctcagcctcccaaagtgctgggattacagggataagccactgtgcccagattcatttctgacttttctttttcttttttcttttttttttttttttgagacggagttttgttcttgtcgcccaggctggagtgcaatgacaggatctccactcactgcaacctctgcctcccaggttcaagcgattctcctgcctcagcctcccaagtagctaggattacaggcgcccgccaccacgcccagttaattttttttttttgtatttttatctgagacggggtttcaccatgttggccaggctggtcttgaactcatgacctcaggtgatctgcctgcctcggcctcccaaagtgctgggattataggcgtgagccaccgcgcccggcttgacttttctaactttctcgttgatgagtagatagttgtatcatcacagattaaatcttgaggttttcatctattcctggctatggtgagagctacccaccctgccaagctcaggaatgcattctttcaaatcattctggatgcgtagggtactaggaatttagtctgtatgattgcattttattttaatttaattagaactttgaccctcgaacttgctctcagggtgggatattctttagaaagcatgaatagcctatccttactgtataccatgagaaagttagtgatactaaccagttataattttataaaagaatatgatgatatatatagtcagccctctgtatccgtggattctgtgtctggattgaacaaaccatggatcaaaaatatttggggaaaaaaacaaaacaataaaaataatacaaattaaaaaatatagcacaacaaatttacatggcatttacattgtatcaggtattatgagtaatctagagataatttaaagtatataggaggatatgcatagattatatgcaaattccattttatatcagggacttgagcatatgagaattttgatattcacgcgaggggtcctggaaccagtccctcgcagatactgagggatagctatatgccttataaaatcccaggcatatttgtttatgaaaaggcaagctaggctgggcacagcggctcatgcctgtaatcccagcacctgggaaggctgatgctggtggattgcctgagtccaggagttcaagaccagcctgggcaacatagtgagacctcatctctataaaaaaataaaaaaaattagccaggcattctggcacagtagttccagccagttgggaggccaaaatggaaggatcacatgagcccaggaggtcgaggctgcagtaagctgtgaccgtaccactgtactccagcctgggcaacagagtgagactgtctaaaaaactggccggtatggtggcccacacctgtaatcccagcactttgggaggccgaggcgggtggatcacctgaggccaggagttcgagaccagcctggacagcatggtgaaatcccatctctactaaaaatacaaaaaattagccaggtgtggtggcaggcacctgtaatcccagccacttgggaggctgaggcaggagaattgcttgaacccaggagccagaggttgcagtgagccgagatcgctccattgcactccagcctggacaacaagagcgaaactccgtctcaaacacacacacacacacactcacacactcacacactcacccacaaaaaacccaccaaaacttctgggttggatctggtgaggtcacaattttggatttggttcccacgtggtccagttttgttattatgaagtaaatctctgtttcagaggccaccatatcacatttctcgagtctccttgtagacacctaacttgtccgtgatgatgtgaggtaataacaggagataatgattcagcaaagctttgtcccgccactgagaaattgctttgaaacagtggcccatccacagttgcaaagtgggggtgattcttcttcagggagcatagcgtagcagattttcccctgcgtcctctgtgtttgttcctcagtgtctggaaagtgcttaccctagagagtgagcttgggaccatttttattaaagctattattattattatttgagacaaagtctcactttgtcacccaggctggagtgtggtggtgcgatcacacctcactgcaacctccacctcctgcgtttaagtgattctccttgcctcggcctctcaagtagctgggactgcagatgggcaccaccacgcctagctaattaagaaaatttttttgtagagctgatgtctccccacaacccagggtggtcttgaactcctgggctcaagagaccctcccaccttggcctccctaagtgctgggattataggcgtgaaccaccgtgtctggccattaaaggtatcctcaaaactcattttatagtatttattttcttttgatgttcattgattttttttttttttgctaaagttgtcttgctttttaatgtagaccaatggagtgcattttacagacaacaaaacatatcctatatggtgggtagcaaattaaataggctttttactttttttctactctttgattctttacctattaaaatattgcagttttctcttcatttaaaaaacttatgaaattcgtgcttaatgttaaaccttgaaaacatagacaagataaagtaaacaaaggccatctaacatcccataatcctggttaatatttttgtgtattcatctctcctaaggatgtgtccattagcattttttccaggttgaattacagatacctttttcagagactgcatgctagtctctcatgattcccttatctgttatattgaagtcgtgtgtgatcgcacgggaaacttgcttttgttatttgccatcaccaaaggacccttctgaatgaagagcgagggcagctggctgttgggtgtgtggcgtgttgtcatcacttgaacacaggattattaaaggtgcgcaggattgttaaatgtgcctgctgtcggctgatgtcagatgatcccctgggaaggtttatttatttatttatttatttatttttaccctgcaggctccagttctgcttcagcagatctgggatggaggctgagactccccgtgatgcccaggcagctgttcatgagccccctttggagtaccattgagccaaggtcctctagcatggccgagtgctctctgctcttgcagtgaggcagtctctgcttttgttctgctcagggctgacctgttttggggggcttcctccactcttggggggcttcctccacttcctggctcttttccctcatccacgctgctcaagaccccatttcttccctgctgtctcatgcatacatccacgctcctcccaaacctctgttcctgtcactccagcaggctcctccatctccccaggccaccctcctaccaccaccactcccaccaccacatcagagtccttttttttccagttactacttgattgcccccctccccacttcacccctcagtttcctgtctggagccctcagattcctttctctccatggagggcagtgactcagaggcgcctacctcagaggcggcatcaatcaggtgtgtcctggccccaaactagctctccacttggggctccctgagtgttgaggccttggatttccttgcaggggaaggaaggaggggtgagaaagatccagaatcttcaaaggagccttctttgcccagtccaacatccactccacccagctgactggagaaataaatgctaggtttgactgaacaaataacagtaattaagatctgtttcctgaacagcctacccctttggcctgtttactttgcagcccaataacaattcattcagtcagcctggcattgaggtccattgtgtatgattttgttgccggagtgctagtcttcacaatctagggctgatagaagacttctgccttgtaattttaaaaagtagagggaacaccgctgccaatatgagcaagttacttgtttctatctctctctctcttttttttttttatttttatttattgagacagagtcttgctctgtcgcccaggctggagtatggtggcgctgtctgggctcactgcaacctccgcctctgagttaaagcgattctcctgccttgctctcctgagtagctgggattacaggcatgtgccaccatacccagctagttttttgtatttttagtagaggcggggtttggccatgttggccaggctggtcttgaactcctgacctcaggtgatccacctgcctcggcctccaaagtgctgggattacaggcgtgagccaccgcgcctggcctgtgacttgcttctatctctgtactcccgtacttggttgtgtgtagccaataccctgaatgaaaaaaaacaaaaaggtaaaggttggcgggtggtgatgtaaggttattttcatttctgttgatgatagaagaaataagtataagcaccttcatttggccctggttccttttgcaaatgtattttaagaacataaacaggagtttctcaagctgggggcgaaggggtaattgcatgacagttctctgccagttggtgccatcgaggcagctggtgcttgaatgcaggcatcctcacaaaggctgtctagggctttgtgccagcttgccttggaatgaggacctgctccagaagtgggtggaggggtgctgataaaacccactgggcatctggcagtgcttgcttgaaaaggcaatgaacagcggctatttgtttgggggaaaggcacacacctattcgttccttccacttcaagctagaagtggaagaagaagatgaatttcaagggtgaaaagagggaagagctggaaagaaggtttcctgaagtttgagggatgatgaaggctaaagttaactgtgagaaaaagtgttttctcagctgtaggaaaacagtgcagctgttactccaagaaaaaagctgttaaaccaggactttcatggcactaccaggcatccagaacatggggtgggctagaggagtgagggcgaccctgtaggagggacatgcgtcttgagaggttagtgtgggcccatgcctccctttccccttcccctgatcttgcctctgagcactggtactatccaggtacagctgtggttttccaaaccagaggcctgttgtctgacattttgttttctaatttatgtatttatgtgaaaaatattagaaagacttgaaataatcatcttttattggacactgaatcctaaagaacaggattttatgggatctagggtaggtgaagcgtgcaagtttttccttgttcagagcccttgttgctagactaaccaccttgaaagagaaacatattgttactgggcagtggaatgggtcagaggtgttcttttgagcagtgagccctttctgtgatgtggtttgtggggagagcggccagtggttgaatctgcacgtggggtgatttagtcggggctgtcagcttctcagaagcgcaggaagggaggtagtcgggggtgggcattaccatagcacagcctgtagctgttcaagagcaccagacttttttttttttttttgagacagagtcttgctctgtcaccaggctggagtgcaatggcgtgatctcggctcactgcaacctccgactccctggttcaagtgattctcctgcctcagcctcccaagtagctgggattacaggcacgtgccaccatggagtttcactcttgttgcccaggctggagtgcaataatgcaatcttggctcactgcaacctctgcctcccgggttcaagtgattctcctacctcagcctctcatgtagctgggattacgggcatgtgccatcatgcctggctaattttgtatttttagtagagatggggtttcttcatattggtcaggctcgtctagaacttccgacctcaggtgatccgcccaccttggcctcccaaactgctgggattacaggcgtgagccactgcgcccagccaggaacaccggttttgtggccaccccagggttaatgcgacacatgctggcttttcgttttaactgtcatgagggaaacctttcaaaatgtattagactctgagacacttgaaactgccttcttcctaggatcagcagagcatttgtttgtttgtttgtttttgagatggagcagagcgttttttaaagctactaacgatgacttcctttagttgtctcaagtgtctgttagtatattgcacagtagatacagaagtgtggaacccagaggatgagttactagctccttccttttccagactgctgagttgtttgcactgatgtgttttttgatgctccactgatggttgtcactagatttgtccttgagccaaatcacctaacctttctgggcctcggttttcacatcaggaaaataggaggactggactagatcagggacttccagtgcaggttttgggatgtagccctgtttaggttgaattttctggatgctgagtttgattaaaaaatccactaaaatgtgagtttcctgagagcagggactatactaccaactcctagaaccagtacccagtcactagtaagcatttaataaatactgtatgaatatagaactgcatttttggtattatactgcatccatatgtgttacatattgtgcatagaatttcgtttggtggggagaagagctcactcgccgctaaactcttgaagcttctggtgcacttgagttctaaggtcctctgcactccagctctctgagagcagtgaaatgagctcctttctgtttccatccccgagcatacgggcatctagctggcactggggcctgtcaccagcctagaaagcactccgtggcttggcagggtttggggattgggctggcacatagcacctcttggaaagggcttggcaggtttctcccttgcagcataatctccatgacacaatgaggcaaattttgggtttagtgtttcactggctgccggttgataagctactatttataaagtagaacgagcagggtttctgcccaccttcttttttgctgagactatttaaaattaactattttataaattaaaaataaaacttttaaataaacttattttaattaaaaatttgtaaaataaaaatatcaaaataaaaaaattaaaattaaaaattaagaataaaaatgtaaacatcaaacttactttataaatgaaacgagtttttactgtattttattttatttgtttttttagagacagagtctcactctgttgcccaggctgaagtgcagtgatgcaatctcagctcaatgtaacctcaatcttctgggctcaatccatcctcctacctcagccttccaagtagccgggactacaggcttgtgtcaccatgcctggctaatttttgtattttttgtagagacagtgtctcactatgttacccaggctggtctcaaactcctggactcaagcgatctacccacctcggcctcccaaagtgctgggattacaggcaggagccactgtgcccagccctaaaactaattaaaaaaaaatatttaaaacccaatgggtacttttgttttctcccagtctcctacacttctccgttttgagtttcaaggtttcattttcttatacctttttcttaatagaacttacttaactcaccttttcagccctgttctgccacaggtatttgttgcctcagtgggtgccagtgaatgttcccacagctcttgttttttcctcagtggaaatgaaggtgtaaagacggctttagctttccaacaagttttctcacacacataagttgccagcatgctctcctgtgttcagactgaaggtggtgaaccccacagtctgactgtggagatggctcttgcttttcacccctaactcagtggctcttaactggggagccattgtctggagacatttctgatcatcacgccttgcaggggagagggggagttgtgactggcatctagcgggtagaggcagggaggggcgctgctgaacatcagcatccagtgtacaggtcagcccccgacaagaaagaattttctggcccccagtcaatagtgtcgagtgatagaaacgctgctctgaaggacctgcccctgaggaacgtttgttttctgttgagctgtcagaagggatgttgtttaccctcaacctcaaaccttatagatctcaccaacctgctaaaatgtatcaagtgtgatatgatatttttaattttaaggtagagagagggtcctgtgatggaatgattcaaataatcccactgctgtctgagaacagaggacttgataaacattcttctggtgctgaaagtagccctaacctcctgagaaagagactccaaaaaaggggaacatctttgtcccagactccactgtaaccccaaagctgactgatggctttgtatgcgttcatagcctcttcttgcccatttcagacttggttctggtggctggagatactaagttgacccttgactgtttgtttcatggaaatgttcaacgtggaaaataacaccgctctagtatgttgaaacttgtttgagaaaccacttgccagaaactcatctctcacagtccccacaatactgctgccacagttatgggcatgatgatgaaagccttggcgctttagaggattctctgaactcaaaataaaatttaagaaacccagataaaggaactataagagcatatttctagtctaggcagatatatagcttctgtttaacttcttgaacttttaggtagccgtattaatctgttcttgcattactataaagaaatacctgagactaggtaatttataaagaaaagacctttaaatggctcaccattctgcaagctgtacaggaagcatagcaggttctgcttttggggaggcctcaggaagcttccaatcatggcggaagacaagggaggagcaggtgtcttacatggcaggagcaggagcaagagagagagagagtgggagatatcccacacttcagatgaccagatctcatgagaacacactccctgttgtgagaacagtaccaagtggatggtggtaaaccattcatcagaaatcttcccccatgatgcagtcatctgccaccaggccccatctccaacattagggattacaattcaacatgagctttgggtggggacacaaatcctagccatatcgatagctgtttaatttttttattttatttttaattgcttcaaattctaccaagtattggtttatttacatcagttaaactctataaagttttacaaggcttaaggaattttttttttcttgcggggtaaaaaatgcatacataaaatttaccatcttaactactgttttgagatggagtttcagtctcgttgcccaggctggagtgcaatggcatgatcttggctcactgcaacctctgcctcctgggtttaagcaattctcctgcctcagcctcccaagtagctgggattacaggcacatgccaccacacctggctaatttttgtatttttagtagagacagagtttcaccatgttggtcagtctggtctccaactcatagcctcaagtgatccgcctgccttggcctcccaaagtgctgggattacaggcatgagccactgctcctgacccaactattttcaagtgtatagtacaggaggtgtttttttgttcgttttttttttgtttttttaatgcctcaattatggtgatagttcactctggctgttttcttccaatcacattgaagtaggtttgatttactcattgtctgatgcatttaacaaatatttgagggcttaccacctatgaggtggaacaggaatgttttgttttcttccaaaatagaaacctgtaatgtttttctaattataagatgtatgcttgttgcagagagttcagaaaatacagaagagcatagtcactcataattctacaactctgtttactactgttgatgtactgatatatccttctagtttgttttttgttgttgttagtgctgatctatgtcttgttatatttttacccaaaatgctatcatactctacactattaatattaactattttcagtttatacagtgtggacgtctttccatggccataaatttttctgtataacctatataatcatttcagtgggtgtattatattctacaacatgaaccttctgtaatttaactgatcttaaatctaaatctttttattggacatctaggtttcttctcttaaaccacatgtattagatgtgtaatagatgtcatgtagatagtcatcttatgtatatctttgttttcttgcttagagagtgtagaatcaaggtctcttgtttactgcggtattcccaggaattgacaaagcacatagcaggtgtagagtatagtatatattagtgagtgaatgaatggcctggttatttccatagaattaggaaatagggcttttaatatggggtaggatttggtgaggcagggagcttggtgattgcggtggttgagctgcttggggcaagacactagaagaagccatccatgttcactgaggccagagtttgcatgggagacaggaaggggcacagaaagggaagtgacctcttcagatacttgctgaatgcttactgtacacacaggggcagggaagaaaaattgcttcctttttccagtgtagcctgtctccctcctgtaggaaaccgaggtttgaagccagtttcaggccagtgttacctgtcttgttcatgcgcttatgccagcagtaagtggagaagaatggcaaagagcctaccacatttaaattaagtctagtacttgcgggctctgtgaccttaagctgctgtttaacctctctgagccttggtctcgtctctgtaaaatagggatgattgtaacaggtaataataattgttgtgccttgcagaaagtaagagattaataagtgttaactattgctaactaatattatgatggattcagtaagctttagctttcttttttctttctttgagatgcagtcttgccctgttgcccaggctggagtacagtggcgcgatctctgctcactgcaacctccgcctcctgggttcaagcgattctcctgcctcagcctcctgagtagctgggattacaagcacccaccaccacatccagctaattttttgtatttttagtagagacagggtttcaccatgttgtccaggctggtctcaaactcctgaccttgagtggtctacctgcctcagcctcccgaagtgctgggattacaggtgtgaaccactgtgcctggctgattcagtaagctttcatgggttgccatgtattcttttgtatgggggaaagccactgtaagccccagataaaccacatgtgtatgtgttgagttttctagaatacaaccatttgtgagttaggaactacctgcagttacactgtttgttcagtaaaacactcctttattgagcagaggaatttttgtgctcgttcttctagcttttaagttgcaccatgccattgcatagctatcaataaaggacagtacctggcactgtggtgccaagagggagggtttaccaacaccccccccccaccccaccactgcccttttgtagtgggaagaaaggtctgtctaagctcagtggaagctatttctgagcttgagatgggaagattaagccacacaatgttggttgttgggtccagaatttcaatgaatgttgctctccaaagtagagaagtgttcatttcttctgcagaccacagttgactcaaaggtaaccctaaagcttcaaaagagaaggaagggaaggaggccctcacacggcatgggcagtattatgtattactgaaaggtgtggaactctgtagttaaaagatgcagtgttgtttacttgaataaaaaactttgaacccagttttatgtttttaatggatgtcttctattaccttggtactataacctcccagcatgctcaggaacacctgagttctaacagcttggtcagcttcagtatttgaggaacttccccactgtgccccatcccactgccgtttattaaggaacagtattataatttttgtagctcacagaaaacttgatgtctttccttagctttggtaggtctcctgtatttccagaattaggaaaagggactgaatgaagggtggtgtcacacttccttttacggtttggacttagtttagacacatgaaagccaacttggctgtccagccccgttgaggagcaagtccttcagaatagttggtttccatatggccgaggggttcatactccccaaaactcaagcactgaagctaaaaactgtgacccacatttgggatcattcttgtgacagaactgttctaagcacttatttgcttaggatacttctttcattcctaagtggaatgaaggtaacagaacatatgtgctgcctgggccattgtcgtgaatatgagtgatcacactgccgtgtgtgagctgttaccatgcagaacgtagaccatgcagcaatagagtgatgcttacatgacctgtgtgtaagctaaagaaaaatcaggctttcacatcaacttagtttattcagaagtcttgctgaagcttgcaacctgttagtcttttcagagagtttctgttagactgctccaaggcagagtttcagcccgcagtttatagacaggtgatggcggctcttccagtgctcagaagttacaacagatgtgctcgaagttagattagagcaagatctcatcaaggtttgggcacaggagttcatgtggttatagatgatagaggcatagtcattaatcctgtcagacatgtacagaaagaggcaagggttagggtcattgaacttaacctgattcaggcaagagactcgggaacctgtgctgtgtgctgctgatcatcttcagggcattcttctggagggctgcactcggtcagagtcaggggctttgtggaatcctgctggtaagggattttgtaaaattctgcaggcagcagaaaagcaaacgtggcttcttacatttgccattttgtctcacgtgtgcttgaagagcttaccgctgctccactttttagttctggcttctccttttggttgcttttctctcctccttgctctggggttaactcatcatgcttgcctgttgcagtttgtttttcaacatctaagaagttatggatgctaaggatatccagttacctcttgcagggttgacaggagtgtggtgtgatgccaccatgctctctttccatgcctgtggcagatggtactcagtgatcattgcactttccctgctgagacattcagccttaagaatcctcctcagcacagagtttcaggcagccgctgcccatccgttggatgtgagatgaaacctgttgatctaccacccgtcatctacctgggcttcttcgacttacaagtgatgacaactaagacccagaagggcaggtcacttcgctagagttgagtccaggttctctggttctccccagcagtttgtcctcttggttgctgtggcttaagaacctggtagtcaggcctttggaactgtgaaagtaagacgtgagagagggagacagagacccttttatgattaaggtacatgtgttgtgtgtgtgtgcatgccgattttgtaatatgtttggccttcttgttgccagctggaaattctaggtaatgaaggtattgtgctttttaatttaacagaagtagtacttggaagttactaccagccctagctcatgtttctgtgagcatttcctcacacacctagatcaatccttggaaggaccatctgtgcccaaggctggtgcggaggacagagagggagacatatttattttttgtagaatgtgtgtgtgttgcggggctggtccttcattggagaagaaaaataacagtaagtgggaggcccagcttcaggtaagataagcaagagtcagcttatcctttcattttgattctttgccccggcaaggacaaagcacctcctatttagaaaagcctttgccattcctgcggttggagggaggatgtgccaggctcttcgaaagattttcctttgcagtatgtttgcgggaggggaagcttcttcagaagggaaaagcccaacatacagcaataccacatttgcaaatgcttttatatcactatcgttcaacttagttgcttttattttatttcttttttgagataggatctctgtggcctagaccagagtgcaatggtgcaatctctgctcactgcagcctcgacccgtggtcccagctatttgggaggcaatcctcctgcctcagcctcccaagtagctgggaccaccggcatgcaccaccatgcctggctaatttttgtatgttttgtagagatggggttttgccatgttaccccggctgggctgaaaatcctgagctcaaatgatccgcctacccagtgctgggtgcctcccaaagtgctgggattacaggcatgagccaccacgcgccgtttacttttctcaagtagtcagttttcttcattttttaactgtaagagtaatgcatgcacatggtaaaaacccaaccaggagagcagaacaataagtatcatagatgtcccctgttcttccccacatctaggcctgttcctcgggtagtcagtgttagtggtcttgtatctacacatatgtgtatgtacatagatatgaaatagcagggcgtactgcctgtgttagttggctagggccaccataacaaagtcacactgactgggtggcttacccaacagaaattcagcttctcacttgtgaaggccagaagtccaagagcaaggtgtgtgcagggtcactttcttctgaggcctctctccttggcttgtacatggccaccgtgttgttgtgctgtccctgtgtgtgtgtcctcctcttcttagaagcagtcctgttggattagggaccaccccagtggtcgtatttaacttttaaatacctttttcgttgagacagagtctggctctgtcacccaggctggagtgcagtggcgcgatctcggctcactgcaacctctgccccccgggttcaagcgattctcgtgcctcagactcctcagaagctgggactgcaggcatgtgccaccatgcttggctaatttttgtatttttagtagagacggggtgttgccatgttggccaggttggccaggctggcctcgaactcctggcctcaagcagtctactcgctttgggagttgggattacatgcgtgatccaccgcgcctggtctaaccttaattacctttttaaaggccctatctgcaaatacagtcactttctgaggtactagggtttagtacttcaacatatgaattttgggggacacaatttagcccaacacacctgacgtattaacaaatatttcattgtataggtcgtaattcattttactagtccctgggtagctggaaaataaggctgtttctagtgtttgttatgaacagcctcatacctaaatctctgtgtctttttggaaatgtatctgtgagaggagtttctggaaggattgcaagcattgccctctgaagatgttgttggactcccttttgcgtgtgtgaatgttacttccttggaggaggagagtatgcagtatctacaaattaacacccttagtattctctgtgattcagtgcttgcgtgggaaattgagtatagcatgcaattgtgaacttgttcccatggaggagattgccagccactgtgcgtgaggagtgttgccactgtgacttcaccatacattattcagccaacatccatttactgagtcgtttgggggggcaggcactgttttgttcatttatttatttatatttttaaaaaataggcttaggtttttttttttttttagagcagttttaggttcacagcacaattaagaggaagatacagagagttcccatatacctcccctccccacttgcacggcctcccccattatcagctcctcccaccagactggtacatttgttagaatcgatgaacctaccttgacacatcactaccacctaaagtccatggtttacattagcattccctcttggcgttgtatattctatatttatttgttttttatatgctgtaactttttcagtaaaagctttatgccctcttggagccaggggtaacgaaaccctggcacttctctccaagcttgtgaaagcaccagtagttccagccaggaattgatttttccagttttgaaagtgagtgacatgctcagtgtcttaaccctgtaggtggcaggggctggatgtgaacccattttattcaaaggtatgctcctccagaaacacgtgttcagtcagcagggctgtgagatttccctagatgctaacataaatgtttcttttacggatgctgttttgaatttccacctggtatatatatcaatgtgtagcttaagataatgtgctcgaaccttaattattagcatagtttactttgataaatcacttttgggctagtaagaaaggctagtccattctaatatttggaatgtgtgtgtataggtacacatacatatagacacatatatatgtacatatgtatatttgtaataccatagcactgtatagagtaagagtgaaaatgaaatttggaaaatcagatccatacaatggcatatgactttaatgacagaatagggttaaaccaatagggctttctttttacattttccacaatcatgtcccttctgttgctatttgtctgcctttagatgatcagttccaattaggctcacagtgatgtttgtatctgtttatttttccctctgtggagataatagtaagtttaaatgttgattcagctgtgggaatgttttattgtgggaggcattaactgtttccaaaatacttattttcccaaatagaataagtattttgttgatcacatttgaacttgaaatacagtgagaggttgctgggcaccatggcttacacctgtaatcccagcactttatgggaggccgagacggcggattacaaggtcaggagattgagaccatcctggctaacacagtgaaaccccatttctactaaaaatacaaaaaattagccaggcgtggtggcgggcgcctgtagtcccagctactcgggaggctgaggcaggagaatggtgtgaacccaggaggcggagcttgcagtgagccaagatcgtgccactgcactccagcctgggcgactgagtgagactccgtctaaaaaatatatatatatatatagtgagaagttatctaagaccacagggtaacagagagttagcaaccagccaggcatggtatcatggtgtcctgtgcttgtagtcccagctaaggctgaggcaggagcattacttgagcccaggagtttgaggccagtctgtgtaacacaatgaaactctgtctcttaaaaaaaaaaaaaaaaaaagcaatcagtgaaggaggcagttaggaaagggttcaggaggcaggacccagagaaaagccagctaaagcagtggggaggggacagttgtatgtgtatgtgtttaaaattggggcatgtgagtggaaagaggtcagtaaaatcagagattgagaacatcagtgaaggaattgtaaaggaaagtggcccataaaacacccacacatgcagtaatgttaggataccacttgtgtattctcttatctcagcccgagtagaatgtcttcttttacaaagcagtggcttagttttgtgagtcaagaagaatctggaggaagctggcttggaaaatcggacgtaagatggagagagttggttaggaaaaatttgtagtgatgaaacagtagagaatgacacagggctcaaacaatgacagtctcatgaagtagatgagataactagggaaatgactgtgattccaagatctgtcataccattatggtatgttgtcttacccatatacctgtgatcgtagctcattgtaagtgatgtttatggtgtagcattctaattgatgcttgttttgaagccttgcagagtctcaaacttccttccaaatcattatcaaaagattgaattgttgggctttaggtttatatagagtatagtgttaatacatacagattttattgtaatctgcagtttatggtaatttcttgtagcattgccctgttggcttaacagggactcctttctggtgccagttgtgtctgattaggttatccaagacaccatgtagtacttctgccacccccactttataaacgagaagtcttgaggttttttttttttttttttttgtgcaccaccacacccggctaatattttgttttttgttttgttttgttttgttttgttttgtatttagtagagacgaggtttcaccatgttggccaggatggtcatggtcttgatctcctgacctcacgatccgcctgccttggcctcctaaagtgctgggattacaggtgtgagccaccgtgcctggccaagtcttgagtttttaaaggataaataacttgcttgtagttcacagctagtaggtggcaaagccaggccacaaacccagccaagctttgagcctgagcttttaatcaccatcctctattaccttatggtttattaaagatcccaaagaaaagatgtgtatgctgttagtggtatagcaggagctctgtgctcctctgggcccacgtcctactcattaacccaaaaagcttaccatttgggacatgaaactctggtagaaatgcagtgtaaaaggcacccatttcttttgagcttcaagttacatactctcattatttcctacaagggtgtatggctgcaggcctttcccatcccagcaccctgggtgcttgtacattcatccttaggctcatggattttgacaggttccttttgaaaccgtctagggttgatggtcatgttgtccgaggtgttatccaagtccgttgtctcacgaccaagaaaagtaaggattaatatgaacacaagggtgaagttggagtgaacgaagaaagctctgtgcaatggaaaggaggacctgagtgagtcgctgtttttacagttgagtctgaaagcttttatgagaaactcccctcatctctgtagctgtttgcctaagttcccttatctgtgcagctgtctgtgtaactctccttatcagtgcagacacgggcatgtgttgggtaaacacaaagtgcagctcctcatttgtgtaactgtgttttaggtaagcctcccccagcacctccccactccctgtgcaagttcccacggagcccaccgtgtatgtgcctgagaaggagaggaaacttttccctgggagcctgctaatcacacaaagaacaaaaggcttctatgctgggccctgctttcttatcagtgcagctgcagttttgtttttccccaggcaactcttatttgtatgtgtagctgtgatttttcagtctgtttctctgaggactagccttaactgtctgcctaactgatttttccttttcttctccctcactttcttgggcccaactttttgtttttcatgttcttcccactttgtttactagttcttggcttcttctcttgctcttagctgattgtagaaatctttttgtctgagagtcacgattataatacttcagatgaactgtgccttttctgtgtaataattgggcatctcccaaaccattgatggttgtcattaaagatagcaccagaacaattccgatgaaagctttgttcacacaccgaactgttcctgcatgtcctatggtcaaggtacctgggaagaatgttcatcttgtagcttggaaggtcgacctacagaagacctgggtgaatacgttggtaaagtggtgtgactcagtacaggacaccaactgggcatcccacaatttaattcaattctgacactaactacctagagttcgcacagacctcacaggttaagggctgggttccacaagacttttctcatttcagatgccaattgcaaatctaggccttccatacttctgactgaccagctatgaatcaggggttcccagcatcccctctttaggttcaataatgggctagaatggatcacagaactcaccaaaactctttactggcgattaccagtttattataaaggagacaaatgaacagccagatgaagaggtacacagggcactgtccggaagggtcccgagcgccagagcatcgttcccttggagtttgggtgcaccaccctccaggcacatggatgcgttcaccaaactggaagctctgaatcccattgattagggtttttatggaggcactattatgtacatgcggctgattaaatcatgggctattggtaattagctcagtcttcagtccctgcccaggtgtgtgctcctgaaagttccgaccctctaaaccacatggttggttccactgatagccagccttccatcctgaagctatctagggacccaggaagagttgcctcattagtacaagctctggtatgactgaaaagagcattagtaacgaaatactctcctgttaacctctgtcactcaggaaattccagaagttttagaagcccttgcaccagaccaaatttttgtatatatatatgtagagtaatggcaaaaaccacaattacttttgcaccaacctaatatgattgttttcttttttcctggtcatgtttttcatggagatagcctcccaagtagctgggactacaggtttgtgccaccatgcctggctaattaaagaaaaaattttttgtaagagatggggtcttgctgtgttgcccaggctgatctcaaactcctgggttcaagcaatcttcttaccttgatctcccacagctctgggattaaaggtgtgaatcactgcactgggccttattaaaaatatatatatgtgtgtgtgtgtgtatatgtgcatgtgtgtatgtatatatgtatatataaaatatacattagatatagactgtctcaatatatataaatatatatacacatatatatatatatgtgtatatatatttatttagagacaggttcttgctgtgttgaccaggctaaacttgaactctggtctcaagcgatcctagtctcaagtgatcctccagccccccgagtagcagggactccagatgtgtaccacagtgcctggccatgtttcttattctatcacagtatcatgctctaagcagatgccttctgttccttttctagctggcctgctgctgtgggtctgcaggctgctctctctgctgtgattgctgccccaggattcggcagtccctcagcacccgcttcatgtacgccctctacttcattctggtcgtcgtcctctgctgcatcatgatgtcaacaaccgtggctcacaagatgaaagagcacgtaagtttgtccgtgttcagctcgtcctatttccgatgtttgatgagggtgtgtgggaaaaacatgatttagaagatggggtccatgtacccccatgtgttttggggtatacctggtttccttgaaccttcctgaagcctgctctatgctttccaggatccaatgccttctggctaaacaggaaaaccaatcaacagcttgatctttagtagtagtgtagattctatctgatgcttttggtggagaattcttgttttaatttttaaattttaaaacatttgtgtagattaatggggtacaagtgcaattttgctatgttgatatattaccttgtggtgaagtcagggccttcggtgcatccatcccgggaataacacacgttgtacccaccaggcaacctctcatcatccacccccttcccagccccacagcccctgagtctccattgtctatcattgtccatcattggacacatcatggacacatcattgtccatcacaatcgtctgtttatgtcagacgattgtgtattttatcttagcattgtttatagctgttcctgatgaaatatactatcttttcttgtacccttctgtccttttcccttgtcataggatggctgccaggatttctttcttcttttttttcgagacagagttttgctcttgttacccaggctagagtgcaatggcatgatctcggctcactgcaacctccacctcccaggttcaagcgattcttctgcctcagcctccctagtagctgggattacaggtgccccccaccacggccagctaatttttgtatttttagtagaggcagggtttcaccatgttggccaggctggtcttgaactcctgacctcaagtgatctacccgccttggcctcccaaaagtgctgggattacaggcgtgagccactgtgcctggccgcctgccaggatttcaaatagcagctgaaacacttaatttggcctacataggaagtataataaagctgatattctcacaaataatggagaatgggctatggggcatttcccacctttctggacaggttacttgtagggtgagtggtgtcttcatgggtgaggggtggatttttggccgttctttggtcagcgtatacagaagtaggcctggtgtgtgatgctgatggagatacatgtgggacctctttttcttgaatttccttttttcccccatagtagtcctcctggatcacaggggactgtggtggggattttgagagagcccaagaaataacactttgtctcctaggttctaagcgaattgacaaaaaagactaagatgtcagcaggttgccaaacatcacctttattcctcataaaactgatgtgaggctctgtggttcatatcttcagggaagcaggcttttactgaacccccaaatgactcagactcacccagcagggcaccatcagtgcccgggaagggcagacttctttgcaagggcgcagtttgccaggaagagagagcagcaggcgtgttcccttggggcagctcttatcctagagatagagggagaagaaagccttgctatccaaatgccatttccccttacaaccgaccactccgtactgcatcttcccagctgaacaagtgaggaggtggagggaagtccggagcaggctctgatggagctgcccacagtagggatgacattgcccggggcaacacctgagcaaacgtttgccccaacctgtgctgaaactagggctattttattttttttattgattgatgatttttttgtgggggggtggtggatggagtcttgctctgttgcccaggctggagtgcaatggcgcgatctcagcccactgcagcctccgcctcccaggttcaagcaattctcccacctcagcctcccgagtagttgggattacaggcgcgtgccaccatgcctggctaaattttcgtatctttctttagtagagatagggtttcaccatgttggctgggctggtctggaactcctgacctcaagtgatctgcccgcctcagcctcccaaagtgctgggattacatgcgtgagccaccatgcctggcctgaaactagggctattttaaatacactcaagtatttcaaaacaaccattttcttaacagcactttgtatattcttattcattaaaataggccttctgaagctttctgttgcatagtgcttttataattctggttgtatggtcttggatatggtggatactacagtgaaatttgggttcccctctgactgcttgaaacattggctctttcttcagtaagacactgtagtgctagccgtggggtgttcacacttgcgagaaatggagcttataattcagaagagaagtgatgaagtcttttttttcttttcttttcttttgtttttttgagatggagtcttgctctgtcgcccaggctggagcgcagtggtgcgatctcggctcactgcaagctctgcctcctgggttcacgccattctcctgcctcagcctcccgagtagctgggactacaggcgcctgccaccacgcctggctaattttttttttttttgtattttttagtagagacggggtttcaccatgttagccaggatggtctcgatctcctgacctcgtgatccgcctgcctcagcctcccaaagtgctgggattacaggcgtgagccactgtgcccagccaaagttataaagtcttctaaggcctaaaacaaggcagaaattacgagtctcgctctgttgcccaagctagagtgcagtggcacaatcatggctctctgcagccttgacctcccaggctcaatcgatcctcctgcctcagccttctgagtagttgggactacaggcgtgagccaccatgctggctagtttttctatctgaaagcgtagattttaactcttattctgagcgtccacttaatctcccatgtactacttgtgtttttttaagtaatacagtaaattacttaaatttactctttgtaaattcaacaagcttgaatttctaaatccattaaggtggcttgatgatccactgtggtactgtggtgggaactctgctgtgcactggttgtagtgtgatccctgctcttaataagttgctattctttaatagaattaagccctgcatccaaaaaacaaaatctattactaaacaaatagatagtatcccacagtggtgaatttattgagacgttagagggagagataatttgggagccattggtatgtgttttaggacgtgaatttcataatgataatattcacacctgattaccatccaagtaacctgccccatgaagcagttctagcaattccagtcagtatttatgctttctgactgttaacggatcatttgagaaacagaagatgttccactggtgttgctaggaaaggcttcgtgaaataagtgacttgtatgagtaataataactatttcaatagctaattattgagtgataccatgtgtcaggttttattctgagcactttccctgtattttcttacttcatcagcactgtactcacctgaacagtaggtactagcattacccctgccctacagatggggaaactgaaacatcgagccatttaagtacctcacccaaggtctccagctattaaatggtggggttaggatttgaatctggtctgaatatgttcttagctacgaggctgtgtgactagagaggagggagaggcaggtggagaaggaccaagaggtgaggcgaggtgaaatgaccacatcttgcaggaattgtagtgccaaggtgaagtgtttgaatgtggtctgtggcaagtgggaagccattacagattctagagcaggaggctatatcatggaaacagagggagatattttgggaggtgagcctagaggtagtggtggcagtgggcacagggtgacttacagtcagagaacagagagagggaggaagagagggaaggcaaccctgatgtccctcacagaggctcttgtaaatgtttctatgcctgtcccctgaatgtacctatttacaaatggtttggctgggtgtcctgcgtagggaatgagatccctgtgggtgaaaccaatccttttccagctttagggcctcacaagggagctgccatctggccacaaagtcagcttgtttcgtggcctacagaagagaggctgacctcatcctcagggggtgcttgcgggcgggtgttgaaaggtccccttgtagggacgcacactgggctcctgctggagtccttaccccctctttgttggccgtggaagtgcctgagactgtgactggaagaggagaaagaactgcatgcttgtaacggcccggatgggagtgtgtaagtgcctcctacccagcgttctgccagagtcgcgtgggtctttggtatgtgggttaggagcgcaagggcagctcccttgtcagttatttccagtttttgccttggttgcagaatgtggcctgtgtttaagtttgagtaagaggggactgcaagggatgctgggccagactttgtcctgcttcttttctttagggaaactcctctttcccaggagaactttggctcagagaaagcttgactgtgctggttgaataaggcatgattctgtcttctcttggagcatttccccatctcaaaacataagggctatttattttgcaggtcattcttgttattaactgtataatttaagcaggtacacactcatgagatttgatacctgggggattaaaaatccattttagaggccgggtgtggtggctcatgcctgtaatgtcagcactttgggaggctgaggcgggcggatcacaaggtcaagagatccagaccatcctaaccaacatggtgaaaccccatctctactaaaaatacaaaaattagctgggtgtggtggtgtgcacctgtagtcccagctactcaggaggttgaggcaggagaatcgcttgaatccaggaggtggaggctgcagtgagccgagatcccggcactgcactccagcctggcgacagagtgacactctgtctcaaaaagaaagtccattttagaatgtagaatgcaaagggaacaaaagtgggcaagaaagtaaagcctcccaacccaaacgctaagtcaaggtgtaacgtctgtgtttgaggaagattcagatttaggcaccctgggaagccacatgggtgtttggggagggaggagaaaggaaagtctttatttcctagggagtaggggccactaaaacctgtactgaagaaggaaggatgggtgacctgtgcagcccccactttctcccctgagagctcaatgtgccaggccaatgtaggaagagccatagatattcccagcctgaaacatgttagatctgtttccttcattccacattacactctccactccctccccatcttcccctcaagctccccagccctaggcagccactaatctattttgtctctgtggatttgcctattctagacatttcgtataaatggaatcatacaatatatagccctctgtgtctggtccgttctctctctctctctctctctctctctctctctctctctctctctctctctctctcacagatggagtcttgctctgtctctctggctgaaacgcagtggcacgatcttctgcttcagcctcccgagtagctgggattacaggtgcctgccaccatgcccggctaatttttataattttagtagagacagggtttcaccatgttggccaggctggtctcgaactcctgacctcaggtgatttgcctgcctaggcctcccaaagtgctgggattacaggcgtgagccaccgcacctggcccacttagcatgtttttaaggttcacactcaggttgtagcatatgtacttcattcctttaagtggctagataatattctgttgtatgaatataacattttattttacttttatttatttatttcttttgagatggagtttcactctgttacccaggctagagtgcagtggtgtgatctcggctcacagcaacccccgcctcccaggttcaagcgattctccttcctcggcctcctgagtagctgggattacaggcgcgcactaccaggcccggttaattttttatatttttggtagagacagggtttcaccatgttggctagactggcctcgaattcctgacctcaagtgatctgcccgccttggcctccaaaagtgttgcgactgtaaatatacctgtaacatattttatgtatccatttgtcagttgatggacatttggattgtttgtaccttttggctattataaattatgctcctgtgaacattcgtgtactgatttttgtatggacatatgttttcatttctcttgggtttatatctagaagcagaattgctggattgtgtagtaattttaagctcttgaggaaccgccatattattttccaaagttgctacatcattttccattcccaccagtaatgtgggatattcaggatgaagtcatgtattaaggttcacatttctccacaccctcaccaacacttaatggtacatcttttttttattttagtcgctatagtgtgtgtgaggtggtcatctcctctttgcctgtgcctctaacactgccctctgcccttcccgttcgcttgctttcccctggggcagcttgttcatttctggctttgatcatccccatatgtgcatctgcttgtaaaaacacccttcactcaggacagtgctgaggacactggtagattctttcttcctgcatccccgtttttctagatcttgtgcatacttttccccagacaggtcataaaagtctcaggcttccactctgcattccagtcagtcacggtgatttggccatgccaccctccctggtgttgcatattacacttaccttgtttgaacttgagtagttcccagatgttcccagctgccctcagacttctttctccagataacttagcccgttagttaggctgagctgaaggtgctgtttgctacatttctcccagatgataccctatttctaaattctggggtcaccacagtgtagtgactgtaggtgaatacagtggctactttacttaaaaacaacttggatttccaaaggctattcataagcacatcttttagtctgtttacagtgacatgttaaaatacttctgtggttcttggagttgacagagttctttgatccgttatgtttgaaactctgaaactggggagatgagctactttatttcctatttttaaactgaagaattaaaataaatatgaagccataatattaaatattccttgtgggaagcccttcttgtactggttccagggatccaaaaatgcctgaaacaaggccccttaaaggagcgagttaaagagatgagtggaaaaaggctgcagctcgtatgtatagcaagtgttctgccttgagaagagacagcaaatacgtgtggtgttaagtgttctacagagaaaacaatgatctttttaggatataatttatttttaaaatttgtataaatttatgggggtacaagtgtaattttgttacattgatatattgcttaggatataatttgaatacattgttagaattttttttttttttttgcgacagagtttcactcttgttgcccaggctggagtgcaatggcatgatcttggctcaccacaacctctgcctcccaggttcaagggattctcctgcctcagcctcccgagtagctgggattacaggcatgcaccatcacactcggctaattttgtatttttagtagagaaagggtttctcaatgttggtcaggctggtctcgaactcctgacctcaggtgatccacctgcctccgcctcccaaagtgctgggattacaggtgtgagccaccacacctggcccattgttaagaatttttaaaagcagaaaagtcctaagtggtcatcttaacaaacctgtcgtttgacaggtgaggagctgtggcccaggaagtgaagtggcttgtcagaactgagacaccaggtatatctgggattagaacccagggctgctggtcgcctggccagtgcatctcctgtttgtgcaactaggtttgcttgttggtcagatattcacagaagtcacagttaaatgccttttatcaagcatatccttcctccgctttctagactttcttctgggcccagtggtaagaagtattacttttggaaatagcgctgcctggggccctcagcagcgatcttagcttagttacatttcccatctgcctgcttcctgttgtgatgaccaaaagctgagctcaagggatgactgttattctgaagtagaaaacagaggtagccacaaaactagtatttatttattcagtggctttacatgtaaaatagaacttgttttcaggttgtgtttggtataaccatctttttaaaacaaacatcatcagtgaaaaatattccgctttgatccaaaatactgtgcagtttgtcccaatgtaaaatgacaggtcttcatgctgaagctggagagtctggctcttgattttcctttgatatttactggttgaatgttcagagcacactgtacctgagacctgcatcaggggctggcataggcacattgaagcctcaagtagaactctctccattctccgcttatatgcttttgtgtcagaacaagtgtcaaattaacaataacaagaaaatattgctgacccagttctttgattctggaatgcttttttaaaatccagctgagatggagtgcttttcaaaagttctctttctgcgtagcaactgagttcatggtactgttgtaccttatgtgtcaagttatcaaggaggaagtttttgagattaaaagtgggttgggaccatcgaacctcaagcccattgtagaactgagggaaaattctcaccatgaccttttagaattttcctctggggagctggctttgaggttttgcctcttaaatcctctgagttccctcccctccaagttaggatgactctggagacatatgtttccaaacggttttatcttttggtctaaatttcatccggagataacatgtgagagaaagcaaggagtccctgtaccctcctatgcctcagctgtcattgctgggccttatccttccccatacaagtggatgtcgggaagtagtggtgggaaatcgttttgtactggaggcagcaatttgaactaatggatattctgctgagagtctttttttgagcctgaaccaaggacaaagaggtttgatcctggtccagtaataatgagcttgccaggaggcaggaaattggaaacaatacatactgtccttggtctgtgaggatccattacctgcacgtttgcgggagcaccaggtgtcagctggatctcttttaggattggtctggctatggacgagagagaatgataagatgtgagaatgaaagttttcctaacacgtttttttctgtagtcatctaaagcgtctgttaagcaactgtccacagacagggcctcggagtagcctgcagataaatagaacagacaaaagctttggaaatgagcattgtcagccatcataaacatggggctggagagaacagagaaatggcacaacgaagaatggaagaaaaagtagcctcagagcgatgggaacaggaaacaatgcatagatattgtgaatggctgaatcttgatacttactctgcatagaaatttaataggatgattctgtgacttgattaaactgtaatccgagctcattcttcaaaagtttaaaaaattgcctagctgtcattctttcagatgcaagtggcgagcactctgaaaggtgctggggatttcagagacactgagtaacacacagttattgtccccatagagctggccctcaggtaggggaaaagagagcagtttggcaagtgtgtctggaaggagcctgtgatgctagactgtgtatgtctgaaagctaaaaatatgtgaactccattagtgaatattggacagtggtgttggctcagatgtgactcggctgaccttcggagtcacgtggtaactcaggaatgctctctccccattctagagacagagctgaggtgcctgggaggtttataaaatggaatgaagtgtttttgcctcctcatcagggctgagcataatcataaggggttgggtattctggtggtgtggttttaaaatttcagcgagacagtctctgcagtcttcaaatagatctaaaattatctttcgacatgctggctttcatcagtgtggggtttatttttggttccatggggtgtgtttgtgtgacagatgtgaggacgttttctgttcgagctattgatggcttctgagccgcagagatgagcgctggaagctcatagacacattctctctccattccttcccaccccatctgaaaaactttctgtgggtggataaattaaggtactttattttctgctaaaaaaaaaaaaatgacatatgggagatacacagtttgattcacttaaggcccaagttccatttgaggacagccctgaggaagggaagagtctcatgggagaaggcaggagcggagggttgggacagctggaccgcagcccaaaggagctgctcttttggctcttgatttgtagagtaagttatcaccagttgtcacttgcttttgaaatgtgcatttgtacttaggcagttaacagttagccacaactcctcatctattcttcctagtagcgcaggggtggggcagacttttcttacaaagagccagctagtacacactggaggccctgtggtctctgtagcagctctcgcctttgtagtgcaaaagcagccaaaacaatatgccagccaatggcatggccagccaaccagtgtggctatgttccaataaaactaggaggctagctggatttgacccactggctgtcgttggctgactcctgtgttagaccctccatggtcttatatgcgttatgtgcagttattctcccatctctctcaaaagggaaacgtcagtgacctgaacattgtgctcagagtaccagagttcttgcttaagttgcaggtaactgactaggctgtatgaaccacatagtgggtagactaggtaagaataatgtggcaataaattagtatgacatgtttaatagtaattatgtctatatggcattttggaataaatggcaaattgtttacaagttaaaaaaaaaaaagtctttttttttttctttctttttttttttttagagacagggccttgccctgttgcccaggctggaatgtggtggcacgatcatggctcactgcaggcttaacctctggggctcaagtgattccctgcttcagcctgctgagtaaccgggaccatagatgtgcaccacgatgcctggctaatttttcttttttttttttcttttttttttttttttgtagagatggagtctccctatgttgcccaggctggtctcaaactcctaggctcaaagcaacgatcctcctgcctcagccttccaaagtgctgggattataggtgtaagccactgtgcccagccagtcatctttttatatattctgtcaaaggacgaaattacaaatttagttggaaagttgaatggattttatttgtgattctagaatgtgaagtagaacgactgttccagttagctgagcagaggagggtgtctttataggcagaaaaggcttgaaaaaaagcagaaacagaacaaaaggttaaaacagaggatttccttattaggcagactcacattgactagaatctttcagtggtttttttttttggtttttgtttttaaagaaaactggcccccaaattcagtggcacttagtacaagtggcttcattttggttcggtctggtctgctggggcctagtgcaggagtcaaaaacaatggcctctcctaaactttaacaatccaaaccaagcatttggtgatccaggaagaagtggggttggagaaaatgagggtctgggcaccctagttccccagctgctgggcaccatcattcaattccaggtctgatataagaaagatgctggggccggaaacttaaatgtctgccatgtactggttcccatcactagaactggggaacaggtaatggggctctcaaatcttgaggttataggtttggtgtagagtcctatcttttggggaacattaggtcctaatgtcctgcctaaggcaaacatcatgactagtccgaattaaccatgaaaatacttcaaatatccatcaagtagagcatagttttgtgcatacagcatttcactagtagaacgttagctctttttagcatgaacttttaaactgttttattcacagctcgtatccccctagtttagagcaatacctgcacatagtagttgggaatgagtgcgtggatgctcaaactctaggctgtaatacatgtgtatgtcatgtaacatatagtacggaatgaagattatacatgcaaactctaaattcactggatttttacaaattatatgctcatgtctgtaatcccagcactttggcagaccaagatgggaggatcacttgagccaagagttcgagaccagcctgggcaacatgacgaaaccccgtctctacaaaaaatacaaaaattagtcaggtgtcatggtgtgcacctgtagtcctagctgctccaggaggctgagatgggaggattgcttgagccagggaggtggaggttgcagtgagccgagattgtgccattgcactctagcctgggtgactgagtgagaccctgtctcaaaaaaaaaaaaaaaaaaaaaaagtacgggagacagttatgtaaatagttgaacttgcaaataatgtattaccactgcgttcaggtccacacatttaagaagaaagcaagctaattttggctgagtgaggtggctcccacctataatcccagcagtgtggggatgctgcagtgggaggatcttgtgaggccaggaatttgagaccagcctgtgcaacatagttaaaaccctgtctctacaaaaagtaaaaaagtagcggatgtgttggcatgcacctctagtcccagcttctgggaaggctgaagtgggaggatggcttgcgtctaggagtttgaggctgcagtgagctatgattgtgccactgcactccagcctgagggacagagcaagaccccttctctattaaaagaaaagaaaaaaaaagaaactagcagatttgaggctcacttagactataagcatgtgttttctctaaatggttagaatagaaagacctgcatgtttcagcatttagtcctctctttatagaaatttcacatttctatgttcaagagatatctttccatcagccgtgttcacctcagggcagcacagtgtcttctgttagaccctgtattctgtgtggggccatagccgtattttctagccgaaacgaaagttcagacctccgtagctgtggttttaagttgtcttgagttagaaatagatttgtgtctttggctcagagggtcctattcactctcttcccggctttggttgtaggggcattgcttacaaaggccctcaggaatctggaagattgacatgttgaccttgccggggcagcacaggagtacctggctgagagatggtgtgtccccagctctgcctctcttgccggcacctccactcctcctctcttctgctctattacccctaattccagagtttccaaaacccttcttatggagagtttggcagtatccgttcaaattttaaatgtactaactttatgacttctgtcataaagctgactttagcttctgtccttctcaacactttacatgtgaacagagagatacacataataaggatgatatccattgtacattatttataatagtgagaaaaaatcagaaaaaaactaaatgcctatcagcaggataacaaactaaattagagtcaatcagattgtagaattctaaatttttatctatttttctgagacagggttttgctgtgttggctaggctgcagtgcagtggcgcgatcatggctcactgcagcctcaaccttctgggctgaagtgatcctcccacctcagtctcctaaactcttgggctcaagagatgctcctaccccagcctcctgagtaactgggactacaggcgtgcaccactatgcctggccaatttttttactttttgtagagacggggtctctcactgtgctgcccaggctggtcttgaactccggggctcaagtgatcctcctgccttggcctctcaaagtgctcagattacaggtgtgggccactgggcccagcctagaattctatgtagtatgtaagaagatgcaaatagatttatctgttaaacatacagcaacctccaagacataatgaatgtagaataatggcacagcaaagggtctagaaagatccactcacacctggggacagtggcacctctagggaagcaatcaagttagaattgaggcattgatgggcaaggacactgggttatttgtatttttattgtaatttacacattttggcagtaaaatatataattgttttgcttatataagtgcaaataaaattgagaataatcctttgcagttagatttttttttttttttttttttttgagacggagtcttgctctgtcgcccaggctagagtgcagtggtgggatctcagcgcactgcaaaccccgcctcccgggttcaagcgattctcctgtctcagcctcccgagtagctgggattacaggtgcccgccatgcacctggctaatttttgtattttttagcagagacggggtttcaccatcttggccaggctggtctcgaactcctgacctcatgatccacctgcctcggcctcccaaagtgctaggattatgggcgtgagccaccgcacccagccttctgccttcagttttacctaattctctcaatggagattgaaatgagttgaatcctgttctgcatctgtggaggagcccttcttcccatagtaattaattagtcagtcttctgggagttgtctcctttggagcttattgtataacggtttgcttagagttgctttctggctgcttaatcctatctgtgactgtttgattctgacaaaatattcatggtggaggaggagctgtgaactcgcattctcagtctttgcatgctttttgagattaattttcattcatcttttggcttttaataatgatacaatgtagatttttctattaaaaatgctcagataacccaaagaaaagagaagccagtactggttgttgttattgtttattaaatagccccagatcccccaaagggcctcaaaggcaatcacttactgagaaatgagctttggttgccaagaggctgtgtaaggaaagagggaagctgattttagtgtttcccatttcatggctgttgtccactgaccaataacaggaagtcatcagtgtggtggaccctggaagtacttcatggagaaaaacaaactatcctggaaagtttgaagatgagtggaatatcagaaaagggaaaggcagactgggagacattctaggttctgaaatgcattttcaagtgagggatattaaacagaacttgcaaatctagttcttctagtttttgtgaacctaatttatccctcatgtggagctgcccaaagctttctttgaaatttgatattaatataatgaaatgtaagaataattagctttgctaatattgcattttcttttttcttttttttgagatggagttttgctttgtcacccaagctggagtgcagtggcgtgatctcagctcactgcaacctcttcttcctgggttcaagctattctcctgcctcagcctcctgagtacttgggactacagacgtgtgccaccacgcctggctaatttttgtatttttaggtatttttggtagagatggagtttcaccatgttagccaggctggtctcgaactcctgacctcaggcagtccgcccgccttggcctccccaaatgctgggattacatacgtgagccaccgcgcctggcctaatattgcattttctaatctcaagtaacacgattacacaactacaactttcacctacttcctctccatttcttaagaagccactcccaaaacttatacatgttttctatgtttgtagcatctgggcccctggccaattagacctgtaggtcttcctgtagcttttttgttgtttatttgcctgggattgaagttgttttagggacatagctagcatctctcctgtgtaaacaaaattacgtgaattttcttctcccttgcatcttgttgagtttattacttgttttcatgttttggaaatgtttttcctaatttgtgagttcagaatgctttcttctggatggtggctaggtctctgaaggacaagtagtgagtgctattttttggacctcagttctaatataaatgtaccaaggaaagattcaccttactgacaggtcgggcgcggtggctcacgcctgtaatcccaacactttagggggccgaggcgggtggatcacctgaggtcaggagttcgagaccagcctggccaacatagtgaaaccccatatctactaaaaatacaaaaagttagccaggcatggtggcaggcacctgtaatcccagctactcgggaggctgaggcaggagaatcacttgaacctgggaggcagaggttgcagtgagctgaaatcgcaccactgtactccagcctgggcgacaagagtgaaactctgtctttttttttttttttttttttttttttttcaaaacaagaaagttaatctttcaatccaaaggtagtagatcctttggtaaagtgaatagagcatctactaattctaagatgttcagtttcccaccatgtttaaatcggaatgcattagtttgtggatcatgtaatgtacctgagtctcttccccgaaattatttttatataatgtcaggcctctgagcccaagccaagctatcgcatcccctgtgacttgcaggtatatgcccagatggcctgaagtaactgaagaatcacaaaagaagtgaatgtgccctgccccgccttaactgatgacattccaccacaaaagaagtgtaaatggccggtccttgccttaagtgatgacattaccttgtgaaagtccttttcctgactcatccggggtcaaaaagctcccccactgagcaccttgcgactcccattcctgcccaccagagaacgaaccccctttgactgtaattttcctttacctgcccaaatcttataaaacggccccacccttatctccctttgctgactctcttttcggactcagcccgcctgcacccaggtgattaaaagcttttattgctcacacaagcctgtttggtggtcccttcacacggacgcgcatgaaatataacataatagtgctttagaattaaagaagttaacttaatgactactatgggttaggaaccgtggtaagcacttcacaggtgttatctgatgtaattctcaggcaactccatgaaatgggtgtcggtattgtttcattttacagatggcacaactgaggctcagggtgtgtatgtgtgtagctagctcaagttagcagtggagttaggaatggaagtcttatgagctgtttattcttacttgatagtttgtggctttgagtttggttgctttgagggttggagggaaacgccttgttctcaggggtctgtatagaaacaacatacagcctgcatgcggtggctcacgcatgtaatccctgcactttgggaggccgaggcaggcagatcacctgaggttaggagtttgaaaccagcctggccaacatgacaaaaccccatctactaaaaatacaaaaattagctgggcatagtggtgtatgcctgtaatcccagctacttgggaggctgagacaggagaatcgcttgaacctgggaggcagaggttgcagtgaaccgagattgcgccactgcactccagcctgggcaacagagcaagactgcatcaaaaaaaagaaacaacatacagtgtgtgagcctggcttaagtgccctgtccttgggtgcccagagccagacttaagaggtaacacccttagcaggcacattcctttcaccctgtggtgtggaatttgtatgtgatgtattttttctttttccaaaaatggggtggactttggaacagcaaatatttaatcggagcaaattccccttgccagaatcctgctagcttgttcaccttggaggttctttgcccaaaaatacttaccacatactgaaaactaaatgtgctaagtcacccacagagtataaaggaggtcttgattaggatttggagcaggggggttgtttacctgtttttgatgaatatacagtgtcaatgtactcaccctgtgatgagccttaaagggccctggccgcattccagattctggagtaagcaaacaagggaggggatttgttggggatggtggctcagcctgctgctgttagcattctccttgaaatggattttggaggaagaaaaaagaggtagggaggcagagaaggtctaaaggtgaaagatgggctggtatagatgaaagaggtgctaatgtgcatgtgttatggggaagatgtggttcaggaattagagttgctgatggagtagaagagagaaggtggggaagaaaataatttagggaatgttttagagcaataaatcctgtgtaaatgaaacagcctaatgaatgaagtggtatggcttctccatgaatgtagcttttagagattcaaagcaatattacctcctcgttactggcactactcatacaggtgtaacttttgttttgggttagactctctgaaacattcatttttgtgtgtgtcccctaccatatttcagcacctgaaaattttaaccatgctgtttcatcactcatgtttaaacacagctaaaaattgaggttcctccagaaagcacctgtgtgactgacttctcattacccgcctgcgggtgcttcctttcatgcgcgtcggtgtgaagagaccaccaaacaggctttgtgtgagcaacatggctgtttatttcacctgggtgcaggcgggctgagtccgaaaagagagtcagcgaagggagataggggtggggccgttttataggatttaggaaggtaatggaaaattacagtcaaagggggttgttctctggtgggcaggggcgggggtcacaaggtgctcagtgggggagcttctgagccaggagaaggaaattcacagggttaatcactcagttaaggtggggcaggaacaaatcacaatggtggaatgtcatcagttaaggcagagcagggccttttcacttcttttgtgattcttcagttacttcaggccatctgggcgtatacgtgcaagtcacaggggatacgtgcaagtcacaggggatgagatggcttggcttaggctcagaggcctgacacttcctgtatccagccccaattgctgttctaaagcaatttccagaccagactgttctcgctgggataccccttggtgatgccctaaggtgttaaagagcaaactcctgctttgttcttcacttctgctgtctgtcctctgccctccaccctccctccaccccaaacggcaatgccataaaaaaagaagaaaacaaaacagctttgtctcattcttgtgcttcattcttgtcatctgtgctctcctgccaattgtgagctctacctgcagaatctctggtttctctgcctggggttaccttcttcacctgttcccagtggccttcaaacttgtccccttgcctcaagtctgtaccctttcaccacgtcttccactttgtagccaaaggtgttctagcttcagtagtgcttttccccttgcttacaggatgggggcctgactgctaagtctggcatgcacctggcccttcccagcaagaccttgcctttgtagagaagggaaaaatggcttccttccactcttctaggttctttctctggaagcaaattaaattgacataagaccaattacaggagaaaaagcaattttaaaaagggtcagataggctgggcatggtggttcacgcctgtaatcccagaactttgggaggctgaagtgggcggatcatttgaggccaggagttcaagaccagcctggccaacatggtgaaaccccatctctactaaaaatacaaaaattagccaggcgtggtggcaggcgcctgtaatcccagctactctggaggctgaggcaggagaatcacttgaacctgggaggcagaggttgcagtgaggcgagattgcgccactgcactccagcctgggcaacagaggtctcaattaaaaaaaagcggagggggggggggcggtcagatgatagaagcttatggcatgttgagctacagagaggaataggggcttggggcctctgggagttgctggcaacacgtaatgggagagtgaggggaagaaatgtatggtgaataaacgtctgatacactttactaatgtagatttcctctacagatgtaaattttttgtataaaacagcagctttgcagagctactcctgtgtcttcagcttctcagaataacgagcttgaaatacgcaaagaagaatgttttagggtggcatatcttggtttttgtgagtgacgccaaggtcagaggtaaccaggtccacgaacatttgtgtctttccataatgttggacttaactgatgctatttcagttacaaaagccaccagctatgtggagttcccagggagccaattcttcttagtacttctcatccactcattagatctgcaggcacacaggttccagcctctgcaccagccagtcagtattgcaaaccgtacacaatcgtatactctgtcaatatataaatgttactgattaaacattgtgcaacaaacaaaataacatttaacattaagagaaagggaataggaaaagggttaatgaagtagtccagggagagcaataaagaaaaaaagaatttcctggtctgggctggttaatctggttggttgtgcaagaaacagtctttgatgtgggcagagccttcggggcagatgccaggtgcttgtcacgagttagaaccgtacctaccctttttatggccacagagtcctccagtgaggactgatagttgaagactgtgcttgtttatctacttatctggttggatgcagtctttatcaagcaaaacatcttgtctctgttgtgacaaaatggtgtaaaaaaaaagtcataaaaaatgtacagttttaggaatttgctgaaaacaaaatgttggctatttcctcatgaagtctttcacatgtcttcatgaaaatggagctggccaggtacagtggctgacacctgtaatcccagcactttgggaggctgaggcaggtggattgcttgagtctaggagttcgagaccagtttggtcaacatggtgaaacaccaactgtacacacacacacacacacacacacacacaaaattagctgagcttggtggtgcatgcctgtagtcctagctactcaggaagctgaggtaggaggatggcttgagccctggaggcgacggttgcagtgagccaagattgcgccactgcactccagcctgggtacagagtgagaccctgtctcaaaaaggagtggggagaaaatggaactctttgtttgtttgtgtaaaggaaaataaaccctctcaggactgcccaaactctttatgccaaatggaaacttaagactggagagacagtcacgtgacactgctgctgtcccctcgcaccttgcccccctgcccagtagatagctgcgacttcccaaccttgtgtcaaagcgctatgcattagccacacccctggagaaggcagaaggcctcgtgcatcccggatgactgccctcaaattgctcataagtaaattctctgctggtccctaaacctttcaagatgtgtatcttcccataaaaaaggacatgtcagctgtaactttaggtctgcaatctaagtctagctccctgtccacggaattgcagtctgttacatttcacactgacaatgcccattacaagcttatcttcccaggtgcagaacaaagacaggacagcagtcatttctctgcctaccctgagactacataattaactcttcctttactccctttttgaatgtttatcatatctcttttatagcggagtttactgggcactagttaaaatctcaggagaatgttgcatttgcctcaccacctgcccccttttcctgcatgccttctcccctttaaagaaatgggtaaataccgagcaacctctttgggagcgccagccacagaggattctgtgatttgtgtgtttctcagcagcccctcaagctctggcttaattattccccattgagactcttgcctcagtctctcatttgggttgacatttgtttatggaaatcgtgatagccacagatattattgtttcttcagtatctttttctggagaagaaactgtaaattatcttctttatcacactttccttttaccttcagttttgtgctattttttctctgtgatactttatttttcttatgaataatagttataatgtgatttattttctgttcagaagagtgttcaactttgatgttgataagaagcaagtttttatgactgaccaaatccttattttatgacattactaggaatgtgctgcttgttctcattgtgtaagattttaattattctgataatgaaactgattatttcatgtggaagtcttctaatttggctagaataagctattgtcaacatttatcagaagattaagacccactaataaagagctccagtggatcaagaaaatacccaattaacagccaattcagagaaaaaaaacagatggccataaacttgagaaaagatgctgaatctcactagtaataaggaagatgtaccttaaaacaggatattgggtttttgcctttaaattagatgtccaagttgggaaatgtgcaatctcagatattactggtaggatgtaaattggtacagcctttgaaagtatgatttaactcatcttgaagtttaaaaatgtagatactggttgaatattcctaatccaaacatctgaaatgtgaaatactctaaaatttgaaacttttaaagtgccaacatgatactcaaaggcaatgctcactgaagcattctggatttttttggattagggaaccttagccagtaatatagtgtaaatattccaaattctgaaagacttctggtcccaagcattttggataagggacattcaacctgactacttgacctactaattccatttctagctcaggtgtctgtcctacataaataatggcacaggtgcagtgaggcatgaacagcagtatttattgaattagtgtttgtgataataaaaaacaagtacaaaaaataaaatttaaaaaccctccccaacaaaaaattaagatcagtgtgagaatggttattgattttgatcaagcctttttacagtataagatagtgatgaaaaagaatgtgatgggattttgcgtattaatagagaaagactcttcatggcttattgtttatttttgttttctttttttgggacagagtctcactctgttgcccaggctagagtgcagtgtcacgatctcggctcgctgcaacctctgcctcccaggttcaagcagttctcctgcctcagcctccctagtagctgggattacaggcacgagccaccacaccgggctcattattgtatttttagtagagacagggtttcacatgttggccaggctggtctcaaactcccgacctcaggtgatccacccacctcggcctcccaaagtgctgggattacaggcatgagccaccgtgtctggcccagcttattgttaattgggaaaaaatattgcagaacattacatacaatcttttattttaaaaagctgttttaatatatttattatatgcatagtatgatatgagtgtatgtatgtgtgttgtgtatgtatatgtatatgtgagtgtgttgtatatatgtatacacacacatttatgtatgtgaattaatacaaatactctacccaccaattgtttactcttctgagggagaggagtgacattttgggtggatagtaaaagaagtctctgattttttatttgtatatatgtatacatatcaacaaaaatatatccatgtattgaaatgggattttaggccaggtgcagtggttcatacctatgatgatcccagcactttgggatgcgaagacaggtggattgcttgagctcaggagttcaagaccagtctgggcaacatgacaaaaccccatctctacaaaaaaaaaaaaaaaaaaaaaaatacaaaaattagctgggcatggtggtgcgtgcctgtagtcccagctaattgggaggctgaggcaggaagattacctgagcctggaagatcgaggctgcagtgagttgtgattgtgccactaaactctaggccgggcaacagagccagagagaccttgtcttggggtcgggggtggggtgggggtgggggtgggggcggttaaaaaaaaggtaatttttgtaaaatctgatgttggatttcagaagtcatttggggcaagtaaaggctgagtgttactttatgatcactgtatctttaaaaaagattcagagaaaattagaaaaatatctctttagaagatagatcctcagtctgtttctttatgcacacgatccatttccacagtggatgttgtggttggctgcatgaacactccgtgacagtccacctctcactcagttgtaacagatgacttttctaaactttctcctcagattcctttttttgaagatatgtgtaaaggcattaaagctggtgacacctgtgagaagctggtgggatattctgccgtgtatagagtctgttttggaatggcttgtttcttctttatcttctgtctactgaccttgaaaatcaacaacagcaaaagttgtagagctcatattcacaatgggtaagtattttagtcttcttggggattgctttctcctttcttatgttcaggacagtagtccaggatcccatctgcccaccagacactgtgactgcccttcttctagttgaaattgttgatttaggggaaggtggaattgatacttacccacatggttgcctcaaaggtagaatcttatttgtaacacctggtaccatgatgcgaaatttactcaagacaaagagtttatttcttgttccaagaccttcccccaggtcatttccacccctgcaatgaaatggtgttttgcacaactggaggctgcactgagtctgcctaattatgggaaaaagcattcttcaagtcacctagttacttccccttgattaggagagaacattggccaatggcagaatcatggattgacatgctgtaccttctacgaggtcctttgtccttcttgaatgtcatttaaatacatttcctcttttttttccccccacttctagcttttggttctttaaacttctgctgttgggggccatgtgctcaggagctttcttcattccagatcaggacacctttctgaacggtactaatggggtattttgggtatctgtttattttgtttttacccattttgtcaaattgctcagaagcgcagtccaagtacctctgatagttagaattactgattttcttttggcttcaaaagaaattcctgacttacctgcccatactttttccatcattgcctatctacctcccctcttctcaccaccgcatcccacttccaggtagggtgtaagaggactctgatactctgctggcctgggagaccttgttctttccaagcactgcacagaaaacccagcaacagggagcgcagggctgtcagcagctaaatgtctgctgcagcgatagtgggacaggaaaagcatctttcagtctgttattaaacttaccgtatgtgaagctctgtagcattgaattatattctttattgttagaacctgctttaattcattaatatgaagcctttaatcatagctgaaacagggcgccctttttcatatgagctgagggaaaaacctgaatttcagtggttcagagcattttgttcaacccaaatggattcactttcctaagtaaggtattaaaaacatttaggccaggcgtggtagctcacacctgtaatcctagcactttgggaggctgaggtgggtggatcacttgaggccaggagttcgtctgagaccagcctggccaacatggcgaaacctcatctctactaaaaaatataaaaattagccaggcatggtggtgtgtgcctgtaatcccagctactcaggaggctgagacatgagaattgcttgaacctgggaggcagaggttgcagtgagccgagattgcaccactgtactccagcctgggcgacagagtgagactttgtctcaaaaacaaaactaaactaaacatttagattgtgtcagtttataaggaacagccataatccttcatatagttatgtatcagggcctagctagttgtttaaggtcatacttgtttttcatgtactccctaagtcttgctgttacctaaaatactgttaaaagttttaaaattctctacagagatccttttatgtattagaatgtatatttggagggagaagagacctagaaaccctctggtccagctcagtcttttttttgtttttcgagacagagtcagagtctcgctctgttgcccaggttagagtgcagtggcacgatctcgcctcactgcagcctctgcctcacgggttcaagcaattcttctgcctcagcctcccgagtagctgggactataggcacgcaccaccacgcctggctaatttttgtatttttagtagagacggggtttcaccatattggccagtctggtctcaaactcctgaccttgtgatccgccccctcttggcctcccaaagtgctgggatttacaggtgtgagccactgcggccggccaagctcagtccttttttttttttttttttttttgagaccaagtctcgctctgtcacccaggctggagtgcagtggtgcaatctcagctcactgtgacctccacctcacaggttcaagtgattctcctgcctcagcctcctgagtagatgggattacaggcacccgccactatgcctggagtttttttttaagtagagtcagggtttcaccatgtaggccaggctggtttccgactcctgacctcaagtgatccccctgcctcagcctcccaaagtgctaggattgcaggcatgagccactgtgcccagccccagctcagtgatttttatagacaaattggaacccatgtgatgtgacttattcaaggttatagcgtctttgtggcagagccagaagtcgaaccgagtccttgtcccctgtctgaaccttgtttctttactggtcattgttgactttttacccaataaaatttgaacctttgattttcctggcaatatgtgtttgcttttaagttgtgggtcattatggattttatgaattagggcatctattagggtacctggcagatgtagtgtggaggataagcttggatatttcagggtcagactgcctgtgttcagatcccaactataccatttattgactgagatgttgtcaacctacatagattctcaatttttctcttctgtaaagtgagtgacatttataatagtaatacatatcttatatggttgtgtgacaaatatgttaggtacactgatcatctagtaaaaattagctgtggttattctcttttgagcaaaatacaacgaaaggttgcctcattgtgttcttcatggtcttttgcagcctggcgctatgtgggagccgtcggaggcttcctcttcattggcatccagctcctcctgctcgtggagtttgcacataagtggaacaagaactggtgtgtgcctttatggaaagcttcccattgactcacagaaactgcccagttttgaccaaggctgtactcaactgcattgctagggatttgcagttttgtttccctttatacctgcttttttgtacctcttcatttactcctctccttcattcacttctcactttttgaccccctgcccctactcccttgcttgggctctgagtcaaccagtggtgtgaattagccacactcaatcccctgctcgtacgggtctcgatctcctgacctcgtgatccgcccacctcggcctcccaaagtgctgggattacaggctcgagccaccgcacctggccttgctgtgtttttttaacagactcttgcttataagaatctagaaaatgtgctcattgctcttaatagaacaactaaagtaccttttcttccctttttcatttatctctttgtaaatatcttgagaaggagatgatcctaaaaacagtaggatagaaaggtcatgggcctggcaaccaggagatgcagatttcagtacccttttgttttctttttcttttattattattattattattattattattattatttttgagatgggatcccactttgtcattcaggccggagtgcagttgtgtgatcatggctcactgcagcttcgatttcccaggcttcagtgattctcccacctcagccccctgagaagctgggactacaggcatgtggcaccacacttggctaatttctttttttgtttgcttggtagagatgggatttcgccacgtcgcccaggctgatcttgaattcctgggttaaagagatccttctgccttggcctcccaaagtactgggatgacattgtgttcggcttcagtgccccttttaatgcttgttctcactgtagagctcatcagtcggcccctctgacctccattttcacacttaaataatgtgtttggactaactggtgtgttctttttttttcctttctagctcaaattttgtggtttacagtgtcaattctctattagaattgaaacaaagggctttaggtgtcgagtgtaaagactttttttggatttttagtgggatgggagagcaccagagggccttaaaaagggaggaatataatctgttttaagtgcagaaaggtgaaaaggtgtcaggggtgcaagtaaggaggtcagggggagtcaatccaggtgagggaggagtagtctggaactaagtggtagcaaggagctggatcctcctatgttccaaagccagctctgggtggaggtgggtgggggaggggagagcagcaagaagcttccagagtgaccacagttcttttgttcttttcttttcttttcttttcttttgagacagagtctcgttctgtcgcccaggctggagtgcagtggcacaatctcggctcactgcaagctccgcctcccgggttcgtgccattttcctgcctcagcctctcaagtagctgggactacagtcgcctgccaccatgcccggctaattttttgtattttttagtagagacggggtttcaccgtgttagccaggatggtctcgatctcctgacctggtgatccgcccacctcggcctcccaaagtgctgggattacaggcgtgagccactgcacccggcttcttttcttttcatttcatttcatttcattttcttccttccttccttccttccttccttccttccttccttccttccttccttccttctttccttcctgcctttcctcttcctttccttttccttttcctttcctctttctttgctttcctttctttcctttcctctttctttctttccctcttcccctaacaatgggaagttggagttgctgttttctgaggttgggataattgcacaatagcaggtttgggggatggaggaatgggggtgtcaatatcaggaagttagccttagcctggatgtgccaagtttgagataccagttagaccttcaagtgggtctccaattgttaaatgaacaaggggataatataagtgacattcaggggaaaggttagggttgaagatttaactttgggatggactgtaaacataaattaactgaaagaaagtccttcatattctaataacataaccaaaaagactagtgaatagaagcgttggtcgtctcccacgcacaaaccagtcagcagtgtttacctttttctgtataattcatgctgtctccccatcatccattattatttgctcttagatatttttttccttcttaaaatcccatttttctctcatttcctttgtatgccttttatgttagaataattccaaggtcattggagtgtctggcacagtttcaggaatatgacggtcattatcattttggcctttcctccctattttctttgtttctggttgcaggaactttttcatcattaaaacattttagctgggttgcttgaacactttccagttttgtgagggcataaagcaagttgctttttctgtgaggtttgggagaatgtggttacaaagagcaatttaatcataaggcagatgacaatgattcattcaattcattctccctgttctgtcctcttcatttagcatttatagatacttttttttgttctgaacaatttccctttttgtgtgagacagggtcttgctctgttgcccaggctagagtgcagtggcatgatctgggctcaccgcagcctctgcctctggtgtccaagcgattcagccactcaagtagctgggattacaggcatgcaccaccacgcccggataatttttgtatttttggtagagatggggtttcgccatgttggtcaggctggtctcgaattcctgacctcgtgatctgtccgccttggcctcccaaagtgctgggattacaggcatgagccaccatgccctaatttattttttaattgacatattgtaattgtacatatttatcgggttcattttgacgttttgatacatatatgttatatagtaatcaaatcaaggtagttggctattcattacctcatggatttatcatctttttctttctttcctttctttttttgtctttttttttaaagagacagggtctcactctgtcacccaggctggagtgccgtggcgcagtcatagctcactgcagccttgaactcctaggctcaagaaatcctcctgcctctgcctcccaagaagctggctaattagcatgtccagctaatttttttgtttgttttttgttttggtttggtttttggtttttgtagatggggtcttgctctgttggccaggctgtatcatttctttgtgttgagaatcttcaaaagcctctcctctagctgttttgtaatatacaataccttactgctagccatcatcaccctaccatacagttgatcaccagaatttattcctatctatttaactttttttaatgtcaaattttcctttactattccctgatactattttagataaagaagcagcacagttacaggtccttctcttcagtacagggaataaagagctaaggtcagccagtatggctcttagtaaaggtaattctctttcctccctaagaagatggcatcagagctgctggcaacactttgtttctgtttttaaaagtttatttattattattatcaaacatttagggccaggcacagtggctcatgcctgtaatcctagcactttgggaggcagaggtgggtggatcacgaggtcaggagttcaagaccagcctggccaagatggtgaaaccccgtctttactaaaaatacaaaattagcccggcatggtggtggatacctgtaatcccagctactaaggaggctgaggcagagaattacttgaacctgggaggcgggggttgcaatgagccaagatcacaccacagcactccagcctgggcgacagagcaagactctgtctcaaaaaaaaataaaataaaaaatttagacagggtcttactcttgcccaaactggagtgcagtagtacagtcatggctcatagcagccttcatccacccgagctcaggtgatcctcctacctcagtctcccaagcagctgggactacaagtttgcaccacaacatgctgctaatttttgtagagacaaggttttgccttgttgcccaggctggtcttgagctcctagcttcaagtgattcacctgcctcggcctctcaaagtgctgggattacaggtgtgagccacctctcctggcagcactttggagtagagactatggcgcttcggggctctgtgtttatggagaaaacttggggaagcccagtgaagagccacttttttcatcctgccaaaaactgacccacggtggttcatagtcagaatggagaagctagaataaagtctgtaggtagctaaaggaaataaagagtctcaggactgctcaaactcattacaccaaatggagagttaagcctggagacacagtcatgtgacactgctgtctccccccacctgcccatagatagctgtgacttcccaaccttgtgtcaaaggactacacattagctagatctctacagaaggcaaaaggccccatgcaacccggatggctgccctcaaattgctcataagtaaattctctgcttgtccctaaacctttcaagatgtgtatcttcccataaaaaaggacatgtcagctgtaactttaggtctgcgacctaagtctagctccctgtccatggaattgcagtctgttacatttcacactgacaatgtccattacaagcttatcttcccaggtgcagaacaaagacaggacagcagtcatttctctgcttaccctgagactacataattaactcttcctttactccctttttgaatgttgatcatatctcttgtatagcagggtttactgggcactagttaaaatctcaggggaatgtcacgtttgcctcaccacctgcccccttttcctgcgtgccttctcccctttaaagaaatgggtaaatactgagccttctgcaacctctttgggagcaccagccacagaagattctgtgacttgtgtgcttttaggtgcaccctcagacctctggctcagtacacctcggctgattgagactgttgcctcagtctctcatttgggttgacattattcattttaatgaatgaatacatttgtcgcagaaagtggaattctctcattgttgagagaaaattctcagcttgagtcaagaagtttccatatttaccagaaccttctagctttgatgagcataatcactgctaaaataatgtgtcttctgagcagctgggtaccagtgcctgtggcctgtagcattagttactgcctgagggatggtgactgttaccgcagaatggtgggcttcgttgacttgtcttctctcctctccctcttacccacttcccggagaaacaggacagcaggcacagccagtaacaagctgtggtacgcctccctggccctggtgacgctcatcatgtattccattgccactggaggcttggttttgatggcagtgttttatacacagaaagacagctgcatggaaaacaaaattctgctgggagtaaatggaggcctgtgcctgcttatatcattggtagccatctcaccctgggtccaaaatcgtaagcatgtttttttccattcttcgttacttatattttcctaagtgtctttgagcaaacccaatggctttttttgttttgttttgtttgtttggaactagtgtattccttaacttactgtggatgtgtcagcagtaggcaaggtggggctccagtctcttcatatctcatgctcgagctgtgatagccaagcatttctcatgtcgagaaagacctgaacgtaacgaagtcaatgaataggaagatactgcctttgctaaataatgtaccacaaagagcctttaaatgggaaatgccttccgtgtatatcaagatcaggtgtttatgagcttgcctacaatctctgtgtaaaagttgaatgaaagggccgcagaaggggttggttctggggtcatctttcactcaaggctgtggacagtgtggtctgggagtcaggaagcaggacatcccatcccagctcagccagcagctggcccatgtgctaaccttccttagacccaggttcttcctcagtaaactcagtggaaacatgtgagcctgaccttgctcattgttgtttcaaagccggaaggaagagacagtgggatctgaaagtgctttaggaagtataaatgtgaattgccatttataaactactcttggtttcttaagccagggtatagtgtctttgggcttacagtgagatgtccctggtctgattttttttgtgggtgtcggaccctataggtgatgaaaatgcacatgacattcaggttctaggtaggaaaatacaggcaataaatgtacagcccccttgaatcatttctaaaatagtggtttaaaaaggcaactagtggtcgggcgcagttgttcatgcctgtaatcccagcactttgggaggctgaggcaggcagatcgtctgaggtcaggagttcaagactagcctggccaacttcgggaaaccccgtctctacaaaaaaatacccagaaaattagccagccatggtgggacacgcctgtattcccagctacccgggaggctgagaggcaggagaattgcttgaacccgggaggcggggcttgcagtgagccaagatcccaccactgcactccagcctgggtgacagtgagactctgtgtcgaaaaaaaaaaaggcaactagtcacaaataatttgttttcttctattaaaaattttaagaccattattgaaattgagagtattattctcctaatccctttaattgatcagttaagagttcctagaacaacttgatattccgattaaaatctttgggttaagtcctaccttttgaaatagggataatgttttgaaatacttggtttaataccattaggtgctaaggaaaatcttattcccttgccaaagagcaacattataacagggtctattttatgtctttattggtaattacaatttaataatgataattttggaaacaaatttgaccaaagggaagactgagtaaaaactgcatccttttatgtcggcaagtggtcgaaaatttcgcaggaaagaaagagagatcccttatcacatcctggttactctgaaggatctgaacccttagtttccttgaaatattataactttcaaaaaataacagatggcttgtgaagtttcagagaaaaatgaacacttatacactgttggtgggaatgtaaattagttcaaccatagtggaaagcagggtggcaattcctcaaagacctaaaaacaaaactatcattaggtccagcaatctcattactgggtatatacccaaaagaatataaatggttctcacataaagacacaggcattcacaatagcaaagatatggaatcaccgacatgcccgtcaatggtagattgaataaagaaaatgtggtacatatacactatggaatctatggaatacggtgtagccataaaaaggaaagagatcatgtcctttgcaggaacgtggatggggctggaggacattatccttagcaaactaacacaggaacagaaaaccaaataccacatgttcttgcttaaaagtgggagctaaatgatgagaacatgtggacacatagaggggaacaacacacactggggcctatcagagggtggaggtgggaggaaggagaggatcaggaaagataactaatgggtactaggcttaatacctgggtgacgaaataatctatatgacaaacccctgtggcaattttccccttacaacaaacctgcacatacacccctaaacctaaaataaaagttaaaaataaatgaataaataaataaataaccttaaagccattctcccagtgaatgctgagccccatagccttcctctttagccaagagcagttcttgtattctgtccccaaaagctttttgatcattggcaggtaagagctttttgccctgtcatagactgtagtatgtgatgaccttgtagaatccagaatacatcccctatgaaatctggtttaccacttactcccctccccaattaagctatgtggttttatcaacaactatggtaattttttttctgatcttgtgatttaagaactaatgttacaaacctcagggagactagttagtgtgttttaagtgtagccataggcttgataaagtattggtagataacttggcagaacctgatgtctttgaagtagcaatgttcagttcagcgtgtaactctctcccccttaatatctttttagttttatctgagaaacatactacatttttttctcttttctttcctttaaaggtggatgctcaagtttgaggactgtcatggggactatcaggttttttaggcatgtgctttctttttcttcaaattaaaacctgttgtctgtctcttgtcacttttcaggacagccacactcggggctcttacaatcaggggtcataagctgctatgtcacctacctcaccttctcagctctgtccagcaaacctgcagaagtaggtaagccagcctgttagtgggcttgtgtttgcggtgtgaatattttcattcatggaggaatgagctattgtttaaatattggagaggccttggagatagagagcagaaagatggttaccagaggctgggaagggtttgggaggaggttaggatgattaatgggtacaaaataaataggaagaatgaataagacctagtatttgatagcacaacagggtgactatagtcaaatttaattgtacatttaaaaataactaaaagagtataattggattgcttgtataacacaaaagatcagtgcatgaggggatgggtaccccattttagatgacgtgattgttacatgtttcacacctgtattaaaacatctcatgtaccacagaaatatgtacgcctactatgtatccacaaaaattaagttaaaaaataaaaataaacgttagaaatgtaccaaatcacagtagagagatgatctagactttttcatgaaaaagtctttaacttgagctatgtaaaggaaaattccctttttcgattcttcctggtgtgtaggacagacaggaggaaaggtttggctgtggagtttgcttttaggcctaaataacctctttagttgtatttcttttcttttctgactatagcagtggaataaagagtggaaagaatgtgggggagtggggagcagggagcaggatctgagcacagatccatgatttactggctatgtgacctcaaaccactcgtcttaaatgacatttatttacagagacaacagaacatagtgattagagcatgagctttgaagtcggactgcctggtttatagactgatcctgctacttaagtaacttgcagaaacttacttatcctctctattacttatgtgatgtataaatgtaaatatacacagacatacatacatatatacatacatacacataagcatatataaatgtatgtttgagtatatttgagcttatataagtcaaataaatgtagtgtctaagagaattgaagttgtttcctcttttaaatttggaaagctggtgcagtgataattttgaaagttttagcatatacacatagtatttatgggtttgtccttgttgctgtttatagtggaaagtaatgtaagtggaggtcttaagtaactattgcctaacctggatttaagttttttttttaaatactctatcttgactctgtaagtttacataaatttagtctctttaagactttcttttatgactgtttatgtattaatttctggctttaacttactgggatttttatttacaatattttttaaatggcaggtatccctttaaaacagaaaaaaaaggctgagcgtggtggcacatgcctgtaatctaagcaccttgggaggctgaggcaggaagattgcttgcagccaggagctgagaccagccttggcaacatagcatctctacaaaaaaaaaaaaaaaaaaaaaacagaaaaaaagttattttaaatttcaagtgctctacatttttttaattagcctaagaataaagattcttgaaaccacagcatacacagggaagtttatagcattaaatgcctatatgaaaaaagcagaaagattacaaattaacaacctaacattgcacctggaactagaaaatcaagaagaaatcaaacccaaagttagcagaacaaaagaaataacaaagatcagggctgtgtgagttggctcatgcttgtaatcctagcactttgggaggttgaggcaggcagattgcaggagcccaggagtttgagaccagcctgggcaacatggtgaaaccctgtccctacaaaaaaatacaaaaaattagccaggcatggtggcacatgtctgtagtcccagctactctggaggctgaggtgggaggatcactggagccccagaggttgaggctgcagtgagctgtgagctcttattgcaccactgcactctacccagggcaatagacagggactttgtctcaaaaaaataaaataaaataaggaactaaataaaataaagacccccctcccccccaaaaaaacccatgagaacaatacagaggatcaacaaaacaaaaaaaaggtggtttgttgaaaagataaacaaaattgataagcccctggactaaccaagaagagagaagaccaaatcaacaaaattagaaatgaaaaaggaaaaatcacaataataaccacaaaagtacaaaagatcattacagactattatgaacttccatatacttacaaactagaaaagctagaggaaatggatacatttctggaaagcaagaaggaatagaaatcctaaacaggccaataatgagtagtgatattgaatcagtgatttaaaaaatcttccaataagaaaaagccaggaccgaatggagtcatagccaaatcctaccaaacatataagggagaactaataccaatcctcctgaaattgtgccaaaaaatggaggaggagagaactctccctgactcattatacaaggccagatatatcaccctgaaaaccaaaaccagacaaggacacaacaaaaaaaaattacagaccaatacccctgatgaacatagatggaaaaatcttcaacaaaatactagcaaacacgatgtaatagtacatcagaagataatataccatgatcaagtgggtattataccatggatgcaagaatggttcaacatatgcaaattaataaatatgatacatcatacattacatattacataaacagaattaaagataaaaaccatatgatcatttcaatagatgcagaaaaagcatttgttaaaattcagcatcttttcatggtaaaaaaaaaaaccctcaataaagtaggaacataacttaaaataatagaaggaatacaacttaaaataataaaggtcatatatgataagcccgcagccagtatcatactgagtggggaaaaatgggaagcattacttttgagaactgaaccaagataagggtgcctgccttcaccatgcctattcaccatagtactggaagtcctagccaggacactcaggcaagaggaagaaataaaaggtatccaaattggaagagaggaagtcaaattgtcgtgtttgttgatgatgtgattctatatctagaaaacccaaaaggctccaccaaaacactgttagatttgagtaatgaattcagtaatattgcagtatacaaagtcaacatacaaaaattagtagtgttttggctgggtgcattggctcacatctgtaatcccagcactttgggagggcagggtgggtggatcatttgaggtcgggagcttgagaccagcttggccaacatggtgagacctcgtgtctactaaaaatacaaaaattagccagtcatagtggtgtgcacatctgtaatcccaactacttgggaggctgagacaggagaatcacttgaacctgggagggggagggatcttggctcactagccaagatcgcactacagcacccctgcaccccagcctggacaacagagtgaaactccgcctcaaaaaaaaaaagtcagtagtgtttctatacaccagtaatcatctagcagagaaccaaatcaagaagccagtcccatttacaatggctacaaaaaataaaataactaggaataaatttaacgaaggacgtgaaagatctttacaatgaaaactactaaacattgatgaaaaacttaaaaggaggggccatgtgtagtttcacatccctgtgatcccagcactttgggaggccaaggtgggaggatggcttgaggccaggaatttgaggccggcctgagcaacatagggaaatcccatctctacaaaaaatttacaaattagctgagtgtggtggcatgcacctgtagttctagctactcatgggtccgaggttggaggatcacctgagcccaggagcttgaggttatggtgagctatgatcaggccactgtactccagactgggtgaaagagcaagaccacgtctcaaaaaaataaaaataaaaaggatgcaagcgaatggaaagacatcccatgctcatggatcaggagaataaatattgttaaaatgaccatattgcctaaagcagtcttacagatttagcgctatccctatcaaaataccaatgacatttttcacagaaaaacatcctaaaatttgtatagaaacaacagagccagaatagctaaagcaatcctaagcaaaaagaacaaaacttggaggaatcacacttcaaagctggaggagtcccttcttcaaattatgctacaaagctacagtaagcaaaacagcatgatatttgtataagaatagatccatggaaccacatagagaacccagaagtaaagccacatatttatagccatctggtctttgacaaagttgacaagaacacacactggggaaaggatacccttttcaataagtggtcctggaaaatttggatttccatatgctgaacccctaccgaacccctgtctctcaccacatacaaaaatcaacaaaaatcaacaaaaggtggattaaagacttacatgtaagacctgaaactgtaaaaatgctagaagaaaacctaggaaaactcttctggatattgctcaagggaaataattcatgactaagacctcaaaagcacagacaacaaaaacaaaaccagacaaatggaactatgttaatctaattagcttctgtacagcaaaagaaataatcaacagagtgaagagacaacctgcagaatcagagaaaatatttgcaaactgtgtcttataggggagcaatatgcagaatttacaaggaacacaattcaacaacaaaaaacaccaaataatcccattaaaaagtagtcaaagaacatgaatagacatttcattttttttctaaagaagacatataaatggccaacaggcatttgaaaaaaatgctcaacattgctaatcatcagagaaatgcaaattaaaaccataactagatgtcatttcacaccagtcagagtggctattattaaaaagacaaaaagtaacagatgttggtaaggatgtggagaaacggaaacacttatactgttgatgggaatgtaaattagcatagcttctatgggaaacagtgggagatttctcagagaactaaaaatagagctaccatttgattcagcaatcccactactgggtagctacaaaaaggaaaataaatcattatatcaaaaagataactgcacctctgtgtttatcgcagcactgttcacaatagcaaagataaggaatcacctttaagtgtccatcaacagatgattggataaagaaaatgtgatttttatatatatacatacatacatatatatatatacacgtgtgtatatatatacacgtatatatacacgtatatatatacatatacacacatatatacatatatatacacacacatatatatatacacatatatatacacacacacacacatatatatatctatctccacacaatggaatactattcagccataaaaaagaatgaaatcctgtcttttgtagcaacatggatggaactggaagccattatcttaagtgaaacaagcagacacagacaaatactgcatgttctcacttttaagtgggagctaaataatgtgtacacatggacatgagtgtggaatgatagtgaagactcaaacataggaaggagggaggggatggatggtgagaaattacttaatgggtagaatacacattatttggtgatagatacactaaaagccaagacttcaccactacatgtaaaaaagttacacttgtaccccataaatttatacaaataataaaagattccttaaaccacagcatacatagttacgtttactgtttcaagtgcaaatactagtcataattttagtctcacttcagacacttgaaatatgcacgtttgtaaagtggtttctagagtgttactttatgttacttgctttggtggcaaagttggcagtcagacctaggttgggtgttccaaatggaagactccatgttaggtaaaaggtaaattaccactgatggttatattataggaatctttgttacgtagtgtttagaataactcagtttttcttactgtttcacactacaacagtcaacacagaaggtttctgtgacactaaaataagtggagatttctccccaccagcaagcaggcagtggacatcagttgggtgtcctccaatccaattcggatgctctacctggagataaggtcagatcccacaggtcgaaggctcaattccacaaaacagccctaccattcccactggtcacaagtccggccctccagaacttctgaccaactgttagggctcccacagttaccccttctttgggatggattaatttgatagagtggctcacagatctcaggaaatacttatctttactgatttattacaaaggatattttaaagaatatgaataaacaggcaggtaaaaatatatataaggcaaggtctcaaagggtcctgagctgtctccatgcagttggtgtggctgggttcctaacatgtggatgaggtggtgttcaccttcctgtaagcctccagctctcaggaagctttctgaaccatgtccttttgggccttttatggagacttcattacacaggcatgattgattaaatgattaaaccattggcccttggtgatcaactaccattcctcccattcctggagtttggagagtgggtctgaaagtcccagccctctaatcctaccttggtctttctggtgaccagcccccatcctgaggctacctaggggctgccagccattagtcagtcattaacatataaaaagacaccattttggagatttcaaagattttaggagttgcatgcaagtaaatgcgaatgaagaccaaatatatatttcacaatatcacatgtagccactcacattaaaaaaaaaacacacctcaggagtttccaagttacagacagaaagataccacgattatcatatcacttacagcaaaatgacttctcaactagtttaggagctattgttggctgttgattcacctcagcactgcttggtatctgcaccctacctctctttagaggctgccttgtcaactgaaaaatgcacctgacttcgagcaagactctttccttaggttctggatctgtttgagccccatggcactgagctggaatctgagggtcttgttccaaggatgtgatgatgtgggagaatgttctttgaaagagcagaaatccagtctgcatggaaacagcctgtagagtagaagtttccagtgataagtgttcactgttctaaggaggtacaccacagctacctgaattttcccaaaatgagtgcttctgtgcgttacaactggcctttgtacttgactgtgatgactttgttttttcttttcaagttctagatgaacatgggaaaaatgttacaatctgtgtgcctgactttggtcaagacctgtacagagatgaaaacttggtgactatactggggaccagcctcttaatcggatgtatcttgtattcatggtaagtcttgggagttactcaaggtcacttttgcagactttaaaattacaggaaaagaattgaaataactttcagtagctgtgaggctgcaaccatttgaggaggggggaaaataaccacaagtaaaaaggcgaagagcgtgaactcatatttgaacttcgttcaccttacttgtttttatttggggtaaataaagcaaatatatggtatgtaaatatttgaacttcgtttaccttacttgtttttatttggggtaaataaagcaaatatatggcatgttgcagcaccgttgcctaaccccctttaaaagatggtcgaatagtagtttgctatacctttactggagggcaggggagcacaaagtgaagaagagatagaatgtgccagcatgtcctggcagctttctgatccaaaggaaatagctttcttctgctgttgatggaaagagtacagagtgctgtgtgcgtggtcattctgtgcagacaagaaatgttcattctcttttctgctaaacccacaatgctgttgttcactcggcaaagcagctcctccaaaagtagatgtgatatatgagtgggctgtgtttcagatgcttgtggtgggggttattccacctttaaaaggtttaaaaggttgctagagggagaaaagtcaaggatagaaatggctagttaatctggatatatatttcgctgataactaagcttccctttaacagtaaccttttcacatttagcctttacttctgtgtttacattttgttaatgttcagtataaaaattcaattccattgaattcagccataggcacattgtaaacttcctttttgctgaaacgaaatactcctggtggtgatagcttgtataaatataatgtctttctgagcatgttggcattttctcttacctcctttaacaacttctactattagaaagggaccaacggggacacagaccttttagagtctatttgctcagggtcacacatcaagcaataaaatgcttgttgttttacaggtaggtgttaagatgatggtgacatacattcattcttggcctgtgtgacatagtgacagagtctccttgttgttgcagaatggactgtggtaacttctttctggcctttcaattttattaattcctaagttgttcgcagagtacctacaatataggaagcaggctgcgtggtgcagtggctcacgcctataatcccagcactttgggaggctgaggcaggaggatcacttgaacccaggaatttgagaccagcctagacaacatagcagaccctgtttctacgaaaaaaaaaaaaaatcaggcgtgatggcacgtgcctgtggtcccagctacttgggaggctgagatgggaggatcacttgaacccaggtgtctaaggctgcagtgagctaggggtgtctccactccagcctaagcaaccgagtgagaccctgtcttttgaaaaaccaaccatgaagatatttgatagaataaaatcatgtttttgtgggttactgggtacccaatgaaaaaaaatatttgcccttggccaggcgcggtggctcacgcttgtaatcccagcactttgggaggcaaaggtgggtggatcacctgaggttaggagtttgagaccagcctggccaacatggtgaaaccccatatctactaaaaatacaaaaattagcggggtgtggtggtatgcacctgtaatcccacctactccggaggctgaggctggagaattgcttgaacccaggagggggaggttgcagtgagctgagatcacgccattgcactccagcctgggtaacgagagaaactgtatttcaaaaaaaaaaaaaaaaaagaaaaaaaaaaccctttaaataaagtagagtttggatttgccataaacccttcaatggaaaagatggcaaaaattcttcttagcctgctgcataatggttaccacacatagggcatttcacaacatggaattttcaccctatcatattttctcactatttctagcaggtgtaaagaattcttctgagttggcccttgagtgagagatgataaataaaatgttgtttcttacaggactgaggtaccatagtggagattggtaagggctggtctgatattcccaaaagatgtcaattttcaaagttgatagctactaaaaaaaaaatctgtctaaataccagcaacaaacattgttattgaattcgtaaaccacaaaactgcagtgtatggtgggatgagaacatataaaactgcagcccctacaaagtggagatgaggatgaccactctgctctgtagcgtacttctgtaatctgtaggcaagagcacactctgtgggctgggccccctaggagttagttcccccggggtccatgtgattgatgtttgctgtaattactcactgcagctcttcgaggggtcagctttaagaacactaaattcaggctttgtagggcctgggaataaaaggaatgctgtaggggtgggagttagcccaactagggttttttcagatctggacttctgaagagtttgttttccttcctgactcagaggaatgaaaggttggaggatgttacaaaaaggccacatcgtccgtgtgggaactgtcatttgaacataattgcaggaatatctaggattcttgatagaaattgcaggaagccagagactatagatagtatgtaagttaaaaggagaagaaggccaagattgcctggggtccactcttgtaaagttgtagaagactggaaatctccctagctcctctctttcccttcgccctccagagcccccaagccccacccccaaatacttgtttcctttggggtatctccatcctgactcttgcagctggggtactctctaggagtatgttttaatgtttgtagcctcagctcagaagaagggctcaacccaaacctactccctgcctttctgcctggggctgccttctctccagagcctccttccattgcacccaggaatcattgctgtgaaagaacatcatagcttggaccccatgtaagccctaaccttggtccacttgtgggagttctctgatagctctttttatttttttagataaaaaaaaatgttttaaggcaagttctcactatgttacccaggctgggtaaactgtccttaagggatcctcctgcctcagcctcccaagtagctgggactacaggcataaccatgacacctggcattctgatggttttctctctctctctctccttctttcttcctttttttttttgagacggagttttgctctttcacccaggctggagtgcaatggcaggatctcagctcactgcaacctccgcctcccaggttcaagcgattctcctgcctcagcctcctgaggagctgggattataggcgcgtgccaccacgccaccatgcccggctaatttttgtatttttagtagagacggggtttcaccatgttggtcaggctggtctcgaactcccaacctcaggtgatccgcccgccttggcctcccaaagtgctgggattacaggcgtgagccgccatggccagccctgatggctctttctataggcgcatccctccacacccctttagtctggagctttgctgtgacaaatcctggcctccacgaactatttcttaattcttcccttggtctctggattttgattgaaattgttattctgttgccttcaacttcagactgtcagcctggacaggatcccagagttgatcaggtcagtctcctcattgtacatgtaaggaagcatggagcctatacctgtagctctctactcccaacttcgggcaacctttccttgaggctccttttcgggagtatttagggacactggtggatagtctctccccggctctttttcttcagatggcttggtgtaatgtcccctgagggagaaagataaactggatgacttgcgtaattatattattacaaggcatttgcactataaagtttcctgaccattccacttttatctgtgtttaagagaaaaaataattcttaatattgaaccatctttgaaaatatccttttaaatataaaactggaaaaagtaagaatctttattcaatgtcaaacaacttcctagtttgaagtggggaggttcgcaggttggtgtgatagcattgccgaggggattgttctacattaaaaaaagttgggaaatcaaggaagaatatttatttttttggtacattctgggcctttatgggggggtggggaaatttgtatcttccccaccaggagagggggagatttgtgtcttcattttgggaattctgctctggcctgcctgccagctagaaatctccaagttagaaatcttccaccccgtggccaggcgtgatggctcacgcctgtaatcccagcaccttgggagggcaaggcgggtggatcgtctgaggtcaggagttcaagaccagcctgaccaaaatggagaaaccccatctgtactaaaaatacaaaattagccgggcatggtggtgcatgcctgtaaccccagctactcgggaggctgagacaggagaatcgtttgaacccagaagacagaggttgtggtgagccgacatcgagccattgcactacagcctgggcaaaaagagtgaaactccatctccagaaaaaaaaaggaaagaaagaaaaagaaatcttccaccccatgccccaggttcacagagagctcaggtctcctttgggttctatagcacaggggagcatgactgatcttcatcattgcacaaaggctgggaatagtcacgggatctgtcaagggcctaccctgtacgtttgtcagggaggcggaatgtgtgatctccaggaaagtttggacgtgttatttagagattttctgtggtctagtggactttggccagcttcaaaagcatctgcagtgccagtgttgaggggcacctgcattgtgcattcttctgccagtgtgaaggggttctgggcactgtagtggttctgcagggaaacaggacacggcttttcttttttttttttttggctgtcaccatgactgcagagcactgctggcattttggctgggttggggtggggtggcagcaggcagagacagtaaacacgctgtggtgtgttaggcattctccgtacaataaagcattgtcttaacccaatgctgtaagtctcctcctatccccacgggaaatactgggttaaagtcacacctatcttagcacaggaagaggtaaggcttataggtaacccaggaattgttttatagcaatttgtgctgtgctcaccaaacagtggtctttgtaatagcctgaatgcagataataagaatttcctaggctttaagagcttataaaaaaaaaaccttttcttgataattccaagaagagtgttgtatggagaaaggctacaactgaataaagatctttttttttttcctgcaacatctgcctcccgggttcaagcaattctcttgcctcagtctcccgagtagctgggattacaggcgccccccaccatgcccggctaatttttatatttttagtagagacagggtctcaccatgttggctaggctggtctcgaattcctgacctcaggtgatctgcccgcttcagcctcccaaagtgttgggattacagatgtgagccaccacgcccggcaactgaataaagatcttaatgtagggtaacatctacctgtagaagtcacatggcattaatgatgctctgaatgtagttctttttaaaagtaaaatcaaaagcttccccatgttaggcctctttgatggtgaagtggcaaaggagcccaaatcaagagctttgttttccggaaattacgttaacccaaagaatttatagagtagaatatttactctgaggctttgtttttctttttgagacagagtctcactttctcgcccaggctagagtacagtagcgtgatctcagctcactgcaacctctgcctcctgagtgtcaagcaattttcctgcctcagccccctgagcagctgggattacagctgccggccaccacacctggctaatttttgtatttttactatagatggggttttgccatgttggccaggctggtctggaactcctgacctcaagggatccacccgccttggcctcccaaagtgctgggattacaggcgtgaaccactgcacctggcctattctgagcctcataaataatgaatgttaacctttcaaatgaaaatttcagatagtgatctcttcttaaaattaaaaacttatcttttcccctgtgaaaactatacactgtactaaatcaaaacttgtatgcacaggatatgtgccactcttttttttttttttttgagacagggtccttctgtcactcaggctgaagtgcactggtgtgatcatgctcactacaacctcccaggctcaatttattctcctgcttcagcctccccagtagctgggactgcagacatgtgccaccacacctggctaatttttgtattttttgtagcgacagggttttgccaagttgtccaagctggtctcgaactcctgggctcaagcgatctacctgccacagcctcccaaagtgctgagattacaggtgtgagccaccacacccagccgggccactcttaaatgtcggattaggtgttgtgttccttgggtgcgcagtcattgggagatgtttctgtcttcctctgaccaggcacacagtcaggaggtggagtggcatgggcctggattagcatgcatcagttcaaagcagaaatgaaagtgatgctgttgtacttgagtggaccacaaaagaaacagtgaacttggatctcagtgggcttctgtatgagaaagctttttattgtttatctctgtctcattgatctctctccttgggaaagaggatgagactgcgcagtgttgcctcatggggttcgctggattgagatgagtgtgtgtccccacctttccatgagcagaccagcttcttgagcaccaacacgcccgcccatgtcaggccagcacagaagctacatgacggcaggattgttgcctgtgtcactgagtccccagtgcttagaatcgggcctgacacatagtggccttcagtaaatatttgctaaatcaatctgtaaagttagctggaaccctaagtattgtatatatttgcttaaaatgttctgtgtttttgttttgtagagatgaggtcttgctatgttgctcaggctcttctcaaactcctggcctcaagtgatccttccaccccttcctctcagagtattacaggcatgagccaccacttctggcctgtttttgttttcaggaaaaataaattattttgccccatgcaaggcaatttgtctaacattttacctttctaggtctcagggaagtggcagaattttttattacctcgactgctactcttccaaacagcaagccttgttctactataggctatcacagtaaataactgcgacttttgctttcatgcccttgctttctgttgccatctctgggctcgttgcttttgattccctctaagcaagactagtcaaagggagggaaagataaactgaaattagaaaactattgtagcatttgagggaggagaggcaaaaagcaatactgaaaaccaagatatcttacttctctacctacaaccttctttgcataaaatgatctaatgcaatccatgtaaaatgatatcaactatagaataagccagccaattttggaataaggagaggtattaaaatagattgctttgatttaagtctcctgaacggtaggttacattgaggctctcgtcggagcactggccagccggctttccccttcattccatgtgttgtaatgtgttaatatgcccagctgacgtttttgtctgtttcttagtttgacatcaacaacaagatcgagttctgacgctctgcaggggcgatacgcagctcctgaattggaggtaagttcatttccttttcctgtcctgcttcatctcagaagatccatttctcaggagggccttttgtgtttgtgtctttatcagtctgcattccgtgatcctgtttttctgctgaggaaagatttttgtatagaaaaataaatgctggccgggtgtggtggctcacgcctgtaatcccagcactttgggagtccgaggcgggtggatcacctgaggtcaggagttcaagaccagcctggccaacatggtgaaaccccatctctactaaaaatacaaaaattagccaggcatggttgctcacacctgtagtcccagctacttgggaggctgagacgcgagaatcacttgaaccctggtggcagaggttgcagtgagccaaggtcataccactgcactccagcctgggcaatagagtgacactttgactcaaaaaaataaaataaaaaagaaaaataaatgctttcctgctttcctttgtatgctatgggattaaaatgaatcagtccattcttgattttctgtaagaaagctggcctcttgggtggcatcctgccgctcacccccaaccagaggctcaggtaaccttgtcaggctgcaccctgcgctcttcccttgccgtagtggagtcttggtgggttttattttaacttctgatccacccacctgtttcatacttgtctgtgccctccatacacagcgtggctgtgagattatgtaatagctgtttggaagaaaggagagaggaaagggaaggaaccatatctgctctgcctgacgctgttgaacgttgtagatacattaactcatttgtcagttccatcaggtgggcgttttgtcaggtagagtgttatggacaatacatacattggttgcctgcacatccaaagcctcaaggtgttcagcagatgcctatcagtcaacaaaatgtctgttattttcttaattgtgcaagagtctttctggggctctcatctaccaacaacagcaaggtctaatcagatggaggcagccagggaaggactcagctgtgacccaagaacgaaaagaaccaggggttccaaagatggctaagacttacagcacttgctatgtcccaggcactgttctaagttcttcctatgtgatttcacttaatcctcataaaaacccagtgacgtgctattacctccattttacagaggggaaaaccagaagagttaagtcatttaagcctcacaggttttgatttgccagaatataaaccgtgtactctggccccaggatctgtgttcttgaccactgctgcccaggagctgagctgctgaaccctggtccttgctgctgactgcgggcagctggtttctggccactgcctgcgttttaatagctttccgtggatggaaaagccctggtgtctgtctagatatgggcattttactctgcagctgggtgtctggggttggtctctcttgcacctgacctggatatagtgagccattatgaagggctgtcatctgccaacatcattcaccaactctttctgttgcctaaaggagaaaattgtgctgagtttgaataggttactgcctattatagagaagagaatggtctgtagaaggggtgtttattctcaccattgactaggtgaccacctgctgaggttgcatggttatggtttcaatgtccctattgtgtacagagttcaagctcaaagaacagcaagtctccaagttagatttaagagaggatgtttttcttctcagtccaagggaaaatgtccgagtgtttccttctgaactggagagcatgcgggatggaagttggtttgctctcctgcgtcacatttcacaggatacaactttgaaagtgagagttcatagtttcttatggtaacttgaacttcaaaataactaagacctcagcataccgtgtcttgggcccactgaatgaattagtggtttttagaccatggcacttaatccaagctcctgttaaggctaatacctccgttaaaggtttccttgccaagcagggaaacaagggcttggccttgatacacaaatgagatgaaggctcaagctctcatattcttatccttggctctctgttctttgtagttgaaatatcttcagccacaaagtgctaagggccctgcacttcccaggctgtcttagtactctgtttaccagagtccttctgaaatcacatactttttttctttgcttttttttttttgagacagggcctcactctgtcacccaggctggagtgcagtggtgggatcacagcttactgcagcatcaaactcatgggcttaagcagtcttcctccctcagtctcccaaatagctgggactatacataacctgattttttaaaattaagtttattgttttgagtaggtaagaaataatggccgggtgcagtggctcacggctgtaatcccagcactttgggaggccgaggtgggtggatcacctgaggcctggagttcgagaccagcctgaccaacatggaaaaaccccgtctctactaaaaatacaaaattagccaggcatggtggcacatgcctgtaatcccagctacttgggaggctgaggcaggataattgcttgaacccaggaggcagaggttgcagtgagccgagatcgtgccattgcactccagcctgggcaataagagcaaatctccatctcaaaaaaaaaaaaaaaaaagaataaaaaatacgcaaggtaccagagatgcttcaaaggcaagcattccctccatccctgcccacggcccgtgcaacagcttgattttgataggaaacatgggtaggctgcttccagattccttcactttactatttcagatcctaccagcttcgccaagctcctagataccacgtgttacctattgtgaatcatggatcttggtgtccccatcctgcattcgtctgttccagctctgtcactaagctagtttggtgactttggccagttaacctgcctgacctcagtttcctcagctgtacacaggataataataagcccaatgcaaaggtcaaagagggtttaatgaaataacattgaaagcaaagcacgagaagggagcaccaggagagtggggctcttgtcacgttcattgggtttcacattgagttctccagaagcagaggctgaggcagtttgttgcgtgggatatttattaaaagtcagcacatgtgggagggagaaggggaaggggaggcaaaattgggcagagggtgaagttgaaggacagtgcagctggacaaagcctccctaaccctaggagccataaaggcacggcctttacccctgccatgatcagccattccatggcagttacccaggaagggtaaaggagctcctgtctcgaggctctgctctcagcattcatggtagcaggagcgagcaccaagtccacggatgaggatctctgtggcacatctccctccatggggtttcctgtcaccaacacccagcacacctgggaaagaacagtccacatcttttgaagggcctgggaggtggttcaaataagggttactgttgtcttgctgaggtggactagaaatagaacacaagccgcctgactgttgcttttgctttcacagatagctcgctgttgtttttgcttcagtcctggtggagagggtaagcagagcgcttttattctttgcacctgtgtggcactgcagacctataactctaatctgtagtcatttgggattcagacacaaataacttgaatagtaaggagaaagttttattctaaagctgacttactacttatacacttttcacattcttcctgaaggatagctgagttttgtttgtgttggtattctggtagagagaatcagtccaaattttggtttaaatgtaagttaaattatacagtgagatttagagaatcagagagcacattttttaaaaaggagtgatttggaaaataccaagaggtcctgacaccttattttggggccatttcattccttcaccttactttccaaggtggattggaggattccaagggcttgagaactaactcttgttttactctcactttctgctgagcttatagtaagttttacgtctttaagggtttttaagggttctctttctgttaaaataaatgtggcagggcaggcacggtggcttatgcctgtaatcccagcacttcgggaggctgaggtgggtggatcacctgaggtcaggagttcgagaccagcctggccaacatggcaaaaccctgtctctactaaaaaacaatacaaaattagccgggcgtggtggcgtgtgcctgtaatcccagctacttgggaggctgaggcaggagaatcgcttgaacctgggaggtggaggttgcagtgacccaagatcatgccactgtactccagccggggcaaaaagagtgaaactccatctcaaaaaataaataaataaaaataaatgtggcattaggtaactcttcctgttacggaagttgctagggtggagtgggggttttgtgcttagggcacagattgaagttgccagagggtacagatggctttctggcatcttttctactgacagccctgtagaattagcgagcgtgactttgctgaatggtaaacacacacattcactcattgagcctgggctccctctgtgcttcacagacactgaagagcagcagccggggaaggagggaccacgggtcatttatgacgagaagaaaggcaccgtctacatctactcctacttccacttcgtgttcttcctagcttccctgtatgtgatgatgaccgtcaccaactggttcaagtgagtggcccatttgcttaggtatttttgaagcaaagccttaaagttaagagttaagtactgttcgtgtttgtttgtttgagaaggagtctcactctgttgcccaggctggagtgcagtggcacgatcctggctcactgcaacctctgcttcccaggttcaagcgattcttgtgcctcagcctcccgagtagctgggattacatgcatgtaccaccatgcctagctaatttttatatttttagttgagacggggttttgccatgttggccaggctggtcttgaactcctgacctcaagtgatccacctgccttggcctctcaaagtgctgggattacaagcgagttctgagttttaacagtggatgggtatgttttaaccctggaaactggtgatgcttatggcaactttaagaaaatggaaagttagctctatatggacagtctggaaaacatggtaatgaaggaaaaataggaactcctaagcattcatctgcctttcagaaagagaaaatatcccttttttttctacttcaaattttgtgtatctttttccccatttttcttcattttcattacaaaaattggaaacatctttttttaaaatacaaactaaatgtggaattatgaaaagtaacaatgtggtacccccccgcctctacttcccccacacagataaccactgctaggatgtgtatccttctccttttctgtgcatttataaacctctgtagtttttttttgtttttagttggagtcttgctttgtcacccaggctggagtgcagtggcgcaatctcggctcactgcaacctccgcccctgggttcaagtgattctcctgcctcagccttttgagtagctgggattacaggtgctgccaccacactggctaatttttttttttattatttttagtagagacggagtttcaccatattggctaggctggtctcgaactcctgaccttgtgatccacctgcctcagcctcccaaagtgctgagattataggcatgatccaccatgtccagctaattttttttttaacataaatgtcattatacatgttttcccctggaggcttttttttttttaacttggcagtacatgattgacctggccttccctggcactacacagaggttcatactttttctacaggtccacagctttggttgtatcataatttttttgaccactaagttaagcttagacatgtaggctcattgtgcttccttttatcattcattcaacagatgtgcaagtggctcctatgtgccacacggttctatgaggcaggatttatagtccagcaggagagacagactatgacgcaagtcaaatatggtgtgttagatggtgatgagtattggggagaaaaataaaattaggagagggaattggggtaggggtggtgggagtggtggtttcaagcacagtgattggagagattcttcctgaaggaggagaggagaagggagctttaatgcttcccagtgatgctttgggaactcctgggaatttttggcttggaaagcttaagaaaagatggagaaggctataattaaaaaggcagataataacaaatgtcgaggaagtggagaaattggaaccctcttacattgctggtttgaatgtgaaatctgctttggaaaagagtttggcatctccttaaacaattaaacattgagttacaatgtaatccagctcttccactactcctgagcgtatacctaagacaaaaagaaaactaggtccacaaaacttacacagcggtgttcatacaagcatcattggtgataatcaaaaaggggaaacatcccaaatgaccatcagctggtgactgcctaaacaaaatgtgctctatccatacaataagatactatttagcagtaaaaaggaatgaaggactgacacatgctgccgcgtggctgagccttggaaattgtatgccaggcaaaaaagccacacacaagagaccatgtgattccttttatatcaactgtccagaataggcaaattcatagaggcagaaagtagattggtgaatgcggggggtgggctgagggggccatggggaaggggagagcacctaaggggtgcatgatttcttttgggggtgatgagaatgtttggaaatgggtagtgttgatggtagcacaagtctgtgtatgaatacattgaaagccgttgaattatacattataaatggatgtgaattagtgaattgtatctcaatatattcctgctttgaccgcggctaggtgtcttgtttccacagctacgaaagtgccaacatcgagagcttcttcagcgggagctggtccatcttctgggtcaagatggcctcctgctggatatgcgtgctgttgtacctgtgtacgctggtcgctcccctctgctgccccacccgggagttctctgtgtgatgatatcggcggtcccctgggctttgtgggcctacagcctggaaagtgccatcttttgaacagtgtccccggggcagggactggcgccctgtgcctgagtgggtctgaaaaagctttgagagagaaaaaaaaaaatctcctgattagctttttacttttgaaattcaaaaagaaactaccagtttgtcccaaaggaattgaaattttcaaccaaactgatcatggttgaaatatcttacccctaggaactggataccagttatgttgacttccttctgcatgtttttgccaaaacagaatttggggcacagcatcttttcacagggataaaaatatcttgtggggccagtcattctcatcctcggaatagaaaaacatgccaaaatcttgagtccccagcgcctaacagaatccagacccctctcactcacttccgcctcttagagccttgtccccagggggctttgaggacaggactcagcctgcagggcccctggtatttatagggtccaagaggaggcacctgcttttcaactgcaccctcagtgctgcctcttcacggcccctaaacgtttccctttgaggttgtgatgctgggaatcacagacttcactctctgcctgcacccttccccgaggtctcatcttttctgggtcccacatctttgtaataatgtgaaaaagcacaatttgtctgatcaccccccaggtggttccccaccttattatcactacctgatccgagttactgcaataagtacggcgcttatttatggtgttattcacatgattatagaacaagattcatgttttctctgcctaagcaatggagggctatcattcttacttgtttgtgctgttgataatgataatacttttaggaccttaactgaaaagctgcttcgtgttgaagcctgctgcatgcactgctctttcagttgttgaggtcagcccctcagttttttctccaccttgaggcctttgaaactgtaaaagcggaagtcgttttgtgttctggatctgtaacgtgaccataccgttcaggttcatgctggcatccttggagtaggtttgctaatgtgagaatttctgaggtgaggatctcagacacactgaccagaagaagcttgttaggcaatgtgtggaagtggccgaatatacttaaaaagaggtgcgcagaggcaggcggatcacttgaggtcaggagttgcaagaccagcctggctaacatggtgaaaccctgtctctattaaaaatagaaaaattagccgggcatggtagcgtgtgcctgtaatgccagctactcgaaggctgaggcatgagaatcacttgaacccgggaggcggaggttgcagtgagccgagatcacgctgcacaggaatttccaaaatacgtacttgcaaagtaatacagaaacgtgactttcggcagctacccaagatgatgcctattttcagtgttgatgtattcaggcagggaaaaggtttacttggtggaaactcctgttagaatttcattcggggtggaaagaatcttctcgagctctctgtaagtgaggatctaagaataaaaggctcagcctagtcatttttttctgtgccctactgtatgagttgggcagaattgagtgccacctaagctgggcttctgtgtgccaaaatgctggtgggtgaaattagtgaaattctttctattcattcctttgcccttctcccaagaaaacccatggggaaacaaattacaggggatgaattcctttagaactttccctacttagagtgtttgagattcagtttcaaaaggcactccatctgtgtgtgtggtttagagagccttgttttgtaaattccattaaatttccttttttagggcaggagctctgtactcagcagttaaaagattcatctggagtcgcaaaatgaaaagccgtgttctaacctgaggaatcagttaggggacaggagttccgtgggccaggaatgggctcagggagtggggctgcgtgtcacacacagtagctgtgttgcagtggcctagggccttgggggttgtctttaggaaacaccctgaggggaagcaggtaaagagcctgggcagtattgtgactagtttcattgttttcctcctgctgaggtctagcagagcccttgctttgtcctctcggctgggtctggctgccagctggtgtgatttgagaaactgaccttacgcgcagtcaaggtccagctgacaaggccttgtattccttggctggccgtgattggccctttcctctgcagaaagcagcttagggaagcccaagcaagggagtgtggccggtagaaggccctcgtcgcttccttctggagccagcccagccacacaacgttttccagatgcgtgagtctggtttgtgacatcccgttcccttctgccggttggtctgatgcaagaggaagagttacagttgctctgaattttattctcagctgaaaatgttagcacgtgtatctggatgaacaaaacagatgtggatgtatctgaggattgagggactatcaatgcagagttaatgttaatggttattaattgtgatatacaatactcaggtgaggagtcaacattcctggatttaaagaatctacagttttgtgcaattgtgatttgagaaactggaaacattgtgccaatggctttgagttcctataacaacggtgttaatttgattaactcactgatatcttttaaaaataatagacatttgcttcctacacctttttgtacatgacctaaagagtatattcccagaagctgctggtcagacacatttagggatgacagttgaagaggacttttttaaagctgcatgtgaatatttcctctgtgtgatttgtctgatgtagaaaagttttcccctcatttttatgagtaaaaacactaagtgggtggcaggggggtgggggttcttatgggagtgtcataccgcggcatgttacctgactggagactagagactatttccattataagccttcagaaacccaaccacgtctttactgtgtctagctttttaaatactgattggttagttttatttttgcccacagtttcttgggcaaaaaggttcttcattttgtctgaaaaagaaattatttgccagaggtatttggagcctctttgaaggggagatagagtgggggtgggttgtggggagggtggagttattggggttttggggttctgtttccatacaacattgtttatttccgattcctcagaagatcctttattatgaataacctcagtgtaatgttaatttcctgtccccatgtcaaaattgtcaccctaagcctttttttttttttttttttttttttttggagacgggctcactctgtcagccacgctggagtgcagtgacatgatcttgactcatggcaggcttgacctcctgggctcaaggaccacctcccaagtagctgagaccacaggtttgccccatcacacctggccgatttttatttttttgtagagatggggttgtccaggctggtctcaaactcctgagctcaagcaatgtgcccgccttggcttcccaaagtgctgggattataggcgtaaaccactgcacgcagcctaccctctgcctttttaagatgatgtatttatttaatttttgccatcattggtgcttcaccttcctgcgaaggaaattccagagcctgtatttaagctacctaggcttttacactccctttattgcctttccaaatagtatctcatttggtgtactctagtgtcctatacctcttggaaacgaaagagggcccaacctacaactaagaagggacaaaccttgaactaagtaagaccttacacacccagaaagaacactgggccctccttcttcagggacaatgcagtagccacttggcttgtggaatttactgaaggctatttcctgtaacttgctagttaacttagttttgtatttcaggcagaggtgcgctctgtaatgttgggcctttgacttcacagtactggagagctgttcacacagatgtttagacctttctctctctctctcttttcttctttctcaacaactctttcacagaggcagtcattttgaaaggttgaaatatttggcctttaccaaagagctttttttttccttaagcaaaatcctttcagaaagaaacaaatggggaagggcagattaagaatgcatatgtcccaatccacttctataggagtttaatcatattcacatgagtaaaatgatggaagaactctttaaggtaatcctttgggataaaggatcctgggaagttctctcaggtaaagaaagcttacagcagatttgtaatatatgtctggagagctatttataagaaatttaagaggattgttttgttttcctttattaaagatttaagcctttttactttgcaaaaagaaaactacaaaagttttatagatataactttgctaattttttaaacttttctgaaacgattagctgtagccaaattatgtggttacgttttgctacattagaatttgaaaatgcaatatgtgtggtaaatctactgtttgaaatttataatggtctctgatatgattcgaattttggtaacttttgaaagttattttccccctttagtcatggatttctatttgttttttaatgttaatttttctagaaagcatctgaattgactaggcttttcctatataaaaaactcaaaacttgttaactctgtactttaataaaatttaaaattaaaactgtgttgtttttttctcttctgctagatacatatataattaaagtactcaagttagttgttttgcagagatgttgccttcagatgttaatcaggtctctcaagtttcatggagtctatgctgatcctttaattgacaaataaaagatatatatctgtggtgtgcaacatgatgttttgaaatatgtatatattcaggaatagccaaatcatgctaattagcatatgcattacctcatgtttttgtgctgagaacatttaaaatctactcacagtaattttttttttctgtttttttggagacagagtcttgctctgtcacccaggctggggtacagtggcgcgatctcggctcactgcaaccaccgcctcccaggctcaagcgattctcttgcctcaacctcccgagtagctgggattacaggcatgtgctatcatgcccaggtaatttttgtatttttagtagagatggggttttgccatgttggccaggctggtcttgaactcctgactacaggtgatctgcccacctcagcctcccaaagtgctgggattacagacgtgagccaccgtgcccggcctactctcagaatttttaaggtacagtgccaggttcctaactctagtcaccgtgttacacagtagatctcctgaacttctggctgatattttgtgttctttgaccaacatcaccctgaactcccccctcgcccagtcccccacctccagcccctagtaaccacctttacactctgcatctcttaagtcaaacttaggaagtttgactttttaagatttcatggatcagtaagatcatgaagcatttgtctttttgtgcctggcttattttacttaaccgtgtcttctaggttcctccaaattgttgcatattgcaggagttccttctttttgaggctgaattttttattgtgtatatataccacttttcctttttttgagacagagtctcactctgtcacccaggctggagtacagtgacatcatggcttattttggccttgacttcttggactcaagcaatcctcctgcctcagcctcccgagcagctgggaccacaggctacaacaccaagcctggctaatttttgtattttttatacagatagggtctcactatgttgcacgggttggtcttaaactcccgacctcaagcaatcatcctgcctcagcctcccaaagtgctgggattacagacgtgagccactgcgcccagctcacttttttttttttttgagttagagtcttgcttggtcgcccaagctggagtgcagtggcatgatctcggctcactgcaacctctgcctcccaggttcaaggcaattttcctgcctcagcctcccgagtagcagctgggactacaggtggccgccaccacacctggctaatttttgtatttttagtagagacggggtttcaccatgttggccaggctggtctcgaactcctgacctcatgatccgcctgtcttggcctcccaaagtgctgggattacaggtgtgagccactgtgcctggccacatattctttatattcatttgtggacactcgggctgattctatatcttggccattatgaataatgctacagtgaacataggggtatggatatctctttgacatactgatgtcattccctttgggtatatacccattagtgggattgctggatcatatggtatttctactttcaggtttttaggtgttttttttgttttttttttttttttttttttttgagacagggtctcagtctgccaccccagctggagtgcagtggcacgatgtcagctcactgcaacctctgtcagcctccaggttcaggtgattctcccacctcagcctcatgagtagctggggttacaggcgcatgtcacaatgcctggctaatttttgtatttttgggggtagagatggtttcgccatgttggccaggctcgtctggaactcctgacctcaagtgatctgcctgcctcggcctcccaaaatgctgggattacaggcgcgagccactgcacccagcctgacttgagcactttttcatgtatctgttggccatttgtatgtcttttgagaaatacctattcaggtgctttgtcaactttttaagtgggttgttttcttgctattgagcagttttgagtttcttatatatcttgaatattaaccccttatcagatgttgtttgcgagcattttctctgatgctgtaggttgtctcctaactttgtggtttcctttgctgtgcagaagcttttcagtttgatgtaatcttgtctacatttttgttgcctagctttagtttcgggttttaacagctaagtctttaattcattgtaagttgattttttaatatggtatgaaataaaagtctaattccgttcttcaacatgtggctatccagttttcccagcaccatttattaaaaagacattccttctcccattgttgtgctaattgttgagaatataaatatgaaaccccgagcttgtcttcttcctctgaaagctgtggaccgcacttcctttttcctgcccttatgctggtgacaccctgtcctgatatatgagaattagagtaaagcatttttttttgtttttttgagacgaggtctcttgcctaggctggagtgtagtggtgtgatcgtagctcactgcagcctccaactcctgagctcaagtgattgttccaccccagcctcccgagggcttgggcctacaactcctgctctcaagtgagccttctctcttggcctcccaaagtgctgggattacaggtgtgagccaccacaccgggcacttaaccatttttaggtgtacagttcagtagtaggaagtgcatagaacattcacattatttggcagccaatctccagaactcttcaatttgcaaaacaactcattaaggaactccctgttccccacttcccctctcctgtggcaaccgtcatcctactttctgactctgaattcatcatttgcttttttttttttcttccctctgcttcttcccacatagatactgatagtcttcagctctcccagcttttgatttttgattgtgctatctagttgctatttttatgtagcaattcaggaagatccaaaaactatgcttctatcattgcccccatctcttccattcacacttgaactcgccacaataaagctttcacacacttaaattgaaaactgcttttcgaagtcatgggtgacttccatgttgccacgtccatcgtccttactttacttgacctatcagaagcactggacactatgaactgtttaaactgcactgcaaaccttattcagatttcatacactcatccttactttttgaaagggattctctattgtagttatctttttcctcctcacattgtacaaggaatgtgggaggcagataacttgtctttttagttcttgggtccctgcacccacagagccatccctgtggagccttatccacacacagctggacctgatttacttcctaactccaccttctgggtcggccttcctttactatttgaaaaagcgtgattgggcctggcgtggtggctcatgcctgtaatcccaacattttgggaggctgacgcgggaggatcacttgaggctgggagttcaagaccagcctgggcaatatggtgaaaccccgtctctacaaaaaatacaaaaattaggcgggcttggtggcatgtgcctatagtcctagctactccagggaggcagaggttatagtgagttgtgattgtgccattgtgctccagcctgggcaacggaggagaccctatctcaacaacaaaaaccctgatttgcagccaaatagtttcctcagcctatttcctgccagtaaatggttaggagcccagtggctttgttttgaacagtctttgtccattttagtccaagctagtggtgcttgtgttagttcagttctcttaaaaacattgtgagttttctgtggattttactgggattcactgtgttagataaaaaccatctccaccaatctttttaagatacgctccctctctggggtgcatgtcagggtgctgtgtgagaacacacttgttctttcagaagcctgtttgtctaactaaccatgagggtttgagaagcaattccttacatctttctgggattttaacaaagggcctcatgttgaccagaggccacgttttacttgtggcatcgaaaccacctttgcataaattataactgagaggattatgacaatgaaagagatgtgacctaacttactgatttgttcctaacctccaagctgtccttgttcattcctgggtgtaggctgaactaattttggaaggaacttaacttacagtttaactttgttttttgttgttgttgtttattttgttttgttttgttttgagacagagtctcactctatcacccaggctggagtgcagtggccccatcttggctcactgcaatctccacctcctgggttcaaacgattctcctgcgtcagcctcctgagtagctgggactacaggtgcacgccaccacgccagactaatttttgtatttttagtagagacagggtttcaccatgttggccaggctggtctcgaactcctgatctcaaatgatctgcctgcctcggccttccaacgtgctgggattacaggtgtgagccaccacgcccggcctatagtttaactttgaaacaaagatggtaccagccctttccctgaacaaacacccttttagcctgggaactataaactgcctttgcaggactaacaaattagctacaagattagaaattgtggtttaggagtcatgcagctggaggtggcaagattctaaacccctccaaattgctcctccagataacaggtattttggagaccctgcactcgatggatcagctgtccctaaccagattgataaattggttcatctggtcttgtggcccccacccaggaactgactcagcaccagaggacagcttcaactccctgtgatttcatctctgacctaaccaatcagtagtccccactttctgaccccctgcccaccaaattatccttaaaaaccccatcccaagtctttagggagactgatttgcgtaataatacaactccagtctcccgtacagatgactgtgtgtggattaaactctttattgtaattcccctgtcttaaattgagtctgcctaggcagtgggcaaggaaaattcgttgggcggttacagcatcttagatttgttctttgcctccaagttttattttgattttagaacacgctgctaactgactcagacagtcttgggccctctatattcttctaaaatttgcttgaaaggtgaacatttccctctttagtttatctctttctgtacattatcaactattacaagccacttggcattttcagcactctgcatgaaaatgtccttagccagttcatgaacacatgtaccatcttccacattgctacaagtgacagtgtaattgagctgccagtatgtaactcaggcccccttttctctagcccacaagagcaagagcaagtttttcctccctgttttaggctagtgttaggcctttcttgcattgctctaaaggaatacccaagactgggtaatttatagagaaaaggggtttatttggctcatagttctgcaggcagtataagcattggtactggcatctgctcggcttctggagaggcctcagtgagcttttactcactgtggaaggtgaagtgcgagcaggcacgtcacatggcaagaagaggagcaggtagggagaggtgccacacacaaccagatctcatgagaacttactattgcgaagacagcaccaagccatgagggatctgcaaccatgacacctcccaccaggccccacctccaacgctgaggattacatttcaacatgagatttgggagggacaaatatcaaaccatgtgaagacaccaacagccttctcactgctcttcagtcttctatgtgttacttggtcccaaacatgtagcaattggctttaggttttcattccagtagtatttcatgttctggtgccaatttttattccagtcccctattgctgtgtaatgtcaatctgaaagaaagaactaagggccaggcacggtggctcacacctgtaatcccagcacattgggaggccgaggtaggaggatcacttgatccccagagtttgagaccagcctgagcaacataatgagatcttgactctacaaaaaatttaaaaattagccaggcatggtggaaataaaaaaaaaaagaactaaggcaaatgcatataggtaaagagtttatttgggccaaatttgaggattgcaacctgggaagcacttatataccaagtccaggaggtgctccaggttggggtggttacaagcagattttaaggaacaacatgaggagatacaacaaggtggtctcagcatgttcatatagaaataccattagttaacagaaataagctaacagatgattagctaaggagtacagtgcttcttggaatagtcatcagtttgtgattaacccagacctggagttccttacagaagcaggagggggtctaggaatttcaggaaagtaactgtggggtctcgtgcctactcccctgtggcccgtgctatttagttcatctctatttgtctcttttgtcatcagtaacaaatcacactaaaacttaatggtttaaaacaacaattgctattatttgctcatggtttgggggtgaaaaatttgtgcagagcatgttgaacatggctcatctctgttatctggtgtccgcggcttcaactggctggcttgaaagctaggggctggcagaaatgctcaactaggccgaaatggctgggccttggttctcttctacgtatctttctccatatgccttctgggttccaagaaggagcatttcaagcggtgaaaggaaggcttctaaaacagttcctaaggcccagtctggaatttacagtattacagaatctagttacagaactagattctgttcgtcaggattggtttaggctcagcccaaattcaaggaaaaaggaaagagaccccatctcttcttaggacagtgacaagatcacattgcaaaagactatgtgaggtgtgagatatttctgctgccatctttggaaacacaatttaccacaccctcaaaatggcttcccgtttcctttgaagtaaaagccaaagactctacagtggtctacaaaaccctgcatgacccattccctatccctgcctcaactaccctctttgcccactctgttccagcattactggcttccttgctggtgttcaaatccaggaggtatgctcctccttccccctctcccccgcaggctctctgcacacactctttcccatactggaatgcttctcccttggatagcacttggcccattctgtcactgtatcagtctgttctcacgctgctaataaagacatacccaagactgggtaatttataaatgaaaaaggtttaattgattcacagctccacatggctggggaggcctcagaatcatagctgaaggcgaatgaggagcaaagtcatgtcttacatggtggcaggcaagagagtgtgtagggtctaccatttataaaaccatcagatctcgtgagacttatttaccactatgagaacagcatgggaaagacccagtcccatgattcagttacctctcaccaggtcccccccatgacacatgggaattatgggagctacagttcaagatgagatttgggtagggacacagccaaaccatatcagtcaccatcctcacactcttcctcaaatatgtattacattttcagtgaagttctccctgactattctatgtaagatttcactctctccctgaatttcctaccctactttactgctttattgttttctatagtacttatcaccatccagccaactatatacattttcttaccttttcagtttgtcttcagtggcactaaaattcaagctcccttaggggtagggatgtgttcactcctgtatccccagtgtctagaatgatgcctggtacataataggtgcttagtaaataggtgacaaatgaataaatgaacaaatggatggataaaagaaagatttgtggatggcagtagtgaaaaacaagacatcgtagtgccttgtgaaggacttttaaatgccaattgaaatgtctaaactctatttagggaatgggacataggaaagggtgatacttaggtagatagtggatgatatccttctaggcatatggaaagataaagataggtgctggaaagaagagatttgagtatctgaacttaaaacaaattatatcaaggttacgacaaaccgggaagatgtaattacagatagggccctgttgtattgcccaggctcaaactcttggcctcaaccaagtagctgggactacagacacaagccaccacaaccagcaatatatttagtaattaaaatgccttcttttttttttttgagatggaatctcgctttgttgcccaggttggagtgcagtggcgcgatcttggctcactgcaacctctgcctcctgggttcaagtgattctcctgcctcagcctcccgagtagctgggattacaggtgcctgccaccaggcccggctagtttttgtatttttagtagagttggggtttcatcatgttggccaggctggtcttgaactcctgacctcaagtgatccacccaccttggcctcccaaagtgctgggattataggcatgagccaccaagtccggctaaaatgctcttataaaccaataagaatataatagaaaaacagttggtcaaaaaaacatgaaactatccttcaatcttactagtaattaaggaaattttgtttcacttatcaaatggtgattaattttcaactaagcactgaagacgatattgaggaagactgcattttgtatgttgtggtgggagtgtggcttaaattgcctggcacatttagcaaaatgtatcaaaactgttaaaaaatgacacaccttctgacctcgcaattccaatttaaggaatttccctaaggagttaataatagtttcaactattcagttacaagaatatcactcaaatagagttcataaaagcaaaataatagaaataatttaaattcacttagaacatctatatatggaaatgttaacctagctaataaatacagtgctgtagaaaaatatcttattgaatgtgttctgaatgccttgtaaaaaataatttagacagctgttgccaggcacagtggctcatgcctataattccagctacttgggaggctggggtgggaggatcacgtgaggccaggagttcaagaccagcctgagcaacataatgagaccctgtctctacaaaaaaattgttttaaaacttatccaggcatggtgatgcacacctgtaatcccagctgctcttaaggctgaggtgggaagatcccttgagtgcagcagatgagttccaggctgcagtgagctatgattgcatcactgcactccagcctcagtgacagagggagaccctgtctctaaaacaatcaaacaaacaaacaaaacctatatacagtgctatccaagttatgcacacatgcataaacgtactcgtgtgcacatggacccaaaggaaatgtacccaaatgtttacctaccattacgtcttcacagcggcacctcctccctgcttttccctccttcatattttgggaagttttctagtaggagcagccatgtgttttccatacaactctcctgtcatagcttcagttaattgatccaagagtggactttccatctaagctggacaatcagtgtctttctggaaatttcttcgaaatggctgctgtcttgaaccaaggagtttggaaacttgaaagatgttgttagtgactgttttaagcatcacagacatagaaagaaagccaatctgcagaaagatataggattaaaacagctgtgcagaggagcaattgtggaagagaggagagggagggaaagagtaagaatgaatggacttcctggatttccttataatgttccagtctgcaactctaatccattctggaggcccagcataataaaataataatgatagccaatgtttattgaacacttaatgtgtgcttggcataattctcacaatgatcctatggatgttactgttctaatccccattatggcaatggaataaaggcaaacttttcttaaaatccttactaatttgctttcacagaaactgccagatctcccctctctccccagttccctttcctgcctcctcttttcttcactgcctcccctccccacaagatcttcccctttaggtcaatctttcctttccatatgcagtgctttctctgggcttctttatttgtataaccattatatcagtaaggaattgcatttgacaaatggaccacagggacttaaaaacctgggatgttggttcagcagctcaaggacgtcaggtcaaagattactgtggatttctggtttccccttgtggccccagcagctgctttgccaatccatctaatctgcattccagccagaagaccctgagggcactgggctccctggagaaaaattcattgcatgttttacggcaggaaatatcaagatgagtctggaaatatcttcttattgccagaaaacaaacatactttcaaagacccttggaagacaagctaagttatgtctagtcataaattttatctagaaataagttttgtaaccattatagtattttgtgtatatttttctgctttttaaggtaagtaaagagactgattcattagactcaaaatattagtaaaaatttataagatgttgataactaagtttgaaataatgttcaaatgtttaaattgttaaatctttaaatttataatttattaaatttgtaaggttaaactttttaagttcagtatgttttcagtgtttattaagattttgcctatagaaatgtgagtctgctttgttgtttttttccttgagaaatcaattaaaattagattgtagtttgaaatgtctaaaacttaattctgaaagtttgataaatatttgggagtaccttatcaaatttacaagccagttgggcattcatcaaaaccaaataaaagtagataataaaatattaacaaaactgatttataaattaacacaagtttaaagtcttcaaaattaagttttaaaacatataatttaaatatataaaatataagttgaaattaaagggagtatttatttcaatgcataaaggctctcttcagacataaagaaaactcagatgacattttggaggtaggtggtatcagtcagtgtcggctaagttatgctgtggtaacaagcaactccaaaaccctcagtggcttacaatgactaaagttcagttcttgctcacattgtgggctaccggtagctttgctctaagttttccatcctgggaccagcagtctgtatttgggatattgctggtttcatggaagagagaacgaacatagtagaaccatatgatgaatcagagcttctgcttcgaagtggcacacatcacttctgttatcattgcattggtcaaagcaagtctcatggccactcttgaggtcaaggagatgagaatatgtaatcctcccacaagaagggacacctcaaaccacatctctaaggctgatgcaatgaagtggggaagtattatcttccccagggtggggcagcaaatattttgagtaataaaatctactgtaatggggaataggaggtttttaaaaaattcttacaacttagttttttccctgtcacataggctgtcagtatatcctaacttacagaagtgattgtgattgtgtctgggtgttggaattatggtgattttaatcttcttctttgaaagtttttgatgatgagtatatatttattttgtagacaaattaacaatttttaattaaaaatttaaattataccaggcttggtatcgcatgcctgtaatcctatcactttgggaggtcaaggtgggaagatcacttgagcttaggagtttgaggccagcctgggcaacatagtgagaccctgtctccatttttatataaacaaataagcaaaaattttgatgaaaaatttttttgtaaccaaattaaaatttatgaatttcatttgtacaaaaaaggcagtggataactaacttgtttttaatattggaatggtagtatgtgcagaacagtgttttagaaaaatacatctcacaacattgaagaagaaaatgtatgttggagattttgtgttttagatatatctcaacctgtcagctttgaaagaatgtggctatgaaatggagtgtgtttgttaaagaaataagtaaatcagtaagtgaatgttggttagttgggtggagaaaggcttagaagcatctagcactaaaagatatattcttttgtggttatctggctgatgtcatgaaattctgacttataccaccagggaagcttacatttctctttggcagggaacttcaaatttagtacagtttggacctcactgcatagtcatagtaaaaacttttgtacttaattgactcttcgtttgcttctggttttatagtggccttcctgatgaaccagctttttataatccaaattggatctgtgcctacttaattgtttctgtcccaattctacttggtggtcaagactgaatcagattttcggttcctccttctcctctcgttttgactttccagtgtattcaactgaattttcatcataatgactccaaagtactcttctcttcctttgtcttgtggtcacaagaaaaatcacaagatcacattgatggatgactcatgagctcctcatctttctgatagagtctctgaactgaaccagcgtgagtctaggtttgcaggaaggcttttgattcagccttgtgattctcatgaatagatggcaatagaattaatttctctctcgatcttgcttttctttttcaactaataactttatttacatctattttcctccctacccaacccactgcatgtccttttcttgacccaggtgatgacgtttcttaaaccagtttgctcttctccgtatccaaagctgctctcgtaggtcaccattataactccacagttaatgcagcaactgcccagctgagtcttcccatcatcggacgtccccaatccattccagccatggtgagctttcaataatgcaaatcaagtcttcaaggtcattcctgtgtagaaagcccattgccttcttcatatacttacggctttcaagttccttcatatctagtctctgttcccctttctagcctacctcccagtactctcactccaatatagctcatgtcaaacagatactacttttggtttcctgaaatgcctttccttgacagtgaaccttgcttctgcctgaaacactctctctttccctatttctatcaagctccctgattttcaaggttcatttcgggcagcatgccctctaggaagcatttcttggcagcctgatcctctgcccagcctctcatctgatttaggccatagattgagcataacatgtttcacagtattgtaattgttcgtttatgtggtggtatctcctcacattgagggtagagattgtggttttggtttttgtgtttgttttatcattgtatacctagcacctagcataaggttgtgatgtacaattgtttgctatatgaatgaatgaatggatggatgccttcacaagaaaaatcgctcactagaccatgttggtcagtagcaggtactgggaggcacagagtcaagagtctagcacgtgacacatgacaactgtctcactgtgccatcaggaatggagtggacccctattgggatgtccatccccctaccttttttggttggaaccatccctcttctctcccctcccctccacacagtgacagggatgggcttctgattgccatgttcataaacaagactacctgcaactactccccaccctgggtgggagttgggcactgttagtaaattggtcaaggatggtgcctgacccaaggtggttcagtctgtgtccttctccaggaacttggaatcaggacgtacagagagttgcctctctgcaggtgacgagataagcacaggccctgtccatggtcatgtttttggccatttggaccagagaacccggtttgcaagaagacaagatttctaagatccaagctcggattgcttttccagactccggctctagggtcttcccatggctgtgcagctttcctgagcttgaggttccatgaaacactcctgcatccttacatgaaatttccttgtatttaagccctaaatctccctgaaaaacaaggactgtggaaataaatgaagaccacccaaataagaacaaacaaagcctactatagagaggttgcaaggtagtcagccaccatcacttgtgtttggcagacacttaaaggcaggcagaggtgtggaaaagccttgtggtagaaaaaagggaacactttgggcgtgccctgagactgttggcacggggaagctgcaagtgggccagctagaagtgcggcatgctatgtgattggttgggggtgcccatttggctttctctggttagtccaaagttggaggtaggggcaaaaattatgggagctgtcagtttattaatcgagtcctggccatttggggtccattgctaagggggttattgctttgcttcctggattggttactgcagataatatgttggcttcccaggctagttgccacagattgtgggtcagggttctattttgatatctagtctggccatccgcatattcagtatctcaggacaatacctctctctccttccttcactgggaaactttttaaaatcttctgaaatttacctggttaagtgcataatgtgtgcaggaacagtttcagctttcggaaagggaggatgttttagaacaagaggcacagaaacaaggatatatgtgccaggccaggaagcattattacaggacacgatatcagaataagctaccttccccttccataacttccagggctggtggaaaggggaggtcaatactgatggaccctgcacgttctcaggtgcaaggacccactgggagagtgaaggtgagcacattgggctttgaagtcattttgcttaactttgttttccttgacagcagctccgcttttaagttttggatttgggggctggtgagatggggagctggatcatctctgttcaaagagctgcagctgatgcccagactatgtcacattctcactataagggcaggaagctccctaacagacaactcagcacaaggaactgagcaaatgtaaagctaagagcatactcagatatcatcactctaacttccaccatctccccatgtcactttttattaataaaaaataagtgaggaagctaggcatggaggctcacgcctgtaatcccagcgctttgggatcctgggatcctcccagctgagatagaaggatctcttcaagccaggagtttgagaccagcctgggcaacatagtgagaccccatctctacataaaaaataatttttttaaaaaaatcagccaagtatggtggcatgtgcctgtagtcctagctactcgagagattgaggtgggagaactgcttgagcccacgattttgaggttacaatgggctatgatcacaccactgcactccaggctgggaaagagagtgagactccgtctcaaagaaaaattgatgacaaaacagattaagagaatgtattagtttttttattgctgctgtgacaaatcaccacaaatttaacaacataaatttattagtggacagttctgtagtcagaagtccaggcaggcttgcctgatttctatgctcaggaatagcacagggctggaaatcaaggtattggttgcagagcttttacctggaggcactgagaaaaatctgcttccaagttcattccaattattggctgaatccagttccttacagctgtaggtctgaggttcctctttccttgctgactgttaggcaagggccactttcagttccttgaggtattccttctcacgtggtgctgccatcttcaagcagcaatggcacttgagtcttcctcatacttcaaatctctccgaattccccttctgttgtgtaaagggctcttgtgattagatcaggatcacccagatcatctctgtattttaaggttgactgacttgaaactttaattacatttgcagaatcccttcacaggagtacctagatttgtgtttctcagggaggttatgatggttaatactgagtgtcaacttgattggattgaaaggattgatcttgggtgtgtctgtgagggtattgccaaaagggattaacatttgagtcagtgggctgggaaaggcagacccactcttaatctgggtgggcacagtctaatcagctgccagcactgctagaatataagcaggcagaaaaatgtgaaaagaaagatgggtctagcctcccactctacatctttctcccgtgctggatgcttcctgccctcaaacattggacatcagatcggcctgcagatggcctattgtgggacgttgtgatcgtgtgagctaatatttaataaactcatattatatatatatatatactattagttctgtccctctagagaagcctgactaatacagaggtcatccctagaatttgtcctactacagagagattgcaatttacaccatatgagaattgtgaatagaataaaatgtttgcacagatgctgggtactgtgtaattgttatttggaggtggagaaagggggtgaacatttcctgactgatatggtttggatgtgtgtcccctccaaatctcaggttgaaatgtgattcccagggttgaagatgggacctggtgggaggtgtctgggtcgtgggggcagatccctcatgaatggttttgtgccctccccgaggtaatgagtgggttctcactctattaagttcacatgagagctagttgtttaaaagagcctggcatctcctccccctctctttctctctctgtcgccatgtgacacacctgcttctgccatgattggtagtttcttgagtcctcaccagaagcagatgctggtgccatggttgtacagcctgcagaaccataaggcaaaataaacctctttttaaaataaattacccagtctcaggtatttcttaatagcaatgcaaaatggattaacacactgactataggttagttgtaaaatagatcccaaaagtgtatgatatagtttagatggcccctccaaatctcatgtcgagatgtaatcctcagtgttggaggtggggcctggcgtttgggtcatgggggtggatgcctcacgccttgatgctgaccttgtgatagtcagtgagtttttgtgaataactaggggacagcaatctcagggaggtcatcctgagattcctcaccaccacaccaactctcactcttgattctactctgccatgtgagatgcttgctctggctttaagtaaaagctcccttaggccaccccagaaactgagcagatgccagcaccttgcttgtgcagcctgtagaatcatgagccagttaaaactcctttcttggaaaaacagacaaacaaacaaactcctttcttggctgggtgcgttggctcatgcctgtaatcccagtactttgggaggccaaagtgggcggatcacctgaggttgggagttcgggaccagcctgaccaacatggagaaaccccatctctactaaaaatataaaattagccaggtgtggtggcacatgcctatagtcccagctactcaggaggctgaggcaggagaatcactggaacctgggaggcggaggttgcagtgagtcaagatcgcgccattgcactccagcctggacaacaagagcgaaattctgtctcaaaaaaaagaaaaagcctccaaaactcctttctttataaattaaagtctcaggtatttctttatagcaatgcaggtatttcttttctttttttgagacagagtctcactctgtcccccaggctggagtgcagcctgaaactcggctcacgcaacctctgcctcctgggttcaagcgattcttgtgcctcagccacccgaatagctgggattacaggcgcctgcccccacacctggctaattttttgtattttcagtagagatggggtttcaccatgttggccaggctggtctcaaactcctggcctcaagtgatcctcctgcctcagcctcccaaagtgctgggaggtgtaagcccccacgcctggccatgggtatttctttaaagcaactatattataacctaatatggtatatgagcttatttctcgtttgcagaagagtccaaggcaggcattctagttgatggatagctttcccctacctagtaactcaggcatacaggctccttccatgttgtagatccccagttccctagaacctgtcacctgcatccaagtgatgtaagacaaaagaaaacctggaggaggcatatctgttccttaagcctttgccaagaataggtactataacttagaaccatatccccttggtgagaactagtgtggccgtgcctggctgcaaagggtgctgggaaatatagtctagttgtgtatgaacaagaagaagaaatggattggtgaatagtagcagtctctgcttcaatctactatgagcaggcactttacataattatcattgaattaacaccactaccctgacaggtatagccccccctttatagaagaggaagttgagatccaaaaaaatgaagtaacttgcccaaggtcccacagctattatgtggacgacccaggattggaccctatttctgtttagtttccaaactcttactctttccagtattacatattgactcctaggtagcaagcccctacctaggttggactataatttgattgctatggttgaaccagaattaccaaagggggttatttaaaatggttggttcctatccccactctgttgaagctttgtttaaccagcctggtagaggcccaaaaatgtgcatttaaacaagctctctgggttattcagatgtgctgtaatgtttgtaatataccagaacagctttcccttctgggatggggaaatcattaaggtaaattcccagttgccatctggaaaagtcctcctctctgggatttgggatcataatctatttatgaatttctggaacttctccagtgtagctgaccttccatctgtaggaatggcgtcatgtggagggattcaaagaatagttaacaacagtgcagtgagtgcagttagttctatgtgcctgccctggtggccctgttctctgctgacaaacccacccagctgatccctgcactgcttagattggggtcactattgggtgcctctaattcgctcctttagatccctgtggaatcttacataattggtgatattggctgtctaggccactggttcagccagtttgtcaccccaccttcactaaggatagactgtttgcagacttgtgctagacttgtgaaggaagcagagataactccagctcttaagagcttgtagactagtggggtaaacctaccactagtaatgagagctaccaattatccagtacttttaacatattagcttatttaattctttcaaacaaccccgggacatagcattattggcattattggcccttttccagaagctgaggttcaaagatattaaataactgaatcaaggtcatccaactagtgagtgatggtggggctggtattggaatccaggtcagtctacttctaaagtccatgttcttaggtactccaagtagtggaccaaatgttggtgtaatggactgaatatttatatctccccaaaatttatatgctgaaatcccagcccccagggtgatggtatttgggagatgattagttcatgaagatagaaccttcatgaatgaagctgggtgcagtggctcatacctataatgccaacactttgggaggccgaggtgggtggattgcttgaggccaggagtgcgagaccagcctggcagccttgtcaacatggcaaaaccccatctctacaaaaaaaaaaaaaaaaaaaaattagctggacatggtggcatgcgcctgtagtcccagctactcaggaggctgaggtgggaggatcacttgagcctgggaggcagaggtttcagctagccaaaattgtgccactgtactccatcctgggggacagagtgagaccctgtctcaaaagaaagaaagaaaaaaaagagactagaagccttataaaaggaagagagatccctggccccttccgcaatgaggacatagttaaaagacctcaccagacactacagcttccagtgccttgatcttggacttccaagcctccagaactgtgagaaataaatgtttgttgtttgtaagctacccagcatctggtattttgttatagttgcctgaacagtctaagatagatggttcccaaaaagacgtctacatcctaatttccagaactgtaaatgttaactttgcagacgtaatgaaattagggatcttgatttgaggagatcaccctggattagccaagttattattattattttttttttgaggtggagtcttgctctgtcacccaggctggagtgcaatggtgtgatctcagttcattgcaacctccgcctcccagtttcaagcaattctcttgcctccacctcctgagtagctgcaattacaggagcccgccaccacgcctggctaatttttgtatttttagtagagatggggtttcaccatgttgaccaggctggtctcaaacccctgacctcaagtgatctgcccacctcggcctcccaacatgctgggattacaggcatgagccaccatgtctggcatgacaagtgtttttataagagacacactgaggagaaaacagacacagatgagatgataagaagactaggtagaaattggagtggtgcagctacaagccaaggcatgctgacagccacccaaagctggaagaagtaagtaatagatcaccccctagatcctttggagggagcacagccctgacaacatagtactttcagacttctggtcttcagaactgtgagagagtaactttctgtgttgtaaatcactggtttgtggtctttttttttttttttttcagtagccacaggaagactagtacattctatttgttttataagagcaaaaccacaaggcagcatataattcaaggctgaaggagtgtggcatgctgacagatggtaagaaaagctgaatgtcagagaaagataccaaatccagtcagtggctctgtgtgattatcagttagtatgtgtccttttctcttgtgtccaacttacatcatcaccatcacctattattgagcacttaatatgtgctaggtaccaagctaagtgctttgcctagatcacctcagttaagcctcgcactaattctatgaggtaggtgccaatatttgcctattttacaaatgaggaaactgaggctcagagaggtgaggtcccatctgcagttggactgtgagtaaacggcagagtgaggaccagaactcaagtgtgtcttactgcagagtcttggcttacgcagttcctagccatcttccgtgttagtttgttcttctgcatatagtcattgtagttaagagctctgggccaggcatggtggctcacacctgtaatcccagcactttgggaggctgaggcgggcggatcgcctgagatcgggagtttgagaccagcctggccaacatggcgaaaccccgtctctactaaaaaacacaaaaaattagatgggcctggtggcactcgcctgtaatcccagctacttgggaggctgaggcaggagaatcagttgaacctgggagtcagaggttgcagtgagccgagattgtgtcagtatactccagcctgggcgagagagcaagaccccgtctaaaaaaaaaaaaaagagctctccagtttctggtcaccagaaagtcacttgagccagtgggggtggaatgaggcctggctctatgaacctgagtcgtctagtgtaggacatccccctccaggccagagcagcctgcctctgtggatgtttgttaatgaacgagtgaacatatggttgggctgccagcagagctctgcctatctcagggccacaggaggcatttatgtcatcctcttggtaggtatgccactagcgtctgagctcagttactgagcttcttcccactgaggagaaaaggcaggtaagcctggctctcactctctgcctcacccactaagcctggagagtggggaaggaggggtatggagattatagcatgcaagtcccagggaagggaacggagaaaatggactgaagtttctgataaggttcatagtgatctggatggcctgggcctgtcccattctctgtccaggaagaggaagggaacacaaggtgagattttgatttctattttgttcccagaaactatcaatgctgaagacttaaggcctcttaagaataccctttttgcaagaggggatggaaacatctctggccccaactccgacaggaaagcctggttttagcattgaaaagatgattgaatacagcttgccttttctccagggaagagagacaagatggagtgccagagaggcctacggcaaggtgcctatttttgcattgctgcagcaacgtggaggctttctgccctgcctcacacccctcatccatcagccccagccttccccatcatggttctctcagatgaggcctgattgttgatttctttcacgtgtgtgtggaattaacatcttctatccctttcaatgttgaattaacttagtgacgaactcattaaggactccttatcaaggctttccctcctttctataattttatccattgtcagctttgacagaaatcccactgaaggtttgtcaaagagccattgaagagttctaagtggtcttgcttgcagagggcaactgcacttgacctctatttatactttttgtagtactcttgcctggactcagagatgcaactgggattgaaattatatttaccaaacatcaacatattgatgttagaccttaaaagaagaaaacgtaaaacagcatacagtctttttgcagtaaacagtaaactcaggaaatttttattcattgattccttccttcaacaaaattatggttaagaatacctgctatttgtcaaattctaagattatgaaatagaacaaattctaccctcaacttactcaaagtctagacagggaagcagaaaatagcaaataattactatatgttgtgatatgtaccacagcctgaagagaaatatactgaaaactgagaattcaaaaaagattgaattaatagttggtgggttcataataagcaactacagtaaatgaggaatattagagggttattctgaacctgctaaggtcattggagagacaaccttggatgataggtctggttcctgggtgggttttgagcaaggcttgggctggacctggggtgcatttgagctataccgtgtgcccccagtttcaccctagcagtgatggtccttggcagcagtttatctgctttatttctccccacccatttttatagtaaaacgtctgctaaaaatgatgtcagtaaaagcagtcgctatagtgaagttgaatgtcatttctgggacactgggtgtgtaacagttgcatgtagggagtgggtggctccactttccctaatcaaagacagggaagtcctggcattgagccaggagggttgggcaactggattgggcggcagaaaatcagtcattgtctctgccttttccctggtttatggagtgtcacagatccagagacacacatttcttgtctataaaatgggaataatgtttgcttccaccttactcatttaaaaacatttcttacaattcctagtcagagttatttgtcaaaaagcttttgtgggtggtgatatggtttggccctgtgtccccacccaaatctcatctcaaattgtaatccccccatgttgtgggagggacctggtgggagtgattggatcatgaaggcggtttccccaatgctgttcttgtgatggtgagggagttctcacaagatctgaccttttttttttttttttttgagatggagtcccactctgttgcccaggctggagtacagtggcatgatcttggctcactgcaacctccacctcccagatgtcaagcgattctcttgcctcagcctcccaagtagctggggttacaggcatgtgccaccatggtgagctaatttttgtatttttagtggtgatggggttttaccatgttggccaggctggtctcgaactcctgacctcaagtgatctgcctgcctcaacctcccaaagtgctgggattataggtgtgagccactgcacccagccgtgatctgatgatttaagagtggcagtttcttctacatgctctttctcttctgctgccttgtaagatgtgccttgcttccccttcaccttctgccatgattgtaagtttcctgaggcctccccagccatgcagaactgtgagtcaattaaacctcctttctttataaattacccagtctcaggtagtctttatagcagtatgaaaacagactaatacagacggccaacattttggttaggtgaagacgtttagctttcagttgtttgtttgggcccactccttgtaacttagcatggagacggtgctgaagaaatggggctagggcaggtcattgttaattgagggaaggatcctgggaacatcgggttatcttgaggacacccagagatgggagtgtgaatggaagtacccagagtctggcagcaaaggcaccaggcctggggagcctcgcccacaggcatgggtgggggggcacacagcatggcagaggttatgggtgggtgccatcaggtggtgatgcatgatatagtttggctgtgtccccacccaaatctcaacttgaattgtatctcccagaattcccacatgttgtgggagggggccagggtgaggtaattgaatcatgggggccggtctttctcgtgctattcttgtgatagtgaataagtctcatgagagctgatgggtttatcagggttttctgcttttgcttctccctctttttctcttgctgctgccatgtaagaagtgcctttcacctcctgccatgattctgaggcctccccagccatgtggaactgtaagtccaattaaacctctttttcttcccagtctctggtatgtctttatcagcagcatgaaaacaaactaatacaatgcatatcccctcgttccccatccttgctctcctgaaaatgagagcactgaggatgtgtccagacccgtcacagaagaaacatgaatggctatgccactcagaaaaaaatgttcagccacacgagagtcaagcagaatgcagactagaaatgatactagttttacctaccaaattgggaaaaaataaaagaagataatggacaatgctgatcatttcttgaaacaggcactatggctagaggggatgaatttgttgaagctttctggaaacaattcaacaacatctatcaggaactttaagaatatttaaccttttgttccaatatcccaatcctggaaacctattctaaggaaaaaaagagattatagggttagagatttcaataaaaacatggccagaataaaattatttatattggaaaaagaattaaacaacttcaatggccccaaatagggcaagcattaagtaaacaataaaaatatccataggggagactattatgcagctattaaaaaaatcatactatttttgagacacggtctcactttattgtccaggctggagtgcagtggtgcgatcacagctcactgcagccttgaactcctgggctgaactgattctcccacctcagcctctcgagcacctgtgactacaggtgtgcaccaccatgcccagctaattaaaacaatttttatttatttatttattttttagaaatgaggtctcattatgttgcccaggctggtcttgaactcctgggttcaagtgaacctcctacctcggcctcccaaagtgctgggattacaggcgcgggctattgcacccggcctaaacatcacatgaaggggtggtttgcccctccacacctgtgggtatttctcgtcaggtgggacgagagactgagaaaagaagtaagacacagagacaaagtatagagaaagaacagtgggcccagcagactggcgctcagcatacggaggacctgcaccagcaccggtctctgagttccctcagtatttattgattactattttcactatctcagcaagaggaagcggcaggagaacagggtgatagtggggagaaggtcagcaagaaaacgtgagcaaaggaatgtgtgtcacaaataagttcaagggaaggtactatgcctggatgtgcacgtaggccagatttatgcttctctccacccaaacatctcagtgtagtaaagaataacagaataaagaataattgccgccagcatatctcgcctcctgccagtgtggttttctacaatcgggttttataccgagacattccgttcggtatgagacagaggccttcctcttttactaattctcctcagcacagacccttcacgggtgtcgggctgggggacggtcaggtctttcccatcccatgaggacatatctcaggctgtctcagtggggaggaactttggacaatacccggttttcctgggcagaggtccctgcggctttccgcagtgcatcgtgcccctggttaatcgagaatggagaatggcgatgacttttaccaagcatactgcctgtaaacatattgttaacaaggcacatcctgcacagccctagatcccttaaaccttaattccatacaacacatgtttctgtgagcacaaggctggagaaaagttacagattaacagcatctcaaggcaaaaccattgttcagggtacagatcaaaatggagtttcttaagtcttccttttctaaatagacacacttgtgataccctaacttgtattaacctgattgactctctcttagctgagaaacctgaacggactccatttggctccttcatttgcaagacatcaag

SEQ ID NO: 133 - DNA, 52690 bp, Homo sapiens
tgaggggcgaaccaagatggcggcggttttggctgtgtgaggaagacggaagagacggcggcggagggaaaccgacttccactagtccgggtcgcttgggcggccgggggccctcagagtctcccgggcagtggtagcagttgcagcaggatcaggcgcctgtcggcttctgacgtttaaaacagggggagcggaagggagccactggccgcggtggcagggccaggtataaggaaggaaaatatggcggcggcggcggcggcctgaggaggcggcggcggcgcgggaagctgcttcgcggagatcatggcggaggcgggagcagggcagtgacgggagccccgagttcctagcgctgcggggcgggaggctacgaagcgctgcgcggccccctcggggctgccgggcgccgggctcgccaggcctggacaatagcgccggggagccggaggcgaggaaaggcggcggcccagagctcggtccctggagcgggccatgcaggcggcggcgcggccccgcggcgcccagcggcggcagtgaggccggggagccctccgctcgcgggcgccctcacgcctcgcccctcgcctctccagggcccctttcctgggcgtctactggcggggcccccgccccggttcccgggcggcacgatgaccgacacccggcggcgggtgaaggtgtacacgctcaacgaggaccggcagtgggacgaccggggcaccgggcatgtgtcgtctggctacgtggagcggctgaagggcatgtccctgcttgtcagggctgagagcgacggtaagtgaagccccgcgcggcgggaccctcgcagcccccacggccctgggccgcctccctggttcttgcggggcatggcgctcgctccacgagaacagagggacggctggggagggcggccacctcgggggaggacgggccccaggtaccccagtcttgcgggagctccccggagagcgcttgaaatgtttcctttctctgagtgcctggtggcattttgggtacgaggagagccaagcgtgtttgagctgtgccgccctggagtgtggagaggtcgaggacctgagatagggagtccggagtgtgctgttcttttgcactagagtgaccttgagaaagacactgattaatccgatctgctgccttagttcacccatctgtaaagcaggcatgaaactttgcttggagctaagaaagttcttggacctttcacactttgaagaacgttttgctgtgctttttttgtttttctttttaaacatctttttgctacatgtttctgatcgtgttgaagcttggcaacactgtatctggcaactctacactaagagaaaacgctttcccttgcgaagattttcgttcaccagtgttggttgtcttttttatagtaatgcagaattttgtgtgtagcttactatataaacatcttgcaaagttggaatcatatgagctttttttgattgcttaaatgggtgttcataatttggttaacaggtgcagagaagttggcagataatttttaaaacctttcggatcttccctagtgtttatgcttcacaaattttgaaacagccctcaaggttcaaagactaagttgtttgaaaataagtgtttcacgttttttcttttttccacatgtgctgtttcatattttaaaaggcttattctctgtagggattgccactgtttttggcgatatacagtgaatttcacttaaaatactcaagtggggtaaaactattctcaaattgttacttccaaacgtgaaagtaagttatcttccacttctttttgtacattagtttatattttgcagttgctaacgatgccagtttattatgattgtagcgattctgtatctgaattattgcaaactaatttcaaggaattttcttcaattggactctccccagaactccaattccatgaaaaaccaacaagactagcccttctgtaattgaagactctgggaatattgatgttctatttaaattgaaagtggtaatctggagtatattgcccacaggttataaggttacccaaagtaacttaaatctggagagaaattattttcttttggaggcatttaaaaatttttgaatgttgggtgtatttttctgggcctgagttattggcttcttaaaatacaatttgaatgtcaagtgttagtgtaattttgtatgtgactcacataataacctactctagatctttcacacatttggaaaactttacatagtatgttggaaggtatggactttttgtatcagcttcttatgagatgaaagtatccgtagatttctttttaattttttactttcaaaaaaataaaaacaggattttgccctgttgccaaggctggtctcaaactcctgacctcacgcagtccacccgcctcggcctcccggagtattaggattacaggcatgacccccatcccagctgaaagcatatgtagatttgagatcaatttattgaaatccatattaaaaataatacatataaccttcacatcatgtgtttaatttgattcattatacaaaaaatcctttaagatatttttaagtataaaagtttaatgtcgtactatcagaagtatgcttttctgcataattaatataagcaatttttttccgtgtatatattattatagtatatataatagtatatataactatagtatgtataacatgtatatataactatagtatgtataatatatagtatatataactatatataatatatagtatatataactatagtatatataattatagcatatattctatatagtatatataactatagtatatataattatagtatatatactatatagtatatataattatagtatatatattatatagtatatataattatagtacatatactatatagtatatataattatagtatatatactatatagtatatataatatgtatagattttttttttgagattgggttttgctcttgtctcccaggctggagtgcaatggcaccatcgtggctcactgcaacctccatctcctgagttcaagcaattctcctacctcagcctccttagtagctgggactatgggcatgtgccactatgcctggctaatttttttgtatttttagtagagacggggtttcaacattttggccagtctggtctcgaactctgtacctcaggtgatccacccgcctcggcctcccaaagtgctaggattacaggcgtgagccactgcgccgaacctccatttatatttttaccattttggaaatagccacaaatctctcttcctccattttgcaggttggaggttaaatgactaaaacaaaatgactttaatttttatctagcagggagagcttaactaaattactgatgtgcccttgtaaatttaggctgtaaggaaaactgaatgcaaagaatggacttaggctgggtgcggtggctcacgcctataatcccagcattttgggatgcccaggccgacggattgtgtgggctcgggagttcaagaccagcctgggcaacatggcgaaaccccatctctacaaaacatacaaacattagctggtgcggtggcacgggcctgtagtcctatctgctctggaggctgaggtgggagggtcacttgagcctaggaggtggaggctgcagtgagctgtgatcatgccactgcactgggtgacagagggagaccctgtcacacacaaacacacatacacacacaccatggacttagaaaaaattccaggatacttgtgaaatactgtcagtaatctttagtcgatgattaacatttcttgtcacatctaaatagggataataagtcaaaatttactgactacctactatgtgccaaactcttttagcagtttacttatattgacttacgtaattcttacaacagtgtctgatttagtgctattaaccatattaaactcccatgttactgtctacttgcatttgctgctttattagcctgaaggtttatttcaaagaaaatgaaaattacttttagcctaaagatattttcggccgggcacaatggctcatgcctgtaatcccatcacttagggaggccaaggcgggcagatcacaaggtcaggagatcgagaccatcctggctaatatggtgaaaccctgtctctactaaaaacatacaaaaatgtagccaggtgtggtggcgggcgcctgtagtcccagctgctcaggaggctgaggcaggagaatggtgtgaacacaggaggcggagcttgcagtgagccaagatcagcaccactgcactccagtctgggtgacaaagcgagactccgtctcaaaaaaaaaaaaaatttcaattatagtttatctacaagctttacatggatgtttttgtgttgactgccagttggggtcagccattattgtgtgcttgctccattctccatcataggataattgatattttctttttgttgtcatgagcaaaatggaaagtatttctgattttccataaattgagtcatttgtccaatagaaacttaaaattattgcgcttttccatacttgggctagacctagtcattattgtgttgaagtttttcttttctaaattacttgtagcttttccccaaaaaaacttttgattttcagattatttctttagaacaaaataaatatttgattcttaacacttttcaagtatttattgtctgtaaaattaagtttttgtgatgtgttaatcatccaccttagaaataggctatcagctaatttggtggtcagtgctagagatagtgtgataggggcttttgcatacctgtgaaataaatggtgtgtgttttttttttttttttaggcagaatctctgtcatcctggctggagtgcagtagcatcatcttggctcactgcaacctccaccttccaggttcaagggattctcatgcttcaagcctcaagcctgggattacaggcgtctgccatcatgcatggctaatttttgtgtttttagtagggacacggtttcaccatgttggccaggctggtcttgaactgctgacatcaggtgatccgccctcctcagcctcccaaagtgctgggattacaggcgtgagccaccacacccggccgcgtttcttttttttaataagttctctcagaaaggatgacaacatgtccaaagtcattcatctattaagatggtatgagttgggattcaaattcaggcaattcattttaaactgtacacactacttagtaatgacaaagcgtttgggaattttataatgtatatagtgttagcatgggtatagaaaggctgggtagttttaaaattctctcattattgggtctatatttgtggacggggaagctataataatgctatctcaactgtaggctcagttcttgttaggggagcttatatgctcgtctaaaaatcacagaagagaatttctaaatggaagtacttgtggccttcatgttacagagcagatctgtcatggtaagtactgtatgccttcccttccaaaaccgagtaacttggcactcaacctaccttgctttagaggaaaagggatgtcccactaagcttctgggcccatttcttggattgcatctttatccagtaggtttctgctggcaaaataggttgtaagaacacgtcccttttgttttttgttttctttttttttttttgagtcagtgtttcgctcttgtcacttaggccggagtgcaatggcacaatctcggctcactgcaacctccgcttcccgggttcaagcgattctcccgcctcagccttacgagtagctgacattacaggtgcctgccaccacgcctggtgaatttctgtgtttttagtagagacgaggtttcaccatgttggccaggccgatctcgaactcctgacctcaggtgagccaccgcaccctgctctttttcttttcttttcttttcttttttttttttttttaatttttaagagctctgttgcccatgctgtagtgcagtggcaggatcatagctcactgtaacctcaaacttctgggctcagttgatcttcccacctagctgggattacaggtgcacaccactgtgcctgggtaattaaaaaaaaattttttttttcttttttttaagagatggaagggggtgggtcttactttgtcgcccaggctggtctcgaactcctgggctcaggcatgagccaccatgcctggtccaatttttgaattttttcaaaggttctcactgtattgcccagaatggtctcgatctccagatgtgaagtgatctttcccacttggccgcctaaagtgctgggattacaccgcacctggcccatgcttttctttaaggaagatagattaccttatttctctcagtttttatgatagccgtatacctgcaaagttccatcttccatttcagattattttgtttttatttttaattctttcagtgtatgctgtgtctgttaacttgaagtaaggataataatttcataccttgcttatgctctccctttgtggtgaaatcattatactacttttctttcttttgttttttcttcaacttttattttaaattcccgggtacgtgtgcaggtttgttacataggtaaatgtgtgccatggtggtttgctgcacagatcaacccatcacctaggtattaagcccagcatccattagctattcttcctgatactctctctccctctgcccctttgtactacttttcaccattatgatttttaccatatccacctgccagttttacagttgataaatgcaaggctggggaacaaagtgagaccccccatctctacaaaataaaaatttctaaattagccatgtgtggtgttaaacacctgtagtcccggctgcttggggctgaggcaggaggattgcttgagcccagaggtcgaggctacagtgagctgtgactgagccactactccagcctggctgatgaagcaagaccctgtctcagaaaaaaaaaaaatgtagctcgggcacagtggcccacatctgtaatcctagcactttgggaagccaaggtgggggaggattgctcaaggccagaagttcgatacctgcctgggcaacatagcaagaccctgtctccacaaaaagtttagaaaattagctgggcatgtggcacatacttgtagtcttagctactcaggaggctgaagccagagaattgcttgagcccaggagtttgaggctgccatgaactttggtcatgctactgcactccagcctgggtgacagaatgagaccctatttctaaaaacaaaaaatttaaaaaagaaagaaatgtaagggagttggaattcctccacacactgaagagtgtctttggccataatcatatttgtgctccttattacgaagtacttgccaaggcatccagaatagtgtgcttacattgagtttttaccttgaattttataaagtattctttacatttcaaaatagttttatctgttctctgactcatatcttagagttaaacaggttaaattctcactgttacttgaggcatgaagaaaatgagacatggagaaatgtttttgttcaaggcagcactgctagcgaatggtaaaactgggattctgtgctgtttctgcctcttgatagaactccatgttcattgtaggtgggtctgcctctatccctactgtgattagaaaaggaggtcagaacacttagggtggaaaagcttttgggggtaagagctgtgagagaaatgaacagatcagtcagtagtatagaatcttgtatatgccaagcattctgtatatttatcaagaagagctcagtgtcggtacaaggggaagtatttcactttgaaaagtttgtttatttagagacaaggtcttgctgtcacccaggctggagtgcagtgccacgatcatagctcactgcagcctcaaactcttaggctcaagtaatcctcctaccttagcctcccaagtagctgggactgtagacacatgccaccaggcccagctgatttatttttaaattttttcaggggaggtgggatcttactgtgttgcccagactagtcttgaatttcctgcctcaagcaatgctcctacctcaccctcctgagtagccaggattatagctgtgagctaccacacctggcccattttagtttttaaatgccactatgtaatgaggcatttaaatttttttccgaaaagtcaggaaagaaggacttggagcacatacctgttacgggtttaaagcatactttagtcttggccgggtgcggtggctcacgcctgtagtcccagcactttgggaggccgagatgggcagatcacgaggtcaagagatcgagaccatcctggctaacatggtgaaaccccatctctactaaaaataccaaaaaaaaaaaaaaaaaaaaaaattagccgggcttggtggcgggagcatgtagtcctagctactcaggaggctgaggcaggagaatggcgtgaacctgggaggcggagcttgcagtgagccaagatcgcgccactgcacttcagcctgggtgacagagcgagattccgtctcaaaaaaaaaaaaaagcacactttagtctcccacctacatgagattttgggccccattgacttttctttttttgaggcgggatctcactcttttgtccaggctggagtgcagtgatcagggcttactgcagccttgaccaccagactcaggtaatcctctcacctcagtgtcccaagtagctgggaccacaggtgtacaccaccatacctggctagttttttctgttatttttgtagagatggggtcaccttatgttgcccaggctggcattaactcatttttgatggtgcattctctctactaatgaagcatagtacataagtccctgccttaagccttgaatattgataaggacaatatactctagaagctgatgggttgagctgcttgcttaggagtgacaagggtgtagctcttctttctgaaatccttcagtatttatccaaatcagggctgtggtgaagaccaaagttacttaaacccaaacccaaacactcccatattacttccctgctacctgagtctagttggttgatagtgaagataaaaccataaaaattacaggaattctctatactatctcgtttcttcagtgagaggaagttaaatcttctaaacaagtgaattttccagatgaataaaagctgtgtaccagaaggtgttttttgggtttttttgtttttaaattttagagacagggtcttggtctttcacccaggctggagcgcagtggtgtgatcatagctcattgcagcatcaacattctgggttcaagcagtcgtcctgcctcagcttcccaagtagctggtactacaggcacataccaccatgtccagctaatttttgcattttttgtagagacagggtttgccatgttgcccgggctggtcttgagctggtctccaattcttggcctccagtgatccacccacctcagctttccaaagtgctgggattacagtaatgagccaccatgcctggcctaccataagttttaaaagtcagtaatttttttatggaatgttgactaaatgtgtactggaatgtttttcctaaacagtaaatgaatatattggttaacctcttattcgtaatgtgtttatgggtcattattaatgcttggtgtttatgggtcattattaatactcgttttcctgctatacaacagtacagtgttaccagtgaaatgactgtatgatgatgccctaaaaaaacaagtattgaggccaggcgcggtggctcagcttgtaatcccaagcactttgggaagccaaggcaggcagatcatgaggtcaggagatctagaacatcttggccaatatggtgaaaccccgtctctattaaaaatacaaaaattagctgggcgtggtggtgtgcgcctgtagtcccagccactctggaggctgagtcaggagaatcacttgaacccgggaggtggaggttgcagtgagccgagatcgtgccaccgcactccagcctgacaagagtgaaatccgtctcaaaaaaaagtattgagtgctggttatgtactacatattgggacaggcacttgaataaaaaatttcagttaatgctaatggcaaccctgtgaggtaggtattatttttttcttaactataaatcttgttgtattaacttgcacctggcaagaaatctataatttttatgcaaaacctttccttttaaaaatatttgctgagttctctgtaatgtagactttgttagaaggatacctcactctgtactaccagccatctttatctccaatccccagaggtgtagtgttgtgttgtgttttggtgggggttggtagcaccctacaagaaagggcctcacatttcattttataggaagaaccaagatatgaagcagggagggaactttttttttttttttttttttgaggtggagtctcgctctgtcacccaggttggagtgcagtggtgcgatctcggctcactgcaacctctgcctcccgggttcaagcgattctcctgcctcagcttcccgagtagctggatttacaggcacgcaccaccatgcccagctaatttttgtatttttagtagagatgagatttcaccatgttggccaggctggtcttgaactcctgaccttgtgatccgcccgccttggcctttcttatattttttcttgctattggaatgtgacagtttctacctgcagttgtcttggtgatgttctgagtcgcatttctccttttgacattgttttcccatttcctaattgtaaacacctctattatcagtatatttgggacatcaattaatgtcaggatacacagatctcatttaaaagtagtgtagtattccactgtacttattcacacagtagcttgttggtggcacagtgtagcattcctcgaactttttttctcaggatacctttagacttttttttgttttgttttcatttttatattttattttgtttttttcacacagggtctcgctctgtcgcccaggctggagtgcagtggtgtgatcagagctcactgcagcctcaacctcctggcctcaagcaatcctcctaccccagcctcccaagcggctggaactatgggcctgtaccaccatgcctggcaaatttttattttttgtagagatagaggtctcagctgggcgtggtggctcacatctgtaatcccagcactttgggaggccagggcgggggcagatcatgagatcaagagatcaagaccatcctggccaacatggtgaaaccctgtctctactaaaaataaaaataaaaaaattagccaggcttctttttttttttttttttgagttggagtctcactctgtcgcccaggctggatggagtgcagtggtgccatctcggctcactgcaagctccgcctcccgggttcatgcaattctcctgcctcagcctcccgagtggctgggactacaggcgcccaccaccacgcctggctaattttttgtatttttagtagagacggggtttcaccgtgttagccaggatggtctcgatctcctgacctcgtgatccacctgcctctgcctcccaaagtgctgggattacaagcgtgagccactgcgcccagccaaaaaaattagccaggcttaagtgatcctcccatagcagactcccaagtacctggggtcattggcgcgtgccaccacgcccagctagatacctttatactcttaaattgaggattccccagatgtttatttggattgtatttatcaatatttaccatattagaaattaaaacagactttaggaaaaaaatcacttaaaaataatgttctaacttagcatgttaacaaaatatcattaagaaaaaataacttttctaaaataagagtttaatgagaagagtgtctttttttttttttctttgagacagagtctcactgtcaattaggctggagtgcagtggcacaatcttggcttactgcaacctctgcctcccaggttcaagcaattctcctgcttcagcctccctagtagctggaattacaggcatgcaccaccacacccagctaatttttatatttttagtagagacggggtttcaccatgttggccaggctgatctcgaattcctgacatcaagtgattcgcctaccttggcctcctgaagtgctgtgattacaggcatgagccaccatgcctggcctacttttacaaattgcaacatctggcctaatttttaaaaaaccagaaagattctcatctgcttctgcattcagtctttggcagtatcagtgtagactctgagagaattaatggtggaaaaggcatgtaaccttgtagtatcattttgaaaataatcttgactttgcaggccccatagtgtcctcagatcacattttgagaacagctggtatagattgtttttagtttgttgccattacagactctcctaatgaaatctttatccatataccttggcacttatctgagggtgtagggtaatttcctagaagaatagttggcccaaagagtagtatgtgtttaaaagttgggtaggtgaagatgattcaattttcagtcttggtactggtaaatgagtattaaggacaccttatttttttgagaaagtccaagtgcacatatcaattagtagacattagaacttgttaggaatgatagattccacagtggcagatctaattgtactgatgcattccacttagcttgagcactctcttgattttcatttttctctgtgtttcctttctcattctttctcaagtctcaatattggagttttcttgaattggagtgtaggatttcctttccttggtctttgtgacaatgtctttctcagatgtgtgggaaaaggtatcgtgtgtgtgtgtgtgtgtgtgtgtgtgtgtgtgtgtgtaaataaaagattcctcttgggagataagggcatctgtttcattggagaggatagatgtgtttctcaaatgagttggggtgaatggggtctgtcttgagtgtgtgcttcagttattgagttccactagacataactgttatcagaaacatgttgctcttagttagaaccttctctgcctccctcttaatgttgctgaggtctcctgctaaggatcatcatttctcgcctgtcatctctgctaccatgttatttaataaattcctctcctaaagttgagctctatatccccatccatacccataccttagtaggatagaattactgtgcctaatactgtagctatagcaacaaaatacaaacaaacttgttgggggtaaggattgtgttaattgatattaacactgaactggatctgttatagttgattggtttagtgtttataacttggctcaataaaacctattaggtgatggagggaaacccaatagactaggaataaacctagtattgtgtcttttatttattgtcttactgagccctcaagttgaaagactttccggtgttctagcctctatagcctacttatctctttgggaatatggtattggggatgagagctggacttcctagaccaaaactgtgatatggctgaaaagagagtttcaggggatacttccctctaatatcctgaatagaccagaaaaacatttcccaacactagaagcttctagtgtgtcctgttttagccagaactttggaagggagtacgtcaaacctttttttccctctttcttattatcctgatcctgtaaacactactaagagagttttgaagaaaatgtaaaagagactggtacttgagaaataattgctattagggattaggtggctgacaatgtcataccactgcactgccgtgttttttgttttagtgactgtaaaaatcaggcgtgtgtttcttgaaagcacaacttgaataacaacctcaatcccctgtgctatgtgtttctgacttcttaaacttaaaaaaacttttgaattgcagtataatacatcaaaaaggtacacaaatcataagtattcaatttgatgaattttcaaaaaataaccagcacaccattgaaaaaacaacataaccactactctggaagcctacttcaggttcctccccagtcactatcctacccagagaaaactgctagcctaatgataggttaattttgccactttgtgagctttgtgtaaattgaattctatggtttatacctttgtctcagctgtcttttactcaggtttgtaaaatatctgttgtgtttactctttgattcatatattaacattgttcgtggtatccattgtatgaatatttatactttacagtttacctttttgtgtgtgtgtgtgtgttttgttttgtttttttgagactgggtcttgctctgttgcctaggctggagtgcagtggcatgatcttggctcactgcaacctgcatttccaaggcttaggcaatcctcccacctctgcctcctgagcagctaggactacaggcgtgcgctgccacacttggctaatttttaaaatttttttatagagacaaggtctcactatattgcctaggctgcactccacctgttttttgttttttttttaacagtatttacatactatataattcaccaattcaaaatgtacaattcattgttttttagtataatcacaggtttgcaaccatcaccacaatctaattttagaacattttgtctcctctgaaaaaaatcatgtgcccattagcaatcactacccactttcacttcctcccagccctaaacaaccactaatctattttctgtctctaaatttacctatctggactgggaatgtgcctgtagtcccagctactcaggtggctgaggcaggagaattgcttgaacccaggaggcagaggctgcagtgagctcagatcacgccactgcactccagcctgggcgacagagagactgtctaaaaaaaaacatacacacacacacacacacacacattatgtatctggacatgtggtattttatgatgggcttctttaatttcatatgttttcaaggtttatacatattgtaatgtgttaggttttcattactctgtgtagctgagtatatgccacattgaatttatctgttcattttttgctgttgtaaataaccttgctgtgaatataaatgtacaagtttttgtctgggcatgtattcatttctcttggatatataccgagaagggaaattgcaaggtaactgcttaacttttgaaggaactgccaaacttttccaaaattgatgcctcattttatattcccagaagcaatgtatgaagcttcccatttctctacagccttgtcaccgcttgttattgtcttgtctttgattgtagacattctagtgggtactaaatggtatctcatttgtggttttggtttttgttttcatttgagacagagtctctgtcgtccaggctggggtgcagtggtgcaatcctggctcactgcaacctccacctcccaggttaaagtgattctcctgcctcagcctcctgagtagctgggtttaaagacatgcacaacgatgcccagctaattttttgtgtgtctttagtagagatggggtttcaccattttggccaggctggtctcgaactcctgacctcaagtgatccacctgcctcagcctcccaaagtgctggtattataggcgtgagccaccgtgcctggcccttatttgtgggtttgatttgcatttccttaatgactaatgctgagcatcttctcatatgcttactagttttttgtatatccgttttggataaatttctattcaaattcattgcccacattttaatattgagttgtaagagtcctttatatattccggatacaagtcctttaccagatatatgctttccaaatcttttctctcattctgtgggctttctttttacttgatggtattgtttgcagcacaaacaaatttttaattgtgatgcccaattttttcttttatataggttgtacttttgtgcagttttaacttttagagaagcgtttcctagttgggtcctatgccattagagatcttgcatcttctgaaatataatttgttaaagtaatgcaattctttcactctattttacttttgtaattttatggagatagattgtgtctgagaatatgagttgtatttcaaagtaggtttttgtgtgtctttagtagagacggggtttcaccatgttggccaggctggtctcgaactgctgacctcaagtgacccacctgcctgccgaggcgggcagattatctgaggttgggaattcaagaccagcctgaccaacatggagaaaccctgtctctactaaaaatacaaaattagccaggcatggtggcacatgcccagctactcaggaggctgaggcaggacaatcacttgaacccaggaggcagaggttgtggtgagccgggattgcaccattacattccagcctgggcaacaagagtgaaactccgtctcaaaaaaaaaaaaaaaagtaatattgatccataatgtactttatatactttatgatttccgtggagaataatagaatgcaatttttattctagtaattaaaataatgaaagactacaaagatagttggagatttttataccttttttaaattttatattaaaaatatatagtatggggtctcaccatcctatatatgagaccaggctagcctcaagcaatcctcccatctcgacctcccaaagtgctgggattacaggcatgagccactgcaccttgcctttgttttttgagacaggatctcttatcacccagtctagaacccagtctagagtgtagtggcgcaatcatggctcactgtagtcttgagattctgggctcaggagatcctcctgcctgtctcttgagtagctagaattataggcatgccctacctcatccagctaatttattttttctttctttttcttttttttttttgaggcagagtctctgttgaccaggctggattgcagtgatgcaatctcagctcacagcaaccatgcccggctaatttttgtatttttagtacagatggggtttaaccatgttggccaggctggtctcaaactcctgacctcaagcgatctgcccacctcagccttccaaaatgctgggattacaggcgtgagccaccacgcccagcctactttttcttatttttattttattttattgttattttatgtttgcagaggcaaggtcctgctttattggccaaattgttctcaaactcctggcctcaggcgatcctcccacctcagcttcccaaagtgctgggttataggtgtgagccaccgcacctggccacctgctgctttttcttgttatgaatgtatcactagcacagctcttaataaccaaaataaaatcctgaaaattgagcgtaaagagaattgaaggggcactggaaaatgtgttttgattaatctggcaaaagttggataaagaggaagaagattaaaacagtattttctccaaaatgtgagaatgcttatctgagcgtcctaagccaaaaccagtttttgtaaagaaaaaaagcccaaagaaatggggtttgtggggaatacaggtgggaaaaaataatatggtgaatgtttagttaccttaagcactcaaaggataagaaagagattttggattaattaggtcacctgtcctagacatagttgggagggttggtgtgaagtggaaagctgttcatgtgcataagacatatacaaattgagttatcataacttggttaatttactgtgttcggtattacttggtactgttctgagcacacagtagtgaatggtcattaaatcattaatactggacagcattcataaaacaaatgaactttgatgtaaaagcaaactaaatttggaaatgttaagagcactcttagccatctaaccactatttggaatgggtaaagcaattgttaagtgtaatagaagaaatgaaagctccgtatgagagacagttgcagagaaaactgctttttctcaaatattttgggccagagtttgtcttcaggtagtacttgcaggtataaactagaactggttgataagaggagaggggtatgggaagtcatacaatatataagagattttaacccagatcatctgacttcacactgtgttgtttaattaccttctgctgtccataaattagtagatttctattgttacccagtccttactcgtcagattatcatgtctttactgctaaaagtaagcacgtatataaaacatttattggctgggtgcagtggctcatgcctgtagtcccagcactttgggaggccaagatgggtagattgtttgagcccagagaccagcctgggcaataaagggagaccccgtctgtacaaaaagtaaaaaaattaaccaagcatggtagctggcacctgtcccaactacccagaaggtggaggttgcagtcagtgagctgagatcgcacaactgcaacagagctgagaccctatctcagaaaaacatttcttaggttacaagttactgtaattaaacttaccttgttttaaaaataatttttctaggccaggcgtggtggctcacgcctgtaatcccagcactttgggaggccaaggctggtggatcacgaggtcaagagattgagaccatcctggccaacatggtgaaacaccatctctactaaaaatacaaaattatctgggcgtggtggcacatgcctgtactcccagcttctcaggaggctgaggcaggagaatcgcttgaacttgggaggcggaggttgcagtgagccgagatcgcgccactgcactccagcctggcaacagagtgagactctgtccccaataataataatttttctgtaactgaagttgagtttgcatcaaatgttcagaaaaggaaatatggtcgggcacagtggcttgcacctgcaatcccagcactttgggaggagggggcagtgggaggatcacttgagcccaggagttggagaccagcctgggcaacatagcgagactctatctctacaaaaagtgaaaaaatatttaaaaatattttttgaggccaggcgcagtggctcacgggtgtaatgccagcaccttgggaggccgaggctggtggatcacctgaggtcaggagtttgagaccagcctgaccaacatggtgaaaccccgtctctactaaaaatacaaaacattagcctggtgtggtggcacacacctgtaatcccagctccttgggaggctgaggcaggagaatctcttgagcctgggaggcggaggttgcagtgagctgaggatcgtgccagtgcactccagtctgggcgacagagagaagccctgtctcattaaaaaaaaaaaaaaaaaaattattattattttttttaaggaaatatgtgtgtatgtaagggaatataattttgctgttttacagtaacataatggaatgtctttttctgtttcctaggttctctacttttagagtcgaaaataaatcctaacactgcataccagaaacaacaggtaaaattttgaagatgtgttttatcttgcatattttccttttgagtaaatgaaagtttattatctgattgcttatagtgaaaaatttagaagagattacaacagtttggcagtgaaattctaaaataggatttctgccaattcctatagtgtttaatacaataattttaaatttaaaaagcttgccacaagttaaaatggagtttgtgttccacctactatagcaactgagccctaaaatttccttgtttttacctaaaaaaaaaaggtgaccattgatgtgataagctgctacaaacacagttaaatggtgaaaattcctgttgtagatgatagtgcagaaggaacattagtatctccctctacagcagtactgtgtagataggaatctgtcatatgaatctgatttcttttacagattcctgaatagggtcttattatgatactacagttttgaaggtaactgtacttcacagtacagtgtactcaaaatacactttcttaaacctttctaatatgcaaaaaaatattagaaagtaaatctttcacttagtatcaactagtgctgttattaaatggtattcattcagtacacacgcgcgtgcgcttcacgtacacccacacagacacacaggatgagtgctctatatagccaatgaagtcaagatcagttccctcattgcccagaagatgcagatacaaaatagttaattgagaagaaagaagattaccagcttgttcataaagtgctttgcttcatcattgatctttaaaatactagaaagaagttagtattgtttttatttttcccattgggtgatgcgtaaaggtcgtgacttgtttgaccacacaaatagtggttaggaatgctggtgtcaactcctaaatatatttagtcgtgatttatttgtccaccaaacattcatacagtatattttcttgatagtttgatagtctgatagaatactgtattgcatttagtgttcttaagaaaacttaagtttaatggaaaaatctagagcctggaatatttggctttggtcttccatacttaaatacattaaatacatgttttgaagttgtattcagctgaagagtaaaagcacatcttaagaaaaaggaaagattgaaactgttttgagaatgaatgaacagattcatgtgtctcagcctataggtttttgggtgataagcaagataatttggggaaaagttgctgtaatatttggaatcttcaaggaaaacagaaaagcagtttctaaaattttataaacttgctagatttgtcaaatgggtaattaagagcatatgtctggctataccctgacttaagcatcagccacaaagtgattctgaatatacgttatagcagaatgtgttattggctttacacttatcctagtagcctttaataaggctgataattgtaagtatttatcagaattttaggagccatctaatttgggcaggttgttcctttcacccccaagatgattgttattttctgccaactttgttttcatcactaagaagtagtaccagccaggcgtggtggctcacacctgtaatcccagcactttgggaggccgaggcaggcggatcatgaggtcaggagatcgagaccatcctggctaacacggtgaaaccccgtctctactaaatatacaaaaaataagctgggcgtggtggcgggtacctgcagtcccagctactcaggaggctgaggcaggaaaatggcgtgaacctgggaggtggagcttgcagtgagccgagattgcgccactgcactccagcctgggcgacagagcgagactccatctcaaaaaaaaaaaaaaaaaagtggtatctatattatgactagttttcataacagtatatatctttcccatcctaatgatgaggaaactgaggctcagagaggttacctcactttctaagcattacctgccacatagatggtggtattagaatttataccgtggcctctttacctcttaaatttcttagtattttcattccatgctattttgagggaaaataacataactttaattttgtcttatctggagccttataataagtgctcagtatttactgagcagataaccttgtaaagtatttaggctgccagaattatagattaactgcaaattcttctaccatttgttctgttctggtgaattataaaggtaaactaaaaatgaaaccttaccaatttttggcatgttgatcttagaatgttaatagttttgagcttgaattgccactcagtctggatcagattgcctgcctggtgtctgtgatatatggaagtcctttaagatagtataaaaagtggagtttgaggtgttttccaaaattctgaataaaaattatagacttagtaatactgcacaaccaaatcagattcttatctgtttatttctggctggcagcactttagtccagtgagactactggtctcatgattgacagttatataaatgactgaacagagttaatatgcagtttggcagataaatttttcatttttttttttttttagagatggggtcttgatatgttgctcaggctggagtacagtggctattattcacaggtgtgatcatagtgcactgcagcgtccaactcctggcctcaagcaatcctccctcctcagccccgtaactagctgggactacagggatacaccattgtgccttgcttagacacatttttaaacatggaatccatttgtgttacattaagaagtgttcttggctggggttggtggctcacgcctataattctagcacttctagagcccaggagtttgagaccagcctgggcaacatggcataactccgcctctacaaaaaatacaaacattgggcatggtggcacatgcctgtagttccagctacttgggaggctgaggtggaaggaccacctgagcccagggaagtagaggctgcagtgagccttgatggcaccactacattgcagtatgagtgatagagacaccatctcaaaaaacaaacaaacaaaaaaaaacagaagtgtccttgcctagtgagaaagattagaaactgctgcaatagaatcataggtccttaaaggtaccttaagctagtcatctttccttctcaatacaggaaccattatcatcctgatggatacccagtcggcctttgcatggctgtttttggttacttgctagtcagattgaattatttttttctttataccatattcaaatccatctaactttactcttctaaattctctttgtaccagcttgaaaaaacacttgagtgacatagcccttcagattttgaagttagccattaaatgtaactctccctagtaccattcagtatttcttgtatgagatgatttatagattgctctcaatgagaggatccttttttgaaatggttgattgctatcaaacagtatgtatatttatttattgccagtaagatttgaaaggattttttttttttttttttttttttgagacggactctcactctgtcacccaggctggagtgcagtggcacgatctcggatcactgcaacctctgcctcccgggttcaagtgactctcccacatcagcctcccatgtagctgggattacaggcatccgccatcatgcccggctaaaatttttttgtatttttagtagagacggggctttacctgttggccaggctggtcttgaactcctgacctcaggtgatccgcctgccttggcctcccaaagtgctgtgattagaggcatgagccaccgcaccctgccaaaaggatatattaggccttataaatattttgactctctatttttttttttttttttttggagacagagttttgctcctgttgcccaggctggagtgcagtggggcagtctcagctcactgcaacctccgcctcctgggttcaagcagttctcctgcctcagtctcccgagtggctgggattacaggcacatgcccggctaatttttgtatttttagtagagatggggtttcaccgtgttagccaggctgacctcaaactcctgacctccgcccacctcagcctcccaaagtgctgggattacaggcgtgagccaccacgcccagccaaatatttttattataccatgcatattgtagaatatatgctcttggtactatgaggaatataaaatggtctcagtaagtattgtatgtgcagtgtcttgctgagattacatcttaataaaaactgttgaactgttcattaaattttcattaaagttctgtctagatggccaggcactgtggctcatgcctgtaatcccagtgctttgggaggccaaggcgggagggcccaaggccaggagttcaagaccagcctaggcaacatgacaagacctccatctctacaaaaaatgaaactaagaagttctgaataggaatgaaagggtggtaggtgctaggagtttgctgcttcttgaaccatagcactttgctaagtttaaaaaaaaaaacaaaaaaacctatgtataggtaaatgctcacgtactacaaatgtagccaataatttcaagggcttcatggacctcagaggcccctggtgaaaaacacctgctgacaatagagggaagagagaaggagttttattaaccctatcgtcctaacatgccctagctattttatgcttagatttcctctttggacattttaatgacagcataaaatgtaagtcagtatgctcggatagcgttggtataattggtataatgttttgtttttatcttttgcaatgcatgaaaagaatatatttcatatattggtttaagttgtccttaaggaaacattatttttgttttatagattgggggaagtgaagtgtaaaaagtcattgttttgaaaaagaaagacattgataattgccagtattagtgttgcaaaaagtaaaaatgagcacagttttatttccttttgtttgttcattttcgtttgtgatagtgtatgttaatcattcagactccttttatgtctccaaaggacactctgattgtgtggtctgaagcagaaaattatgacttggcccttagctttcaagaaaaagctggatgtgatgaaatttgggagaaaatatgtcaggtaattttttaaataaaaaaatcaacatgctttctttaagtgtttagttttttgccatgctttcaactaatgcccaagagtttaaataaatttcaaattgatcttttaaattcactgctgtctttgaacttgatttaaaggaaggtgtaatttattgacactaaactctctagctcatacctttgctgaactccagtgttttatatccacctgcctttttgaaactttctcttttcatgttcactagcatctcaaatttagtactccaaaaccaaacataatcttctcacatatatctatcccatctccttctaagtgccatgcagttgctgaaatcagaaacttgtggatcttgtttatccttccatcatcgcttttatccattcagtccctcgataataaatctagatccattggcttatcttcatttttacttttgtagttttccaagccaccatcatttcttgcctggtttattggttttgtcttgactgatcttcctaaatcaacattttagctagagcaattaggtgatctttttaaaaatgcaagtctgattacatcactctttgttcataacttcttgtggcttttgaaagaaaacccacccttgtacttgtcttgagcagtatggctgttgactgactattcagccttaccgtgcctctaggctcgaatgttcttaatttattctggagtttccctagtgacataatcacaatcttttgtgaatttgcatttgtatgtgctctagtagctaatgctgttggctcttgttatacacttcttaggccatttctttctagagaaggtttctccatctccatgtttactttatctagagaataatcttcaccagattccttaattcctttgaatgtggccctcaaaccagcagcacaagcatgacctgggaactgatagaaatgcaaattctgagactagcacccctcccgccgaccccagacctactggatcaaaaactgcaagtagggtccaataattgttttttaaaatcctttcttaggaattctgttttcacaagccctataggccagacttttctctgtaaaaaacaagatagtaaatatttaaggctttgcaggccatatagtctctgtcacagctaggtcacctctgctgttctagttcggaagtagtcatagacagcacataaatgaatggaggggctgtcttctagtaaaacttttatttacaaaaacaggtggcagaccaaatttggctatggtttgtcgccccctgcttttggtgattctgatgcaccctaaagtttgacagctatagcattcatagaagatatagtgtccttagcacagtttttccttgacttaatggaatttatttcaagaatatattctacttcgctgtgcttttcataaattaacctgtctgttaagctgtccctttccttctctgaaacatgaaaggactaacatttatatctgaataccatccatctttttagtttttctttgctttccatccaacaattatatttatagcatatgtctctagattttgtcttgtagtgttatcccaaagagagagaggtgacattaatgagttcaggctatgttaatagcatctgttattcagacaaatcttgttctcctctctcatctttctgaatcaaacacttccactctggatacagtcttcctttatgccaatgtgtaactcaaacctgaactcactttgtcattgtcatgcctggctctcctttaatattgtctgatctttacctttgtttggtctttaatatcataaagtttttcatcatcttaataattttatcactagctgctttaatattcttttctgatactccctttcaacttttatatagtttatgttcaaggtgtcatttctcagtcactctttttatgggttctgtctgaacttctcaatcattttctagatccaagaaagtcattacattttgctctctgagatattaaatgtttttctatttcttgaaccatgttcaccaatttgctcaactcaaaaagatggcattcttaatataataagggcactcctctcttttcatttggtttgctaatcaaaatctaacatttttctgtggataaagtcatagtttgggtatcaggaacttaaaactataatgagagcttacataattaacaaattcagagccagtgtgagaccatgcaggtacaagccatgaatgtgacttgcctcctttcagtgctgctgtccacttggttgaggtcaagaccatatcaccttgcagcacatttcaagaaaagtattccaggtcgtcatcttttctagtatctatcagtgcatctgttcattacgctaagcaatttaagtttcttggcttttccatataaggtctaatttttttcattgctttaccattctacttggccttctacttgctttagtgttcactgtcccaaattctagggccaagataacaaaatttgtttcatttcaaagtttatccttgaccttttgttaccaaaaaaaatgccttactttaaaatgtagtcaatataagttacctttttataataagagcccctccagtggcataaaattaggttttatgacagattttcaggctcctagagggatcatgaaggctacaggttagggtgtgtagaaaggaaaatattttcgtggtttggttacttaaccttcagcagaccttttttgggaataactctactacatataggttgtatttactttatatgtggcttcatttttatgtaggtacacttgtattctgcctagtgttttttaaatcctgtgtttgggctgtcagtatttatagaagatcagtgactcactttggtccaaagccagtttgttcatgctctttggcccttggtttctacaatcaattgatgttaaatattttcctttttgcttataattatatatattttctgtgatcataacattatgatatttggtgtttatttggtcttcacctcagagttaaatattgaagagtttggtggtggcagtgtcctttagcacagtcctaggactgtttctgagacttgccttggtctgctggaaaagagggccagggatatgagatgttagtggctgttttagcatcaggcttctatgttgtgggtctgcagagggctgtttcgtaacagtctcacttagtttagcctgtcctagaaagttgttcttgccagcagacctcatactttatagggaagctcattctgtttttgaactttgactaacttccttaaaattgaaagtatacatatttggagaaatgtaatgtagaaaagtaggcagttttgtcttgaaaatgaccattataggtttcttacaacatttctagtattcatcttagagtagcatttaggtttgctggtcacctgttatctattttgtcagcaattaaattttttttcataggttcaaggaaaggacccttccgtggacatcactcaggaccttgtggatgaatctgaagaggagcgttttgatgatatgtcatcgccaggcttagaattgccatcttgtgaattaagtcgccttgaagaaattgcagaacttgtggcatcatctttaccttcacctcttcgtcgtgaaaaacttgcactggcactagaaaatgagggttatattaaaaagctcctggagctttttcatgtgtgtgaagatttggaaaatattgaaggactgcaccacttgtatgaaattatcaaaggcatctttctcttgaatcgaactgctctttttgaagttatgttctctgaagaatgtataatggacgtcattggatgtttagaatatgatcctgctttatcacaaccacgaaaacacagggaatttctaacaaaaacagccaagtttaaagaagtgattcccatatcagatcctgagctgaaacaaaaaattcatcagacatacagagttcagtatatacaagatatggttctaccaactccttcggtctttgaagaaaacatgttatcaacacttcactcttttatctttttcaataaggtagagattgttggcatgttgcaggtgagttagatcattccttttttcatatttcaagagatgcagcgaaaacaatttgctccttttaaatacatacattgagttttaattttgttaatgtataaagttaagtattgtgagttattttaagagattataatatacaataataatacgagaccagaaggttactctatctggggtaggagaggtaagtgtgacaaatgtagtttgaagaaatggtatgaggggatgattttttggatacagggtcttgctctgtcacccaggctgtagggcaataatgcagtctcagcgactgcaacctccaccttcgcttccctggctgaaacaatcctcccactgcagcctcctgagtagctgggaccacaggtgtgcaccaccacccccagccaatttttgtattttttgtagagatggagtttgtcatactgcccaggctggcctcaaacctctgagctcaagcaatctgcctgccctggcctcccaaagtgctgggattacaggtgtgagccactgggcccagcctgatttttttttttttaagttgaggtcttgctctgttgcccaggctggagtgcagtggcacagccatagcttattgcaaccttgaactcctgggcttgagccgtcctcccacctcagccttccaattagctaagactacagatgcatgctaccatagccaccttttaaaaatttttttgtaaagaatggatctcactttgttgcccaggctggtctcaaactcctggcttcaagcaattctcccaccttagccttgcaaagtgttgggattacagttgtgagccaccatactcaactataggaggataatattaatgaaatggttgaatgctgaactttggggttattactctatgaattttgcatagaatagaacagattggaagaggaaagagtgaagcacaaagccaagagaaatgtcaccaaacacagaatataaattctaatgagaattgtgggccaggcgctatggcctgtctctaccaaaaaaataaaatttaaaacgaatttgtaaaattcccagataatgatacggtaaaagtccagtttcagggtctagggaatgtagcagaggaggcaaattataactgcatgtatccctaccaaaagccacgttttgctaaggggtgtgcctgtgggtgagttaaacccatgtgaatttgagtttcagctccgtctgtcacttaataacagtagctatgtgagttgggcagccttaacttcttaaagcttcggtttccccatctgaaggatggtgacattaatgcctaccctgtaaagttgtctgaaaattaactgaggtcaggcatgtaaagaaagtgtttaatatgatgtaagattcatgggaattttttaagtgtctattgataattgcttattaaaatgtagatttttttttcttatagtatgcccaatctctctgatctggtgttttagggtatttgcatcacagtcccctagggtgcagtatcatgaattctgcacaaaacctgagtcaaagtctctgagagctagacaataatttgcgtttgtaacacccccaaaattagaaaagctcttactgtgtcatcccagtgtgtgaattggtctattctaactgaaatagaagtttacataggctgggcctagtggcttatacctgtaatcccaccactttgggaagccaaggcaggaggatcgattgaacccagaagttaaagactagcctggggctggatgcggtagctcacgcctacaatcccagcactttgggaggccaaggcgggtggatcacctgaggtcaagagttcaagaccagcctggccaacatggcgaaaccccgtctctactaaaaatacaacaattagctaaacgtgatggtggacgcctgtaatcccagactcgggaggctgagacgagagaatcatttgaatctgggaggcggaggttgcagtgagctgagatcacaccattgcactctagcctgggcaacaggagtgaaattctgtctcaaaaaagatttttttttttttttaaattagccaggtatggtgatgcatgcctataatcccagccatgtgggaggctgagttgggagaatcgcttgagcccaggagtttgagtctgcagtgagcaatgatcatgccaccgcactcaagcctgagcaacagagtgagaccctatctcaacaacaaaaaaataagtttgtgtagtacaaagaaagaattgttatttgcacccatacacacacacacacacacacacacacacacacacacgttgttttttattctttgatgcctgtggtattgtaagaataataggtctttgggagactgaggtgggtggatcacttgaggtcgggagttcgagaccagcctgaccaacatggcaaaacctcgtctctactaaaactacaaaaattagccaggcgtgatggtggacacctgtaatcccagctgctcaggagaatgaggcaggagaatcgcttgaatccaggaggcagaggcacatgcctgtaatcccagttactccagaggctgagacaggagaatcatttgcacctggtaggcagaggttgcattgagccaaggtcgcaccgctgcagataagtgtaatatgacttggaagatcttttaagactttacctcaggtgtataagtaaaatttatttgaaacctgaatttgttaagtatagaaaggaagacaataaatgtagtaagagctgcctggtagcacacattacatataaagcagtatgtttaatcatgtctgttcctgtttagaaaattttgtatttctaaaatattagccagtgataggcaaaaaaaggaaaagtatgaactaaaatactgagttctcctgatccttttctttagctccatatggttctgtttttgttatgtggggatttgtcacttctgtgttttcttggtcttcatacatgtaaaatgccagttttattcattaagtatgaataatttcaagttgttaaatctttgcttccctgtaatgtgctttgtaaaatactggctgccaatatgtctgtttctcttgatgctggacacttctatccaaagtgctgctgtgaaggctgtagcattttacaaatgttttggcaagaagtgattgaggtacagtttaatgcaggttcctgcccactttgtatagccccatgcacacaaaataaatatcacaccctcttaacattgactgcttcctttgtagtaccataaacattcttattttctctatttctgtacccccaactgcagcagttcagagaatgtcttttttaaccatttgatacccatttggtagaatatagtatattggagatgtgtcttgaaattggatgccatttgggtagcaaacatggtcaagatcatattaatgaggtatgacctatttgttcattttagaaaaagtaaaggtgagaataaccaaactaacttagtgccacagaagatttttctggagcactcacaacagtgaatgtggagccagtaatctagtgggagcttgtatatacatccatgtgtatgtgtatttagagtgaggcatgtctagggcttaagtggtattgaatctacttccactagctgaggtagtaattaaaatcttggtcgagcatggtggttcatgtgcgtaatcccagcacttcaggaggcccaggccagtggattgcttgaggccacgagttcaagaccagactggccaacatgacaaaaccccatctctgctacaagtacaaaaattagctgggtgtagtggtgtgtgcctgtagtcccagctgctaaggagactgagacaggagaattgctttaacctgggaggcggaggttgcagtgagccgagatggcaccactgtgctctacctgggtgacagagcaagactctgtctcaaaaagcaaaacaaaacaaaagccaagatcttgatgaaaaaatagtgatgagaaacattgaccggacaatcatgaaggctctgccaccttaattgggcttgggtaaattttaaaatccaagtctcaattataaaatgaggaagtaaaacaaaaagttctaaattttgctttttaaataattgagtcattctctgtatctttaaaacactaaagtagctttgtcttcattttcattctcatttgagaggttgtagaactaccttttaaaagttaataaggttataaaacctatgaaagtgaggggtcagcaagtgttggtcctgctatttttgtaagtaatattttattgaaatacagccatatccattcatttccagttgtctgtgactactttcatattactggagcagggttgagtactcgtagtagagatcacatgggccgcaaagctcaaaatatttactacctggcctttatataggcttagaaaatagagccttgacaaaattttatactttaatagtgtggtttttccttctgttaaaaaaaaaaaaaaagacagcattgccaataccacctttcctttttatagttattgctgtgtatattaaagcattcctgaaattatattttaggacaatcttagcattaacataattgcatttgtcctttgtttcacaggaagatgaaaaatttctgacagatttgtttgcacaactaacagatgaagcaacagatgaggaaaaaagacaggaattggtaagaaattagatactatgaaaggcataaaaataaaacaactggccgggcttggtggctcacgcctgtaaatcccagcactttgggaggccgaggtgggtggatcacgaggtcagaagtttgagaccagcctggcgaacatggcgaaaccccatctctactaaaaagtacaaaaattagccaagcatggtggcgggcacctgtaatcctagctactcagaaggctgaggcaggagaatcgcttgaactcgggaggtggaggttgcagtgagccaagatcgtgccattgcactccagcgtcggcaacaagagcaagactccgtctcaataaataaataaataaaataaactttttatatcacttatccttttttctaatttcaggttaactttttaaaagaattttgtgcgttttcccaaacgctacagcctcaaaacagagatgcttttttcaagactttgtcaaacatgggcatattaccagctttagaagtcatccttgtaagttttgtgtctcctcatttttaattaccattttttaatcccaaaattaatatttttaatgctacatgcaaatattctattatagccaatatttgaaattagctgcgtagttcattaagttaaagaagctgtaaaattccaatattagacagttttcacacagtattgaaagaatgcagtaaaggaatttcccataatttaatgatagtttgtcagctttgcagcttattagctgaaatgttaaaataggcaaacaaataaatgatttagaaagtataattttatccgtacaataagagttttatatgcagaagaatttctttgacctttcttttacattgaagttttttcatatgttttgttaggtttggatatttacatagctataggttccgtatttttataaatacaggaaaaataaatgttttttgtctgcagggcatggatgatacacaggtgcgaagtgctgctactgatatattctcatacttggttgaatataatccatccatggtacgagagtttgtcatgcaggaggcacaacagaatgatgatgtaagtaagaagttaacagagcaaaaaataaccagcaaggtaaatattatttgtactaatagtaagtatttatacataggaagctataactgtttttattattcacttttaagatttaattgttgctgtttgggaaaagtgtagccataatatcagacagcttattgttcccctaaattggttcctgtctcagtttatcaatttgtcctacagcaactatttatgttcatttaaattgccttttaaaatattcatgtcagtttttttttgttttgttttgttttaattctgaagtcaacttgctatattgtgttttttaaatcatttagtcaatcaattcttgtatctggggaattaagagtaagttacctaggaaaacattgactttagggtagattctcaaaatcgccaagaatgaagaaatgtagcacagtcccttaaaatatgaagggtgctgtttctttactgcctagccatagagaacaagctgttacgttgttcacaaacactcacgttagcatctgagatataccagattttaaagtagtagagaatatatcctggtaatgtgaagggtgcgcctggatcacatagtgcgtgacatgtgagagcactaaatgtgtgtgctctcctttattttaaaataattgaaccaatgattctgattttttcctgcttcccccataacaatttggaagcaactttttacgtaagaatgagtaagaaggacctgctctcaggtccttcttaagggaggaggggaataaagatcccctaaggaaaaaaaaaaaatctgtttagaattccagcctgtggtatttttacgaaataggaaaatagactgtcttactttttgaaaagatcctatttaatgtattgtgatgtcaaaaggaaatggaatgccatgtaactgctatgtttaagtttttatttttatagtgcaggataggtgcaaaaaagcaccagtttgaactgttgtgtcatgtttttcttttataaaatattaacatcggcctcagcaacatagcaagaccctcctttagtacaaaattaatttttaaaacttagatatggtggcatgcacccatagtcccagatactcaggaggatgagaaggaagagtctcttaagaccaggagtttgactctgcagtgagctatgattgctccactgcactccagtctgggtgacgaagccagaccccatctcaaaaaaaaaaaaaaattctttgagaaccaaagtatctgtattattgaaaataaaggctattgttggtcccattaacccatgagctgaacatatgaacatgtattgatatacctcaaaatacacacagtaggactctttttttttcctgttttgcaacagaataacatttcagtcactaggactcttgattcccactcttcttaatcatcatttccatctactgtctgcattttctctatcccttgtccatcctgcctttgcatacacataggcaagagcagggattttctcactgaatccctctcaatcttatttactacttaggtgaggaataccagtcataataggacctcaggaaaaccagccatctcttttctttgatatttagaatgtgtataatccatttgttctctgcactctctaaataccatagtctcattttctccaatttcagacattcagataattttttcctaaatttattttaaaaggaaattttatatcacttttacaaatggagaacatacatcactggccataaatagaaggactctataataataaaagcaatagaccaggcacggtggctcacgcctgtaatcccagcactttgggaggctgaggcaggcggatcacctgaggtagggagttcaagactagcctgacgatcatggagaaaccccgtctctactaaaaatacaaaattagccgggcatggtggtgcatgcctgtaatcccagctactagggaggctgaggcaggagaatcgcttgaacccgggaggtggaggttagtaagacgagatcgtgccattgcactccagcctgggcaacaagaggcaaactccgtctcaaaaaaataaaataaaaataaaagcaacgaaagtattatgatgttctaaatcctacctaaatattcttactcttaaagctatggtcataaaacccactggctttcttcaaaaggtagattacattattagaaagttgtaaagatatattatcaccaaactaaaactttgcttttgctttattcagaggaatttaaagataatagacaagaaatttctatttagggctatgtccctgtaccacactttagggaatgaaacactgtcatatgtcctgtcagataactgagttaaacatttcactttgcagttaacaaaacagctagagcctaggtataatgctgtggtatgtgtcttagtttttgctttttccgttctctcataataagtgatcctgagtatgtctatttttctctccaggatattttgctcatcaacctcattatagaacatatgatttgtgatacagatcctgaacttggaggagcagtccagcttatgggcctgcttcgaactttagttgacccagagaacatgctagccactgccaatgtaagccatgagcatttcccctctttttcatagctagtatattgtgtattgctggtaggaaccagtgtggttaaagttcatggaattgttcttgtttccttagaaaacagaaaagactgaatttctgggtttcttctacaagcactgtatgcatgttctcactgctcctttactagcaaatacaacagaagacaaacctagtaaaggtaagataattcaggttggtagttaagttctctgttcttgaatgctgaattcaaagttggtgttaagtcagtctttttaggaggcagttagtgggaggtagaggctgggaggacacaccttttaaaaagtagtagtctttaaaagttcaaaccatcaggttaacatagaggtcttaataatttggttggttggttggttggttggttgtttttatcaaaagcaacctggagaattaatgatgtattttgaaaagaaaggttcatgacaaaaatgtccctaaaaggcctgtaatcccagcactttgggaggccaaggcaagcggatcatgaggtcaggagatcgagaccatcctggctaacacggtgaaaccccatctctactaaaaaaatacaaaaaaaatttagctgggcgtggtggcaggtgccttgtggtcccagctactggggaggctgaggcaggagaatggcgtgaacccaggaggcggagcttgcagtgagccgaggtcgccccactgcactccatccagcctgggcgacagagtgagacttcaactcaaaaaaaaaaaaaaaaaaacaattttcctgaaagtactgtaatcagataacagaaacatgtaaaagaaataagataattttttgttgaacaatatttgtattcagtttgcatctacactggtgaaatataaatagaaggcagtagctatgaaaaaattcattttaaattatttgtactccagatgtatagacagagctaggatttttgcacaatattaagctacttttatttatattgaagatatgttaaggtttgttatttttgtattatattcattagagctttagcgtgcgtgtgcgtgtgtttaatttaggaggtagttttaggtctacattcaaaaattgcttatttaagctttaggagtaaatacattattttgtcattggaatttttttttttttttttttttttggagacagaatcttgctctgttgcccaggctggagtgtggtggcgggatctcggctcactgcaacctctgcctcccaggtttgagcaattctcctgccccagccttctgagtaactgggattacaggcacctgccaccatgcctggctaatttttatatttttagtagaggcagggttttcaccatgttggccgggctggtctcaaactcctggcctcaagtgatctgcccaccttggcctcccaaagtgctgggattataggtgtgagccaccacgcccagccttgaattcttaatatagcataattatagcactcacataaaacacaagttaaatttactttttgtgtaactccagaatcaagtccatgaaatgtgaatgtccatttttcttacctgctttattcatattaggtaaagcttgaggcttctttccaaaccacatgttctattcctccaacctttattaagatgagaactcattgtgattttgtgaaggactgtgttataatctaaacgtgggggaatgaaaaaaagcctttcagaggcttgctgcctagtgaggagtaaagataagtcaatgattataattcagtatagactcgttacaagtagtaaaggaggcacaaaacacactggaatcaagggaacagggagagagagtaattgcaccaaagatgacacggtgtctggcaaaacctcatatgctatatctgttggagaacatgctaaggtacctggtagagggtccttgaattttggaataaggcagatactctagatttgtatcataactctgccttactaacttttccaacttgggtctagttagttaataggctcataatgtgaaacagtttcttatagggttgttaaaattaaataaaaaaaagtaaagcaccattcctggcacatgttaggcgttcagtaaatgctaatttcctcctccctaaagttaatatatttaggttaatagaagagattttacttgattagaatttgagttcttacattttagaaggaaaaatgttagtcattaaatataattagttgtgttttgtttcttttagatgattttcagactgcccaactattggcacttgtattggaattgttaacattttgtgtggagcaccatacctaccacataaagaactacattattaataaggatatcctccggagagtgctagttcttatggcctcgaagcatgctttcttggcattatgtaagtgttagaattatttatcatctttgtatattgacatgttggtattttttacatcttattgcccaaatgaaaagaccactgattacaggtcaggagatctaggtcgtaatactagctctgccactgattatgcaggtttgccatgttgagcaggtgtttttcttgactctcttcttacttaatatacagtaagggagtagaatgtatctacagtgttatattccattactaaaacagcactttgatcattttaccttggatattttatagcaggggtgacagactacagctgaggccagatccagcccatggcctgtgattgtacagcctacaagctgaaacatgcttatgtttttaaaaggtggcctgagaagagagaaatgaatatggtacagagaccatatgtggcccacaaagcctaaaatatgtactaggtggacctttatgaaaacgtttgtagactcttttagagcaatatagtctcataacaagattgttcttagacataagtttttcagaatgactttcacagtgttcttaagacccgagtttgttagagaaaaccatgtttctgaattgaaaataggttaatccaggatgttctttatcaagcagcagccagacatctcaggtaatgagttgccatatgtaagtggtccttactggtaagttgttagaccaaatttaggggtaccttagaggttctgtaagagatttctggtggtaatttaatttttgccctttggtttttaaaggtaagtttgagtgtttgttgttgttgttgtttgaagcagtcatagtcatgcactaattagaggcctgaatatatatccatttttgctaatcttctttacttcatttctaattgttttgcttaattgattttttaaaaatccttaaatcatgtaattacatattattaaaataattataaattaaaattttattttaaatttataaataaataaatggccaggtgcagtggctcatgtctataatcccagcactttgggaggatgaggctggcagatcacctgaggtcaggagttctaggccagcctgggtaacatggtgaaaccccgtctctactaaaaatagaaagctgggtgtggtggtgcacgcctatagtcccaactactcgggaggctgaggcagaaggatcgcttgaacctgggaggcagatatcgcggtgagctgaaattgcaccattgcactccagtctgggcaacagagagacactgtctccccacccaagaaaaataataaattttatattttataaaagcaacattgctttcttttaaaattcattaaacttcctatcagggcaacattatattcatttttctcatatactatcacagaaaaagtgagaacaccaaggccaagtttagagggggagtttatagctctttgacttgttcttttatgttgacaatagagttttgttcaagtgtggaaaaggggatttgagagcagaatggaaaaactgaataaatgaataaattgttttattttaccaaacatattaaacacaactatatttcattgattcaaaaaatgtacacttttaaacattatctctgaaattaagatgagtcttacaattaacccatttatgcctagtgttccattattggaacgctaagcttgtgggagttatttatatcctgcttaaggtcaacaccaaggtctgattttttttttttttttttttacagaaaaaatttgcaacctctagcatgaatgggttaatggcatgtcactataattggtagcttagtcagtggcatcttagatttgattactatcttatatctggtgtactaggaaaatgaagatggttatgacctggacttggccatcaatggaatcagttcattaggaggagggagtcatgtgaaaatcaaaatgcaacagtaataagcactacattgaggtgtgtttggatgcatagtggaaataattcattataatttaatgaggcagatgaaaaatttcacacaattggtaacttgagttgtgtcttggtcatgggagagtattgcattcttggttgaatacatagttaagatgttaattgggtaaaaaaaaaaagtgtggcatgtggacaaagtatacttggtcttttttttcttttttccttttttttttttttttttttttgagacggagtctcactctgtcgccttggctggagtgcagtggtacgatctcggctcactgcacctccacctcctgggttcaagcaattctcctgcctcagcctcctgagtagctgggattacaggagcgcaccactacacccagctaatttttgtattttagtagagatggggtttcaccatgttggtcaggctggtctcaaattcttgacctcgtgatccgcctgcctcggcctcccaaagtgctgggattcaggcgtgagccatggcgcccagcctacttggtcatttttaaagagagtcaggacaatgcagctgaaagcaaaggacttttctttagttcagttcatcatttcattattttgcttgcagtattgcaaagaaaatttctcataatctaatgagaactttggagagaatcttttaagtaaatgaaagtttattgttggaaactaagtatgttagcaaaatcttagttatgtttcattgttgatattttccaaactgagtcaggttatcattaaacctaactctttgaaaggacctcttggtgtacctctcttcccagggttgaggatatataagtatcttcctaacaaagatgtctgtcattaggaacaagctttttagaactggctttgtagtatgcaataggagtttttatcaaagatatctaagaactaaaataaatttgaggaaatttaagatacttgtggttcttctgaaaaaaagtgtacattgaagtattaggtatagtattttttaaaggagggtttattgatatttaagtttaggtgcacatatataaatgcagacagtaatgagcaattaaatgtaacagtttggggatttagggagcttttaatttttttatatttgctgctgcttaattattatactttgtcatctttaaagacaactagttaagtatgtaggtgtgtctagcaatcgtttctaaactcggtctttataggctagatatcacatctatcaatttccttggccttattaagttccttggatcttacattgtagccctttagctcatacttttatgttgtttgagagtgttttgttgttaaaaacatggaaatcttaaaaaggagtgaaataaagctttattatagaggcatttattcaattatcattagttacaaggtaaaaagtcacaaatttattacatgaaattcacgttttataaagtacagataaataatgttttttagagatgattgaaactaagcacaagaggttcctggaaatgttaatgaaggttagagatgtgagtggaagcagaatgtgctttacattgaaaatccaatggcagtgccaacttggcctatcctaaaagctttctccactctactttgagtgacttgacttcctagatcttactggtaaaattttgaaagcagctttttactcaacagcaaagaatagtggttggatgtttttgatgcaggtttcttttaagggatggatttgagtggtaataatacaaagttcttgatataaaatgtaagagcaaatggaaataaggaccaaaacaaaaagaccactagaacctccttctatctaccccagcagtttctggatagaagtgctctggaagaagtgcagtggtgccatctacattcccttgtcttagtgaatttcaggaaaggagtttttcactcacctaggaactatagtcagacaagaggggtgtgtgtgtgtgtgtgtgtgtgttatggtaggacacaagtctccacaaagcccgcaaagttggagtacaaattcttaaaatagtaatactcctgccttaattattacaagtttaaaatgtggtctattagcatgagctctaaagtactgatttttattcctaacaaatggaaatgcctcagtaagttcctttgtcaaataaccttaaaaatacaaactgaaaatattgttttgggaaaataaacccttgttaggctttgacttatcacacagaaagatgcctcttagtgtttaaaatgtcttagttcaccatgagtatgtttttaaaaatattcagtagtttaaaaaataaaatgcaattattattctataaactatttagaaactccctgcccagagtgtttcttaagaaagatacactcttaaataagttgcattgttaaggcagttaataatcaactgtacctaattgggcattcacttgtggacctcttttctgccaactaaagaaaaattgagctgctttactcctctgccttcccacccagaaaccgtgtcagcatggttgcctggctacctgctcatgaaggacttgattaatagcaaattggcaatttaacgagccacttccatgatctccaaagaaaccaaaatacaaacacaatatttaatcttgccaaccgaagacgatgtgactgcatgaagtgagtatgcttttttgcactgtttacaataactggggcattaacttactgataattccatttaggtaaagagggctttgttgaagtctagctgtctgagtatatttgtgtcttgatgaatggtgacttaagtaactccccatacctcaagatgtaaatataccttttaatctgtaagttaaagcctaattaattatgaaaatgaaaactagaaaaaaattaaaaagcatactcgctacaataagcatagaggaccacattttaaataacatcctctaaatttatttttaaactatggcaaggcaaattttgggtcatgcagatttttgtgggttgatggcctttctacagccacatccacaaataaataaaattccatgaactacaatgcaaaataataagagtgtccaaaaatattgaagatcaaattatacagtggattgccctaataaaacactggttttttctattaaggtggatataaaaggtcatgttgaattttttcatcttaagtagtgtgataggttcattcatttgtcttagctcttattttagatgtaaattacattttggtcattagtaactggtttattttcaggatttttctggctttctaagacttgtgttctatgatgacatatactacttttagaagacatttttctgataacattttcataatccttatctttaggttcacagttccggaagtgcaaacatcataaataattattgatatgtgttaaacagttttttttggtttgatggttatttttgtttggtaagtctaaagtatggaagagtggtatgtgatttaaacaaccatgcctctgtgtttcaggtgcccttcgttttaaaagaaagattattggattaaaagatgagttttacaaccgctacataatgaaaagttttttgtttgaaccagtagtgaaagcatttctcaacaatggatcccgctacaatctgatgaactctgccataatagagatgtttgaatttattagagtggtaggttctgtatttttaattagaattttcattttaattgtttgagaaaattgaatatgcattacctagtattttggcttgagatgataatatttggagagatttaaaaaaaaaaaaaagtactaaaagcctgtgagagatttgagtcaagctacatcttacctctcagcagctacaaatctgttatagcaggggtcctcaaccccttggccgcggaccggtccatagcctgttaggaaccaggctgcacagcaggaggtaagctgctggcaagcaggcattattactgcctgagctctacctcctatcagatcagcagcagcattatattctcctaggagcatgaaccctttggttaactgtgaggtggaacaatttcatcctgaaactgtgctcccccactcccaccccagttggtggaaaaattgtctttcatgaaaccaaaaaggttagggactgctgctttgtaggatggtcacagtaatcattttaagaaagcaaaactacacttgacagataagcatttgaatgtgtttttcttaacttacacatttctaaagaccaatttcataatactctttattctctagtaatgtaataagctagtggttctcattgatgctgtgcaaatttatctggcatggctttttgttttgtttgtttcttagagacagggttttgctatgttgcccagctgggctcaaacgatcctcccaccttagcctcacaagtaattgagactggaggtgcataccacagtacctggatgtcgtgcttttttaaaagctgggataaaataatataaaacattaaacttgctattttaaccattttaaagtaaacattcacattgttggcagccatcaccattattcatctccagaacttttctgtaacatgctttttttggggggtgagggaggggggtggggacagagtctcactctgtcacccaggctgaagtgcggtggcatgatctcgactcactgcgccttccacctcccaggttcatgcgattcttctgcctcagcctctagagtagctgggattacagacatgcgccaccatacccgactaatttttgtatttgtagtagagatagggtctcactattggccaggcaggtctcaacctcctgacctcaggtgatctgcccaccttggcctcccaaactgctgggattacaggcatgagcctcttcacccggcctgtgacatgcttttaaaatacgcatggctgttgtgtgttctctcttgtaagtgggaactaaactttgagtacacatggaaataaagaagggaacaacaacagataccagagccacttgagggtagagagtaggagaaggtggggattgaaaaactacctattgggtactgtgcttactacctgggtgatgaaataagctatacaccaaacccctgtgacacgcagtttacccgtataacaaatacgcacatggaccccctgaacctaaaataaaaattaattaataaaacatatatgtccatggccagggatagtggcttatgcctgtaatcccagcactttggcaggccaaagtgggaggattgctttaggccaggagttagagactagcttgggcaacatatcaagaccccatctctacaaaaattttttgttaaaacttagccccgtatggtggtgcatgccgatagtcctagctgctcaggaggctgaggtgggaggattgcttgagcccaggagttcaagcctgcagtgagctataatcataccactatatctcaacctaggtgccagaacgagaccccatctctaaaaaatacacatacccagcccgcacatcagaatcagaatcacctagggcaagacctgggcatttactttgtaaagacccatagatagctgggtgcagtggctcgcacctgtaatcccagcactttgggaggccgaggcaggcagatcacctgaggtcgggagttcgagaccagcctgaccaacacggagacaccccatctctactaaaaatacaaaattagccaggcgtggtggtgcatgcatgtaatcccagctactctggaggctgagccaggagaatcgcttaaatccaggaggcagaggttgcagtgagccgagatcatgccattgcactccagcctgggcagtaagagcaaaactccatctcaaaaaaaaaagacccatagataaattggggactactatagtagccagtgtacgttattcccattttttattgtttggttatctctaagattatgtagttttattaaattaagctatttttggtgggtatgaattgattaaattaagcctcatcttgctaaaatgacattttcctatcattttttcattactattcttttctgtaggaagatataaaatcattaactgctcatgtaattgaaaattactggaaagcactggaagatgtagattatgtacagacatttaaaggattaaaactgagatttgaacaacaaagagaaaggcaagataatcccaaacttgacaggtaaattaccatatatttaaacctattcgttcagcatcaagtcgtatggtagtggctttattgtttatttgatattatttggcttgacaaggaacagggaaatcagcagatagcaaatagaaattgtagcttcctgtaagggtcaacataaatgtttccctgaagattaggctggttattagtataatacctcaggcatgtatcaggctagataagggaaaaaaaaaaaaaaagaccaaacagtggaagtgaggcttcatgtgttccaaataaaatcagaggattatattacttgctttgaatttacaagttactaaggttacaaattattatttaaaattttgtacattaatctaaatacctggatttacattgatactttaatatttgtaaatttcatgttaattccctatgttaacaagtttaataagtcatctgtaacagtacaattaagtccatatatgattgtatttactctttcttccctactcatagtatgcgttccattttgaggaatcacagatatcgaagagatgccagaacactagaagatgaagaagagatgtggtttaacacagatgaagatgacatggaagatggagaagctgtagtgtctccatctgacaaaactaaaaatgatgatgatattatggatccaataagtaaattcatggaaaggaagaaatgtatgttggaaaaaaatgggcaagagaaaattaaggctttcttactctagatttattcttatttcttgacaaaatgattatttgcttggaaggtgtgatggcatacggtttaaagactctattgctttatgggatgtgactgaatagcagtgttgtgtaggcataaacttaagttttcttaatttgagttgaataaggaatatactatttcaggaagggtagggatactaaatatgattctgaaggtttcaattcttctctggggtaagatccaatgaatggaattgtggttagtattttggtaagcttcttttataaattgaacttcaatgtttctacccagcgtagtaagctagttaaatgtgttttagtgttacctcatttggggaaatttaaaaaagaagtatgggggacgactattgacagtattctcatttttagtaaaagaaagtgaggaaaaggaagtgcttctgaaaacaaacctttctggacggcagagcccaagtttcaagctttccctgtccagtggaacgaagactaacctcaccagccagtcatctacaacaaatctgcctggttctccgggatcacctggatccccaggatctccaggctctcctggatccgtacctaaaaatacatctcagacggcagctattactacaaaggtacattcttgactcccattttgcccccttttttcccaattgaagctttctcaacaataattttgactaagattccctttggttactgccacctagaactgatttaacatccctgaactagaggatgagtcccccccaccgcttgaacttatataaaggttgagaaatttctgaaagttttttttatgaccaatgcaagtctgcatatagtgtgaattctcacttgggtattttggattttagaactgaaacttcaaatttgtatgtcaaaacatttacagaaatgttcaaggttttcagttattcttgaataaatgttcctaactaatacccagataaagcctttgtggggaaatgataatctaaatatctgggtacttctaactttactttgccagttaaggtttgttaagaaaattaaacatctactatcactaacatttcatataagaaatgaacaagggctgggcacggtggctcacgcctgtaatcccagcactttgggaggctgaggcgggcaggacacgaggtcaggagatcgagaccgtcctggctaacgtggtgaaaccccgtttctactaaaaatacaaaaattagccaggcgtggtggcgggcgcctgtagtcccagctactctggaggctgaggcaggagaatggcatgaacctgggaggcggagcttgcagtgagctgagatcgctactgcaacagcgagactccatctcaaaaaaaaaaaaaaaaaaaggaacaaaatcttaagaaaaaatgtagaaaacatgcaatctcagaataaaaccagttttgggggctccttatgccaaccacccttttcttttgagacataatatattgattattgggctagcagactagcagttaaaagactggcatttgggaatcactgatctaaatcagacacgtaatgcccattcagtcttttttttttctggcgtgagctggagactcctgacggctaagaagtgaatctgagacacgctgaaatgaagaggcaggcttgagagcagagcagtgtgaatttttcccttagcatcgaaataaagcaagcagcagccaggcgcggtggcttacgcccgtaatcccagtgctttgggaggtccaggggggtgggtcacgaggtcaggagatccgagaccatcctggctaatacggtgaaaccccgtctctactaaaaatacaaaaacattagccgcgtgtggtggcgggcgcctgtagtctcaactactcaggaggctgaggcaggcgaatggtgtgatcccgggaggtggagcttgcagggagctgagatggcgccactgcactccagcctgggcgacagagtgagactccatctcaaaaaataaataaagcaagcggcagtggtttctggtgaaggagcagggctaaaaggaaacccagatgaaatgatgaggaagagtcagggtagaactgctttcctaacctctaataaatagaaaaagcctgtctaccctcatttctggtggtctctttatctgctgcagttttcattttggtacttttttttttttttgacagagtctcagtctgtcacccaggctggagtgcagtggcgtgatcttagctcactgcaatctccaccttccagattaaagcgattcttgtgcctcagcctcccaagtagctgggattacagatgtgcaccaccacacctggctaatttttgtaattttattagagacagggtttcactatgttaattaacaggccaggctggtctcaaactcctgtcctcatgtgatccctccgcctcagcctcccaaagtgctggaattacaggcacaggccaccatgctcagcctcatttttatactattttagactttatgtttaaaaaaattttaagatgctattaagtcttgaaacaaacatttttcattcattttctaactcctgggtaatttgctaggattataaactacttaaatttttttgctttagtttgggtgcagtggctcatgcctgtaatcccagcactttgggagtccaaggtaggtggatcgcctgaggtcaggagttcaagaccaggctggccaacatgacaaaaccctgtctctagtaaaaatacaaaaattacccaggcgtggtggcgggcgcctgtaatcacagctactcggcaggctgaggcagggagaattgcttgaacctgggaggtggaggttgcagtgagccgagatcgcaccactgcactccagcctgggtgacatagcgagactccgacttggaaaaaaaaaatttttgctttaattctaattaactcaaagttttcccttattgtaaaaaagtatgcatgtttattacaggaaatttagaaaatatgtaaacataatgaattgaagtttaacacagtcccaccacccagaaataaccaccgttactatgttggtaggatctattttctttctccagccagaaaacaccagtgtttttatatgttttattttctgttctttaaataatccttatttcttaacagggaggcctcgtgggtctggtagattatcctgatgatgatgaagatgatgatgaggatgaagataaggaagatacgttaccattgtcaaagaaagcaaaatttgattcataataatggcaacggcctaggatcagtacctgttgaaaaaaactggttctccacccctcccccatacaaaatccacaacaaagcgcagtggtctcttgtgaatgactgacacagatcagcctcttacacttgacttctgctcatcaagtgccaattcaatggagcaggaggaggggatatcatatatttaggggaaagacttaagcctttgagctctccagcttggaccacacattgcccttttctcagggaaggaaatggaaacaaaaagccaacagggcaggggttttgtaagtggaactctggattgactggtcagttgctacaatcagaatatgctttcttggaccatgtttgagactcagaagaatgggcctttctgccataattcttcactagtcaagaatgccagcagtttctttgtataaagagacctgcctttaaaatcatacattctgaacattttagtcaagctacaacaggtttggaaaacctctgtgggggaggggcgagtataaagttttcctcttttttaactgttccctttgcccttcaaactgcagatatttttttttttaagtggggacttctccctacttgattaaagattgagtggaattctagatgtggtcatttgtgtcataatttttttgttttattttgtttttgattttttttttcctcccctgagtgtatgcttagttgttgagtatatatatttgggaccattaaaactttttttgatgtaatataacctaacgttgtgctggtacctgttttaccatgtgtaatttttgttctacatcacagttcttaatttgtttagagttttatgaaagatggtatagtttttattgacaaaagcaaagtaatcttacaactatgtgcatacaaaagcaatactattttgtgactaaatattttatattaaaatttacatcagcaactgtcttgagaattcagggaaatagaatggaatttaaaacttcaacagttttgttaaatctagaaacatgaaattagtattccaaagagattctgaaatttcttttcttggggaaatgacggtacattaaatcaaaattgaggatggatgatttaaaaacatttgacttttgaataataaaaagaaaagtgaagagtaagagaaa

SEQ ID NO: 134 - DNA, 22556 bp, Homo sapiens
agcgcacgtcggcagtcggctccctcgttgaccgaatcaccgacctctctccccagctgtatttccaaaatgtcgctttctaacaagctgacgctggacaagctggacgttaaagggaagcgggtcgttatgaggtaattctgcacgtttgcccgcgtgctctctgtgctctgtcgcaaacctctttggccggagccgacttgttctctcgtctgctctaagttcttttagcttttggctgggccccaggggtcctaggcttggagggcgaggctgctcacgggtttggtggtttctagccgcattttccccagcccagaaagcacccgaagtcacccttcggggatggatcccactgaggaagggctgagattgccgctgggacccattttgtcctttttcctattggtgaaatgcagttccgttgcctccagctcccagtcggcgagatgggacttaatgcttatcctgcaaatctctaggcttcaaggaagggaccttgaaaggtcattttactttcccttcccccacgctcctagaccgtcgcagccaaatgagaaacggcccacatctcacaggttcctgcacaaaaggatatttttccaagaggatgttgatttaacttcaggagtagacccccccgccccccgccactaaagaattggggtgggagggtagggcggggcgaactggaggaggccctgcagagcttacgtaacaggcgtctgctgccctgcagcgcggtatcgttggactcttgggcacaggatttgcatcaggattgtgacatactaggtaatggtagagcagggtgtggctgctcatacttgctggcctccaatctcatccccacgtgtggctagaaaagtagaattttaaaattgggggaagtttcctcgtgcactttgggtctcttactctgcgcatgtggatctctagtcacttgccaacacggtttctctcttatctgccagaattgttggtagagtgggcagcttttacatttatcctttttgtcacgtgtgatatatttgtgcataccaggagcaaggtgcaggaggatgagtcggtatgtaactgatggacttgactgttcatataccttaacaggatccaagagtggtgtttttgaggggtcataaaggtttctgttgatagcattttgcaaccttgacctttttgggaagtggttgattgatgggtaggtatttatttggctggtgtaatctagccccttttccaatttgggctggttcaaatgagggcttgtgttggatattaacagacacgtaagtcagtaggagatctccctttactctaactttaaacatatgaggacacgtttgagttagggaactgtatgggtaccctaaaaggacatgtagctctcctcttctctctaatttcactttggtcaatatttttgcaggtaaccgctgccctgctgtggagatagaagaacccaataatttatgtccatgaaaaatacctggtttccacatttccccaaatgacataggcctttgtaatctggacaaagtaggagtcacagccatgttagtactagaggagtgccctttctggccctcatacaatcctaaaaaaaggggatagaccctgtaaaaaacaggacaggtggacattggcatgcaactagcttttaggttttaattagttccttgcatctcccctgtgttcgacgctgattcttccagatgcatggaccaactaacagacaaggagtgggacattatgctgataaccttcctgtaattgcagtcttgggctttatttcctctctctctagggaaactggcttgaggaagctagctgggggcgggattggaggagctgcttaacttttctccctctggacctaataaagtttcatttagcacacgctaacccaaagccttgaaatgattggctagtcctgttttgctgatggaaaatgacctgttcagggttactgaactaccaagttggtggcagagctaggagtagaatttaggtctccttggctatcaactagatcctctgaatattcgagacaatgaccaaggatacgttgaaatagaactttctcccgtaacctggataccttctacttatttaggctgaggacaggaagttacatggttccctgattattaatgtatttcttttgaacagagagtcacattgtaggcctacttttttggaggtgcttaggcagccatgtggtgtcagctcaattcctttttgtttcaacgtggtggttgctggcggtgtttccggaatggggcttcctgagtagtggctgcctcatttgtcgtctttgtcctgcagaagtgaactatggtatttgctgactcttctggtccactggtttggattgccaagggaaattgatttgttgaggtaacatgggatagccagaaacctctgacttgttaattaccaggttccatcttagttttttaggactccgcagttgactttacagcctctttgaatacacttctgcttatttttgtggtaatttcctttctttctctcataggttgccagtcatcctttgcctgcttgtaaagcacttcctttttgcttgctcctgcctttttttttaaaccttactggttttctccaacttgtaacttgtaaagaaactgctttgatgtagtgggaagagaaacaggaaaaaattgagagcagagaaaaagtcactaagacacccacaatatcccagttttccatctggggcagtgaagcattgatggacatggttcctttgagagtttttaatggaactggacctgggacctgagatttcaggtgatagagacttgatattcttattccagctaaatcagtatattttttaatgttttattttgaaataaagattcatgggaggttacaaagttagagaggtcttgtgttcaacccattttcccccaatggatgcatcttacctaattatagaacaatatcaaaagtaggaaattgacattggtataaagtgtgtatggttctatgccattttattacgtgcgtagatttgtgtaaccgccaccacaatcaagatacagaactattagatcaccaccaagatctccttcatgctacctctttataataataaccaccccccttcctgactcctggtaactactgatctgtccactgtttctaaaattttgtcacttcaaaaatactatacagattgaatcacatggtatataaccttttgggattaacttttttcacttagcataatgtcctcaaaatttatccacattgtcacatgtatcaaaagttcatacctgtgtattgctgagtagtattccatggtgtggttgtattatagtttgtttaactatcattgaaggatattagggttgtttctgatttggggctattacaaatacagctgctgtgaacatttgtatacaagtcttggtatggacatacgctgtcatttttcatgggtaaacacctaggagtggaattgctgggccacgtccttttgaggtatccccagactgttttccaaggtggctgcagcatttcacatttctaccagcagtatttgagtaatcagtttctctgcttcattaccagctattttagttatttttcgttctgatggatatgtagtaataactgactttgtgcctgaagcaaagctcaggggtgttataaggaaacgaaaaaaaaaaaaaagaaaattgtgcatattttatgtaaaatggaacaagtagaatctgtaggcaagagcagttcctgtgttggagtcctctgaggagaagctaaaagcagagctgttgtgagtgtaggagataaggggaggtaatccagagggcattgaggagagagtatcaaccaagtctaattcattagtaagctgacaccatggcagcttggatagatgagacagtttcttaggtgtctctgtccaaagatattcctccctgtaagggttgggggtagagagtagcactgcaagaagtggcttgtgcccatccttttgccattagtccttttgagcataggccttctgggaggttgcatgggggaaaatgacccatggtaatgggatattctctcttctttggaatgtactttaaggctggcaggctccttgttcaggatatttaaagaagacagagaatcaagtggcctgaaacaaagtagagtgtatttctttcatcagaggcttactgcctttaattttgaagactttaaaacatgttttactatagaattatttttcctcagcctacctttggaaaggctgttcttcagtgaggtagattggagttcaggcctagtggatataggaaattggtggtcttctcagtatgtctgtaggagtttgtaattgccttagccttagagaggaaggggtatttaaaaaggcagaggaaaaagatggaggcttataatcaaggatagcagcagtcttcttgattaggtcatacttcactgtagtccctttgcaagtgatgttagctgtttttagtagtggttgatttacttgtcaaatcacagaattacattttggagaaacatataacaacaacacttttatggcatttactgtgtgtcaggtacacttctaagcactttacaaattgctgacttactaattctctcagtaactacgaggtagatactgtcatcccgatgagaaaaaaatcacttaaaaataatcatggcaggcacaactcttaaaccttaaaaatagctgccatacattattgttttcattcacattgaagtaggctgaggttccaaggagttcagaataattggttcttaagaatgataacatagtaatctgttgggtaagagatactgcagtacattattttcttgtgtcgtcttgattacttcccttctaatttgcctgtttgtcaggtgggctggggcacatgtcccaccctctcttctcaggctttttgaaagaggctgtcttatgttgtgtgtattgcttgaaggacccctagtcttaaggccccaggctttctccaaaaagaatgattttctcttagtgtgttttatttttattttaatttttttctcgagtcatgttagtttcacgaggacccagaaatagtatcaagggaattaggatcaagatgcattccttattattcctcacccctctagctgctacccggatactattgtgccaggcccagacagatatctttttaggtggaactagctttagcttcccagatcttcagggctagttcctgtgatttaagttaggttttttttttaaaattctttttaaagtatgaatacatacctaaaagggcacaaatcacaagttcaaagaattaccacaaaatgagcacatttgtatggtcactgaggttaagagatagaacattaccagaaccccaaagcctctggtgtcgttatcccagtcaccactcccgccatcctccccatgactaaccactattttgacttttaatgccactgattatttttaagatgagatttgaatttctgacttatttaactggttcattaaaaatgcatctcctagtctttgatggaacagtaagttgatcatggtcttgcatctttcttttttagagtcgacttcaatgttcctatgaagaacaaccagataacaaacaaccagaggtaaggtccctgctaatccttgggctgggtttaagatgtgtgtaggtacacaggatgaaatgtttttcctttcatattgtattatggaactgtagcaacttaaaacaaatgattttggctttctatcaacccactctctgatctgctttcttatttatgagaatatacaaatataagcaaaatcttaagaaagtgattccccttcccttgttttttgaaaattagaagaatttggagttcattttctttttttgagatagggtctcactctgtcacccagactggagtgtagtggtgtgatcacggttcactgcagccttaaccttctgggctcaagcagtcctctggcctcagcttcccgaggagctggaacaacaggtgcacaccactacacctggttaaattaaaaaaaaatttttttttgtagagatggggtctcactatgttgcctaggctgttctcaaactcctggactcaagtgatcctcctgccttggcttcctaaagtgctgggaccacaggtgtaagcccccatacctggcagagttattcatttttaaagaatataaaagttggctgggtgcggtggctcacatctgtaatcccagcactttggaaggccgaggcaggaggattgcttgaggccagtagttcgagaacagcctggccaatatagtaagacaccatctctataaaacacacacaaaaaatataaaaatttaaggttacttggcttctcttgcaaaatgaagaactatgtaagagaaggattttaaaagtaccagtagttactaaggttatatgtagttttacaagcccccattcaaatggctcagataagtcaatttttgagaattttcatttgtttttgcttccaaaaaaacaaacaggaaagacttcagaagtacgttttcagtcagtttagctgctccagtgtcttggatcctagattcagaaacaaattttaagtgagagtactgctcttgcttttgactagattataaaaggtctttatttttgtctttactttctttttaatttttttaatttttaatttttgtagattttatatatatatatatatgggttacatgagatattttgataaaagcatgcaatacataatcacatcaggttaaatggggtatccatcaagaaggtttttatttaatttttttttttttttgagacagggcctcgttctgtcgcccaggctggagtgcagtggcacgatcttggctcactgcaatctctgcctcctgggctcaagcgatcctcccatctcagcctcccagggagctgagaccacaggcgtgggccaccacacctggctactttttcatattttttttgtagagacagcgttttgcccttttgcccaagctggccttgagctcctggaccccgcccaccttggcctcccaaagtgctgggaatacaggcatgagtcactgtgctccgcctattttaaattttaaatgaagggtttgtgttggcaaggtgctttctaatgatctagaccagtggtatctaatagaaatacaatgtgagccaaattgtgttaattaaattaaagggacatttaacttttttggtactaagtcttcaagatctggcatgtgtttttatactacagcacatctcaatttgatctagttatatatctggtactcaacagacacacatgactaaatgactgtcgtaatggacagtgcaggtctagcccagaacattttcaggtattggtcctagaatagagcctgtcattttgccaagcacatccctgctgtaccatagtggcagggtctttgtataaggcagatctgatcccgcttgatcttcattattgtgcaacacacagaaacgattggaaatatgcctatcaagttattttaagagtaaagaaacatgtttggaaatcttttcatttccggaaatccatggagttgattaacaaaatgaagcattagaaataataaaacttgctgataagggatagtcctgaaaactaattggttccattgcacaaactttgtacctgatacagatttttaaatttgatataaaggagttcttatatctgctaaatattaataacataagatattttaaaagtataacttttttaatcattccattctttgctcagatgtcatcatatcagactttccctggccatcctgtctaaaaatctcctctaccattgttccccggtcatttttgtcctcaaaagtaggggaacaaaaatggggaacaatggtttgttttttttctgtatctcaccatctgatatattacatgtacgcacacacacatacatgtttattgtctctctccattagaatttcacttccatgagaacagagagtttttaaaaaagttttctgtttcattctcagaacctggaatgatgcctggcacaaaagaagcattcaataaatatttgatgaataaataaatgcttttcttgatcaattttaatttcttataaactggcaaaatggcaagttagtagcaggtttataacaaaacttttaaatgtttaaagggagttaattttttgattaatttataatgtaatgaatgtgatacattatggaaaccaagctctagacagtgcaattattttttcctacataaaaaagtgacttaggatctattaataggtgcagaaaagttactacatgttttttatttttccccaaatttcctttgatggtttcaagatttgagaattttatgtattttccatagtcatataagaagtgttttcaggggtccccaagatcacccacatatctcatgatgatttgctaggactcagagttgttctcatggctaaagtttattacagtgaaagaatgcatgacaagattaggaagaggaaaagacatgggggagtctagagaaatccatgggcttccagtttcctgtgaggggacacatcaagtgttttcctttcttcagcagtgaaaaatgcagtaattgtctgcagtgtttctgcctggagaagcatgctagagactcagatcccaagatttttgttgggaactggtaacatagggatcctctgcctagcaactaccaaaattacaaacttctgctgggtgtggtggctcacgcctgtattcccagcagtttgggaggctgaggcctgcagataacttgagcccaggagttcaagaccagcctggacaacatggtaaaacccctacaaaaaatacaaaaattagctgggcatggtggtgcattcctgtagttccagctacttgggaggctgaggtaggaagatgacctaagcccctggggaggttgaagctgcagtgagctgagattgtgcctctccactccagcctgttgggtgacagagtgagaccctgtctcaacaaaaaaaggaaaagaaaaaaaaaattctagacttctagagtggggcaggtgttcagcataaatcaccatgtttgtatagacggtctaggaagagtgaatagcccttgttggtcttgtcagttaactttgaaagccaagttcccagataccagccaggatctaatcttgcagacaggtccttctgtagatagtagcctcaggcctgctgtgttaactcttgtctgtgaaaggggcagatacataatgagattgtacaatcctaggtggagggttggcattgcatttaacttcttaaggaccaccattgaattactgatagtagatttgaaggaacttggagaagaaaaggagctttatgctttatgaggttatcaataagctagttcccactaatttctaggagtaacttcattctgtttgttgtctctctttggttgcaggattaaggctgctgtcccaagcatcaaattctgcttggacaatggagccaagtcggtagtccttatgagccacctaggccggcctgatggtgtgcccatgcctgacaagtactccttagagccagttgctgtagaactcaaatctctgctgggcaagtaagtgccaggctctggtgctggtagactttgtggcgggggaagttgtcaagcacgttgttactggtttttaactttcatactgctcaagtgtcttcatctcttcctcttctcagggatgttctgttcttgaaggactgtgtaggcccagaagtggagaaagcctgtgccaacccagctgctgggtctgtcatcctgctggagaacctccgctttcatgtggaggaagaagggaagggaaaagatgcttctgggaacaaggtaggacctgtgattttgacattattgggggtgagggcctgagtctgtaagagactgtggttgaagaatagagaaagctcatttattttaacttagacaccttttattgaagcatacaatgccgacacagcttgatgggttatctcaaagtaaacacacttgtgtaaccaccacccaggtcaaggaatagaatattaccagcatcccagaagccctccttcatgttcaggtggtgtttaaatatgtttgaaaaatatgtgaacacctttgaggtgaaagagtattcagtgaatatgatggtcatgatgatgtcaccttggatttaaggcattttcttaagatgtgtaaagtatgttcctttaaatctctctttaagatagaggtacaggtatcgacttatttcataaagaaactaagtctcaaaaaaaaaaaaacttaagtttctgaaaggcagtcatacgattaaagttagaggcagtggtgctgttggtctttagagctcagcccattcaatcagcaaactttttctataaatggccagatagttaatattttaggctttctgtgttgtgcagtcacttccatctgcatatagtctctgttggaactactcacctctgccgatgttgtgcaaaagcagccatagataactcaccaaacagattactgtgaactgacaaccagaattcaaatattcaatgataaaactggctctttgcagatgattttgaatttgcccattgactagaaaggaagctgaaggcattttttagtactttccactattctggtctttagtatctcggagaacaagatgctctgagtctagtgtctcagtctcctttggcttctcacatttattaaggtcattgggagtgcctgctttcaagcagtttctttttttagcaccaaagatgctggtcttgccttatcctgcttttggcatggtcttgctgcagtattaggagtcaaatgctgacctaaaatttggtgtccttttaatctggaactcatgatgcatgaactctagggcttagaagtggcaggaggcaaagggcatattgaagcaaaactttttatttaggaaatgatgagctgactatgtagtctatgacttttttagtaaactgacttgacattcactatctaatggcttttaatacctgaaatttcaggagtcagtcccaagttcaaaatggattaaaaaaacagtgaggctgggtgcggtgcctcatgcctgtaatcccagcgctttgggaggccgaggtgggtggatcacaaggtcaggagttcgagacctgcctggccaacatggtgaaaccctgtttctactaaaaatacaaaaaagtcgggcatggtggcaagtgcctgtaattccagctactccggaggctgaggcaggagaattgcttgaacccaggatgtggaggttgcagtgagccaagtttgcagcactgcattccagcctgggcaacagagcaagactctgtctcaaaaaaaccacaaaaacaaagtgaggatatgaggacataaacattttccctttatccaaagtgcccacattgatcttttaagggccttctctttcttctagttatttgcagatcagtaaatgagaaatgggttctgattgatattatttccatggcaccttttttcatgaagagctttcaatttaccctgtttttccttaaatatctttttaaagagacagggtcttgttctgttgcccatggtggagtgcagtggcatgacattaattattgcagcctcaaacttgagggctgaagtgatcctcctgcctcatccttgtagggagctaggactacaggcacataccaccatgtccaactgacctttacttttttttttttttcctggtagagacggggtcttgctatgttgcccaggctcatctcgaactcctgggcttaagtgatcctcccatattggcctcccaaagtgttgggattataggtgtgagctactgcccctggcctccttaaatagttcgtaaatggaggggttattatgcctttttgatagaagggaaaatttcagagcaacttcccaaaggtgacacaatgaattagtgtcagagctggacatagaactcaggtctccttacatttgagcattgttatcattactacatgtgtcatcttccaatcactagtggcagatgttattgtagtctacagagcttatgggagtgccacaatcttcaattttagcattagtgcctctgcaattctttggatctttagggaaaagccccattttttatggcagtccccttcacctccttgatacataggagcataggagtgggcagtgacttaaaatgaacatctgctttgtgctatgtactcttctgtgtcctgtcccctttcatctggcttgcttcctgtgcctctttgcttaatctcctgccagagactctctggtttgcttatcctcccatcttgctttctgtcccctttggggtatgccttgatggcaagctgacattttaaagctctatgtttaacttctacattttcttcctctctttttgtagaagtatatttcttgttttctcagatgcctagcttccagagaaggtcataaaatacctttttgtcaatgtgaagtgtttctgaggttcttttctgttgtcatgtttccatctgccttctctgtcccagcttgcccttgttgcttttatgaggaatatgtgtgagagccccttgcacttcgcagaaaggccttggtagccagcagcttgagtcaagtatgatactatcacaaggagaatgtttaaaatgaggaactaagtcaaggagagggaaggataatcagaaccttgagctgaaggctggggagaggctagtggggtgtggttaacttcatgtgattagaggtaaagccatcgttcaggaatattaggtttgcaatttgagggaagttaagggagagcagaaacatgcagaaatgaccaaagtatctggaatatttggaagaaagaacacatcctactgctggttgtaaaaaatcgctgtcccacctactcagggtctttagagatgttcaagaggactcttggtgtatgaaatgcttttatagttgtctttggagccatcacattttctgtttttgtttttctctataggttaaagccgagccagccaaaatagaagctttccgagcttcactttccaagctaggggatgtctatgtcaatgatgcttttggcactgctcacagagcccacaggtaccaagaaccttgtagactaccacactgagaacagtattcctatttacttgagtagcccaagctctgggttgtttttggagagttttgtattatactgtaatcctttcagcttctctaattggaactgccactatggctcttgttgagtagctctcatccaaagaggaaataaaggtaaaaaaatgttggtaattgtagggctttttgtggagtttcaggaagaggttgctctttctcaccttagatattttgtacagagttatccttttatgaacgttataagatcagactctcatgctgtcagtaggaagcaaattgaggaatcctcttctgctatcatcaaccggccaattacttactgtgatttgccctttggcctgcctgaagagtgttaactgggtatcttaaattctacctaagttcattacttttttactctttccctttgaccttgcactattagttaaaaatcttatcttgtacctaagtgttttttgttgcaatgtagggatgaaaaccatgatttcttgcagtccagaagtagaaatattttagtgataaggagctggcctctaggactaggaggaatgatagggattgactagaatctgaatgtctttgatcttttctagctccatggtaggagtcaatctgccacagaaggctggtgggtttttgatgaagaaggagctgaactactttgcaaaggccttggagagcccagagcgacccttcctggccatcctgggcgggtatgaagaactctttaagatcatgctttaagtattgtttgcctggtagtaggccataacttgggtggtttattgtcatatagctcagtcacactgggtaactgaggagaatttaataaaggaactacaggctgggcatggtggctcacacctgtaatcccagcacattgggagggcccaggcaggaagattgcttgagcccaggagtttgagatgggcccagacaacaaagtgagatctcatgtctacaaaaaaaaattagctgggcggtggtggtatgcacctgtggtcccagttaccagagaggctgaggtgggaggatcacttgagcctgggaggtagaggctgcagtgcactgtgatcacgccactgcactccagcctgggtgacagagcaagaccgtttctaaataaataaataaataaataaataaacaaacaaacgaacgaactacatacagaggtgtgggtagggttcagggaaaccacaaagggacagtacagtaatttggggctaccaacaggcatcaccatttctatgcctgaagggacaaagggaggggaatggttatcagaattcagagaggaaagttggtgtggagagagctatctgatgggaactgtagcctttggtcaaaggacacaagatctggtagggagggggagccagggcaataaatattctgatctcctttcagtctcctgctgctgcaccccctcccaccctcaatttggctgaaacccaaatggaagccagagcgcaagaaagctccttgatgtagtccatgcaggtcctcctcctgtgatgcaacagggtagagaaggatagaagatggctctgcagggaagaatgggaaagatccaccataggtgctcatttagcaattttgaagtgcttgagccttataacctggcagggtataactatataacctggcagggtataaccatataatctggcagggtataaccatataatctggcagggtataaccatataacctggcagggtataactatgaaaacctcttcatatgtgtttaatatataatttagacctcatttctccagattacatacctattttatcttttctcctatagggaaaggcagcaagtagataatgattttccaatgggttagttaaaaatagaaatttcagaattgagggttgagaggaggataaattttaggtgagagagctagcactgcttggataagacaatttcctgtgacttggtgtggtgatctaggtagcagtctctttatggctggaggcccattacccttctatgagcagggttttttcccccaggggagtgaacatactatctcctgatgaaaattgactctggagttgggtgtcaatttcaggtagcatagttgcttatactgtttggctctgtgtctccacccaaatctcatctcgaattatccccacgtgttgtgggagggacctggtgattggatcaagggggcggttcaccccatactgttcttgtgatagtgttgtttggcagttccaccctcgctcgcctctctcttgccaccatgtaagatgtgacttgcttcccctttgccttccgccacgattgtaaatttcctgaggcctctccagccatgcggaactgtgagtcaatttaacctttctttataaattaccaagtctcaggtagtcctttatagcattgtgaaaatgggctaatacagttgctttctaggctttatgagcccagtttcagagtcttaaaaataactcaggtagatacaggttgttgtgtcttgttcttggaaaaaggtatctattcctgggctttgttcttcaactttctgtagacctggaatatgggagtgagtgccacctagtgctaccttatggttaggtttttaggttcagactgaaatagctgttacggggaattggatgtgagatttttttgccacctttcttgtagtgtagtttccctaggccattaacagtttttgggaaaacttttatattttattaaacaaactttattgtaagaaacactcatatgtatggaagttgagagaatagtgtagtaaactcccaggtatccattaccctgtttcaacaattaattgacagttttgctaatcttgtttcttttatgtcctaactctgttttgtcaggaatgtacacacacacacacacacatatatatacacacacacacgtatatattcctgacaaagtgaatacaagtgaaataaatatgtgtatatatgtgtgtgtgtgtgtgtacatatatagatattttagatatatagacatatctatatatctagatctagatctatatatagatttttttttttctgatacagggtctcactctgctgcccaggctgaagtgcagtggcatgatcacagctcactgcagctttgaccttccaggctcaagcgatcctcccacctcagcctccctagtacctgggactacaggcatgcatcaccatgcctggctaatttttgaatctttttgtagagacagggtctcactgtgttgcccaggctggtctcgaactctggggctcaggcgatctgcctgccttggtctcccaaagtgttgagattacaggcgtgagcttgtgccctgctgtcaggaatgtttttaagttagccttagacatcatatactttcacttacataggttgagtatcttttatctgaaatgcttgggaccataaatgttttggatttcagatttatttttggattttggaatatttgcatggtacttaccagttgagcatcctaatctgaaaatatgaaatctgaaatgttccaatgatatttcctttgagctcaaacagttttgatcttggaggattttagatttttggattagggatactcaacctgtaatactcctgtatacatcttgtaactgctaagcagatttcttttaaataatcaccatattatacctaacaaatttagcagttttgttactatcatccaatacccaatctgtattcagatgttcttgatcatctcagaagtgtctttttacagttggtttgtttgaataaggattcaaatgaagtccatgcattgcctttggctgttaggtatctcttgtaataatctcctatttattactttcattctgttgatttgttgaagaaacaggcatttgagctgtaagctattctttagaagaaattgaactcctttctaactgctttcttccctttgtgtgtgtatgtgtgtgtgtgtgtgtgtgtgtatttaaaacaatctatctttacccttggtggtaaccaatctttacaactgaaataaatagtaaatagtttcttgccatctgttcacccacatcactgttgtttcatacctccttttcacaaatcctagcatagggtttctcactggataggcattatcttgtttattgaatgaagaaggaaacagacacaaggtggtttgtccacgtaagtgggatttagttatatgggaatgtttatggaaggcaggctattactttgtttctctttagtttggatcttttttgtctcatagggagatgcaagatacatgtgtatttatcttatttccatgtactagaaaataagatcccaaagggtagggatctttctgttgcctttgccctgtgatgtttctcaaagacctagaatagtgcttggcacagagtaggtgcccagtaaatgtgttgaattgggtgacccaataaaaataaatgccataaagaaaatgtcccaggctgggcatggtggcttaggcatgtaaccctagtgctttggaaggccaaggcaggaggatcacttgagcttaggagtttgaaactagcctgggcaacatagtgagaccttgtctctacaaaaaaatttaaaaagaaaaattatccaggggtagtgttgtacgcctgtggtcgcagctacttgagaggctgaggcaagaggattgcttgagcctaggagttccaggttacagtgagctatgattgtaccactgcactccagcctcggcaacagagtgagactttgtgttgaaaagagagagagaaaaaaatgtcccagcaactgagcatagggtatgactttaggaatatatatttttgttcagtatatatttatttagtatacagtccagtcaatccctgctctaaggttaggataattctgagtggctctgggatcccacaattagcaatcgtgcttagatacaattagcaatcttgatgctctgaatttgtgtgtgtgtgtgtgtgtgtgtgtgtgtgtgtgtgtgtgtgttggggaatgtgcaaaatagatgtggaacccatagtttccttagacaagagtaggtcttctgagccctgcttaaaaaaagaatatggatttaaatctgttgtccatcagcttctaggtagaattaaaaaaaaatgtattgatggtaagtggggtgaggaatttttaaaaagatacactgatgtctggagccataccttaaaaggatttcttagaaatggattgagtttttgggttggagaaacatagggcaaagttaggcagtacttttgtcactttgagactttctctgttcctgtgccttgaaatagaaactcagtttctatgtaataccacttctctagtccattcttctttaagtgatgattcttgctttctcttgtagagctaaagttgcagacaagatccagctcatcaataatatgctggacaaagtcaatgagatgattattggtggtggaatggcttttaccttccttaaggtgctcaacaacatggaggtaggaaacaaatgccaagtggatgtgaaatagctctccatgataatagcaggttgtataaatgtaaaaagaaaacagtcttttgacatgagccctgaaaattcccatttttatttattttggcaagtctttcgtctttgcattgttcctttatattgtattgtgtctggttcctgtctgctttgtgaggcagtcttgttcttagtatagatgctgacctccatcattttggctcccctgtgtagattggcacttctctgtttgatgaagagggagccaagattgtcaaagacctaatgtccaaagctgagaagaatggtgtgaagattaccttgcctgttgactttgtcactgctgacaagtttgatgagaatgccaagactggccaagccactgtggcttctggcatacctgctggctggatggtgagtcacttgagtgggttggtagtgtgagtgaacagaaactctgtggtgtcatttattcattgattcagccaatcaacaagcattttaaaacaatctctataggagatctgtcagagagggctctgcatgttgcagtgagtccctcatggaagaatccatgggagaaaagcagtgctattggattactggccttcagtaatgcagtaatgtgttgcaaaactttgttgttgttgtttttttttttttttttgagacagagtctcgctgtgtcaccaggctggagtgcagtggcatgatctcggctcactgcaacctctgcctcccaggttcaagtgattctcctgcctaaccctccccagtagctgggactacaggtgtgcaccaccatgcccagctaatttttgtatttttcatagagacggggtttcaccatgttggtcaggatgatctcaatctcttgacctcatgatccacctgctgcggcctcccaaagtgctgggattacaggcgtgagccactgtgcccggcccatttttagttttatctgttttttcttcatctgtttaatgtgtattaagtacttactgcgtactggagatagtgtcatgtactttcatggtttgggttgttttggattatgttgctatctagaaagctatataagaaaactttctcatatgaaaaaattaagtatactgattacaagcagggagaaatgtaagtgtatattaaagactaatatagttgattttagggtgctccaaatatcattttgattgctgtataaaattgtatcatgtttttacatgctagtttgcttatttttcttttcaggcattcacgtattatttagttcagtgtttctcaaagtatgttcctaagaccagcagtatcagtatcatttttggaacttgttaaaaatgcaagttcttgggtcccaccccagacctaccgaatcaggaactgagggtggggccaaacagtctgtttgaataagccctcctggtgattctcatgcatggcaaagtttgagtactactgatctagtttactgtcattcccaacactattgacatctgttgttttgtgggggactgttgaattgtaaggttgtttaaagcatccttggccactagatgccagtagcaccctcccaagttgcaacaacaatatttctagacattgccacatgcctatctattatgaaggggcagaactgacctggttgagaaccattgatctagttttcactaacataaatagtgtggctaagaatgtctttattaaataacttttgaggttttccgttagacttgatcttccatacagtagaatttttgagtataaagggcatgaacaggtttataaagactgaagggtactatttgtttctagaagaaactttggtgtgcagccctgagttctggtcttggtggaggtggtgtttaagtagcttttcttgatagctcatcttctctttcacctctacccctcagggcttggactgtggtcctgaaagcagcaagaagtatgctgaggctgtcactcgggctaagcagattgtgtggaatggtcctgtgggggtatttgaatgggaagcttttgcccggggaaccaaagctctcatggatgaggtggtgaaagccacttctaggggctgcatcaccatcataggtaagcggtcctatacaaagctaatacccatataagctggcagaattctgatcagaggaaggtggaatggagaacttcttctatgtctctttattctgggtaaatgttaagaggtaaacaggtaggtaatttacagaggagcctcttggtaagatagagttgggggtttatcagctaccttttgggttggggagcacactgccttacagttttggtgccaatcccttttttttcttttctctcttttccctttttacctggctttcattcaacaggtggtggagacactgccacttgctgtgccaaatggaacacggaggataaagtcagccatgtgagcactgggggtggtgccagtttggagctcctggaaggtgagggtcttctgttttttggcttgtttgggataagggtggactgtgcagtgagaggtgggtagaatggagtggagaaagttagaaggtagtgttgtcattagcagtcattactacctgggcagtacagaggaacttcagataaagctcctggcatccactgaggcggggagggacagatagaaacttggtctgagagttatggtctagtagacctggaatccacaatgtaaaagttggccagctcctggccatatatcctaaaaaagagctggcatgttattgggaagataaagtgggggaaatctggcttactgggccctatagtaatgctgtctatgtatgtgtgctctctcaaaaacaggtaaagtccttcctggggtggatgctctcagcaatatttagtactttcctgccttttagttcctgtgcacagcccctaagtcaacttagcattttctgcatctccacttggcattagctaaaaccttccatgtcaagattcagctagtggccaagagatgcagtgccaggaacccttaaacagttgcacagcatctcagctcatcttcactgcaccctggatttgcatacattcttcaagatcccatttgaattttttagtgactaaaccattgtgcattctagagtgcatatatttatattttgcctgttaaaaagaaagtgagcagtgttagcttagttctcttttgatgtaggttattatgattagctttgtcactgtttcactactcagcatggaaacaagatgaaattccatttgtaggtagtgagacaaaattgatgatccattaagtaaacaataaaagtgtccattgaaaccgtgatttttttttttttcctgtcatactttgttaggaagggtgagaatagaatcttgaggaacggatcagatgtctatattgctgaatgcaagaagtggggcagcagcagtggagagatgggacaattagataaatgtccattctttatcaagggcctactttatggcagacattgtgctagtgcttttattctaacttttatttttatcagttacacatgatcataatttaaaaagtcaaggcttataacaaaaaagccccagcccattcctcccattcaagattcccactccccagaggtgaccactttcaactcttgagtttttcaggtatatacctccatgtttctaagtaatatgcttatattgttcacttcttttttttttattttttaaagaaatctatttcataccatggaggaaggctctgttccacatatatttccacttcttcattctctcggtatagttttgtcacaattatagattagatcaaaagtctacataactaatacagctgagctatgtagtatgctatgattaaatttacttatgtaa

SEQ ID NO: 135 - DNA, 52640 bp, Homo sapiens
atcagagcagctggcagcgcggcgggcagcgtttgccgagcgggcgctccgggtcgcacgcaagtccgcgcggggtccgggccacgcacgcggtttcatcgccatccccagccgggccacgcgcgcaggcagacaagctgttcgcggcgaccggagaggtgagcgggcgggccgggtcggggtgccagcccgggccgggcgcacggggctcgggaactttgcaaaactttcccgcgcggccagcccgggcgcacgcatgtcccgcactctgtcccgggatccagggcctccccttccacctaaccctcgggaatcgttccccggcacacatccggctggagccgggaccagcgctgcgtccccggagcccggcggggggtcgagcgcgccgggtgggggagggcctggcgagccgccggggaggatgtcaggctccgcgcctgcgcgcggggcgccccgcgattcaattgtcgcgcccgagcccgatttcgcgcgccctgagttccccgggagcatctgggccaatggggagcgagcggggcggggcggccgggtgctgcggagccaataagaggcggctcaagtgaaggggggcgggacttgacgagcgggggccccctctgtagtcccggcggcgggggtgggcgtgggctcgctggcgcgacccgcgcgggccagtgggagtgcgggagggacgccgagggtccagggtttggaggggcgcgagctgccgggggttggaggtcgaggtgagtcgcggggcgcgcgcgctcgcgggtggccgggacggggcggccggttaccatggccaccgcggggcgggcccggtcgcgcacgcgcgcggggggggccggcaaggagggggggcgtgggcaccgaggggtcccggggtccgcggatctcgggtggggtttttccctctcagtggcacttggttgagttcccccgggacttctgaagttccggcccgcgctggacttctgggattccctcttccgtaaataggaatccgaggaatgaatgaatcaatgaatgaatgaataaacgaaccaactcggccacttggcccgggcctcctttctcctctggtcgtggggaaggagggatgggttggaccttctgcttttctttcaattccctcttttcattctccttcctcctcaatcttcaacacttggctagtcgttaatgccttaagtgcttaatttgttgtgtctggtcctggccagggtctggctgtacaggaggactggaagggcatcctgggagtttcctggtgtccacaggccggacaaaagcaaccccgactccttagagcatggcatggctcagaggtgctggtaaaactgatgggggtttttgctgtccctcccctcagcgccgacaccatgtggatccaggttcggaccatggacgggaggcagacccacacggtggactcgctgtccaggctgaccaaggtggaggagctgaggcggaagatccaggagctgttccacgtggagccaggcctgcagaggctgttctacaggggcaaacaggtacacccgccgccagcacctttgttctatgcctggtccaggcctcgcgcctctgcagccaccagccgatactttctccctcccacctccccccccaacaacctcgtccggtcccacttcatctctcccggaaggagaagtccacagaaacctcaaatgcctgcgagaggaaggaacaaagggaggactcacagattgacacgctgggctggcggctggccctcgaatctatagggtctgggcttttaaacttcttttttcaaagctccgcctcaaaataatggctagagaaagaagttttggaggtggccgatggaaggctgaggaattttcgagaaagggcccaggaccatctggtagctaggacggaggggaccaggttttcttttttaaacatccaccaccaattgctctcagcctgtaccggttaagcatcagaccctgcgagtgtttgtttctaaaaatttggattagcttattcagagtctggagatggcgcttgctaatcaggaatttccgccaccctgagcctgctgtgctgcggctgctgctgacctggggcgtgtggtccccgaggggtccaccgaccctcgtctctttctctgttctgtctccagcccctcgttgcatttaaaatgtccccctttgatttcatagctgccacgtttggggcgctccctccattggcacctgggggtggaggtgctactttggttggtgtttttgtgggggactgtgggacctactgggagtggggtttcccggcaggatgagacagtgtgatcgaaggtgtaggtcccatctgctggagttggttggaccgtggggacgggcgtagactactggaactggattaaaagtcgtcagttgagctgcgtgtaccccactgtgttgttgttggattttgaaccgggtactgctgccatctggtgtctaggttggaaaataaacactgcgcccggccaggggtttttgggggctgggaggatcatgcctgctcactccagatgagacctgatgattaatttctctggcttgcatgccataggagaccttcattagccctcttcccgtaagagacgtgatgacttgagtcttaagaatctgagttaacccgccctgccccgggaggaggcgatctggagaacttggggagttgacggtgcaagccgcgtgtgtgcagagaagaggcagggccgggctcgacagaggagctccgcctggcgctctcttcctccctcctcctatgatgcgtgctccctttgtggcatccaaactgattttgatttgccactcagcctattgggtcagcacagaaggcttcatttcacaaagagtttctgaagcctgcaaggaccttctaagttcacagcgtaggtcagtggcgggttggactctcatgctcccaagttcaggagaggagataatgctgagtatccactctatgccagccaccgagctagcattttaacttttgcatttcaaccatgcaggaatgggaaaacacctagacacacctgccatgtagatttcaccatcggtattctgacttattaggtttatcttgaagcgctctgtctttctctctgcccgccaatccatctttttgggatgcatttcaaagtaagttgcagacaccagtccacctttcccttattactgcagcacaccgtcagtacctagagctcagtatttgtttttggttctgttttcattgattttttttgttgttgttcctatttgagacaggatctcactctgcccaggctgtgttgcagtggcacgatcacagctcactatagcctcagcttcctgggctcaagcaatcctccagcctcagcctcccaagtagctaggactataggcatgcaccaccatgcctggctagtttttgtatcttttgtagagatggggtcttattatattgcccagggtggtctcctgggctcaagtgaccctcctgccttggcctctcaaagttttggggttacaggcgtgagctacagtgccggacctaaaagctttgtctatagtgaaacagatgttagacagactgaataattttgacaaatgtctacatccatgcaacccaaaacccctatctcccctcatttgtaacataatacttgagtcatacaatagtgtctgtcacatttctaagtttagtgtgacaatgacaggaacacgtatgttaattagacatgtacattgtgcttttttttttttttttttgagatggagtttcattcttgttgcccaggctggagtgcagtggctcgatctgggctcactgcaaccttcatctcccaagttcaagcgatcctcctgccttagcctcccaagtagctgggattacagtcacccaccaccacgcctgattaattttttgtatttttagtagagacggagtttcaccatgttggccaggctggtcttgaactcctgacctcaggtgatccacctacctccgtctcccaaagtgctgggattacaggtgtgaaccactgcacccagccacgtacattgtgcttttaattgtcaggatgtccgcagtgatgacacctggccctagccttgccggaactcacccggactgaacagggagctgggattggaacctgggattttggtttctgagactgggctctcaacactgaatttcgtctcccaggtcagctctggtagttatgaaaagattcagtgttcctgtgtaaccttcataaccgcctcttagttcccttaccctgtggctgtttcccatgcagtagcttttttttttttttttttttttggagacagtttcgctcttattgcccaaggtggagtgcaattgcgtgatctcggcttacctcaacctccacctcctgggttccagcgattcttctgcctcagcctcccgagtagctgggattacaggtgtgcgccaccatgcgcagctaattttttttgtatttttagtagagatggggtttctccatgttggtcaggctggtctcgaactcccgacctcaggtgattcacacccccctcccccaccttggcctcccaaagtgctgggattagaggtgtgaaccgtcgcatccggcccccatgcagtagcttttaagagatcgtgtcgttgcttctgtcttccgggccacagagaggtgatgcagtttccccacttgcatggctgggaaagtgagctggcagcagggaggtttggacagtggcgggaaggcgggacagaggcacacagcagcacctcccagagcgtgaagtctgcaggcacccaggctaacgtgatagaaagcaacacagttcccggtgggcacaaatgggcagttgtccttatagaatgttctagagtgttcacagtctttttttttccctgtttaaagaaacctggcctagcagcccaaggtctgcagtgaagttgatggagaccccagagcagaacagagttgggtctgtctcggaatatggaggatctcgtggtggtctcacttgggctgaatagggtgacagtgatgtcacttgatgggcgggaacgcagggagctgatcgagggcagtgactttgggcagacggcccagcctaggcaacgggagaggcatctgcggcccccacccctcaatcttttttttttttttggctgcacatcaaaataacaatagctgtcttttgcggcacctttaacctgctcgggtacaacgctctgcactgtacataatcttttcagcatccctggcccgcgactcgccagctcccacatcatcttattttagatagggctaatacccaccacgctgcagcgcagtgcgaattcaatgaggttgtggatttgaagggcggagtgagccctgtgccaggctcacaatgaaagcgaaatcaatctcttagcacagggcctgtcccgctctgcactgtggatgtttggggccaggtcatcctctggctgggaccgtcctgggcactgcagggtgcggagcagcgtccctggcctccacccactccatgccagagcatcctgccctaccagtcatgacaaccacaaatattcccagagacttccatgcctcaaaggcaggattaaggtcagtctgatgcctcagttgaaatggtggcccaggaatggccttgcaagagtcacttgtcacagtgatgcctcaggtgtccccactggacggcccccttgcagagacctgcccttctgtctgcgggagggagggtccccaccaccagctcccacccactgcggcatccctcccccaggatggctccctggtagagggcgcggcctctgttagggtgactcaccactgctgttgtggccccgaagcagctgtagacaatctgtaaaccggtgggcgtggctttgttccaataaaacttgatttataaaaacaggtatggcggggcccagtggctcatgattgtaatcccggtgctttgggaggccaaggcaggcggatcacctgaggtcaggagttctagaacagcgtgccaacatggtgaaaccccgtctctactaaaaatacaaaaattagccagacgtggtggcgcatgtctgtagttccacttaggaggctgaggcaggagaatcgcttgaacctgggaggtgggaggttgcagtgagctgagatcccaccactgcactccagcctgggcgacagagcaagactccgtctcaaaaaaaaagcaaaacaaaaaacaaaaccaaaacaaaagaggtgcaggccagaattgtccccgtggacatagttggtcaattagattgcatactttaatccagcctcagttggtgtgtctgggttttctggctaggaagaatgctgctgtggaatgtgctggaacagatccttacgtgcgctgtgttggagtctttccaggtcaggggttctcaaacggatttcaggaccctttacatcatccagaatgatccaatagccccaggagcctgtgtctgtgtggattatgtctgccggctgttagtgtgttagaagttgaggccaggcatggtagctcacacctgtaatcccagcactttgggaggctgaggcgaggatcgcttgaggttgggagtttgagaccagcctgggccatgtagcaagaccccgtctctacaaaaaatgaaaattagccgggcatggtggcgcatgcctgtagtcctagctactcgggaggccaaggtgggaagatcacttgagcctgaaaggttgaggctgcagtgaaccaagattgtaccactgcattccagcctgggagacagagcgagactttgtctcaaaaaaaaaaaaaaccaaataaattgaaagctgagaaattcagagcacaagaagacaagcgcgccccctcttttagctgtcaacatggcggagccgtccctggtgacgcagcctccaaaggcctccctgtgccctcctgagaccgcaagagggaaagtggcagcgacagtgatcgtggtgtctttgtggcggttgtgttgacctcactgacccccgaagtgccgctctagggtctgtcctcagcggtgacccggccgggtcgaagggcagagttccgctgtcactagccctccacccgtcctgtgtgctgggatgccctcgcggcgccgtccacgccaccgccgccccctcttgtgggttctgtctcctccgtgtctaggatcctcctgcatccgtttttccttcctcccttctctccctccgtctgtcttgcccgcacctgaggttgtcgcagaggcgctgagacgggccagcaggagctgtggctgcccctcaggaaggcagagcagtttctcacttccttccccccaggtcccgtcaggcccctgcaggcactctctcttccggctggaggtccctcctgatcgaggcttacacggtctttgctgagctcctaaacttctggtttctatccctaaagttggagaaccactgctccccaaacccggtggcattatctgccctgctgtgccgctaggcagtgttcggcaccctgaaagagagcccctgaatgtggcacgaggggtaggaagtgggcagctcggtggggggggggggtgcagtgagcttttagtcttaagttttcgtttttttttttttttttttcttttttatagagatgggatctcgcttttttcaccaggctggtcttgaacccctggcctcaagtgatcctcccatcttgacttcccaaagtactgggtttacaggcatgagccaccacactcggccctttgtctaagttttcaaaaggaatcagcaaacttagttatcaagttgtatttgtatttatctggacacttttttttcttttcttttttttgcctttaagggagacagggtccacaaggccgggcgtggtggcttacgcctgtaatcccagcactttgggaggctgaggcaggcggatcacgaggtcaagagatcgagaccatgctggccaacatggtgaaaccccatctttactaaagatacaaaaattagctggggatggtggtgcacgtctgtagtcccagctacttgggaggctgacgcaggagaattgctggaacccaggaggtggaggttgcagtgagccgagatcacgccactgcactccagcttggcaacagagcgagactccgtctcaaaaaaaaaaaaaaaaaaaaaaaaagagacaaggtcttgctgtcgtccaggctggagtgcagcggcgtgatcatggcttactgcaacctctgttttccaggctcaagcaatcctcctacttcagcctcctgagtagctgggactacaggtgcctgccaccacacccaatatttaaatttttattaattgaaaaaacttttttgcagagacagggtcttgcctggtatcaaactcctgggctcaagtgatcctcctgcctcggccttctgagtagttgggactacaagcatgagctattgggcctggcctagcttttatacaatgcccatgttacaaaattccaaatgtccaaaaagcaaggagaatatcttccactctgccttgaccttcagtttcccccctgtagtaacctgtctgcttccagaagtgcttgaacatgtgtgcgtttgctatgggtttttttttgtttgttttgttttgtttttgagatggagtctcactctgttgcccaagctggagtgcagtggcgtgatcttggctcactgcaacctccacctcccaggttcaagtgattctcctgcctcagcctcccaagtagctggggttacaggtgcacaccaccacgtccggctaatttttttgtatttttagtagagacggggtttcaccacgttggccaggttggtctcaaactcctgacctcaggtgatccacccaccttggcctcccaaaatgctgggattacaagtatgagtcactgtgcctggcctgtttttttttttttgagacagagtcttgctctgtcgccaggctggagtgcgttggcttgatgtcagctcaccgcaacctccacctcccgggttcaagcaattctgcgtcagcctcccgagtagctgggactacaggcatgcaccaccatgcccggctaattttgtatttttagtagagacgaggtttctccatattggtcaggctggtctctaactcctgacctccagttatctgccggcctcagcctcccaaagtgctgggattacaggcgtgagctactgtgcccagctggttttttttttttttttttttttttagacaggctcttgctctgttgcccaggctggagtacagtggcacgatcttagctcactgcagcctcgaattcctgagctcaagtgatcctcctgcctcagcctcgcaagtagcagggactataggctgtatactactatacctggctgattttaaacatttttatagagatgggttcctgccatgttacccaggctggtcttgaactcctagcctcaaatgatccttctgcctcagcttcccaaggtgctgggattatagacctgagccactgctcctgacctcattttttttttttttttttttgagacagtgtatcagtgtctcccaggctggagtgcagcggcgcgatctcgactcactgcaacccctgcctcttgggctcaagcaatcctcccaccacagccttccaggtagttgggactagaggtaaattttatagtgatgggttttgccatgttgcccaggtgatcttcaactcctggactcaagtgatcctcccgtcttggcctcccaaatcatacctgagattacaggcatgagccactgcacacagccccattttaacttttttttttttctgaggcagagtctcgctctgtcacccaggctagagtgcagtggcgtggtcttggctcactgcaagctccacctcctgggttcatgccattctcctgcctcagcctcccgagtagctgggactacaggtgcccgccacctcgcccagctaattttttgtatttttagtagagatggagtttcactgtgttagccaggatggtttcgatctcctgacctcatgatccacccgcctccgcctcccaaagtgctgggattacaggtgtgagccaccgcgcctagcccattttatcttttctgataatgattttccttttgccaaaaacggcaagtgggttttagattaagtcactccttttaccaggcacagtaggagaccttgagttagggctgaggtggtgtcatttaatagggacattcaacttcactaggttcaatgataggagactttacaaatttccataatggtaaatcttctttcatttaaattattattattgttaatatttttttttttgagacagagttttgctcttgttgcccaagctggagtgcagtggcgtgatctcaactcactgcaccctccgcctcccgggttcaagcgattctcctgcctcagcctcccgagtagctgggattacaggcacccaccaccacgcctggctaattttgtatttttagtagagacggagtttctccatgttggtcaggctggtctcgaactcctgacctcagctgatccgtccgccttggcctcccaaggtgctgggattacgggcatgagccatcgcacccggccaatcatttaaattattaatgaagaataaaaagaggctgggcgcagcggctcatgcttgtaatttcagcacttcgggaggctgaggcaggcagatcacctgaggtcgggagttagagatcagcctggccaacatggtgaaacctcgtctctaccaaagatacaaagattagctgggtatgctggcatgtgcctgtactctcagccattcgggaggctgaggcaggagaatcgcttgaacccgggagacggaggttgcagtgagctgagattgcgccactgcagttcagcctgggtgacagtgagactccgtctcaaaaaaaagaaaaaaaaaagtaagtcccacgtagccatcaccctctgcagtagtcatctgctgtgtctgatcttgttcattttgctcatttctaccctacccacttacctctacctgactggattgtttaagagatgggatcttgctgtgttgatcagggtggagcacagtggctattcacagatgtgatcattttgcatgagaaccccaaactcctgggctcccctgaccctccagcctcagtctgccaagcagctgggactacagatgtgagccactgtactggctcctactggatcattttgaagtgagttacagatgccataactataacacagacatcataggtacaggaatttcagtgcatcttccccagtggctcatggatcacacagatagaaaatcggtcaggagggccacgcgcggtggctcacacctgtaatcccagcactttgggaggccaaggcgggtggatcacgaggtcaagagatcgaaaccatcctggccaacatggtgaaaccctgtctctactaaaaatacaaacattagctgggcgtggtggcatgcacctgcagtcccagctactcgggaggctgaggcaggagaatcgcttgaacccaggaggcggaggtcacagtgagtcaagatcgtgccactgcactccagcctggtgacagagggagactccgtctcaaaaaagaaaaaaaaagaaagaaaatcggccaggatgccgggcacggtggctcagccctataattccagcacttcgggaggccaaggcgggtggatcaactgaggtggggatttcgagaccagcctgaccaacatggagaaaccccatctctactaaaaatacaaaattagccaggtatggtggcgcatgtctgtcatcgcagctactcgggaggctgaggcaggagaattgcttgaacctgggaggcggaggttgcagtgagccgagattacaccactgcactccagcctgggcaacaagagtgaaactccgtttcaaaaaacaaacgaaaaaggaaagttggtcaggatgctgggcacagtggctgggtcctgtaatcccagcactttgggaggctgagtcagaaggatcagttgagcccaggaatttgagaccagcatgggcaacatggagaaaccctgtctgtacaaaaaatacaaaaaactttctggacgtgatggcccatgcctgtagtcccagttacttggaggggccgaggcgggagggttgcttgagcccaggaggtcgaggttgcagtgagccatggtcgtgccactgccctccagcctgggcaacagggagggagaccctgttttaagaagaaaaagaaaattgataaagatgtagatgatttgaacaacacaagtaacagggttaccgtaatgacatggatggaatctgaacccagcaagagagaaaacacattcttctcaggccacgaggagtgcttagggaaactgaccacatacaaggcaagtcttaaaaactcgatttttatttttatttgtatttacttattttgtttatttatttgagacagtctcgctctgtcgcctaggctggagtgcaatggtgagatttcggctcactgcctcccaggttcaagctattctcctgccttagcctcctgagtagctggaattacaggcgtgcgccaccacacccagctaatttttgtatttttagtagagatggagtctcaccatgttggccaggctggtctcgaactcctgatctcaagtgatctgcctgcctcggcctcccaaagtgctgggattacaggtgtgagccaccggacctgggcttttgttttttatgttttcatttatttatttgtttttgagatggagtcttgctctgttgcccggactggagtgcagtggtgtgatctcggctcactgcaaactctgcctcctgggttcaagcaattcttgtgccacagcctccccagtagctgggactacaggcgcccaccaccacgcccgggtaattttttgtgttttcagtagagatggggttttgccatgttggccaggctggtctcgaactcctgacctcaggtgatccatccgccctcggcctccccaagtgctgggattacaggcgtgcaccaccgtgcctgaccctttacaaatttagaacaattactgccttactgaccatgttttctctcacctgtggggtcagaacttaacaataactaagcttcctccttcgcgcttcgggttgtgcaagcttcctcctgcctgctttggggcctttctgcaatgttccagaagcggcatcaggaggctgcccagccagctcgtgagttgtgttctggagtcagagttttgtgccagcctgggccaggccccatccccacttcccgccccatttgcccctgtctacatcattgtactgggagacacttcctgtccctcctacgtagcccacgctaagcagggtgcttctatccacctcacctttccgatgtgggaagggccgaagtcatggaggggcgacccgtcaggcccagcaagggtggcacagatgttgtccctagtaacagatgagaggggatgggctgggactgcaggcctggctccccaagctgctcctgcgggtcaggggctgcccattagcctggccagggcccctcattggatccctcctggccgcccagaccacagcccttgcccccctgcctacccgccaccagttctcattggccctgcctccctgcttaactctgccgccttggcttcccctcctcggtctgtctcctccccgacttgtcctctgtctgagtctggcaggacagagtccgaccgtctggccccctcctggctccgtctgctcctcctgccgcctcctgctgtcgaggtcacttggttcttggcctgtctggcccccagccaccctgctggctgcctgctctccaggcagcccctcgcccagggctgcacctccgacctgtcctccgtcttgggtggggctgggactgtattttccatcctctgcagtggtctggtttccctcgtgcgctgaggcccctctgcttggctgcccctggctgccccatgcagctgagccatgagcgcggcctgtgtgcccctctcccgctggctggagctcaggatgctcacgccgctctggcagatatcgctgctgcaaacataggaggagcagctgcccctctgcgcacgtggccttcggacacatgtgagggccgctctagcttgggtgctcactgcgggtgattccaccctccaggggacactgggggatgtctggggacattcatgactcgggcgctcctggcgtggagtaggtggaggcctggagtgctgattagcaccctgcagggcccaggaaggccccaccccagagagtgatcagaccccaaatgtcagctttggcaagagcagtgtgcctggccacagaggtgctggcccggatgcagatgagtgccccatccatccctctgagcgccgtgtggcttgtcccatgctgcttttcctgacccagtgatattgggggcacttgacttctctctttttaagacggagtctcattctgtcacccacgctggagtgcagtggcgagatcctggctcactgcaacctccacctcccaggttcaaatgattctgttgccttagcctcttgagtatttgggattacaggcactaaccaccatgcctggctaattttttaattaatttttaatttttttatttttttgagacggagtctcgctctgtcgcccaggctgcagtgcagtggcgtgatctcggctcacggcaagctccgccccccgggttcatgccattctcctgcctcagcctcccgagtagctgggactacaggtgcccgccaccacgcctggctaattttttgtatttttagtagagatggggtttcgccgtgttagccaggatggtcttgatctcctgacttcatgatccacccgcctcggcctcccaaagtgctgggattataggcgtgagccaccgcacccggccaatttttgtatttttagtggagacggggtttggcaatgttgcccaggctggtctcgaactcctggcctcaagtgatctgcccacctcggcctcccaaaatgctgggattacagagtaagccactgtgcccagccccttttttagaaaaaattaataaactttattttctagagcagttctaggttcacagcaaaattgagcagaaggtacggagttcctatagaccccctgccccaacaggcatagccgcccccactgtcagcctcccccacagagcggtgcatcggttacagttgatggcccgatggccctctgtggagtcatcttcatctctgagtccacagtctacatacaccaaggcttgcccttggtgttaagtttttttttttttttttttgagacagtgtctcacttgtcgcccaggctggaatgtagtggcgtgatctcggctcactgtaacctctgcctcccaggttcaagcgattctcctgcttcagcctcctgagtagctgggactacaggcgcgtgccaccacgcctggctaatttttgtatttttagtagagacgaggtttcaccatgttggccaggctggtctcgaactcctgacttcaagtgatccacctgccttggcctcccagagtgttgagatgacgggcgtgagccactgtgcctggcctgcttcatgttttaaataacggctttattatatccctgcagttcacccagttaaagtacacagttgaggtatattcatagttgtgtaatcatcactgcagtctattttagaacattttgtcaccttgaaaggaaaccctgaaccctgtcccagctactgcttcctttttctgcatctcctcccgcagcccctggcaccctcaaatccccttcctgcctctgtggcttggcctgtcctggaaatttcatagaaatgggatcatgcactgcgtggccttttgtgtctggtgtttctcactgagtgtgatgtcctcaaggtgcatccacactgtggcctgggtcacagccttgctccttttcatggctgagtcgtattttattttgccttatattttatttattttattttatttcttaagacagtcttgctctgttgcccaggctggagtgcaatggcacaatctctgcttactgcaacctccgtctcccaggttcaagcaattctcctgcctcagcctctggagtagctaggattacaggcacccgccaccacgcccagttaagttttgtatctttagtagagacggggtttcaccatgttgaccagggtggtctcaaactcctgacttcaggtgatctgccctcgttggcctcccaaagtgctgggatgacaggcgtgagccaccgcacgcggcctgagtcatattttgacacatggatggatggccacattgtgttgatcctctcacctgttttttcttttctttctttctttttttctttctttttgagacggagttttgctctttttgcccaggctggagtgcagtggtgcaatctcggctcactgcaacttctacctcccaggttcaagcaattgtccttcctcagcctcccgagtagctgggattacaggcacctgccactatgcccggctaattttgtatttttagtagagacaggtttcaccatgttggccaggctggtcttgaactcctgacctcgtgatctgcctgcctcggcctcccaaagtgctgggattacaggcgtgagccaccgcacccagcctcaatcccctcacctgttgatggacacctgggttgcttccactctcaggctgttgcgagtgatgccgtgtgaacctgcgtgtacaggttgacgtgcctcttcctctccatccgtgccacctctccccaaagccagctgctctgtgctggagagctggccctgagcctcctcctggctcccaggcagcgcctagcatgtcagaggcactcacttctagctgggagaacagaggggctgaagcggatattggtgggccctcgatgtccacggtgggtttcagagcagcccttgaaacccttgtagctgtaggtgggtgtgtacatattcaaacgggtttttctgatgctggtggatcgcttgcttgagccccggagttcaaaaccagcttgggcaaagcagcaagacctcatctctaaaaaaaattagctgggcatgggtgatgtgtgcctgtggtcccagccactcaggagcctgaggcaggaggattacttgagcccaaggttcgatgctgcagtgagctacgattgcaccactgccctccatccttggcaacagagtgagatcctttctaaaggaaaaaaaaaaaaaagtccgggtgcagtggctcacgcctgtaatcccggcactttggaaggttgaggtgggcggatcacgaggtcaggagatcgagaccattctggctaacatggtgaaaccccacctctactaaaaatacaaaaattagccgggcttggtggcgggtgcctgtaatccccgctacttgggaggctgaggcaggagaatggcgaacctgggaggcggagcttgcagtgagccaagatcgtgccactgcactccagcctgggcgacagagcaagattccgcctcaaaacaaaaaacaaaacaaaacaaaacaaaaaaaaacaggccgggtactgtggttcatgctgtaatcccagctctttgggaggccgaggtgggtggatcccttcagcgtaggagttcaaaaccagcctggccaacatggcgagaccctgtctctactaaaaatacaaaaattagctgggtgtgatggctcatgcctatagtcccaagctactcaggaggctgaggcacaagaatcgcttgaacctgggaggtggagattgcagtgagctgagatcacacccctacactccaccctgggcgacagagtgagactccatctcaaaaaaaaaaaaaaaaaaaaaaatttttttctggaaaagatgagtcagcctttatcaggttcttaggtttatggtgaacaaagaaagaaagcctgcagagaagggccttggccttcactgtgacccccatgctgtttgcatttgaacagccgtcaggccttggatccccaaggggcgaaaggaggaagagctgacattctatgtatgtctctctcctcccttttcctaaggtctctctcctcccttttcctaaggatgctcctgaaccagggcatttctgcctctaggggacacatggtgatgtctgggggacatcggttgttgtcatgactggtggaggccagggccgctgcagtgcctctgcagtgcccagcacggccccacggtccagtgcccagagggggagacccagcccatcccagagtggtcagccctaatgtcagccatgcttaggtcgagaaacctgtattaattacatggaaaccaaccgagtccaatcctgctcgcaccaggcacgggataaactcctgacggggcagacgtggaaaccagggggacccccagctcctgggattcacctcctctctcccttcccactcagtgtgtggattttaatgcgtgcagcctcctgggacctcagtagggcacagcatcatgggataaggagtttcttgggggcctgtggaatccttcaccagggggtctcacccagggtgacttcacacccccccaccccataccgtatgatgtctggggacatttgtggtcgtcacaactacggggtgctcctggcatggagtaggtggaggccagggacgctgctcagcaccctgcagtgcccaggatggctccgccccagagaatggtccaggacctggccccaatgtctgcagtgccgggggagaggaacttgttgccttgggggcatctagatggcaaatcatcaggaggggggggtcctagatggcaaaccaccgggagagggtccttgttgggtgttggtggagtgtgaaggggcagcttctgacaaaatgcctcggcttctccagcccccagatacagctcaggtgatgagctcctccttgcatacctgctgagtcaggtgacccgaggggcaggctgtggagccaggccccaggggttgagcgcatcaggataaaagcgcacaaagggcgggtggagctgagggtcagaggaggtgccctggcaggcgagattggcgctggagccttacccaggaagctcataggaagctcatggatgctggcatgtgcctcttgctgttcaggtgggacagggtctctctgtctcgacactggacagtgggaccgtcctgggcactgcagggtgccgagcagcgttcctggcctccacccactccatgctaggagcttctcccagtggcgacaaccacaaatgtcccagacgtggcccagcgtcccccggggtctgaatcatgtttggttgagaagcagtgacagaggtgacacatgttcactgtcacaaaagctgccgtaagcacgaagtattaggaaaaactcccaagacccccatgtgtgcgtggtgccccgtgatgatgttttgtgcttctgggtgcttcctgcatgcagtgccaaaagccctcgctagaggggcctgagaccctgagggaagggactggggtgccgcttgtgagcgggacagccccctggcatggcccaggtatcatggctctttactctgatgcagattgccccccccccacaagggctgggacacagtgtttggttcatcactggtgcccacagatgcccacttggcatttggtggctaaacagcgtctgcctctggtgtccctgcagatggaggacggccataccctcttcgactacgaggtccgcctgaatgacaccatccagctcctggtccgccagagcctcgtgctcccccacagcaccaaggagcgggactccgagctctccgacaccgactccggctgctgcctgggccagagtgagtcagacaagtcctccacccacggtgaggcggccgccgagactgacagcaggccagccgatgaggacatgtgggatgagacggaattggggctgtacaaggtgagcctcccctccgcagctgctctggggttggacgttctccctgccattctggtctttgcatacccagggctcacaggaggggcttcccacgcgcctctctagctctggctgggcagaaatggccaaggggtggtttcctgcacgttccttgaggggaacatggtaccctgggattcctttgtggacctctagagcagagtcctgttcggggcctgcaggtgtcttctccgtgaagcttgcagtggctgtgacgtttctgaacttgctgctaccatgtaagatcaggaaatgtcacagaaagatctgggtttccagcttttttatttttttattttttttttggcagggtctcactttgttgcccagcctggggtgcagccgtgtgatcacagctcactgtagcctcgaactcctgggctcaagtgatcctcccacctcagcctcctgagtagctgatgttataggcatgtgccaccacgcccagctaattttattttattttattacttttttaatacatggtctcattctgtcgcccaggctggagtacagtggtgccatctcggctcattgcaacctccaactcctgggttcaagcaattctcgtgcctcagcctcctgagtagctgggattacaggcatgtgccaccacacctggctaatttttgtattttttgtagagacgggatttcgccatgttggccaggctagtcttgaactcctggcctcaagtgatcttcccgccgcagcctcccaaagtgctggaattataggtgtgagccactgcacccagtctgttttattttttagtagacacagcgtcttaccatgttgcccaggctagtcttgaattccggggctcaagcgatccacctgcctcggcctcccaaagtgctggtattccaggcgtgagccacgacgccctgcctggatttccagcttctcttgacaaatgggcagctctggtctctcagggcctcccagcagctgtggctgaagcagagccgcaggggcctttgttaagacagtccatgccccctggccccgcatccccgtcacccctgccggggctggtttctcatggtcagcggttcccagccagggaggagaaacctcgctgtgggcattcgagtttgcgccctggttccagagcatcccagtgtccgagaaccaaggtggtctcccgtcagttttcctcaccccgttgggatgccagacttccctcattcctcacaggtcaatgagtacgtcgatgctcgggacacgaacatgggggcgtggtttgaggcgcaggtggtcagggtgacgcggaaggccccctcccgggacgagccctgcagctccacgtccaggccggcgctggaggaggacgtcatttaccacgtgaaatacgacgagtgagtcatggcaggtgggcgggcctgggtattcaggctctgtgacgcgcatccttggctgcgggtgttcaggccagagcttggcactgtctcgagatggtgatcaggatctggggccccatcctcgaattcctaacagcatacgaggctgcccacttggggactagcctggggacccgaagccggctgccccctcctgtgtctccgcggagggttctgctcgatcagtggctgaaactgccaccccatcagtttttctgttttattccatcttccgggtttgtcatctctccctcatccccacccctaacgtcagtctccagtctttgcacaagtgtttactgggcacttcctacctgccaagttcggggtccacacaccagtggacacagatggtggctgcgtctgtccgtgctgccatcgtgagatttcacagacggtgtggcttaaacacggacattggttgacttgctcactgcaacctctgcctcctggattcaagcgattctcctgcctcagcctcctgagtagctgggactacaggtgcccgccaccacacccagctaatgtttgtatttttattttattttatttttattttattttttcgagacagagtcttactctgtcactcaggctagagtgcaatggcgtggtctcagctcactgcaacctccgcctcccaggttcaagcgattctcctgcctcagcctcccaagtagctgggattacaggtgtgtggccaccacgcctggctaatttttgtattttcagaagagatggggtttcactatgtaggtgaggctggtctcaaacttctgacctcgtgttccgcccgcctcagcctcccagagtgttgggattacaggtgtgagccactgtgcccagcttattttatttttttgagacagtttcactctgtcccccaggctggagtgcaatggtgtgatcttggctcattgcaccctccatctcccgggttcaaacgattctcctgcctcagcctcccaagtggctgggactacaggcgtgcaccactgcgcccagctaatttttgtttttgttttgtttttgagacagagtttcactcttgttgcccaggctggcgtcaatggcgcgatctcggctcaccgcaacctctgcctcccgggttcaagcaattctgcctcagcctcccgagtagctgggattacaggcatgcgccaccacgcctggctaattttgtatttttagtagagatggggtttctccatgttggctggtctccaacttccgacctcagatgatctgcctgcctcagcctcccaaagtgctgggattacaggcatgagccaccgtgcccggccatgcctggctaatttttgtatttttagtagaggcagggtttcaccgtgttggtcaggctggtcttgaactcctgacctcaggtgatcttcccgcttcggcctcccaaagtgctgggattacaggcgtgggccaccttgcccggcctctcctcttgttctaaagacaccagtcctgttggattggggcccaccctactgcagtgtgatctcatcttaatatgatttcatctgcaaaggttctatctacaaagaccctgtttccaaaaacaatcctattcgtgggtactggggatcagcctttgaacatctctttttgcaggggacacgggcaacccataacaattttgtacctggaatgtgccttaatatacctgtgtgttctcaacaccagcatataagcctgttgggaggggcctctgcacactgtcgggaggggccgtcccacctcggctcgtttcccattgagggaaggaggcttggtcttagcacggggtctaaggcccgggctttcctcccagctacccggagaacggcgtggtccagatgaactccagggacgtccgagcgcgcgcccgcaccatcatcaagtggcaggacctggaggtgggccaggtggtcatgctcaactacaaccccgacaaccccaaggagcggggcttctggtacgacgcggagatctccaggaagcgcgagaccaggacggcgcgggaactctacgccaacgtggtgctggggtgagcctcgcgtcctggggcgagcccttcctctctcctttcctcccctcccggggcccccggactggctttgaagccgtccagccagcgctgtgtgtgcgaggcccttagcctccggcctggccttcctgcctcccctctggggtctgttcctgctcactgctgagcatctttctaagaccgaccaccttgtgcccctgagtgcctctgcccagggaactgtctctgacccccaggccctgacaggcagagttgtcaaacttcctttttctcatggtgttttttttatcgctctgttgcccaggctggagtgcagtggttcgatctcggttcactgcaagctctgcctcctgggttcatgccattctcctgcctcagcctcccgagtagctgggactacaggcgtctaccaccacacctggctaatttttttgtatttttagtagagacggggtttcaccgttaaccaggatggtctcgatctcctgacctcgtgatctgcctgcctcggcctcccaaagtgctgggattgcaggcagtgagccaccgtgcctggcctcaagctttctttttctctcttgtttgtttcaaatttggtgaataggtcccattcacagggtcaaaatagaaagcacccaagaccacacatgaaggttctccctcctctgcctggtcacccagttcccctttttggcgacatcactgttaccaactttccagggacattctgttcataaacatacacgccaaaccacaccgcttaggagttggcaaactgcagtccacaggcctgctgtggtccgctgccggctttgactaatagttttattgggacgtggtcacacccatttttatcttattacctgtggttgcttttgtgttataagagcagagttgtgtagttgcaacagagactatgcggcctacaaagctgaaaatccttcctatttggccatttgcagaatcattttgcaaagcctgttctttctcccttgcctctttgtgtgtgtgtgtgcgtgtgtgtgtgtgtgtgtgtgtgtgataaaatgtatgtaacagaaaatttaccttttttttttttttaaaagacagagtctccctctgtcgcccaggctggggtatagtggcatgatcttggctcactgcagcctccgccttccaggttcaggtgattctcctgcctcagcctcccaagtagttgggattacaggcgcccgccaccacgtctggctaatttttgtatatatatatatatttagtagagtctgggtttcaccatgttggccaggctggtctcgaactcctgacctcaagtgattcgcccgcctcagcctcccacagtgctgggattacaggcatgagccactgcgcccggccaaaaatttaccattggaaccatgtttaagcgcacagttcggtggcattaaacgcatttacgttgttacgcaaccatctccagcactttgtcctcttcccaaactgaaactctgactccatgaaacactcactccctagcccctgacacctctgcatcctactttccatctctgtgaatctgacaactcgggggacctcctaggaatgggatcacacaggatttgtcctttgcatctgttcactgacgtcactgagtgtgatgtccttgaggtgcatcaggctgtagcctggtcggaatttccctcctttttgtggccgagtgatagtacgtgacgtgttgtctataaacacgagcatcttggcaacggcgttccaagtacaggtacagcaagcacgcagaggtcctgggctgggacatttatggtgcatctgtggcccggtagggaggtcagtgagctgcgggtgatggaggggagtggctggggctgtgggagcctcctcactgagtctgggccttaagcgcgtggctcgggtgtggtgtggaattggtctttattctctgctaggcgcatttctgaatctgagattttctgagaaactatctggattgttatatggaatctgatttttaaatgctggtgactaactttttttttttgagacagagtcttgctctgtcacccaggctggaatgcagtggcaggatctctgcttactgcaacctccacctcccgggttcaagggatcctcctgcctcaccctcctgagtagctgggactataggtgcccaccaccagctaatttttgtatttttagtggagacagagtttcaccatgctgcccaggctggtcttgaactcctgacctcaggcgatccacccacctcagcccctcaaagtgctgggattacaggcgtgagccaccgcacccagcctatctggttttataaagggcagttcccctgcacacactcccttgcctgccgctgtgtaagatgtgcctgtgctcgttcaccttccaccatgattgtgaggcctccccagccatgcggaactgtgagtccattaaacctctttcctttctaaattacccagtctttattatttagtatgtctttattagcaacatgagaacagactcatacaaccccttccaagctcttgtggtggctgatataatccactactttgcggttgaaggatgggggcttcatttttttttttttaacttggttcttggaggccgcctgcagttcccagggcccacctgcagttccttgccccatgggcttctctgatgtggctactgatgtcaagctagcaagggaggtcttcagctagtcggctagtaagatatagagcatcgtgtgatgtgtcatcgtcccaggagtgacagtccgtcagctctgctgtattttatgggttaggtttaagtgacagccctgtccatacttttatggggagaaacgcctacaaatgcgtggttgccaggaggtgggggttgtggggccaccttaggctccatccgcaccagttatacaccagctgctgcccgtttaccctgagacagataacctgcccagccagcacccacgggcttcctccacctcagtccctcccctagcagaagaaaactgcatttctgcacattgactgtcacaaggcaggggtgtcaccaggcagggaaacgaagatacctggccgaccacaccttggggtgtttgggttcttcgattcattcatgcttgtgtcccgagccctctggggatgcaggaggcacagcgggaaagggaacaggtgctcggtccaggcggccttggggcagacactgtcccttgccagccccatgggagcttccagggatgcagtgagagggtcacgctgagccgagttgtgcctcgcaatgagtttgtgatgtgtgcccatcgttagcaccttcgacttctatcatctgctgagtcaggcatcatacaagatgagacagagaaacgcgattgcagtccctgtcttaggaggcacccagcctggtgtgggagacagatctgcagatgacagaccagggagatgcgtgctctgagacaacacgcgaggatgggtggcagagatggccgagtggactctgggattgggaggctcagataggtggctgagccccaggtcctgctctgggcagtgctaggagctaccagcctttgccagggctgacttctaaatgcaagccctctacactggtgtctctgcagtgtggggggtcaattcattcatcattcattttcattaaattttaccttgcattgtagattcacatgcagttataatgtagagatggctaggcgcagtggctcaggcctgttgtcccagcactttgggaggctgaggtgggaggatcgcttgagcctgggaggttgaggctgcagtgagccgtgatcacaccactgccctccagcctaggcaacagcaagagagtctgcaaaaaaaaaaaaaaagtgaaaagaaaaaaaaacaggctgtgtaccctttattcagtttcccccagtggtaacaacttatattaataaactatactgtgttatcacaactggaatattgacattgatacagtcaaaagtgagtttcctcctcacaaaatccttctcgttaccccttttatagccaaacccacctccccatccccacctggtccctgacccccggcaagcaataatttttttttttgttggagacggagtctcgctctcttttgttctccattcatacaattttgtaatttcaaggattttacaatttcaactttgtaataaggattcccgttatataaatggaatcacacagtatgtaaccttttgggattgattctttttttcccgactctccataattacagattaattgaagttaccgcatatcagtagctcattccttttcatccctgagtagtattctgtggtatagatgggccacttttttttttttttttttttaacgacccattggatatctgagctgcttccaggattttttgctgtttaagatttgtttatttttttgagacacagtcttgctctgtttcccaggctggagtgcggtgatgtgatcttggctcactgcaacctccgcctcctggattcaaacgattctcctgcctcagcctctggagtagctgggattacaggtgcgtatgccagcacacccagcttatttttgtatttttagtagaggtggggtttctccatgttggccaggctgatcttgaactcctgacctcaggtgatccgcccgccttggcctcccaaagtgttaggattataggcgtgagccacttcgcccggccagtttaggatttatttgagtaagttaataagaaacagtggtctgcaattctcttgttttgtatggtctttgttggttggtcaataccagccttataatgtgagctgggaaatgtttattcctttttctgttttctggaagagattgtgtaaaatttacgttaattcttctttaaaggtttgatagaattctttaacgagaccataggctgggtgcagtggccgatgcctgtaatttcagcacttggagaggcggaggtgggcggatcacttgaggttaggagtttgagaacagcctggtcaacatggtgtgaaatccccgtctctactaaaaatacaaaaattagctgggcttggtggtgtgcacctgcagccccagctacttgggaggctgaggcaggagaatcgtttgaacctgggaggtggaggttgcagtgagctatgatcatgccattgcactccagcctggatgacagagcaagattccgtctcggtggggtgggggaggaagggaagctttactgaggccatggagatctggagatgtcttctggaggagcttttatgaattgaatttcttctatgcttatgtgactgtctggactatctgtttcatcatgtttgagctgacatactttctgggttttggggaattagccggtttctctgagcataaagtcatttgtattatttccttattctctgatgcctgaaggatctagtgagatccctgttttattcttggtgttggtaatttatgttttctttttatttttgtcagtctttaccaattttatttttgaggatcttagacctttccctcccttctcatttatttgtacagcaagaataagacagtttttttttgtttgtttgtttgttttgagacaaggtctcactctgtcacccatgctggagtgcagtggcgtgatctcagctcactgcaacccccagatcctggcttcaagcgatcctgacctcaggtgatccactcgtctcggcctctcaaagtgctgggactacaggcatgagccactgcacctggcataagagttttgttttggtcaggtttttttttttttttttttttttttttttttgagataaggtcttgctctgttgcccaggctggagtgcaatggcaagctctcagttcactgtagccccaacctcctgggctcaagcaatcctccaacctcagcctcccacgtagctgggaccataggcgtgcaccaccatgcctgactaatttttttttttgttttttgatgagacaaagtctcgctctgtcacccatggtggagtgcagtggcacgatcttggttccctgcaacctccacctcccgggttcaagcgattctcctgctttagcctcccgagtagctgggattacaggcgtgctccactgcacctggctcatttttttttgtattttcagtagagacagggtttcaccatgttggccaggctggtcttgaactcctgaccttagataatccacccgcctcagcctcccaaagtgctaggattacaggcatgagccactgcacccggccattttttttttttttttttttttaattttcggtagcaatgggggtctggctagattggtctcgaacttttgagttcaagtgatactcctgcctcagcctcccaaaaggtgctgggattataggtatgagccactatacccagtcttagaatatgtttttctttctttttttttgagacggagtcttgctgtttgctgtctcacctaggctagagtgcagtggtgcaatcatagctcactgcagccttgaactcctgggctgaagcaattctcctgccttagcctccttttccttaacacttaatttgttgaggaatcctggtcatttgtcccaggagttccaaatggctctatccagactgtagagatgaccaggagatgtcacttgctgtgtgcgtctgtgctacctgtgagctggtaggtcagtgtgttcccacactgtcccatagccaagagccacctgtgctgtgcttgaaatgtggccaggaggaactggaatgtactgtgagtgtaaaatacacatgggtgccaggcgcagtggctcatgcctgtaatcccagtactttggggggccgaggtgggcggatcacaaggtcaggagatcgagaccatcctggcaaacacggtgaaaccccgtctctactaaaaatacaaaaaattagccaggcgtggtggcgggtgcctatagtgccagctactcaggaggctgaggcaggagagtggcgtgaacccgggaggtggagcttgcagtgagccgagatcgtgccactgcactccagcctgggcgacagagcgagactgtctcaaaaaaaaaaaaaaaaacacatgggctttcagagacctggtacaaaagaagaatgtaaagtagctcattaataactttttcatattcattccatgttgaaataatcttttgtctacactgggttctatggaacatattccaattacttccacctatgtttacctctcaaacgtgcttattaggaaatttagaattacatacacagcgtgtgttcaagtgctgtttccctcggacgttgctgatggggatgtcggattattgatctcgggggatcagtttcactcacaggagttcttgtattttgatgtaggccattggatcaagcgttgcctttatgattttttttttttttttttttttttgagatggagtcttgctctgtcgcccatgctggagtgcagtggcgtgatcatctcagctccacaacctccatttcccaggttcaagcgattctcctgcctcagcctcccgagtagctgggattacaggcacgggccaccatgcccagctaattcttgtattcttagtagagacggggtttcactatgttggccatgctagtctcgaagtcctgaccctcgtgatccacccaccttggcctcccaaagtgctggaattacagatgtgagccacggtgcccaacttgatttatttatatatttttttgatgagatggagtctcactctgtcgcccaggctggagtgcagtggcacgatcttggctcacttcagcgtctgcctcctgggttcaagcaattctcctgcctcagcctcctgggtagctgggattacaggtgcgcgctaccatgcccagctaatttttgcatttttagtagagacagggttttaccatgttggccaggctggtctcgaactcctgacctcagatgatcggcctgcctcggtctcccaaagtgttggaattacaggtctgagctaccatgcccggccaacctttatgagtcttgcttgtcggttcttgtggatttggtgctccttagccaaaggttcaaactcattcttcccagggcatcctgcaatgaaactctggtttctgtgttttgtttttttttttttttttttttttgagactgagtcttgccctgtcgcccaggctggagtgcagtggcgcgatcttggctcactgcaacctctgcctcccgggttcaagtgattcttctgcctcagcctcccgagtagctgggattacatgcgcgcttctccaagctcagctaatttttgtattttcagtggaggcgggggttcaccatgttggccaggctggtctcgaactcctgacctcggcctcccagtgttggtattacaggcgtgagccactgcgccctgttccgtttcatgttgcttctgtgagtgcagctttgattgctagggggcgtagctgagctgttgccccaggcatcccgagaacccgtggtgttcaagtgctgtgagtagatttaggggcctcggcaggccagaatgttccagcgtcctcgttccttgcagggatgattctctgaacgactgtcggatcatcttcgtggacgaagtcttcaagattgagcggccgggtgaagggagccccatggttgacaaccccatgagacgtgagttctgagccagcctttccccatcttccgcggtgggcacggggcgggggctcttgtcccgtctctggcttggccgggccccgccggagctgaccctgccgccccgtgcccagggaagagcgggccgtcctgcaagcactgcaaggacgacgtgaacagactctgccgggtctgcgcctgccacctgtgcgggggccggcaggaccccgacaagcagctcatgtgcgatgagtgcgacatggccttccacatctactgcctggacccgcccctcagcagtgttcccagcgaggacgagtggtgagtgcggccctgcccgccgcggggagaccagagcgccccctacaaatccccagaggggcactgaggagatacaggagaggggcaggcgcgggggctcacgcctgcaatcccagtgctttgggaggccgaggcgggaggatcacttgagctcaggagttcaagagcagcctgggcaacacaagaccagcctgggggacgtagagactctgtttctttttttgtttgtttttttgagacggagtcttttttcttttctttttcttttcttttttttttgcggcggagtctcgctgtctcccaggctggagtgcagtggcgcgatctcagctcactgcaagctccgcctctcgggttcacgccattctcctgcctcagcctcccgagtagctgggactacaggcgcccgcctccacgcctggctaattttttgtatttttagtagagatggggtttcaccttgttagccaggatgttcttgatcccctgacctcgtgatccgtccgtttcggcctcccaaagtgctgggattataggcgtgagccacctcgcccagccttgagacggagtctaatggcacgatcttggctcactgcaacctctgcctcccgggttcaagcaattctcgtgcctcagcctcccgagtagctgggattacaggtgcctgccaccacatccggctaatttttgtatttttagtagagacggggtttcaccatcttggccaggctggtctcttaactcctgaccttaagtgatctgcctgcctcagccttccaaagtgctgggattacaggtgtgagccaccatgcctggcctggagaccccatttctacaaaaaatgtaagaaaattagctgggcgtggtggtgctcgcctgtggtcccagccacttgggaggccgaggtaagaggatcggatcgctggagcccaggaggtcgagggtgcagtgaactgtgatcgcgccactgtactccagcctgggtgatggaagtgagaccctatttctttagaaaagtaaaaatgaggtcaggtgcagtggctcatgcctgtaatcccaggactttgggaggctaaggtgggtggatcacgaggtcaggaaattgaggccagcctggccaagatggtgaaaccccgtctctactaaaaatacaaaaaagttagccaggcgtggtgccacgcgcctgtaatcccagctactcgggaggctgaggtaggagaatcgcttgaacctgggaggcggaggttgccgtgaactgagatcgcgccactgcactcaagcctggcgacagagtgagactaagtctcaaaaacaaaaaaaaagggggggtggtgaggaaatcttcccatgttgcttgagtgggtgagacctgcggccagccagggaacagagtgcagggggcttcacagcttctgtgagaggaggtttcgtagccactgtgttcctggcgcacataatgacaattgcggatgtggatggggaggttgtgatgtgctaggctcgggtctgaggacctgcctgtggtcattcctccagcacagaagtgggtgttgttgttgccctgccccccctccccacatcgtagagatggggaaactgagtccacggcagtgagaaggcactcatggaatctgcacgtgtatttcccacatcccacattgcgttcactctcactgttgcaagatccgtggaattctccgtggaaggccaacagagaacctgctttcttttttttttgagatagagtcttgctctgtcctccaggctggagtgcagtggtgcaacctcggctcactgcaacctctgcctcctggtttcaagcgattctcctgcctcagcctcccaagtagctgggattacaggtgcccaccaccatgcccggctaatttttgtatttttagtagagatggggtttcaccgtgttggccaggctggtcttgaactcctgacctcaggtgatctgcccgcctcggcctcccaaagtgctgggattacaggcgtgagccactgtgcctggcttagttcgaatgaatttaaatgtaaacagcctcgtgtgccaagcggcctgcaatgtggacagggcaggatggtagtggtgccaggcggggagagccatgtccgtggtgtgtgggcagagggcacatgttggctgagacatctgccaggctaggcgtgggcagtgacaatcccgacctcgcaggtactgccctgagtgccggaatgatgccagcgaggtggtactggcgggagagcggctgagagagagcaagaagaaggcgaagatggcctcggccacatcgtcctcacagcgggactggggcaaggtgaggcgggtccttcccacgtgcccgtggcccctccccgcctgccagggctcacgctgttgttctttgtgtctgtgcctgggacagggcatggcctgtgtgggccgcaccaaggaatgtaccatcgtcccgtccaaccactacggacccatcccggggatccccgtgggcaccatgtggcggttccgagtccaggtacctgcagcgtcccggggctccaggggccacgcgggctcatcctgcttttctgggggcagtttctcctggctttggccagccaggggtcagggtggttaccagtggtgcctcggctagccgaggaggggtgtggaaagcctgcaggtttgggtttactccttattttaccagggacctgcaatgaatccttgggggtgggggctgctgctctgctcagagacacgtaaggtcattcccaaagctcctgtcccagggaaggggtggcatctgctaagagggacctgtctcagcgctggttgtgatctatcattggggcagcccctgcctgtgactgggtgttgacagtgctgggcgctgtcagctgtgggctgtgtgtcacggcagacgagacactttggcactagtgacattggagccagatggttctctggggcggggccatcctgggcactgcagggtgctgagcagcatctctggcccccacccactccatgtcctcccaagtcatgacaaccagaaacgtctgcagacatgagtgtccccttggaggcaggattgcccctgggtgagatgcactgagctgggtggacaagctgggcctcatcatggagttcatggggccaggcgtgcagggctaggagctcctggggcagcgctgtatccctagtgctcagcggccagccggggccccatgctcaggccagggcctctcaaggcattttgtggagtgagtggcaggctgcacctcaaccggcctaatgaaggccggcttttatatcataacctcatttagaactcagtcacccccacttttattttttttgagacggagtcttgctctgttgcccaggctggagtgcagtggtgcggtcttggctcactgcaacctccctctcctgggttcaagcgattctcctgcctcagcctccccaatagctgggatcacagggacatgccaccacgcccagctaatttttgtatttttggtagagatggggtttcaccttgttggccaggctggtcttgaactcctgacctcaagtgatccacccacctcggcccccgaaagtgctgggattacaggtgtgagccaccgtgcctggccgtcaccccccattttctagaggccgaagaggagcatcggagatcagcagtgaggatgccccgtgcacgcttgatggggctggaattcacgccagctggtttttttttttttttttccatggtgcagctcaactccggccgtctctagccgagcagcacacgtagtaggtgactcgcaggcctgaggagtttggtgtaaaagtgaggccgctggctgctcggggtagggaggaggagggcggtggagcttctctgcagcagtcattgcagaggacaccatgtatatcttggtggcatcctcaggtcagcgagtcgggtgtccatcggccccacgtggctggcatacacggccggagcaacgacggagcgtactccctagtcctggcggggggctatgaggatgatgtggtgagtgtgtgtgtgggaggggtgggggagggttgctctagttttttggatggtggtaaaatacatagaacaaaatttcccatcctagccgtttttaaatgcttggttcccggtggcgtgaagtatattcccattgctatgcaaccatcaccaccaccatctccagaactttctcatcttcccaaactgaaacgttgtctccacgaagcactcactccccaccccctcccagtccctggcaccgcccaacctggttcctgcctctgtgactctgacgactctggagacctcctgggagtggaatcgcacggcctgcgtccttgcatgcctggctcctctcactgagcccgacgtccttgctttgtccatgttgtcgcatgtgtccggattccccttttgttcacggctgagtcctattctgccgtgcggagggaccatgctgtgttgatctgtctgtccgtgggcactggggttccttcccctttcgactgctgtgaatagatctgctacgaacacggctgtacaagtatctccagcccccgttttccattcttttgggtgtatatccagaagtggaattcaagactcctgtgataattccatgttgagtgttgttttttttttttcttttttttgagaccgagtctcattctggctggagtgcagtggtgtgatcacagctcactacagccactacctcctgggctctagtgatcctcccatgtcagcctcccaagaagctgggactacaggcaggcactgccacgccaaactaatttttgtatttttttgtggtgatggggtttcgccatgttgcccaggctgatctcgaactcctgggcttaagcgatcctcccgctgcagcctcccaaagtgctgggattacgggtgtgagccaccatgcccagccctctgtttaagtttcttgaggacgcaccacactgtttgtatagtcgctttgccattctgtagtcccaccaacagtttacaaagggctccaatttccccacattctcaccaacgcttgttattttctgtttctttgaaagtagccatcctggggagtttgctttcaatgcagtctctttttttttttttgcctctgcagagggttcacccagccttcttgtctgtttcaggaccatgggaattttttcacatacacgggtagtggtggtcgagatctttccggcaacaagaggaccgcggaacagtcttgtgatcagaaactcaccaacaccaacaggtttgtggaatcagccttcttatttccttgctgatgcatatctgccgagtcttggttctgttttgggcctcatgtccagcaagtgatagtctcattaggagcgtggtagaacatagcgaagcctggcatttggttcctccctctgtctcccaaagtgctgggattacaggcgtgagccactgcgcctggtctggttcctcccgtatgtgtgccacataccgtgagccattcagatggatgaaagcaaacttccctataaaaggccagataatagatatctttttttttttttttttttttttttttttgggcagagtctcgctctgttgcccaggctagagtgcagtggtgcactctctgctcactgcaacctctgcctcctgggctcaagcgattctcatgcctcagcctcctgagtagctgggattacaggtgcttgccacctcgcctggctaatttttgtatttttagtagagatggggttttgccatgttggccaggctggtctcgaactcctgacctcaggtgatcttccctcctcggcctcccaatattggtattacaggcatgagccactgcgcctggctgatagtaggtatcttaatgctgggcctggtggctcacgcctgtaattctcgcgcttcaggaggccgaggctcgaggataccttgagttcaggagttcaagaccagcctgggcaaggtagtgagacaacccatctacaaaaagtaaaaataaaaaaattagctgggtgtgttagcatgtgcctatagtcacagctagtcaggaggctgaggcaggaggatcacttgagcccaggaggttgaggccgcagtgggctgagattgcaccactgcactccagcttgagcaacagactgagatcttgtcaaaaaaaaaaaaaaaaaaacccctccaaaatagattgcttcagctatgcaggtcacacagtctattcagagaacctcttcagctcttgtgtcgtagcacaaaatcagccatagaccatatgtaagtgagtgagcatggctgtgtttcagtgaattttatttgcaaaagtatgtgataggccagaatttgcttggcccctgattacaggatgggggcggacttttccagcataaaaaccatcataaagcccaaaggaaaagacagatttgattatctaaacattataaatatattacataaataaatcctataaattaaaaggcagatgactaggaggagttcttgacatgacacatgatgatagtgtctttatcatataaagagctgttgcaaatcaacaagaaactcatagaagagctgggtgcggtggctcacgcctgtaatcccagcactttgagaggccgaggtaggtggtggatcacctgaggtcaggagttcaagactagcctggccaacatggtgaaaccctgtctctactaaaaatacaaaaattagctgggtgtggtggcaggcacctgtaatcccagctacttgggaggctgaggcagaattgcttgaacccaggaggcggaggatgcagtgagccgaaatcatgccattgcactcttgcactctagcctgggtaacaggagtgagactctatctcaagaaagaaagaaactcgtagaagaaagcaaagaggccaggcgtggtggctcacgcctgtaatcccagcactttgggaggctgaggtgggcggatcacgatgtcaggagatcgaaaccatcctggctaacatggtgaaaccccatctctactaagaatacaaaaaaaaaaaaaaaaaaaaagcctggtatggtgacaagtgcctatagtcccagctactcgggaggctgaggcaggagaatgtcatgaacctgggaggcggagcttgcagtgagccaagattgctccactgcactccagcctgggtgacagagcaaaaaaaaaaaaagagaatatggaaataatgcacaaaagaagtgcaaagttgtaatcaaatacaaactgaggctgtggtgagatactatttgtttcccctataaagttggccaaaaattctaaaatgttgacataggtcaggggtaaaatagcattccactgttggtagaaatacaaattggaaccatctttctggaaatctcttctgcctgtttgtatgaagagctttataaatgatctattcttgtcactctaactccgctttgaaaaatgtctttaggagacctctggctaggtaaaaatgtaagatgtaatgtttttcataccattatctaaaacaattggcacatagacacacacacacacacacacacacacacacactctcacaaagtcagtaactaagtacctaaaaaagacatgggccatgggtggtgtgtcacatgcctgtcgttccagtactttgggaggctgaggtgggaggattgcttgaggctaggagtttgagacctacttgtgcaacataaaattatgaaaaattaaaattacaaaaaagaatttcaaaaaagttagctggttatggtcgtgtgggcctatagtcccagcttgggagccggaggtgggaggatggcttgagcccaggaggctgcagtgagtaaggcgtgatcatgccattgcattccagcctgggtgacagagtgagacaccctttctctttttgtttgttttttttttatatgtgtgtgtgctttgttttgttttttttgaggcagggtctccctctcttgtccagggtggagtgcagcagtgtgatcgtagctcattgtagcctccacctccttgggctccactgatcctcccacctcagcctccagagtagctgggactataggtgcatgttaccacgcctggctatttttttttttttttgtggagatggggttttgccacgttggccaggctggtcttgaactcctgggctcaggcaatcctcctgccttggcctcccagagtactgggattagaggcgtgagccacggcacctagcaaccctgtctcaaataaatagtaggctgggtgtggcctattttataaattatacatatataactttgaaatattaaatttttttttttttttgagacagaacctcactctgtcacccaggctggagtgcagtggcataatctcggctcactgcaacctctgcctcccagactcaagcgattctcctgcctcagcctcctgagtagctggaattacaggcacgcgccaccacgcccggctaacttttgcatttttagcagagacggggtttcaccatgttggccaggctggtctcgaactcctgacttcaggcgatctgcctacttcagcctcccaaagtgctgggattacaggcctgagccaccactcccggctcctgtgtttccttttttggggggtacatcctcacctataatgcgtggggtcctgactctccctgcagggcgctggctctcaactgctttgctcccatcaatgaccaagaaggggccgaggccaaggactggcggtcggggaagccggtcagggtggtgcgcaatgtcaagggtggcaagaatagcaagtacgcccccgctgagggcaaccgctacgatggcatctacaaggtgagtgccccttgaggaggccgggggctctgtccccgccggggctgcctctgatggagctgacgctgatgcccgctctctgcaggttgtgaaatactggcccgagaaggggaagtccgggtttctcgtgtggcgctaccttctgcggagggacgatgatgagcctggcccttggacgaaggaggggaaggaccggatcaagaagctggggctgaccatgcaggtgtgtctgggatgggggatggcactttgggaggccaaggcggatggatcacttacgttaggagttcaagaccagcctggccaacatggtgaaacctcatctctactaaaaatacaaaaattagctgggtatggtggcgggtgcctgtaatcccagctactgaggtggctgaggcaggagaattgcttgaacccagaaggtggaggttataatgagctgagattgcgccactgcactgcagcctgggtgacagaatgagagtccatctcaaaacaggagcactgccgggctccatgacggctctgacacttcccgcctgggcaccatgtgtcctgcttggaggctgtcatccttgaaggtcattgtgggtcacagaatgggccctgcctgggcttgtggtgctcatgttctggaccgcgctgaacactccaggaggcctcccgtctcgggcccatgcttccctggtttctctctgatccagaataatttccagggccccagctgatggcacccccctagctgtcccatataaatcctccagccagggggtgatgggaacgcgcagatgacatttgcttctccgcctgccgcatctcagagttgaaaaccagacttgcttgtcttcgttctgttggtaaagggatcgctgcagaccagtcaggcatctggtgtcttctgttttcacttcttggctcatcacaaaaaaaaaaaaaaaaaagcagaaacaaaccaaccaaattggtggattccagagagatctggacggaaaaatggggaagatgaatatccccgagccatctctcacctccctgtggcgatgggaactgccgagaacttactcaacaagcggcgcagcatttcagcaccagttaggatgtggtctgtccattgcagggagaagctttacagcagacgaatcgtgagactatttaaggaatcttaattgctgtcgagagcctgatgtcctctacccgagggggtcactcaggttgtcttttgaatggatttgtacggtggggaatttcagaagctgaggaagtagagagaaaaatagtaatgggagagacagcctcagcttctgttgggagtaggattttttttgtttgtttgttttgagatggagtcttgctctgtcgcccaggctggagtgcagtggtgggatctcggctctctgcaacctctgcctcccaggttcaagccatactcctgcctcagcctcctgagtagctgggattacaggtgcccaccaccacgcctggctcagtttttgtatttttagtagagacggggtttcaccatgttggtcaggctggtcttgaactcctgacctcaggtgatccacccgcctctgcctcccaaagtgctgggattacaggcgtaagccaccgctcccagcctttttttttttttttttttggagacagagtctcactctgtcgcccaggctggagtgcaggcatgatctcggctcattgcaacctccacctcccaggctcaagcgactctctcatctcagcctcctgcatagctgggatcacaggtgtgtaccaccatgcccagctatttttgtatttctagtagagacggggtttcgccatgttggccaggctggtgacctcaggtgatccacctgcttccacctcccaaagtgctgggattacaggtgtgagccgctgaccctggccaggattttttttttttttatgactctcatctccattgtaacataaagaatgtgaaaggagctcaaagatttcctgagacactggagagtcagacgtgacttataggtaccttcgaaatggagcgatgatgccctgtgaggacagagagggcccgagtcctcagaatcaccagagtttggccagctaaggccctggggtcaggtgttcgtaagtgaagtttctggggaaacagtcatgctcattcactgaagtagcctgctctcagcgcttgcagtccagacccataaggcttgaaaacattcaccctagggtccctggaagcaaaagtttgcctgccctcatggaaatcgtaaagacaacgagatcttattggtgggatgtgatgctgaacacgtcacccgcgttcgctcacattaaatgcgcttaccccgaccctgccaggtggagcttggccgattatctcctcttagtctcctcttgttcgtagtgaagctttgcgattagacaggattagccattggtcgaggctccacagttaacgaagagctgaatgcacaggcgtcccccccttaccagggggacacttcgaaggtcctcagcacatgcttgaaaccagagagtaccaaaccgttgatgtataattttttttccatacgtttggactggtgattaagtttaatctataaattaggcacagtatgagattcacaacctctctttcgcatcttaggcttctctttagcatttccaaattgtcagcatccctactcttgcactttggggccattatttttatttttgagaccaggtctcgctctgttgtccaggctggagtgtagtggtgtgatcatagctcactacagcctcaaactcctgggctcaagtgattctcctgcctcaggctcctaagtagctgggactacagatgcacaccaccaggctcggctaattttttaaatttttttgtagagaggggatcttgctatgttgcccaggctggtctcaaactcctgggctcaagcgatccccctgccttggcttcccaaagtgttgggcttatttaataaaaattagaatgtttaatattaatattttatatttagcctgtaatcccagcattttggatgactgaggcaggtggatcacttgaggtcaggagttcaagaccagcctggccaacatggtgaagccccatctctactaaaaatacaaaaattagctgggtgtggtggcgggcacctgtaatcccagctactcgggaggctgaggcaggagaatcgagaagctggacaaagggaaggttcacatccctgtgggacgatgcaatgtttcatcatgcagtgtgcgtgatgtgaggtggctgtaaagggggaggaaggggccccgagccgagggatgcagcgcctctagacgttggacacttagaacagtgtgcagtttacaacttaggaattgtttctagaatatttcatgtaacattttcagttgactttgggtcactgaaacctcagcaaaactagataagggaggactaccctgtgctcttcagggggattgggggtcaggtgtgtctggaaacccagacctggcaaggaggctggaagagcgggctctgcatagcgtgtgggccccaagcctgactcacggctgtccctcttcctcctgaagtatccagaaggctacctggaagccctggccaaccgagagcgagagaaggagaacagcaagagggaggaggaggagcagcaggaggggggcttcgcgtcccccaggacgggcaagggcaagtggaagcggaagtcggcaggtgagaatctcgtgggtgtggggtgagcgtcttgtgtgtgggggagcaggtgggcatctcgcgggtgtggggttgaggtcgtgtggacgtgggagccggtggctgtctctccggcagctcgggccacgcgcccctccctcacgcgccccaccctcttccaggaggtggcccgagcagggcgggtccccgcgccggacatccaagaaaaccaaggtggagccctacagtctcacggcccagcagagcagcctcatcagagaggacaagagcaacgccaagctgtggaatgaggtcctggcgtcactcaaggaccggccggcgagcggcagcccggtaggctcgcacggctcactcgtcgccctgatttgcgttgactgcggtaaaatgtgtggggcttgtttcccatgttccccattttcaagtgtacagctcagtcgcactgagtacattcttgtggttgtgcaaccatcaccaccatcaccacctccagaactttatcctctccccagactgaaaccctggccctgaaactgtcactcccaccccctcccaagccttggcactcgctccccagccccggcaactgctccccagcccctgcacccgctccccagctccggcaccccctgccatcctaccttctgtctctgtctcccggggctgttgcaaagtgaccccaagcctaggagtgcaaagcgactcacatctcacagctctggggctgggagcccgacatgggccttgctgggctaaagtcagggcagggatagggctgggccctcctgggggctccaggggagaaccagatttctgcctttcccaaggtctagaggcactgtatccctcggctcggggccccttcctccccctttacagccacagcgcatcttcttccagtctctgagtctcactctcccgccctctctcgggaggacctcggggtgacatcaggccccccgcctcacccaggatgctttcccagctccaggtccttcactcagtcccacctgccatttctcctctgctgtggatggtgacgtctcaggatggtgcaggtctcaggattcagctgtggccgaggccatctcagtggtccctctcttcccatttccttcaggccacattcttcccagggctttctccccagctcccaccctacgctggggcagccccttgcccctagaccttcacttgtgtctctttggtccccgcacttagctccaagcaggaggaggtgtctttcgagtcatccgaggctgggctcctggtggcccgtgtactcagtatgcattgtgtcagtggacaccatgcctctaaatttttttggtgacaggagctcaccctgtcacccaggctggagtgcggtggcatggacaaaggtcactgcctccttgaactcccaactcccaggccacgcctatgtttttaatttattttgtttatttttattatttttttttgagatggagttttgctctcgttgcccgggctggagtgtgcaatggcatgatcttggatcactgcaacctccaccttccaggttcaagtgagtctcctgtctcagcctcccaagtacctgggattacaggcacccaccacgcctggctaatcttgtatttttagtagggatgggatttcaccgtgttggtcaggctggtctcgaactcctgaccttaggtgatctgctcacctcagcctcccaaagtactgggattacaggcgtgagccaccatgcccggcctattttttaattttttgtagagatgggggtctcactgtattgccgggctggtcttgaacacctggctcaagcgatcctcttgtcttggccttccaaagttctgggatgacaggcgtgagctgccgctcccagccaggaacctctcctaaagccctgtcttgactcagtgcagggtgtgcttggtggtgccagctggtcatatctgggtcctgcccagcatcattgaggctggcgcccttgtactggctccgcctcatcctccccaccttgccacttggggtgttggggacttcaggtgaggctcatgcctgttgggcctctgtttttctcagaacggggacgatcatggcccccgcctcctggagtgaaggctggggacagaattagaggacccaggtacatgctcagcaggaagccactgatctgtgggagccctggtcccggtgtctttgccggcctcacacccgcttccctctagttccagttgttcctgagtaaagtggaggagacgttccagtgtatctgctgtcaggagctggtgttccggcccatcacgaccgtgtgccagcacaacgtgtgcaaggtgagtagagatggccgcgggagccgggtggaaggttctggaaggatgacctgacctcccgttcccacatgcctgccactacagacagaggcttgttggctttgctccgctcactctgcagcttttctcggggccctgttgactgctttctgggcagcctgtattaccacggaggcctataacattctcccccaagtcctgtatggtcaaggggccagggtgggagaggatgggccacagtcttggcctaaggtctggagaggaggtgcacatcccctaggggtcaggaaagaaggcttcttggaggaggtggtgttaccaggcagcatcccttgtacctgggacagcaggtgaagaagcctgggtgggaagtcagcagctggggcctgcagtggctctgggcactggggtggtggcctgccatgggctttaaactcaggacaagtggtcagtcgtaggagggacacaagatcccagctgatggtttttttttttttttttttttttttttctgagacagagtctcgctctgttgcccatgctggagtgcagtggcgcagtctccactcactgcaagctctgcctcccgggttcacgccattctcccacctcagcctcccgagtagctgggactacaggcgcccgccaccgtgcccggctaattttttgtatttttagtagagatggggtttcaccgtgttagccaggatggtttcgatctcctgaccttgtcatccacccgccttggcctcccaaagtgctgggattacaggtgtaagccaccgcgcccaccccgcagctgatggttttcaaaccgattggtttggggccaggacagggtctcttcccccctgtgctgtgggccttggggctggatcattgtctggggtggggccgtcctgggcactgcagggtgctgagcagcatccccggcccccacccactccatgccaggagctccctgcctagtcgagacaatcacagacatccccagacaccttccagtgtcccctgggggcagaactgcccaggtgggcagtgtgggtctgggtgatggtttctctgctgcaacctctggccagagccggcagtcccggtggacaggtgtggaagggactgaccctgccaccccacggatctccccaggcttctgagttgctggcggttttccttccaactgcagtcccgcagtcctctcagccatgggccacacccccgggtctcagaccccgtgtttgttttcatgccaggaggcagctcagggaaggtcaggagatggggtgttcccagtcatgcccatggcatctctgcctcctcgggccccacctgcctcgccctgtggcctgagtcccttcagctgtgtgggcctccctgagtgccctgagtgaggtggcagaaggggtgagaggccatggtgtctttggggctggtggtccgggtctggccatctgtcacctctcaggcgtgcaggcactaatccctccaagcctcagttggccacagtgagaaggggcctggtaacactgtcctggatgccaggttgttgtgaaggtcccggcttagcctctggcaggaaggaggtgctcaggaggtgggcacaggcagagggctggctgtggggggctattggaagagggaggcctgggagccccgtggcggtaggaaggactgtggggacattggaaaccatctgtcctgtgcatcggtgtgaaggcgcggaagcgctgaggatgtgaaggaaggggctaaccagcatcacggtgtccccacaatctgtccttgttgctctgttccaacttgggaagctcagcatcggaggggttctgggaaacaggctgtgaccttccaccttgatctttttaaattataaacttgaggccagccgtggtggctaatgcctgtaatcccagcacttggggaggctgaggtgggaggatcacttgaggtcaggagtttgagaccagcccgggcaacatggtgaaaccccatctctactaaaaattaaaacaaaattagctgggtgaggtgacaggtgctactcaggagactgaggtggtagaatcgcttgaacctgggaggtacaggttgcggtgagctgagatcgcgccattgtactccagcctgggcgtcagagcaagattctgtctcaaaaaaaaaaaaaaaaaattgaaaaaaacattcagagacagcatctcactctgtcgcccaggctggagtgcagtggtgccatcatagctcatcgcagccttgaactcctcgcggggctaaagagatcctcctgccttagcctcctgagtagctggggctacaggcatacaccaccatggccaacatgatgaaaccctgtctctactaaaaatacaaaaattagccaggtgtgctggtgggcgcctgtaatcccagctactcaggaggctgagacacgagaatcccttgaacccgggaggtggaggttgcagtgagccaagatcacgccactgcactccagcctgggcgacagagcgagactctatcttaaaaaaaaacaacaaaaacaaaagccacaggctgcctggggcaggtgactgtgctgtggtcaccaggcctctcccccatgtggtcaccgccctcgcccagctgtgtgacgacatgctgcagacatgtgccccctgcgtaggcatctgtgcacctgtgtacggcgtgtcactcctccctggcgtgcagccagcccggtggcatcttccctgtttgtctgcttgggaagtggagactccaggcctctcagctctgtcttctcctggctttcttccccaggcacgacttggttgattgagcttgaagttaggaatctgaatccaccagacttggttccttcctccttttcccctttcttctcattgacgtgtatgtttattttttatttttttcgagacaaggtcttgctttgtcgctcaggctggagtgcaatggcgtgatcatggctcactgcagcctcagcctgcctccctgggttcaggtgatcctcccacttcagcctccggagtagccacgcccggctaatttttttgtttttgttttttctttgagacgcagagtcttgccctgtcacccaggctggagtgcaatggcgtgatctcagctcactgcaacctccgcctcccgggttcaagccattctcttgccttagcctcccaggtagctgggattacaggcatgtgcctggctaatttttgtatttttagtagagacagggtttcaccatgttggccaggctggtcttgaactcctgacctcaagtgatctgcccccctcggcctcccagagtgctgggattacaggcatgagccacgatgcttggcctgatgtgtgtgtttattaagcatctactgtatacactgtgcttggtgttgagagagaacacagcctcaaagctcagggagcatctgccctgttgtagataagataagcacattaataatatataacacggctccacaggtggaaggagaggtgccgtcttgaaggcagatggggtgaggggatgggactgcctctagggaggtgtcagggaaggccccataagggaggtgacttgagctgagctgtgagtgatgagagccgggggaccgagctgttaagctgcatgacctgccagggacaaaagcctggaggccgggtgagcttggaatctttgagggcccctaggggggccaggctggtgatgggcagcaggtggaaagtgagactgaaggtcagaggggcctctggacctggtgagactgtccccacagtcctgggagaggtggccaggagcaaacctgatggtgtggatggcacttctcacgcgcctgctgtgtcttacaggactgcctggacagatcctttcgggcacaggtgttcagctgccctgcctgccgctacgacctgggccgcagctatgccatgcaggtgaaccagcctctgcagaccgtcctcaaccagctcttccccggctacggcaatggccggtgatctccaagcacttctcgacaggcgttttgctgaaaacgtgtcggagggctcgttcatcggcactgattttgttcttagtgggcttaacttaaacaggtagtgtttcctccgttccctaaaaaggtttgtcttcctttttttttttatttttatttttcaaatctatacattttcaggaatttatgtattctggctaaaagttggacttctcagtattgtgtttagttctttgaaaacataaaagcctgcaatttctcgacaaaacaacacaagattttttaaagatggaatcagaaactacgtggtgtggaggctgttgatgtttctggtgtcaagttctcagaagttgctgccaccaactctttaagaaggcgacaggatcagtccttctctcgggttctggcccccaaggtcagagcaagcatcttcctgacagcattttgtcatctaaagtccagtgacatggttccccgtggtggcccgtggcagcccgtggcatggcgtggctcagctgtctgttgaagttgttgcaaggaaaagaggaaacatctcgggcctagttcaaacctttgcctcaaagccatcccccaccagactgcttagcgtctgagatccgcgtgaaaagtcctctgcccacgagagcagggagttggggccacgcagaaatggcctcaaggggactctgctccacgtggggccaggcgtgtgactgacgctgtccgacgaaggcggccacggacggacgccagcacacgaagtcacgtgcaagtgcctttgattcgttccttctttctaaagacgacagtctttgttgttagcactgaattattgaaaatgtcaaccagattctagaaactgcggtcatccagttcttcctgacaccggatgggtgcttgggaaccgtttgagccttatagatcatttacattcaatttttttaactcagcaagtgagaacttacaagagggtttttttaaaatttttttttctcttaatgaacacattttctaaatgaattttttttgtagttactgtatatgtaccaagaaagatataacgttagggtttggttgtttttgtttttgtattttttttcttttgaaagggtttgttaatttttctaattttaccaaagtttgcagcctatacctcaataaaacagggatattttaaatcacatacctgcagacaaactggagcaatgttatttttaaagggtttttttcacctccttattcttagattattaatgtattagggaagaatgagacaattttgtgtaggctttttctaaagtccagtactttgtccagattttagattctcagaataaat

SEQ ID NO: 136 - DNA, 620 bp, Homo sapiens
ggcctaaaactggcctgactgggggaacgatgtgtctgtatttcatgtggctgtagatcccaagatgactggggtgggaggtctgctagaatgggaagggtcatagaagggcctgtgacatcagttccttgtgtgtgtactcactgaagcctgcgtgggtccagagcggaggctgtgtgcctgggggagttttcctctatacatctctccccaaccctaggttccctgttcttcctccagctgcaccagagcaactctcatccccatgccagttccacagttgccacacctctgtggcatgaaatgagcacccttcccatttaaaaggtccggaatccacgtgcgaaaaaaaaaaaacaatcaaaacaacaaacattttttgtggggccgcgcccggggcccttgagaaaaggtttttaaaacctttcctgtggggcgcggggcccaagaggggacgtgagaacgtggccaacgttgggccaaagagaaccggggcaacggctaggcggtgggttctcccaataaaaaagcgggggggcccggcggtttggaccacccagaggagtctgggccatcacgggttacaacggaggcacgaggcagataatcggcgggggggc

SEQ ID NO: 137 - DNA, 28192 bp, Homo sapiens
cttcctcctcctcctcctcctcctcctccctcctcttccccaccttcctccactccctcccttcccctccccttctacctcctcctcggccagctcaggttgcagcttctctggggaactgctcacctttccggagcaggggaagctgccccgtgcccgggagggagcgggcgcaccgcggcccccaggacacgcgctgtgagtcccgcgggcggtgcgcctgggaggaagggggaggtcggaggagcgggcaccgcggcgccgggtataaggagcaaaggtaagcggaacggctcttaaaggcgcagttttgcttttgccctgaggcgagaggttggagggaaataccggagcggcgaggggagagcagagatcacgaggcgtgatctgtgtgatactgtgttgtgtgttgaggggtggggggtgccctcgaaaggccactcgtaagttccaggtgcttgagagggagggttattttgcaatctcagaccccgcgcccccttagggagtctccatctgggatcactttggcccctgggctcccgtctgaaccctacaaagcaaagttttccacccagtccggaaccaggcgctttctaagctcccttcattctgggaagggcaagggtcaggagtctccagggaccaaaggacccgagagtgtggggccacatcgctgccttgaagggcttcctgggctctggtgaactttccagagcggcaggcagggggtgggaggccggagccctgggaagaacgtggaaggacacgtgaagccctgcaggtcccagttctgggggaggcaggggtctggggaatgctgctgcttctctctttccaccccggaagaccaaaggggcagtgcccccctccacccctcatcaacaggcgacagagggttaatgcagcagagggaaaggaggctgggtggggccggggggagtgggcggtgacctgttgggctaaggagatgtgccttgaggattctgctgtagttgagggacaccatcaggaatctgaaatccaaaatcgggtctggactggaggcctctgttttcgccctgtggggggcggggattccctgaaggtgtctgcagaccttgtgctgggtgggagttgggctgcagaaacagtgaggggttttctgtgctgcagggtcagcaccctcctaggcaccagccctgcctctcttcattctctctgggcacctcccggcagtcggggtgggaggattgacactgtgggagtgagaggccctggaacctcttccgcgctatctgctactgtctccccttcttccccacccctagcccagccctcggcagttccccagctgtagcctgggccctgtgactcactaacaccaccggcttgcccctcctgtgtcagcacccagtgagcttcggcatgttcgcgtggcattccccacccgggcatgggcatgcagcacattcctggacacgggcctgagaggatgcctggagcgcctggtggactggcacgtcctcagagatcccctgcctttagcctggccttgggaggggcctgggaaaacggtgctgagggtgctgagggtcggtggagtacagggcgacactggctccaggtccgggtttgcatcctgaaggcgttccagagagagggtcaccttgccacagcaaagctgctatctcgggttaccctttcccagccacctcttgtgcagctgaggaggctgtggggctgacccctcccccacccttaatctggggtgtacctgaccattgggttcccaggactctccccactgggtccccaggactctccccataccctgccaggagaatggaagaagctctccacgcgtgccagaagaagttcttcccaaacttatcgggggtgccagaggcagagtagacaagccttagtggccaccatttgttgaatatctactgtgcgccaagcagtgcgtcacaactttatgaagtaggtattattatcatccccattttacaggtgaagaaactgagtctctgagagaccaacttttccaaggtcacacagaggtgggatccagcccacttccgtctgaccccaagcccctgctgttaacccctgccccattgtggggaggttccggcccactctggagttctctggtctgcgtcagtcctcaggagaagaaagaatgggggtgatgctccaaatattgaggctcccatctgtctgtcctgcactaggcagagccaggcttctccatggggcacaggagagagggcaccagatctgaggagcaaataggttcttggtctgagatctcgtgggatcaggttgccagccctgcaaacccccgctcaggtctagaggacatggagctgcctttcagggtgcatttgcttcctctacagactcggactctgtcctctgcctacttgggccgtcccgcactcgggaatgcgtcctacactgtagggcagagcccggcttgactcttcccggttcctaccctaaccaagcctctactttctgggatcaccctgttgggacttttgtccagcatctccatctacctgtcctctgattccttctgttcttctctaactgagcttgagaactaaaggggagggcaaacttctggccttggtggaatccagctccagcatatagtagctatgtgaccttcccctcactagcacactcgtgaatttctcccagcatccgttccctcatctgtaaaatgaggatcataatagagggctgttataagatttaggctgggtgcggtggctcacgcctgtaatcccagcactttgggaggccgaggtggacggatcacgaggtcaggagatcgagaccatcctggctaacatggtgaaaccccatctctactgaaaaaaaaaaaaaagcacaaaattagtcaggcgtggtggcaggtgcctgtagctactcgggaggctgaggcaggagaatggcgtgaacccgggaggcggaggttgtagtgagccgagattgcaccgctgtactccagcctgggcgacagagcgagactccgtctcaaaaaaaaaaaaaaaaaaaaaaaaaaaaaataatgcacagtgcctggcatgtagcagagactaaataactggtagctatagtggttggtggtgcttgtttggaaagggaatttcctggtgattgcaccagggctggtctagagaccaaggtagattttcccagccccatcaggccaagcccttagttagacagaatctttactgctcttccaggttagggaggagggctctgtgtaagagaatggtggtggtggtaggggaatgggttggatggaaatcttccaggaggggccaggaatctgtgctgtgggggccctaccttctggcagttatgaatgaggcaggcactgggagctggagaggcagcagtctcttgctctgagggccctctggcagcgccttctttccctgaggtaggaggaccctcccctggtacttaattaattgcagtccctgttctgctctgttgttcagggtgagtggctggcctggttccaggcccacctgattagcccacctttggcaataagtcacatttctcttcctcggctctgtgtcccaccataaccccttacgtccccttccctggacttttcacctttgccctccaggcattccctgctgagtgggcactttcccacatccagggggtgggagcagaccaaggttaatcttgtcctggctcccacagctgcttacacacacacagctgcatgcacatgcacacacaggctgggctcacaacagctcaggccaagggtctgggatccaggatcactacagagctggtagctgggcctggctggagctggccagtggttcagcagcaagtctggaagaggaaaagccgtgggcgcatctccgccagacctcctgtctgaaagagagcccatctgctcctagaatctccacagctacatctgcagaggaggaggggtagtgaggcaagtgtgaggtttggttttaaactgaaaagggaggtgggcggattgcttgagcccaggaggtcgaaaccagactgggcaacatggcaagaccccatctctaaaaaaatacaaaaattagccaggtgtggtggcacgcgcctgtagtcccagctactcgggaggctgagaggggaggatcgcttgagcctaggaggttgaggctgcagtgatccatgattgcatcactgcactccagcctgggcaacagaacaagaacttgtcaaaaaaaaaattgaaaagggtcttaggccgggtgtggtggctcatgcctgtaatcccagcactttggaaggccaaggcgggtggatcacttgaggccaggagtttgagaccagcctggccaacatgatgaaaccctgtttctcctaaaaatacaaaaattagctaggcatggtggcgtgtgcctgtaatcccagctactcgggaggctgaggtaggaggatcgcttgaacccaggaggtggaggttgcagtgagccgaggtcgcaccactgcactccagcctgggcgagaaacaaaacaaaacaaaacaaaaaacgggtcttgaagcaaagctccctgacagcatgagtaaccctgaagagactggacaccttgctctgggagacatgggccagaacttttgaaaggactatgatgagatcctctttcctggagctcttgataatggtcccaccctctgagcctccctacccccaccattaaataaaagtcttccctagaaatggtggagtcgggatagacaagatgacccaataatggctggctggtgcactcatcattatttatatgttgagtgtatgtctcctgtccaccatgggtggaggcaatttatggactttggggtcagttcagattctgcctcttccactcagtaactggttgccttaggttaagtaatttgctcacccaggtttcagtttcctcatttataaaataggaggataatactattatctcatgtgattgcgaggactccagtgagataatgtccacctagtagctctttgctttacctgatgtcattatcaaggggtggtggcagagttaatgggctacatttggtagttctcagtgcctttggccccacttgatatttttttctgaaatcagggtccctgcaaacatcagggatcagcccccaaattgggaagagaactctattcttaaaatgtttctggccaggcacagaggctcacacctgtaatcccagaactttgggaggccgaggtaggtggatcacctgaggtcaggagttcaagaccagcctggccaacatggcgaaaccccatctctactaaaaatacaaaaattagccaggcatggtggcaggcacctgtaatcccagctactccagaggctgaggcacgagaatcgcttgaacaagggaggcagaggttgcagtgagccaggattgtaccactgcactccagactgggtgacagagcaagactttgtctcaaaaaaaaaaaaaaaatttctaccctccctcactctgaacactgttccccatcttatcattatcgagggaaattcagagctccagaatgattactgccctcacaccttgcttccctaaagaagcctgcccttttctgcctggggagtctcctcaggaaccagaccttcttctcttctctggccccagccacccagcaccctgggctgcggggtgaccagcccaggaggtgacagggctgtccttcccacatcctggcaggacccactgcctggaagcaggtgggcggtaggtgttatgctagagggcatcactcttgacaaagcagcactggctcccaaactctgcctgcaacatgggatgagcccaggaaaggggtcacagagcccctccctgatcctgccgtggagcccagctggcagcatcccctgccgtggctgggctgggtgccatgttctgtgtgggtgccaaacctggcatggctccttcccaaggaaggtggcccttggggatgctgtgactttcttggctgtggtgaccaataaagggagtgccatctctacgcaggcccatgcagtcccttccaaccctgcacaaagtcagaagcccaaagtgtggtcccagctctgccctgtcaccctcagtggcctcgggcagatcgctcacctttctgagtcttgccttctttgcctgaaacatgagggtgcagaccaggggatttccaaaggcccctctgaggctgctggtctgaggctccgacttttgcctgtcctgctaacaaggtgagctgtgtgctggggtcccaagaggggctcagcctcctgttcctccaaactgtagagccaggggcttgccccagctgatggctgggtacctggtccctgccatgctgagatgggcaaggaaatcctggaatgcctcagccctgtcaattaggaggagaacaactacctcgcaaagaaatggatgctggattcaaacactacacaggcactggatgctcaaggctaggggttggcaaaccatggctcttggccaagtcccgacagtttttgtatggcccatgagctaagaatgatttttacatttttaagcagtcggtaaaaagtcaaaagaagaaaataaagttttgtgacccttaaacattttataaaattcaaatgttagtgttcatagtaaagttttactggtgtgaggccaaactcattcatttacatcttgcctgtgggtgcttttgtgctgcaaaggcagagtggcagagtggcgacagagacgatggcccgcaaagcctaaaatagtggctgtctggcctcttacagaaaaggtttgctgacccctgctcaagataatcatagttctctccaggccttgcactaaactgctccaggatctcaatctaaaagtactttcttttcatttaaaaagaagtgttgctattttcttcttatgtaagcaataaatgttcattatggaaatattagaagatgcagataagcaaaaagaagacattaaaatcacccataattctatcacccaggaataactactgctggtgttttgacttaccaccttctgggttatctaacagtgtgctgtgtttatatgtgcatgcctgtgacacatgtgtatatcctgcatacgtacagcttttacaaactgtacacatctgtcctcttcacttaaaaacacatcttggccaggtgcggtggctcacacctataatcctagcactttgggaggccgaggcgggcggattacctgagttcaggagtttgagactagcctgggtaacatggtgaaaccccatctctactaaaatacaaaaaattagctgggtgtggtgtcgtgcgcttgtagtcccagctacttgggaggctgaggcaggagaattgcttgaacccgggagacagaagttgcactgagccaagatcacgccactgcactccagcctgggtgactccgtctccaaaagaaaacacacacacacatacctctaactgaacccttgggggacacacaggcagggtgcccagaaggcagctgcacccaagcatctggagctgaggggcttggtggggccagggctacagatctggagtcatcagcacgcgggtggtggtttccacttcgggaggggatgaggtcacccaggaagcatgcccagagaggaagagcaaagggccaaagagagaattgtgggagtgttgacattcaagggacaggtagaggaagtaagtccaccagacccgggaggaaggaagaagcaggaggagacccaggcagccaaagggagtggaatccgaggcccagggcccaggacagtgcctggcgctgagcaggtgcttgtgaaatgagtgagtgactttgaggaggctgaaccctggtgagtgagtgacactgataaaagacatttagagaacagttgaacaactatgagatgttcagaggcctgggggaggccatgcaggccaaggaggcctcctgggcccagcctggtgggagggaggccatgcggagtgtgaggagggagaggcggggcaatccaagtgaccagaagctgggagctggtcagaggagcccagtggagttcttggcggtgacatgaagctgctttttttaagctagtctctcagattggaatgaggaaagttggagacgaccagccaggggttcttgtcagaatgtgggcactgggcggcgtgggccagctggtgggggtggagtataaataggaatatggtttagagatgctgggaaatcctccccattccctccccctcctgagactgagaggtccccagggatgccaggctcaaaggcccctgcagttctgttgccaaagttgggcatggagagaaacccagagacaggactgaaggtcccatgacaggccagcaggagagctggacacgggatatctggctgagagagggctattgggtgggtgaactcaacactcttcttttcttctccaatttattgtgtaaaagatggtaggcaccagtttctgtgccagagcaagtggagaggaaacaagctgtttcctctggtatttaaggaagacctaaggaaaggttccagactttgggatctcaaaaacacaggacagttggggaaggaccttccttgagtgtctttaaagagggctgataaaaggagcagagagggctcctctggctgggagagtaaggcgggctttctctggaggcaggaggatgggggagatggaggccaggcctatcctggcccttgccccttgctctggtctctgatctgggatgttctgtacgcccaggaccagaactgacagaagggctccttgtcccatcttatcacttggacatcctgagcctcctcagagagtgcagaccagctttagctgggcccccaaaaaaggtcaaaaggaaaataccagaagatgcaatatgcacctctattccttaagcctcaggaagccagagagcagcagggtggacatcagtaggactgaagtggagccacacagaggggctagataggaggtcgtgtggggtcagaaagggtcatctgtaggggtcaaggccaacatctgagcctgagtagtgcacctgccctacaaggctctgagaatcttccctgagtgatagagccaggaagagggccacaagcccctccgaaccccttccccacagccctggaggccctagctcaatgcatgttgcaggaggaacttctcattcgggttcttctcattccagtccacccctcactgtaggatggtgcctccagcccaaaaacctccacagacctcactgggggagtaattgctgggcaggacactgcccccactgcctcagcccatctcccgctgctgttgggccacatgctggctagaggaagagggtcaggtttcagctgaggcctcgagtccagctttcatatttcatttgctggtcatttgagggctcactttgtctcaggctttgggtcaggctctgggggtgcaatgacgagtcacgccacagtgcttgcccttaaaaagcccacaggcaaactagggaaatgacaagtaaacagttacaggacagggagccaagtgccctgccttgggatgtcagaaagctgtgggagcacagaagagggaccatcacctggctggggacagtggagtttcgggctagaggagatgcagaggtccccatggcaggatgagtagcacgttgttggtttctccctagtcccccatccatctgcttgggtaccaatccctgtattcctgttccctctgaaacccaagaaaactgaggaggaagcatgccccggggagtctggggctgggtgactggacagtctaggcttactctagtgtgcccagaaagaggacagggccaggcccaccccaatcatgctcaagtctaactaggacaggagatggcctaatgagaagatacacctagaaacaggtccctggcctgcctgaaagtggaaggaaaggcaccaacatttattgcacgtggcagtgtgtcctggatcttaaaggtgactaagatacagtctttgtccttgagggatctaatgtttccatatctgtagaggaaagaggtttaaacaagtcatcatgaagcagtggctcgatggcctcattcagtcacttgttcattcgttccacaaatgctgagtacctggtgggctccttactctgtgtaaggcatcagggaaacaaaaatgttaaggccccattcttgtcctgaaggatctcacagtctagttatgagtgtgtgctggctgctctggaagggacaaggaggaagcatctcattctacctagaggaagaaggtgtggtcatgcacagtctcccaggggaagtgacccatgagttgagtttgggagtggttttaccgagggaaaaattgaggaagggcatcccaggccaaatgattgcaaagctgtggggtgtgagtggagtttgctctgggaatgccaggtacatttgataaaaccagaccttctggggaggggtgagagctgaggctcaagaagacagggatccaaaagcctggtctgccaggccctggaatttgaactttttcctgaaggcagtgttagctttgaaggatttttttttttttttttttttgagatggagtctcgctgcaacacccaggctggagtgcagtggcgccatttcggctcaccgcaaactctgcctcctgggttcaagcgatactcctgcctcagcctcccaagtagctgagattacaggcgtgtgccaccatgcccagctgatttttgtatttttagtagagacagggtttcaccatattggccagtctggtcttgaactcccgacctcaggtggtccacccaccttgacctcccacagtgctgggattacagacatgagccaccgcgcctagccactttgaaagattttaaatgggcaagcgacatcatcagaaagcagctgagaaagttaagtctaggacgctgatggcagttggattggaggccaagtattattctcaattagcagcaaggaaactgaggcatggggtgttttttcaggtcacagctactaagtggggtttcttccatgacaccaaactgcagagaattttggagagcaaggctagacaccgtgtgttcctcactgcaggacatttctgattggagtgagactctaggagacaatggcgtatttgtctggagcaagggcgaccctgatccccactttgcctcctgagcagacatccaacaggtttgcccaaattgctcccggaaggccttccccgcctacttcctgcattccaaacagaggctgtgggaatcctcttggagctctgggactgtccagagcatctgtttgttggcagggtgactgcaggcctggctatcctcatttctggccactctgaaggtttcaggcctgcagcctctctcatccaggctggggcagggcaaggttgtgaggaggccccaaggcttctgctgctgacgccgccacagctccaggcagctaaggggtgactggcttcccctgaggtttgtcccaggctcctggaaactaaggcctccagctgtgcagaacagggtcagctggaggatgaaggaagagatggtatctgcaggctcccagcaggcacagttctccctgggaggagggagtgtctctgaggtcctagctcatgacgtctgcaaacttggtcagccatggcctctagttctttgaaattcacccaagggccaaagtggctgagtgaccgaggcaggggcagggactgggagatagggtgtcatagggatcctggctggtggtcagccttcgtgactgaagggaagaccctctgggcttcagaaagtgggcagccacaagttacgtcccccaacccctgcccctgggcccacagagaccaagattgaaaagaaaagcaaacaaaacaaaaagagggacttggggatgcatctaacatgtgcctggaacacagcaggtgctccacatgtgcctgtaaagcagacacatgcctgctgtatgccaccagcaccaggcatagagaccaacgtgctccagatgagggagacaggtgaaaagtcacgccccattgaaggaggggcacctggtggtcctgggggtggggtggagtgagttccaggaagctcctgaaggccccagagacttgtacagcatgcaggggcaatgaagaggggcaaagccagagacgaaggggccccagatcttgaagggcctttgggtgcaggctggggaatcggggctttgttcaagaggaaggcaaagaggcttcttgaaggggtttgctgagagaagactccagtcctggccccaggagcttgagaagtgaagctgactttcccgccctccagtctacagcatcccagattcctgggatgctctgtcaacctccttctccacctccatggtctccaggtcaaggtctctcaggggtccagccccaaggcaggtattaggtctgtggcctggcacaggttgtcccagcagtcagtgggctgggaatctgccctgtctggacactggggccctggggctggcctggcctgctctgtggagctttctttcctcctaagagagaagatggggcttgtctgccagtagccggggttccctgccttgcacgggccccaccctgcgtggccctgcagttgtctaagtaggggggaccctgcctccctggcccttctccccctcacatctgccaagagatgatcctgctccctgtctcctggccctcttccatcctgggatccaaaagcaccttgcaataaggaagtctgcagggatgtttgatgaagtttatatgaggactctttttgtctgggcagtagcttgagagaggagagccaagctttgctggacatcttccctgtgccagtggtgtgttgtgttggctcacccagcatgtttgctcagataccactgtacgttgaaaatgtcacctgcccaacatccaactcctggtcttcccactgaaaccactactcccagaatgccttgtctcctccagtgactgttctatctctccactccggctgcttggcgaaaaccctgctgcagagtcatgcttgactcttttctcacccacaacatacaatccatctgcagagctctttgcctccaccttcaaaatatagcccaaatccagccacttctcaccatctccactgccccccgctggtcccagccaccatcaagctctctcccctgggcctcagcagcagcctcctgcccgggctccctgctctccccttgctccccttgtctgttctcaacacagcagcgtgttaaagcctcagtgtgatcatgtcactcatccgttcaaaccctccttacccctcgaggcccaacacagctgctccgcactcccatccagcatcttctccagccacatcattgtcctgcagtgaaccagacttacttctgcctcaggacctttgcccctgctgttcccttgttgacctgcttctcccagaccctgcatgactgaccccctcaccttacacctactctggatttctcctgagatgtcacctgcttcttggggaggccttcttgaccaccctacttaaacttgcaactgcacttcccacaccttccctcttccctgcatgaattcccatcattgcacttgtcaccatccatcatactgtgtattcattctgtctattgtccgcacccccctacccctgttagaaagtattaggaaaggaattaatgtctgtttcattcatctgtggattctcagggtctacaacagtgcctggcatgcagcaggtgttcaataattgttgaatgaatgaatggagccaggggtgagaggggttttatcacgtcattgcgattccatagcctgctagtggtagcaccaaagtttgaaactgagtttgtttggcacgcagttcagagtaggagaaaacagtcaagcctgggccacagggaaggggcaagggcggggagggctccaggtaggagaagaaaggagcaatatggtcacgtttgtgcacttggcaacaaccaggaaattgctgcgtgattctgggcaagccatttcccctcttggatgttcagcatcttcactgggcaagggatggggatggaggctgtgtgagcgtcttcccctgctaacattctgggaggccagccctgctcactgggggcacagtggcctctggcaagtgctggctttcttcccagcctggctcctccttcctccttctgtgccacccatggctctggcaccagcaggaggttctgggccggctgctgtgtccctgggaagaagcaactggagctggctgagctttatgacttacctgggcagggaggtgggaggggaggttggctggggtctgcctgcccaccctgcagctcctcagtgggactctgctccttcaacttcctccaccccccactgccgggccagtatccctggacactcatcgccctcttcccctggcaccaattgcacggggacagccccagatggctccttggtctggggacaaaggctgtgctgtgcctggccccgggctggcctcaggctggtcatactgagcccttctgtccccacttgggggtgaggggtagatagcactaaggtgacaggcctttttcctgtctcccttccccctcgacccccaaatctgaggagctgactctcccaagggaaaaatgacagaggcatcttgtgtcttgacctagggaacaacagactattcactgcccagtctgccctgtcacacccaagaccctgctgggttcaatgccctggttgtccccagcagagagagacatccactctgctgtggtcaccacccccaccgcctgctcccctgtcaccatcaggaagtccaccctacatctgacctccatccttccatcaggaagtccatcctacatctgacctccatccttccatcaggaaatccatcctacatctgacccccatcccttctgctgctgtgacagccacttcctctcaggctcctgtcctgcgggtggagaacagctggtccccatcgcctgcactgcttggccccacattcctgctccagtcagctgcctctggcctcacccttcctccagctcccagccccactgtcctccccaccccaggcacaggctggtggctccttgctcctcactgaaccttagggagagcaggtgtgactcagggctgaatctcttttgtcttgcagaaatggggggcctccttcccggaggcttttaatgagctcccctcccctcaccctacaagcaagagcaagggtgtgagatttatggttgctacttgtagattcctgagccgcaaatccaacatgccatcccataaatcccagactgcaggacggttttatggggaagccctgtttttagaaaggggtgtggctggtctccctcctggcagagctcagacctcagggagccaagtgcctgcctctccccacccccagagaacaaccatgacaaagcacggggacattggggacatcagttggtgtggtggagatgcactggcttccaggacagagagacttcctctcctgtggggggcctcctgcttcccttccctgctctgaggatcccccgtctcagcacaggagggtggcctggaagcctgggcagataattgtccctgacctggaccttagatgttttcctggtcaccgctccaggtgtacatcattggagatgttttttcaaatgcattttcccaggcaccattctcagaacctcagttccagaatctcagggtgagacctaggaatctgaatttttttacaatgctccctggtgattctgatgttcagctatctttgaaaataattggctgagtgctgtggctcatgcctgtaatcccagcactttgggaggccgaggaggggcagatcacttgaggtcaggagttcgagaccagcctggccaacatggcgaaatcctgtctctactgaaaacacaaaaattagccgggtgtggtggcgcgggcctgtaatcccagctactcaggaggctgaggcatgagaatcgcttgagcccggaaggtggaggttgcagtgagccaagatcacgccactgcactccagcttgggtgatagagcacgactctatctcaaaaaaaaaaaaaagaaaaaaggaaaaaagaaaataattgatctttacaaggagccatctccactctcctatcttgctcggaaatgggagtcaccaggtaggtgtgtctgggtcctcttgtcactgggacccacaccccctgccaccatcatgaagcctccagattagatctctgtggcctgaatgctatacacaagtgtgaggcatggtggctgccctctggaagcttcctgtctgcaagagtcctgcagacagcaggcctgagacattgcacagagccacggaggagcggctgaagatgactgacaggaaggagtttagggatggggagtcaggaaagtccaaggctggtgggctctgccaaggaagccagaggaagcgctttcagctaccttctcatcaaaggaggcatcaccagcccctgagtttcttgagaatggggaccaccctttacttgcctctgaaaccctcatgcctggcacaatgctggcgcatagtaggtgctcagttttttggtttgtttgttttttaagacagagtcttgctctgtcgcccaggcaggagtgcaatggcgcaatctccactcactgcaacctccgcctccagggttcaagcaatcctcctgcttcagcctcccaagtaactgggatcacaggtgcacaccaccatgcccagctaatttttttgtatttttagtagagacagggtttcgccatgttggccaggctggtctcaaactcctgacctcaagtaatgcacctgcctcagcctcccaaagtgctgggattacaggcatgagccaccatgcccggccagttcatttgttcagtggaactgagtgagacttcagggcccactgacagagatgggcctgcctagcactgcagacccgaggcctccactctgaaaggtgccagcccgctaaaggaatgaaggagagcttgttcatacccagccatgaggatcagggcagctggagggccaccactgagctgtgtttgggggcagccaggagcatgcgctgccagacagaggaccctttccaggctggctgaggacagaaggatgtgatcattaagcaaagccaacatgttactgacccataatcccttaaaccaggaggattcgggaagggcctggtcgccttggcaactaggtgctggccagtcgcagggctgagagcatcctccaggagtgggctgtgcctggtgctggtgcatgggtaacagctgggagcgggtgcagggcggcccatcatagggctcaccccctggtgccttcttgccagcatgggtggaagcccttgtgaggcctcaagggcagtgtgtgcagagcaggatgagaggggggctgcactgagcgtgtaggaaaccatgaagggaagtggaggggaggtgagacagcgctgctctgggttttcagggcaggagggagaagggagggtctgcaggaagaagcagttgcatgggtctcattgggtggccagcagggcatcctctaattcagagggcacgaggagctgggtagcctgaagaagaaagctttcatggttggggacaggaccgtgggggtgggcagagcagcttaccccgctcctccatggtgttctcggtaggggatacctgcctgcttggagggctctggcatgggaagaggcctgcagggatcaagcctcatcttccctagggctcgactctattaatggcaagcttccgtgtttcccctgagaccttccactgctcctgacctcctgtatttcagctggagagaaggtgcagctggccagctctgatgcactcttcccttcctcctctttttcccctcttgcctcctggggcatgccagagcagagaccttcaggtgtcagtatcagaggtgaaatgaggtttggacccaatcatgtcccaagggtgttggccaagctgacattcagtttacgggccttggtcagtaagatttattggctgttgacacattcaggcccttggacacaagttggtaaatttctgctggtccaaggactgcctggttctggcaccctccctgccaccccagcccttcccccagaactctctagacctccagcagctaaagggcttaggtctggggggccttcaggatcctctttgcacatcatgcctgctattatgaccaatactttgctggactaggtggtccatagagaactgcacagggcgtggcggggcgggcggtgggcagtggaggcagtgctgagggtcactgggaggaagaaggtgactgggaagaagagggtgaacacccaccctcagaggggtcaaactttgcagaagacacaaccctggctcccagtgatggtggcatacagggcgacagagcttgatgagagagctgaattcccagtgggtggagacctggactggttgccttgttcttttcaactgctcttctcacacttcccatctcaggacccggctgcccagtccctcatgatcatgaacaagatgaagaactttaagcgccgtttctccctgtcagtgccccgcactgagaccattgaagaatccttggctgaattcacggagcaattcaaccagctccacaaccggcggaatgagagtgaggggtctgggcccacccagcacctctcccacctaccagacactccccagtcaccttcccctccccgcccaccccctccccactggccttaggggaggagcacagcgctgggggaggggggctacccttctctccctcaggacagagaggcagggaggggagctgacgcctgtccctcttagacttgcagctcggtcctcttggcagagaccccccgcaggagtgcagcaccttctccccaacagacagcggggaggagccggggcagctctcccctggcgtgcagttccagcggcggcagaaccagcgccgcttctccatggaggtaagggcctctggagctctgccccggcaggtggcaggatgcacgcacaagggtgtgcacaggagggcagctgccttacagccagactttgtgagttcaaattccacctctgccattcattagctctgtgactttgagcaagttactcaacctctgtgcaccatggtctccttgtctttaaaatggtcatcatggattaaatgggtttatctatgccaagtgcttagaacattcctgaatttagcaagggctagacaatttgactatttgatccacacacatatgcccaagtatatgaaaaaatatacttacagaatcggtgcctgtaagggcatgagactgatgttgcacagatggtgatactgtggcccagagaggcagagagtgacctggctgtgctaaggtcacacagcagccccgggtgttcacgtgtatgtcttgagcacacactgggagcagctgtgagcctggggtcacagcctgtgattgggctctgaatggttgttctgcagggaacgctaggtccagagtgaaagtctggagccccacagccctagctaccctgaaaccaacagtggtgtccccatctcatccctgtcaccacaggacgtcagcaagaggctctctctgcccatggatatccgcctgccccaggaattcctacagaagctacagatggagagcccagatctgcccaagccgctcagccgcatgtcccgccgggcctccctggtgagtcccaagagggtcagaggacacaaggtggggtgatatgccctccccagcatgggcatatcagtcccagctgaggcctagatgggatttcgaggaagattcctgggcctctggtgccacctgctggcttgagtgcattcaactagctcgtcctcctacatcaacatccatttcctagatgggtctcacttgggctggaatgggactctaagcccacagtgggtcccacggtctccacatggttaagatcaataggccagctggcatgtgccttccagtcctaactgcctatcagagctgtttgggacatcttacaaaacacagactctacctccagacacctatagaatcagcctctccggctagggggtccaggaatccgtcttgttaagggttggatacacctgagctagaagtgcgctgatgagagacacagtcagagaggtggattctgaactggacactcaaggtacaatgggaaaaaaggcagcactcactctggaggagctcgtggtctcagtcggagacacaggtagtcaagatgtgcaacaatcccaggtgccacagctctgggctctacactcttggctgtcctgggaggaagaaactcacactttcacgagctctgtcctttatcacagggataaagggaaaaggagccccttccaccatggagtctcatcccttccctcccagaggctggagttgggggaggcgtcatgtctgtggagctgctaagggcttcaagctcacggcattctatgtctctccctctcagtcagacattggctttgggaaactggaaacatacgtgaaactggacaaactgggagaggtaagacgctgggtttggtcttctccgaatagccaggcaggatggcttggaggaggggcagacctccctagtcggccctctctggtcggccctctctggttggccctctcctggcccctgccccatagaggtgcacagtcttggctgtgcgctctggcccaggctttggcagggattgaagtgagctcagatcctgaaggagggcgtgaggatagagtagccatggccctgggcagaatccagtcttttttttttctgcaagtccttcttgcctgggttcaaaacctagctccaccatttactagctctgtgacctttggcaagttacatgacctctctgtgtgcctcagtttcttcctctgtccaatgagacagtaattgtcctatcacatagggttattgtgaggattgggcaggttactgtaatcagcttatgtacggcacacagacaatgcctggcacataggaagtgctgtgtcacttagctatttttgttgtcactgtgcagaggcctggggtgggtgaaggtttatagagagagggaacacacagccctttccctccaggagcccaaagaggtgacctctgtgtaaacatcagcatcgtataaggaagaaaaaacctggtgttatcatagacgggcacgcggcgtgctggggcttagaggaaggacggattcactccgactggggagtcattagggatgcttcctggaggaagtaggctttggaggaaacagcatgtcagtaaagggaggaagggcactcaggccccagtcgtagcccaggcagaggcacaaatggggaggcactggacagaggccagcagcacctgaatgcgcctggggccgctgtggccctccatcccagggcacctatgccacagtcttcaaagggcgcagcaaactgacggagaaccttgtggccctgaaagagatccggctggagcacgaggagggagcgccctgcactgccatccgagagggtacagcatcctaggctcccacgctcccctgggggcttcaggaggaggggttcaccagcctgcacccttgtgggagctgggggtagaggatcattgctggaatgggactcctggcgctgaccccaagaaaagagggtatggggacacatggggtcctagggacccaggtggatctgtctcctcacagtgtctctgctgaagaacctgaagcacgccaatattgtgaccctgcatgacctcatccacacagatcggtccctcaccctggtgtttgagtacctggtgagagtccggctggggctggccgcctctccctcttgtggtggaaacggggtgtgggtaggggagtgggaagctgagggagtgggagtagtgggatgagggcgacccaggccttgttctggaatcagattttcagatgctcccgtgcaggagtgggccaagagctcaggcttacgggtggctcgagccagggacctgtcccactagtgggcgtgggcccttcccagggaggggcttcctctcctcagcctgtgtctgggcttctggccaggggtcagcgtggggcaggactgagccacgctctgtgttccaggacagtgacctgaagcagtatctggaccactgtgggaacctcatgagcatgcacaacgtcaaggtgaggcctcaggggcagggtccccccatcttggcagccacctgtccagaagcccagtgtggggacccactctcaccaccagggatccggctgctgaggtggctcagaccttcccacgtaggaaagagggagagggcaatgccatcaacgagtccaggaactgggttgagcgctttaccccaagaacagacacacactgtctgccactgtctagctgttggtataaaacccactctcaactctgaacatcagtttcccagtctgtcaaatgggagtgtgagctacctgccaaaatgcagggaggcttctggggaagctcggggttatgaatgacctctcctggtgtttgttaaagaatcaaggctgggcatggtggcccacgcctgtaatcccagcactgggaggccaaggcaggaagatggcttgagcccaggagtttgagaccagcctgggcaacatggcaagacctcatctctactaaaaattgaaaaattagccgggcacagtagcgtgcacccatagtcccagctgcttgagaggctgaggcaggagggccacttgagcccgggaggttgaggctgcagtgagccatgatcacaccactgcactccagcctgggtgacagagtaaaaccctgactctaaaagaaaaaaaaaaaaaaaagggatcaagcacatatgtctccacataggcgggcatcctgacccccgtgctcctgactgagacttcgctggcctcccccacactcactgcgtcctctgcacccctgctgtcctcccctctggatgggattccctggtgtgggtggggtccaggatgggggctgcagggtgtgcaggagaatgaggggcttgtgctgacctcactgccaagcccctgcccccatcctggtcccagccttggagcagaggctcagggccaccttccaccccacatttctcttccccctcccccagattttcatgttccagctgctccggggcctcgcctactgtcaccaccgcaagatcctgcaccgggacctgaagccccagaacctgctcatcaacgagaggggggagctgaagctggccgactttggtgaggctggggctagggtgggggtctgacgctactggggtgcctcagggtgtgggtgcagtgggggagggcatagcagtcaaccccacagcacctgtggacagaggtccagtgacatgtctgcccccaggactggccagggccaagtcagtgcccacaaagacttactccaatgaggtggtgaccctgtggtacaggccccccgatgtgctgctgggatccacagagtactccacccccattgatatgtggtgagtgagcactgtggggaccgaggaggggaggacaggcctggccacacctccagactctcctttgcttccccaagggcctcggggaagaactgcctaacttcctttgcctaaaagccttgtgacatcctgctgaaatggatgttaaaaaattaggtctgaaatataataggttagggtttccctggcttaaatagacccccaagcctgtgcatttgaaatcctcccccagaggcctgtggggggttaccagagacccagagggtccaggagggcccctatagtaaatacgatgaatcttccccaagcatcagtcccagtgaaaattttgaaagagaagtactatttttatgttaaaatgaacaagtgtatgatttggtgtaaaatgaaaaatcagcccaaattgcaagccaagccgccggtggttatgaatggctgctgtgactccgccccaaggttccccaggagaatggatttatgtacttctcttccagtggggcacacagtggagagagtttgagacaacactgctgagagaattgccacatgggcgctggctgcacagacccaaacctcacagagtgaaaggggactttcctcacagagtgaaagtcgcagctttcccgagcccagggaagccccccagagaggggctgtagtgggggctgggcagttctaggagcctccactgccctgggccacccctccgccgccagagccacgatccctgcagccgcctgtggcaggtcgtcattggtgccctggtggagcagccctaggaagggcggccgcccctgcctgatgccgaccctaccccttgctcctcgcaggggcgtgggctgcatccactacgagatggccacagggaggcccctcttcccgggctccacagtcaaggaggagctgcacctcatctttcgcctcctcggtcagtctcccgctgctccgtccctctcaccaccagggggcgccggaactcctccagcccaggcgcggagcgggacggggaggagcggctcggccgcctctctcccgggcggggaccccctgtggcctcggccatctttgctcccacctcatacattgcatccctttcaagtcggccttggccctgggcctcacgcaggccctccccaccctctctcgtctccccagggacccccacagaagagacgtggcccggcgtgaccgccttctctgagttccgcacctacagcttcccctgctacctcccgcagccgctcatcaaccacgcgcccaggtagcccctgcgcccgccgcccctcctgctgcggccctggctctcccatccccaatcaggcacagcctgtgtccgcgccttctccttgcaggttggatacggatggcatccacctcctgagcagcctgctcctggtgagtgtcctcccggcggggcccagggagaggcagccaaagagccaggtccctgtgccccatgccgggcctacgccccaacttctgtggctcgtgtgcttacacgtctttgaaacatctcccctgtactctccacccccaaggccaaggggtggcctccatacacatcctctggagtctgtgcactgcgagcccaaacccgttacttagctgtgtagctctgggcaagttacagagctcctccatgcctcagtttcctcagctgcaaagtgggattaatacctattttataagatggccgtgaggatacattgagatgacgggacacacttagtgtggtgcctgtcttgtaaggcacacgatgaagggttgttatcggcactacgcttcctgttacggatgttctccatctgatcatggttggtttgcatctgtatttctatcccaagagaaggtcactctcctgaagtttcatttctggtttttcctggtggctggagaccgaggagccttcccctgagtcttgagatggcctgaggttgggtttgtggtaggggctggaggctgacctggggcttctcctgttagcctcaagcctcacccaccttggtgctctaaccagcactggagtcctgctgcccagagggtttgcagccccccagccgggcccaatagccccaccctgtgcctttcagtatgaatccaagagtcgcatgtcagcagaggctgccctgagtcactcctacttccggtctctgggagagcgtgtgcaccagcttgaagacagtgagtactgggggtccgggagcagggccacccagaaccaaggaaaggggttggtgagtgtgggcagaagaaccagaacaaagaggccagaggccccagccccagcagagcagccccgggcaccttgcctcccctgctggggttctcattccaaattgagggggcaaacagtggaaatgagacgctgcctcgagggctcagttggtccttctgggccagtccttactggaggccagctccacgcagccctctccagactatgcacttctctcccccagctgcctccatcttctccctgaaggagatccagctccagaaggacccaggctaccgaggcttggccttccagcagccaggtaggggcttgtgctctcctggacccctccccttgttagtggaagccagagcaggcgacccctccccagtggggactcccatggtccccccaccactggcttccctttggactctttggggagcagagaaggggttggtttctcctgcctagacttcctcgtccagctcttccctcctcaaccctccaccccagacaggacattgcatttgacagtagccctggcaaagaggcatgctgtctctggtgcattctctctgcaaaccctgagctctctaatcagattccatcctgggagaacggtactttgttcctagaacagtcaatggccttggacattgacaaatgctttccatgcatcgtcttctttaatccttaaaataccccttgaagctagtactattaatattccccatttcatagtcaatgaaactgaggctctgggaggttaagtcacaagttcatgcagctagtaagtagcagagatgggatttgacaccaggtcagaccggctcctgtttgcatgcccttgcttgctctgtcagagcagctctgggggacagcgactgtccctgctgacctggggtacccgtcagcccagcctcctccctgcagccccacctcttctccattctccaggacgagggaagaacaggcggcagagcatcttctgagccacgcccaccttgctgtggccaagggacaagagatcacatggagcacaaattcgggtaggatggagcctgtgtggccctcggaggactgaagaacgagggctgacagccagcctggaagaccgcttggcagcccttctggccacggctgtttcttctttgtgcttcccgtgtgcctccccagtagccctcacctgcataccaacccctcctttacccacgttggggctggcataagctgcttccctgagaggacatgaggggggggcggtcctcgtaccctctcccaccctggtgtttgggcacctgcgtgggatgcacacggatgacagaatcaaggcgccaggatgggcactctgccctggatacaggctctaccctcctcccccaggacctgcctagtgccagtttggtagtccccctttctggccccttggagcccacacacgtttcatctttttcccctctgagagcaagaagagacatggcatgttctctgggaccctggaatcctaggtacccacatgtgtgccaaagcctaccccacctggcaggtgtcccacagcaacagaaggaatagtagtccccactctttccatcagccctaccctaccctcattccccgacaccctctggcttgaaccatggctgagcagtgccggcatacgctttgctggcatgcttggatgcccagctgtgtccagaggtggcctgggaccgccagttgcacgcctgccacctcagccagcccccgcccagctcatcagtctgaatggagttgccttaaattggcaggtggtaccgtactcactgcccttggagctgtgaccggctcctgcctgtccaccccttcccgaggtggctcctgcttaccttatcatcccagggctctgattagccaggcctggtcagggtcctggggacggcacccagatatgcagagtcaccctgacactggtgccaggctgacctcagctcccgaaggctcgcacagcctccccatccttccttcccagcccttgtggctctgtccacctgatcccaataccagcttcccccagcccctgccaccccagagggcggccacgacagggagaggtgtagatgccaccatctgagggagaggaacgtggaacaggagcaggctctgatgctgagaggcttgcctccgggggctggaagcctgggtggccggggcccctgaagaaggctcccctctgtatcccccaggtctcctcaacactgggctgatcctgaatggcacaggccaaggggaggccagcctcgcctttctacccaggccccctgccctgcccacctcaggcccccaccctccactcctccccacggtactgtgaacgtcgtgtgactcagtgcagagacagataatatatttaattcatgtacagaaa

SEQ ID NO: 138 - DNA, 71540 bp, Homo sapiens
gagttcaatcaattcagaacgtcgagatggagcccaactcactccaggtatttcgctctcctccgctcctccgatcccggcaccccccggcaccccccaaccccccagctcacccacacctctgcacccacccacaccccccacaaacttttcaccaaacttttaccctctgcatcccccaaaatcatttttattgtttaaaaaaatccctgcactgatcatacatacataatgtaattttaccgcctcaaatggggaggtgggtagaagtggcggtggggggccctgagtttttttttttttttttttagggaagcagaaaatttgtgggtgctattatttttccacccagcgttatatctgttgggtcgtctgtattaagagagtggatgtctgtgtgtaaatgtgtctgggaatagatgtttgtgctctgatggctacattatttatttggtgtttttttccccccctgcagtgggtcggctcaccgtgtggcttgcacggaccttacattttctacaaggcttttcaattccaccttgaaggcaaaccaagaattttgtcccttggcgactttttctttgtaagatgtacgccaaaggatccgatttgcatagcggagctccagctgttgtgggaagagaggaccagccggcaacttttatccagctctaaactttatttcctcccagaagacactccccagggcagaaatagcgaccatggcgaggtggtaaacctgtctgtccccctcttctttctttattatttttccccctagtaatgcttattacagggcaagcttgaaaatactgtattcacttctgcaggcaagcaggatcgactccttttttaaaggggtagcgccactagctggggctcgagtattttgccattgtcagagtttggctgtcagctttacaaagaggatccaactgctgattttagtcaagatcaaataacttgttcgagaagggttttgttcaaggatgtgtgtgtgtgtgtgtgtgtgtgtgtgtatgtgtgtgtgtgtgttcatttgctctcctgctattgcctcttgaacatcacatgctttttatattttttgccttttgaaaatttaccttcgtgtctggctcggtcgtgtctgggtggatttctttcggtgggtttcgatattgttcttttttcaaagtaagtatttgatatgtttaagagggcggaaattacgaaatggaggcagaatgagatcaaaagctattgagttggcaaagacgtgttgaataaagtgataaatgacaggtactggaataatacattcaaataacttgcagatctgcccgggcggatttcaaagcggtggtgtaacaggcacaaacacgttaagcattaacaactatctctcgcccactccccctccccccggacaagccatttgatgttctagtttgcaattactccacgcaaagtggacgtcctcctgcgcgatctttgggggtgtgtgggacgggggcgggggaggggagggcagaggggtgtgtgctcgcccactggccctgcgggtccagcgttctccgtgcccagacggcgctcccggggagggcggggaggggacagagcctccccggcacgtttctgggcggccgcgggggcgctcgccgcgctcccgggaggacgccggaggtgagcccgctgtcactgggcgccggggcggccgcctcccttcggctctgtcatttcatgtgtgaccgcagttctgcgggctcccctcctcagctgaccgacctcagcgccgtggtacctaccgaggggaactattttggggagtctgtgcccacggcgcagcggggagggagggcgcactgccgcctggcgaggctttgtgttgccaaagcgagagcagggtaatcaaacagacttttgagggcagctagtgctgtgccaggctctcgagctttcgaggtaggtgtaaggatctaaggatctttttgttaaatgaatggtttcccgtttaactcatcccggggctcggagctgccagtccttccagaattcctcggtttgatcgagttgatagtacttttggcattgctagttcactccctctccccaggatcgaattactcgtcagtggtctatgccggttaattactggagttcgtcgaaacgttcgccctcgaatctgccttttcggaaataagcccctcccacctccccgctcacctcccccctccaccctccccggccagctttggtttttaaatgttcatatttcccgacgtccgcctgcaattttaaaaaggtgttgtttggaaatactgtgaaaaatcctgcaacctaccaacaggttgagctctttccccctcccaaggtctggctcggccccctcccccgacccaactttcctgcgcagctgtcttcctccccctccctctccccctcctgatttcttattatttgcttttcaaatttattacttcaacatggcctgtgatctggaaaagggaaggattaaatatccagaaaagaactggtgcttaacagacttctgactaagtccaggaggaaattattcagtgttttatgggatattttgtggtcactcttttttggggggcggggaattgaaattgggatgttttttaaagaccctgagttgaccccacttggtacagttttaatttttgttggtgtaattaaatggtgaattctgatttaagaataaaggctatatttgccaaacgttgcatctgctagaagtgttgacagtgaatagatatatttttaaatacacgatttctttttaattgttcattatggggaattgaaagggaaccattgtaatgatctgtgcatttcgtcactgctatatgagccatacctgagaaaattaatcttgccatttaaaagtaaactctagggggtttgcggagggagatggctctatttataatcctcagctgcatatacatcgtctaatattatgcatgatttgttttttaatgctaacacggctggtaattagctgtatgattatacttgtatatttcattaggactttggctgatgtcattgtgaattattcagccatattaaaacaattttcaattgagataatgacacgcctcaaaattatgcaaatgcagactgcattgtgcaaaataattatgacaaatgtaaagcaggtagaaagtttcccaatgcagatcggttttccaccctggtgatgtcatttcccccctggcctaagttagtcattcattagcagaatagcagcagcagtcttctctggaggagagccttacagaaaccagcatttactgctggcacctagagggggcaacagggccctctcattaagaaatttgctttgttttcacttattccattaacttgtttatatacatttaaatgatttttattattgattttaaatagttttgaatgatgcatttgccatttgcaatgtgtaactgaaagagaaaggtttcttggtgatatgcactgttacttggagaaaatgttcagcacatttaatcagccagtacagtttattttaagtaaccaaatggagattaataatttcttgattgagctgacatcagcatccatttcgaaaggacagccaggactcagtatgctttttttggtttaagagaatcattctgcctttttatgatttcttgaaatgtaaagacgtcagttctaaaagcagaaaaatgatcattgtgcaagattagaaatagcgtccctgtgtggtttgctgtgatttgcagagggtttttttttttttggaatattttctcatgatttttgtaataaattgtgggaggctggataaggcaggactttgtacacccattttacagatggggacatagactcggaaaggttatgtggtttgtcaaaggtcaccaggctagaacccaggcctccttgaaattcaaggttatcttttctccccagtgaaacctacccttgaaagcagagcttgaattcatcatattacattctagaagtgtgtactaatgtgaacagtccctcagacattttagaattgtaactagttaatcagttttgccaaaggtcaccagatgtctaggtagcaaaactatccttatcctgtaaagttaagctaattctaatcagtggtatataatgataacagttatattttaatagttattaatgagcattaacaacttactattcattttaatgatgatggtgatgatttatatgcttatatacaccaatgccttcatatataatacttccagtgttcgcaactggtgttgaggaaaagcattcaagaaagtcacattttgattctgcagcttgctatttgcttaatcttgaacaaccataagtacttggaacctcagtttcttcagctgcaaaatgggaacaaagtagggatgactatagattgttggtgaagatcaagaggatttataggcaaaagagctttatatactataaagtacttaaataaatagaaaataattatgattatagtgacctttgttctagatattcttaattttataaacaataaaaaaaaaacttgtgtctgtgtggaggttcttggacctaaaaatgataccatcttaaattaccatgaaaatgaatagcagggccatgtgcaaggagttaagtgtctttagtaattacttagaattgccacattcagccactagctcttcagaggaggaaaatggcaaagtaggcgggtaattggttctgttactggataacttctgattacattcattttccaattgccaagtgcttaatctattggcagtataccctcttaaaatgggtggatatgcaagcttggatttcagcctgaccagccatcgctgggattttataagaaggtttgctggtcacctccaactgtgcttgtggatggctaagctaatgatgtccaggagtcaagatcaggcatacctggatgttacagattctagcatgcattccagatttctaaaagtgattcagttatcaccagcctcactactgaattaaaaaatgctaaaaatccatgttctggggcccctattgaagtctcctcaaatagaatctctagagttgggtccaggagtctgaattttaaatatttaaacagtctcagtctagctgtgttatcttgggcaagttctaaactctctgtgcctccgttttctcatctgtaaagtggaaatacggtccttatttcctaggattattttaaggattaaataagttaatatatgtaaaatgcatatgcccaaagttgacacatagtagatacttcaataatggttgactgttgttattatcattaatattagcattaatctcactgaggtttgaaaccactaccatggagcttactgaaaagtttttccgtgtgagggaatggcacctaggtgagtttgctaggacatgtgggcttccaaatcctaccgaatcaggctatctttcatctccatgttggctttagctgtgtcaccaaaataaaaagtgtcttaaggatttacattttagtgcagaagtaaactgtcaactggatcagcaggattttttttttcaaaagattgcctgatttggtcatatctggagttagacagacacattctggaatttagaaggtgctggattagtcttgctcttctctttggatagctcctcagtcttggtctatatccataaggtaattttttagagatttctgagacctcttaaatgaccacactggccttagacaattgttttaacttttttaagcctctgtttcttcctctgtaaaatggatttaatggcctcaactgtgctgggaatcagagataataatgaaaagggtctggaatctagcatagtatagtacctacacatgagagttcaatgaatagtggttgcacttataatagttattatttatttttagtaatcatcttaagctaagaaaaggatttatctttactctctaccaagcaggccttttagaacaaagataagaatgtaaagaattacatggagagaaattactggactgtgacaagagtcagccaagtaaggcctgaaggccaaatctggcccactgtctgtttttgtgaataaagttttattggaatgtggccatgctaatttgtttatggctgctctcaggctccaacagcagagttgagttgttttgacagttaccagatcgctgacaaagtagaaatatttattatctggctttgttaagaaaaacgttgctgacccctggcctatgcggttgatctgcaataaggtagatgattgtgtacctatttttctttcttgagttttggccattaaccagtaatagcagaaatataagaaacttaagtaatataagaaattgtacttcaatattatatcattaacgtttacatatccaatccaatttcaccattggttctaggacattaaaatttgagaatgagtgaaataatattaaattatattttgtatggttaagagcgaaactttagccaatattagtattgtctattttgagttaataaaaaactactcgtgaagttctatgtgctcagtactctgctaggtgaagagacagatgcaaaatagtttgcgatgtgaccctttttctgaataaatttatcagtcttgataaggagatgagatcaacatgtctaaaaatgtaaaagcaatatgagtcacaacacatcagtaaattgtgctgataatacatgtcataggcatccaaaggaaggctcccaaccatcatgttttttggaaaaagaattcattaaatttctcagatgttgattgaaaacctactgtgtgctggcacttggatacaagagattaaggagaatggcctcggccaggcatagtggctcacgcctgtaatcccagcactttgagaggccgaggcaggcagatcacgagattgagaacatcctggctaacatggtgaaaccccgtctctactaaaaatacaaaaaaattagctgggcgtggtggtgggcacctgtagtcccagctacttgggaggctgaggcaggagaatggcgtgaacccgggaggcagagcttgcagtgagccaagattgcaccactgcactccagcctgggcaacagagcaagactccatctcaaaaaaaaaaaaaaaaaaaaaaagaagaagaagaatggcctctgccctcaaggagttcccaaactgcctttgtagacagacagtgatcacagaaaaggccatcagactctttccatctgtgttccttagtttaagttgagacgaactgagatcactatttatttgtagcatttcttaatctttccggaaattagaaagtactgtcttcatctttgaattattacttcctggacacatatttgtagagcacctattatgtgccagatcctattctaggccctggggatgcagcatgaacaagacagacaaaaatcactgctcccagggagcttatagtccagtggttggttgtaacctgtcgtgcactttataccttgtgccttatagttatctgtgttcttttcctttaccttgtcacctgaccctatgctccccccaccatagtgctgttctcaggagcaggcagttgtgccttattcacctctgggtcctctgcaatatttagtgctattcagtgagtttttttttttttttttttttttttgagacggagtctcgctctgtcgcccaggctggagtgcagtggcgcgatctcggctcactgccagctccgcctcccgggttcacgccattctcctgcctcagcctccagagtagctgggactacaggcgccagccaccgcggccggctaattttttgtatttttagtaaagacggggtttcaccatgttggccaggatggtcccgatctcctgacctcgtgatccacccgccttggcctcccaaagtgctgggattacaggcgtcagccaccgcgcctggccttcagtgagtattttctgagtgactgaacgacataattaaaatgccttcttgcacacagtctaccttttttaagctttacccagtttctttctggcagatgaccagtgaccagtcattcacatgtgggccagatccacgaccccatctcacacttcttctttctcttccaaagtctgtagtcattttgcactgtagaatgtgaaaacatgggaagtggttttttcacaggggcactcaccaaagaaacaagcaaatatttgaaagattagactggaggcagcatctctgtttcgttgttaattttccagtctcagcagtcaacccataaaaagtcagggctttggggtggcaacctatgaaaagactagacttcaggaaagaagattcactcctcgcctggtgttggttggcagttcatacgagccagcatgtttttcaggctgatggtcttaactaagccacatgtttgatagtgcctcacaattgtaagcaattaaaacctctcgacaattagactgtcagacacatactaaggaaatgttatttttatgaaatacaagagtccatacatgtaaatacttcattattaattattaataaagcatgccattgttcatagtggcatctagtgatatatgactcaagctcatttatcaaagtctagttttaaccaatatccagaatataattgcttgaaccaaatgcattcacttgtcattttttatagccagtgtagttggatatttgccatcttctactcagaataatactgtagctagtgactacccgttgccttggcttttaaggaaatttaaaacaaatttatcgattgttggcttaaggattcattcacctctcagagatgtggtcatggattccctcatttcttgaagaatctacactgcacaaatccaaggatgcatttttctggccacgctgtgttcctcactgacttgctggagatgagaaccttggtcttagccctccagcatacatccctcatgccctggactatgagcatcagtatcgacaacacatttcaaacatgcagatgatgatgattattgaaagggtgctttagaatcatgctaatggcatcaatctctcgcacacacttgggtaaattaattctgcttttaaaatcagatgcactgttagcagcgttaaagatggatatttgacatttatcacgcagactaggatgggtggtttaattacgcgaattttctgtaggatctttgtggctgtataaatagacgcacagtggcgtgtgtccttggcatatgaccatcaggttcacagtcacatctccattcctgtgccccagtaagaaccccaggcggcaaaggccaaatgttgctagtcaatctagtgaccccataaacatcttttcccccacctttcttttctcatgactccaagcacacccgggctatgaaacaccccttccaccccatagttgagttccaagcctcatcagtggcactaaacattaaactcttgtctttgagaataatgggctttgctttctacaccctcaagcatgttgagctactgtgcaagctggaaaataaaaatgttctaattgtgtcttttaaataagcataggagtgaattaattagaccatattttgtctttagttgcttagttacacaatagtattcctgagcacgagtaagataaattggctctttttgtgctgcttgtcccttaatcataattactgtattgcttaggagagtaaagcatacatagattttgaattttttattaatagtcaaaaatatgcatatgatatataaagtatatgctgttcaacctgttttatatgtgggaagaagttttattgtggtggtaacatttgcattagttgctcaaagatgtagttctgggaaatacataattgaaatgtttttgaattgctttttctggccttttcaatcttattcaaaataatagtgcttccagtcctggagtagtcattctcatttgatttaacatctttctttgcactgcacgagcggcacccagttttaaccctgcagagcctagatgaagttctgtgattcataggccatacattgtgccttatgttttttggctcatgctcttggggcttggggggcagcgggcagaagggtgcctttgtcttgccgtcattattccaatgcccttcgcccttggctcacttccatgctccttaaggaaggttctagggttagagagtgtaagagtttttttagcatgagctggacaactatctgtgcttgcctgctggggtcttgcaaaatgaaatgttgctactggaagttgggtttctaaccgcctaccccaaccctccaccaaggagggcagcaggagttagacagcttgatatagttattgaacaatgagagagtctggattatgacccaggatacttgcttggtaaatgtatgtgaaaatcgactccattgttctattgtatttgaaaagcaagtaaattatttacagatatttgctaattaaagcatatgttgtttcacaagcacaaaggatcgcagtataactggagacaaagaactaagtgcaaataatttaaattcactaatactgtgtattcttcttaagggaggaatatgtttttaaaatgtgtatatatagggtgttggtcaaaaggtacaaacttttagttataagatattcatcatatatatgtgttcatcttctatctggagatctaatgtatagtatagtgactatagttaatagtactgtattgtatacttgaaaattgctaacagagtagatcttaagtgttgttaccacatcaaaaaaggataactgaggtgatgaatgttaataacttgattgtggtaatcttcatgatatatatgtacatcaaatcatcacattgtataccttaaatatatacaaccatcatattgtatactttaatgtatactatttttgttagtcaattatacttcaataaagctggagaaaataaaagtatatatataggcatatatataattatgtgtgtatatatatgcatgtttatatatatatatatatatgtatacacacatacacacacacacatacagataacttgtcctgttatctctgtatacattacacatatatacatactttttttttaacccttccaagggaagtctcgcatgctacagagatagcaagccaagttaccccccagttgcttgtcactaagcttgccctaagctctccaacggaagatgagatggaaacagttttgacagaatgctattttccctttggtttttgcttgccattatctagtttgagctcagctcagagtatcactagaaataaggcaaattagccagatacagtatcagagaataaaaatgttctcacccattcctttgtcctcagactttcctgaatgtgataggctcaggtttagttgtttttcttctgttttggcagtgttctggttggaaatttgcactgtggaaaagacgctggtgatacaaggcaaaaggcagaccagtgaaggtcagatgcagaaaaggtcattgataatgttctcagagaccttttcctggctggaactttggtgtatccattggtaaagctggtctctctggctgtgctgtctgccaacatgtttggttttaggcatggctagcttaaagtcccttggtattgttgataacgatggtcaagaagaattgccatggttatttaagagaaaggctcatgtctaatttgccatggacaattctgtagactcacaagataacagataaaagagactgagaagaacaaatccagccctctttatttaatagatgcagaacctaaggcccagaaaaatcttgggcatgtcctcagaactagagagtgacagaagtggaactaggattcagtgttctcaggcaccacagtctggtcggctgttttgtggggaaggggctgctctcttgaggtcatgtgctgaggaaagtaggcaagtgcttcccgtggctgtgttcttggtaggtcattccagtgccctgtcttataccagtgcatggtgccatgggggacatcacttttataaaacaactcatggagagtatggactttactggaatggcaagataccttgttttgtttgtttgtttgtttttgagatggagtttcgctctttttgcccaggctggagtacaatggcgcaatctcagctcaccgcaacctccgcctcccagattcaagcgattctcctgcctcagcctcctgagtagctgggattacaggcatgcaccaccatgtccggctaattttgtatttttaatagagacggggtttctccatgttggcgaggctggtcttgaactcccgacctcaggtgatccacccgcctcagcctcccaaagtgctgggattacaggcgtgagctaccgcgcccagccctggaatgacaggatacttagcagagagttagtgattacacagaagccaggattgatatccaggatcccagactggacatcaccttcatttctataatttttcctgaagccaggagggccctctaatgggatgctatttatgttggctgaagaaaagcttcgccaaaagttggcaatgttggtaataaatggaattggtacttatgcgaacatctgatactcatggatggtttcatcattcagaagtgtgtatctactatatgcctactatgtgtcagttctctgtgctgttaaaggagcagttaaagtgagtgcctactatgtatcagttctctgtgctggggatataatagtgaacaatgagtgactagtacacaaagatttctgttctcagagagcacattttctctcctatagtaagaaggaagaagcaacttgattaatttgtcccaaatggagggaaaaccatctccatacattgtagtcttaaaaccgaattcacgcttccttctagagtgctttctctgtgtattcacagcccagagaaaatgccccatatttctctttcccgaaaccatctgcaaaattttcacccactgtgttttcaatgaagtcaaagtcacaacattttccattaattcagtgaccacttatatgtcaggcattgcaaatacattaacatataaattaaatataaataaaatatctcatttaattctcatggatactctattatgtccgtagtattttgacatttccatactttgtaggtgatgcagctgaggccaacagaggttaaaggaacttgcccaaggtcacacataggtgagactcaagagtcgggattgaaacccatgttctcccgatgctgcgaagaccagtgggcgagcttagtttctcattataactttagaatatattgagaactctcaatatcagcactggggttttcactatatactgatgtattctttaattgagtctttatgaaagcttctttcctgctctttagggacttgcacagttgactgatacccagataatagtaatgccatgcacacaggtaatacactttgaaagggcactttacactccacatagcgcctttctcacatttcacaggagagaagtctcagactcagtacctccagcgtgactttgtgtgcagcccagcactgcgcactggagagagagaggtggaaaaccaggcagatcctgccgccatggagcttaccatcaggtggggaccacgcatagtatataaacttatcacaaacaaagggtgattctgtgatgtggtcaaggggatgaagggcaaatacaagtgcctatgtcaggggtacatgattttgtcggaaaggtctcaggaggcattttagaagaaatatcatttgagttgaggtctaaagggatctgggggtgaagattgggaagtttctaggcaagctgtatggtgagcactacctccctgcagaatggtttctgggctgggcttggccttggtgaattcgtagccaggttagagatgtccgtttgcccactggagggaccagttggtctaggtatcatctagacacctggggtgcatatttagagctaatgtacatcatttggctatggagatggttgaaaacacggcaagctaaggcaaactaaggcccataggccaactctggtctactatctgtctttgtttgtttgttttttgtttgtttgtttgtttgagacagagtctcgctctgtcgcccaggctagagtgcaatggcacgatctcagctcactgcaaccttcacctcccagattcaagtgattctcctgcctcagcctctggaatagctgggattacaggtgcccaccaccatgcctggctaatttttgtatttctagtagagactgggtttcaccatgttggtcaggcaggtcttgaactcctgacctcaagcagtccacccacctcagcctcccaaagtgctaggattacaggcgtgagccaccgtgtctagccttgtttgtttgtttttgagatagggtcttgctctgtcacccaggctggagtgcaaaggcgtggtcttgcctcatcgcaacctctgttgcccaggttcaagtgattcttgtgcctcagcctgccgagtagctgggattgcaggcaggtgccaccccacccagctaatttttatattttttttagtagagatggggttttgccatgttggccaggctggactacctgtttctgtaaataaagttttattagcacagagccatgcccacgtttacaaatggtctctggcagctttcgcactatagtggcagagttgggtggttgcagcagagactatataccacacagagcttaaaacatttactatctggcccttatataaaatgccaacccctcatttaaaataatattaataaaagtaatagtaaaactaggtcctgacagattaatatgtgacattttatttactcttcataacagtaatactgtgaggtagattctagtatcatctccattttgcgggagggtaatttgaaaggttaggtaacttgtccgggtttccaaattcactcacctggtgaatgacagagactgaatgggaactcaagctgttttaattccaaaatgcaggtgacagaaacattgtgctgtcctgtttacaagtagaggaaacgggaagtataagaaaagggtggtaaagttagctgaggttttactctgtgaaataaaactgcgcaacagctgtatccgtctttcaaggtcccatttaaaagccacctcctccttgaggtcttccattgactgtctaggaacaaggaagccacagaggcacaggtgtaagtgccctctgggtcaggcagataagatcaatgagtgactgggccaggtctgggagacaatatgatattcaggggaactggggagcgcacgactggtttgaggcatgcctctaaaatgttcctcttgagccaggtgccatggcacatgcctgtaatcccagctacttgggaggctaagcggggaggatcacttgaacccaggagttcagggtgaaccatgattgcaccactgcactccagcatgggcaacagagtaagatcctgtttctagtaaaaaaaaaaaaaaaaattaattaaaaaaataaaatgctcttcagtttctacctagcattgctgggcaggaatgtcagtctgagatattgacaaatctttccatttttcaagagaagccagaaacctagattttcatgtgattttagttgaccattctatttatttatttattatttatttaagacagagtctcgctctgtcgcccaggctggagtgcagtgatgccatctcggctcactgcaacctccacctcctgggttcaagtgattctctctacgtcagccccgctgagtagctgggattacaggaaagcaccaccacgcccggctaatttttgtattgttagtagagatgaggttttgccatgttggtcaggctggtctcactgcacctggcccaatccaatttttaaaacactctttgtgggccaaacaaaatgtgtcttctgtccagatgtggcccacaggctgccaccttgccatctctagagcaaagctttggactattacagtttttaaaactttctcatatttggcccattttctgtaactaaagcaaaaagaaccgttggtcccaaaggggctgttaaaaatggggtggggagagccacgtggataaagccagggctctggagtctggagggatggcaggaagagatgtgcaagaagaagagcttggctctgccctggagtctacatttaggcttgaggagggaggcagggaccagctgtggaaagaagtgcatgagtgtgaaggtgacctgtagccatcctggaaggtgtcctggagaaggggcccttgaaaacacctagggatggatgagggtaagagatgagaaaatcctaggcagaagcaaagccacaggcaagtaggaaggaaggacataccaataccggatatggtctggatttggtaagagagcacaggtctagtgggaaatgaggtagactgaggccagactgcaggggagcctagcatgtcatgtggacttgaatctgaaggcggtgctgctgaataaattcacatgtctgttttctctttctagttaaaatataaacccttagccttgaagagtagttaaatggagtgtgaatatttactctgccagttagtagctgtgtgtcatcttgaccaacttgcttaatctctctggcatctcagtttcttatctgtgaaatggcttgatcttgctgggctaagaatgtcaagtgagatgcttatgggcatagagcacaaaaccatgacctggcttatcctaggtctgcagcagatgttggttattgaccctgccctccctggtcagggaccacatcctaagttttgaagtcttagtgctaggctgttaataactccttaataactaatttatgggttgagatattggactattatttgaaaaacaggaactaaggaaactatcatattaaatagagttaaacttcctggtttttcatttaccccaaaagacttctcttgtgtttaggttcaacattttttatctatatctgtgatttccagtcactttgaaggagacatgttcaaatccattctattctgttccatgtagatgttaaaggtacattaggggccaggcacggtgactcatgcctgtaatcccagcacttttgggaggctgaggtgggcagatcacttgaggttaggagtttgtgaccagcctggccaacatggtgaaaccctgtctgtaccaaaaacacaaagattaactgggtgtggtggcatgcacctgtaatcccagctactcaggaggctgaggcaggagaatctcttgaacctgggaggcggagattgcagtgagacgagattgtgccactgcactgcaactccagtctgcgtgacagagcctgactccgtccccccccccccccccaaaaaaataaaaggtgcgttaggggacatctcttccattggccatgtcaaaattaactgagataggagtagatggagtcaagagacaaaactggcttcccagatgtttgatctaagtgccccaccctccaccctgccctttcatgatgcaaccatcaggaaacctggtattgatctgcaaaatgtgcaaaacattgaattcattttaaatatacccactattcctccatttcaaaaaagtttcctgtattttcttttcttaaaaacacccctaacttgaaaatttgcttcatccctttgtccccttccaccccaccgtcttcctcatttggggatgctcatggtagagggtgtattccaatccaactctgaaagatgcaaaaagcatcagccagaccatgtaaagggaaaggtcccagccaaaatggctggggggaatctcagaaggatcttccaaatagaggtagccttctgggccattaaatccttttgctttggattaatcccacagtgtatatcagatcactagaattcagatgaaaacactgctgtagtactcagtctcctcgccaaatgattccaaaatatataggttataaatacagaaaaaataactgaattcgatatttcttaagtgaaataatctgttccttgtgaatattctctgtaatagtctaatagtattttgtgctcctgggggctgagtgtgtttttagcaacaatgcattggttgtaaaatatgcatccctaactatctggacagacaagaaagagggctctagtaaaaagactgaagtttttttttttaaatgcagatcgtatgaatcacataaatggtggtgtctaaaaattatcaacaagctctgggtttgtttttatttctttacattataggtcctctttctcactccacatttttgatattactagatcagtaattcaagagacagccaagcaggtgttcacatctctcctgacccccagaattccttaaatgaccccttgaggcagtggagtaaaaacattctcagcatgtcagaatattgagatatctcagttgtcttaatttttttttctttttgccttaatctttacaggctttttgtgtgtccttttttctctctgcttaagccaagaggaatcttgcttcagtcttggccatgaagattgagggacaggaggacagggtctgcagattgtacttacagttaatacagttctaactgctcagctgtgccagctgacttttctaattggtctttaaaagatgaatctttgtttttttttttttttttcctgagaagtttcacttttgttgcccaggcaggagtgcaatggcgcaatctcggctcactacaacctccgcctcctgggttcaagcgatgctcctcaggcctcagcctcctgagtagctgggattacaggcgtgtgccaccatgcctgactaatttttttttgtatttttagtagagacaggtttcgccatgttggccaggctggtctcgaactcctgacctcaggttatccgcctgccttggcctcccaaataaaagatgactcttaaatgagtagatggaaaaaaaaggaagatggggcttggaattctcatatggtagttaagggcataacataatattgctcttgaaaaaatataacatttatatttttaaatatgggcctttgactataaccttttattcaattaaattcaatcaatatttattaggatgtaccagggtactatggggggtgataaggggatgaataaaatcagcttctttctctctagttagaggagatcaaacatgttcaagttagccatacttggcaagattatatggcctctttcatactgaaaaatacactcacattgttagatagtattcttagaaatttctatggatacccctccaaaatgaaagatctctcatacaggcagttgatttaggatttaggcagttgcatgaagtattttactattggtttgtcgtcaactctgcagaaaattatctaatttctaggaatacttgaaacatatttagcacctcattttacaaactttattttattgtcatacaatggtgtgtaaatgtgtcctgtgttaaagatggttgtatcggttatctattgttgtgtaacagattaccccagatttggtgtcttgttaaaacaacacttactatccacagtttctgtgggtggcaagtctgagtaaggcttagctgggtgcctcttgctaagggactctcaaagctccagtcaaggtgtcctccccagctgtggccatctgaaagctctgtagagggaggatctattaatacttcagacccactcacttgcctgttgacaggtctcagatctctcaggctgttggactgaggccctcagttcctctcaggcagtgggtctgggtctccctggcttccttgctgggccacatgggcctctccatagggcaactcaaacatggcaacggactcccctcagagtgtaaggtgtaggaatgagacacaagccatagtccttttataacctgatgctggaagtgacatcccatcacttttgcctaattctgtttgttagaagtgaggcattattgtctagcccacacccaagagcaggagattattaggaggttgcatataatctcaggggaccatcttcgaggccacctattacagctggcaacagagccaatcacttcagtgtacagctcatctgatgagggttgaaaggtattcttcttactctgttttacttttttccttttttcccttttattagttgtttatctatttatttatttttgagacagagtctcactctgtcacctgggtcggagtgcagtagtgtgaccacggctcactgcagcctcgacctccctggctcaagcgatcctcccacctcagccttccaaatagctgggaccacaggcgtgcaccactgtgcccggctaattttttgatacagtctccttggatggttcctcccaaatatctccccgctcttcagggcatataactatagatgacatacacagtagactgcagattgcctaatcttttgaagatttgttagtcttacagcatgtcaacaagccatatcgggtcttttttacatctaatgtcttgatcattgcatttggagagttttgctggaaagggcattgtgtctggttagatgagaaatcggcagagagaaatgaggaaggaggatcctgtagctgatataaacaggctccttaatgcataagaaaataggcatgtttgggccgggcatggtggctcacgcctgtaatcccagcactttgggaggccaaggcgggtggatcacctgaggtcaggagttcaagactagcctggccaacatgatgaaaccctgtctgtattaaaaatacaaaaattagctgggcgtggtggcacatgcttgtagtcccagctacttgggaggctgaggcaggagaatcgcttgaacccgggaggtggaggttgcagtgagccgagatcatgccactgcactccagcctgggtgacagagtgagactccgtctcaaaaaaagaaaataggtatgtttcatgcacagtggttgaggagaggctttaaatcatgttggcatacggccatggaaagaagacctaaaaatccacatgagagggattcttgtcccaggtgtgtttctcatgagtgtatctacaagaggtgagcatctcctggccctccttccatgttgtgtatacgtcaggagagcagctggtctgccatcttttaaattctgtgcaagttaactgttttgtgagaagactcattgatctttctttctggaagtgtgcagtttggtcttcagcaaagtgctcacaacatacatatgtaggcattagagctttgagaaaaaggtagtattaaacagattctggccaatgtttttttaatgcataatgatgttcagtgatactggttaatttttaataatggaaattgatttatggggtggcttccatgttaaacctagtgggaacttaaagaaaaggggtctggattcaaattgaggagcatgcatcagcagtaagacatacacatggggcatgttgtatgtttttctttttttagccttaaatgtaaccatgtaccacgtttctcccagtggcttcacgtgtgctgttcctctgcccacagtgtcctgtgttcttccccatcttccctcacctcttaacttggctgcttccttttctttctcagggtctgagcagagagacctttcctgaccactcaatttcagtcatccccgcttccaccccttgccccatcaatgcctcttctcgtccttttgcatcagattttgtttactatctggctcttctacccagtccacacatacatgactatccgctctagaggagtaggggttttgtctgttttattcctggctgtaaccccagtgcctggcatagagtcggtgttcaataaatatttgttgaactgataaaatcacttatgaccatttttcattatataaaccacatttagctaagggcttacgtttactgtccatctcccccaccttggctgctgtatgactcagagaggcttgttccccagctgttcctagtgcctagcacagctcagaatagatgcttgcaacactgaagatgaaagagtgagtgaactctctgacaaaggactagaaggagtgtgagctgcacttcccaggaaaggagcaggagactctgcctgggcgctgtgtgtttctgaagggcagcaccatgtcttatccatccttatctctgtagctgatactcagcccagtgcttggcacagagcagagagtcaatacaaggtaattggatcagattgaattgagtttgggaaaagctagaacaaaatctctcctgacaacaacactggatgaagctcagcttgtgaatgctctcttaaaggtggcagagatgactcctcctggattccctcctgtgattgttttgtcaggatgcctagtagtatgcatctattcattcatttattcattctttctttaagctccacctgcaaggatgcagagcacagggcatggaaagctgcacaagttttcagccccacctttagaaagcatgtcttgaggaaaagttaggctgtattctctggcttgtacaacctccccgaggaggcaaaagagttggactcaggcggttgtagttgcttgagtctgtcctttgtgttggcctccacaccacagtcgttgaacaggagtagaaaaagcaccaactgtggttgcaaattggcttttgcattaatcctggcttattgaaaaacactcaatatttttccaaactgaatttagggcttttgactgaagcctgaatcatttactgcagcagagcatatcactagtctaggaaaaactagaacttataaatacaaagtccgtttaagtaatccaatataggataattacattattaaataaagctatgggtctcaaattatcccactgcctttgtacatgtgaggataataatgtgaactgtgctaagtgaacagagtaaaaaaatttaacaagaatggagtgtgtctaaatcatatgtttatgtttaaacagaggctacagaaaacaggaagatttactcggtttgtacattaaagtgtcctaaataggcataaggctgtcagtgattcttggaagactgctcttctaattaatggcaacggtatattgagactctgtgccagatgaccagtaagctttaataattcagattttcatacaccaacaggggccaagggttttcttcttcctttgagggtctttatgggatagactctgctggatgatgtacctgggcagaaggtcatgtgcctgcaaaagtggatgaaaaaggctgggcatagtggctcatgcttgtatcccagcactctaggaagctgaggcgggtggatcacttaaaggtcaggagtttgagaccagcctggccaacattgtgaaaccctgttcctactgaaaatacaaaaaatggctggtcatggtggcacatacctgtaatcccagctactcgggaggctgaggcaggataatcacttgaacccgggaggcagaggttgtagtgagcagagatcgcaccactgcactctagcctgggcgacagagactctgtctccaagaaaaaaaaaattaaatggtcaaaaaaatcagatgttaaagtaatggtcgagtcattccggattgggtggtggttgggtttgggctttattgttacggtttttgcttttattgggtgttcttacatatggcttaactgagcataacactggaattgggctcatttatcttctttgttaatgttttaatggccagagctaactgggtgccaagctagcttttattatggcaacctgaaaggagttaaaaaaaaaatagaccatggagtttacaccctattaatttggccagagaaaaagtaggcaggcttaactaacactgatataagtaaagcctcttctttgcatatcaaatgcttgactgtttagagagaaagtatgtaggacactgggatgcaattttctgctctctgtgtaagttgtcttttattttagggaggaaaaaggtacatgcatggtaagcccaagaggaaagaaatggaacagggaattatgagagggtgtttctaggactttctctggagatggtcaggggagcaggctgcagccgaccaggttttagattagtgtgtattaaaaatgtatttaggaacataaaatatttaggatttttgaattacttgtttgatacgcaaatgccgttggctataaccatgaaggatggtcgcgttacatttaacaaagcgtgcctcagagcaatcttctgtttgtttactccctcctcttgtgcccggatggatttccaaaattcatcgagccacaggcgtcaaagatctggtgagcaggatggaaaaggttggaagaggaggggctagcttgggaaattagaacccaatacactaaagagcctccgtggcaaatcatttcatcatgttaagggagtcaaattaaatcttagcacatacttcagagtctatcttcattgctctgacaacagaaaattctttacatttttaactagcacatgagtggtgatttctgccgtctttctttgggaacaaaaacacgataaaaattaaaaattaaaatcctttttgtgaagtgacttgaaatcccattcaccccagggaattggcaggaggtggggaaaggtgcatttgtcccagggagggagtaggttgggatgtgactactgtcaaggtttaaatgaccagttttccagaaagaagatgatgctaccatgctggtttctggttccacttcagttttttcatctctaaaatgagttaagaccacctatctcagaaagtccttatagggattagatgggataatgtctattaaattcgtagactagtgtctgtgtcaagtaaagcatctctgagttttctgcagctgtgtccttgagagctggggaggatgagaaacccaggtatttaattttattattattattgttatattttatttatttatttatttttttgagacagagtctcgctctgtcaccaggctggagtgcagtggcacgatctcagctcgctgcaaccttctcctccctggttcaggtgattctcctgcctcagcctcccaagtagctgggactacaggcgtgcaccaccacacccagctagtttttgggtttttttgtattttgtatttttaatagagatggggtttcatcgtgttggccaggatggtcttgatctcctgacctcgtgatctgcccgcctcggcctcccaaagtgctgggattacaggcgtgagccaccgtgcctggcctcaagcctattattaggttggtgcaaaagtaattgcggtttttgccattgaaagtaatggcaaaaaccacaatgacttttacagcaatctaataattgtcttctggtccaaccttcccttggagataccagcaggagttacaggaccattattgttcctagacaaagaattaagaagagttaggaacatgcacagttacccacaagggacatttgaatcccacttgccctcccttcattttctgctcaagagataatatataatagtaatcaccattatttcatggatgcctactctgtgttgaccattgtattgtaacaactacagcatcctaactaccctatgtagttggttactttatcctattttccccattttttttatatgagaccttgacaagtccaagaataacatagacttgccagggtctcatctaaaaaatgaggaaaataggctaaaataacacagtagagctgcacttgaacctcagtccatcagactcaaaagccagggttttctcagctctcccttagtttcttccaacatggtacattcagagatgatgtaccattaaaataagcacttggtgctttgggcccaacacaggccttggctctttgggaagtacaagagaagtggaagttaggcaaggaaacctgcctctaaaaaatatttgcaattgaggtgtttactgtagaagacagaattatgcaattcagcatcaaatactagtgcctaataaagatttaacattatgtcacaggtaataagaacagtaagtcccagttcagggaccaacttagatgagatagctttttattttgcctaataaggacattcaaaaacaactaccagcatcttttgatatcatcatttcagagaaaataaaggatattataataccgcatgaaagaaacgagaagggataaaagtctccagcggagagtgtgtggagtccctccatatcagggccactcctttcttttctctgctttctgccctgggaggctgacctatgcgggctccattaacagaggccctgggcactgtggtttccggtggggtttactcatagaggtgctgggagcgggaggaagggagaagtgtggaggcaggtatttattccctgttgcttcccttcaggctggtcccttcaggctggtggcatccctttaaggaagagtcattgtgtttggtagaagggtcttctctattctggtaatcactcccacccctctgcggccctttagcccaggagtggtgatggctgagctgctccagcccaggttcctgtactgtgtatctcttacgattcctttacatcccaacacctctgtcacttgttccagtgtaaaacctccccttgaattattattactatcattattattattgagacagggtctcaactctgtcacctaggctggagtgcagtagcacaatcatggctcaccgcagcctcaacttcctgggctcaggtgatcctcccatctcagcctcctgagtagctgagactacaggcacctgccaccatgcctggctcatttttgtattttttgtagagattgggttttgtacaggctgatcttgaactcctgggctcaagcaatccacccaccttggcctcccaaagtgctgggattacaggcatgagccaccgtacctgccccccaacttgaattattattactcaagtattccattggtttcctgttgggattctgactgatacaaggagagtccttgaaatctagcaagtttagcttaatgaagcttgactgcattgtccccatttttctcatttcaccgctgaccagtgaaagcttcatcttgtttgatccatattaccatcctgtcttttctgactttcttggattccgagtggcaactacttatctgtagtgtgaaacctttttactccctctgtagatatcccattagcagaatacactaatgtgtaatggggagaacagttgggcaaactggtaggtacctcaaattgcagtgtgtctgagggaggcttgaaagcaagggagtggccaaaccacccaggcttcgaggtggtacattcttccccctacccgtctccattggtgcacaccagaggcacatgcacctgccaggaatggttccgtcaggacacaagctgaagtggttgtagttagtctgtctaaaagttgactcttaacagagttccttcatttttaatttctatcttaattaaagtttgccaccctcatgcaactagttggactagtatttcggtgtcacaatttatttagctaatacctcatattgttgtttttgtgttcccaacatttatcatgtttcaaatgctacaaagtacattttgaaagcctgggatgttcagggaagactgaggtgagtatgccatgctttcctgttcttgttccatcccctccctgccaacccgtctgatattacacttgtgcatttattgtccttgggatgctaggtgattatagctctccttaccaatgatctgttactgggtacaacacagtatgataagaaaagttcatgttctttctctggagggatgccatattagtaaggatataggttcagctgtgtgtaacagagactcgtatattatagttgcttagatacattgggagttcaaaatctcttatcatggtacagacgtagatggctcacagggctagtgtggtggctttgctctgtgaggttgtctagggactgggctcctttttctcctgagcaatttgccctcattcttatggtccaaagctacacttattccctttgagggaattacatccgggaaggacatcactaatactcatatcctgtagtcataatttggtcacgtgactgcacctggctgtaaaaggaagcagaaaaaggacgcctttattctccacccagcaatttagcagtttattattagaaaggaagaatagatattatggagaggttagccacagttgggaagtgttaaagtctccttgtaccaggcaagatattttcttacaagtaagtcaaagggaaggctgtgcagttccgctgagcttgagttgactctgaggcatccaaattgataacaagggactagagtgtggatgaatttttgggaccaaacagtacaatgtagtcatgggctttaggggtgagcactggaatccccatagagaatgatttctttaaggagtgatatgcagagaaagaagaccacatcccagattgcatctaagtatatgtttcatacattttcccagttgggagatggaatgaggaagaagagaaattgaataaagcaaagaaatgtagaggtgatagatgttgggtaggtgttctccaagggtctcttgcatatgtacacatcttgtgagcaaagccactgactgtctgtgttctggactgtcttttcaaagatctttatatagtgaatagcattggaagacaaaggtagtgtttttccttagaacaagagcaggcatgcttactgtccagtattaaagatacaggttctcggccaggtgcggtggctcacacctgtaatcctagcactttgggagggcgaggcgggcggatcatgaggtcaggagatcgagaccatcctggctaacacggtgaaactccgtctctactaaaaatacaaaaaattagccgggtgtgatggcgggcacctgtagtcccagctactcgggaggctgaggcaggagaatggcgtgaacccgggaggcagagcttgcagtgaaccgagatggcaccactgcactccagcctgggcgacagagcgagactccgcctcaaaaaataaataaataaataaataaataaataagatacaggttctctatgctcaggactcttctccagtagtgcaccccattgtgtgaaaaggtatcatctatccctcttcacatctccttttgggaactgagtattaaagaaccaccacaaacgctggtacattgactattgctattactgtgagtaataaaccattttttgtctctggccaggagtctcatggcttctgccaacatccatgaaactggcaggtgaacttggaagtctgaaaaaagggtaaaaatctcagacccttcacagttcttaacaggaaggagagtttcaagtcaaaattagggttgttcattaccaaatgctacaaagaagttaaagaaattgaagaataagaaaacgccttgggttagtgacataataccatggctctcaaagtttcggactcaggaccctttacactcaacttattgagggccccaaggagcttttgtttatgtaggttatacctactgatatttactacagtaggaattaaaactgagaaataattttaaaatatctattaattcatttaaaaattatgacatccacatgcacaaaaatacatcaagctgaacctcataacttatacacaattaagtgaaaacagatcatatttctaaaagtaaaatgtaaacctataaaacttttagaacagaacataggagaaactcattatgacctgggataggcaaagagttcatagatataatggcaagccacaatccataaaagaaaaaaaatctaactggacttaatcaaaatataaaacctttgctttgtgaaagacactattacgagaattttaaaacaagctacaaaataggagaaagtggtttcaaaccacatatctgacaaaaagttaaaagaactctcaaaactcaagtgtaagaaaacaaataaccaaatgggcagaagacttaaacacacatttcaccaaaaaggacatgcagttggtgagttagcacctgaagaagatgtttgacatcattagtcattagagagatgaccatttaaaacacaatgagaaactaccacatacatattaggataataattattaattattaataatcaattaattaacagtgatagtgtcaagtactggcaaggatggggagcaactggaactctcatgcattgctgttgggaatgtaaaatggtacagccactctggaaaacagttgggcagtctgtagaaaaattacatccatacttaccatatgactcagcaatctgtctccaaggtgtttactctagagaattgaaaatatgggttcacacaaaaacctgtgcgggcataccttagagataatgcaggtttggtttcagaccactgcaagaaaatgaatatcgcaataaagctagtcacatgactgttttggtttcctagcgcgtataaaagttacatttacaccatactgtagtctgctaaatgtgcgttagcaatatgtctaaaaaaaaagtacataccataatttaaaaataccttattgccaataaatgctgaagatcatctgagtcttccgcaagttgtaattttttttgcttgtggaagatctgggcttgatgttgatggcagctgactgatcagggtcgtggttgctgaaggttagggtgactgtggcaattccttttttctttttctttttctttttctttttttttttttttgagacagaatctcactctgtcacccaggctggagtgcagtggtgcattaatggttcactgcagcctcgacttcccaggctcaagtgatccttccacctcagcccctgagtagctggaactatgggtgtgtgccaccacacctggctaatttttgttgctgttgagatgcagtttcgccatgttgcccaggctggtctcaaaatcacaatttcttaaaatgccatgcattggttgacacttcatttcacgaaagattactctgtagtatgcagtgctgcttgattggattttacccacaggtagaatttctttcaaaattggagtcaaccctctcaaaccctgccactgcctttatcaactaacttgacgtaatattctgaactttttgtggtcatttcagcaatgttcacaaatcccagcacttcgggaggatgaggaaagaggattgcttgaggctaggagtttgagagcaacctaagcaacacagtgaaactcctctctaaaaataaatttaaaaatttagccaggcctgtagtcccacctattcgggaggctgaagtgagaagatagcttgaggccaggagttcaggccatatggtgccaatgcactccaacctggccaacagagccagacccaactcaaaagaacaaaaacaaaacaaaacaaaaaaacattgttgacagcatcttcaccaacagtagattttatgtcaagaaacccctttctttactcattcataagaagtagctcctcttcatctgttcaagtttagtcatgagattgcagcaattcattcacatctttgggctccacttctaattctagttatcttattgtttccaccacctctgcagttacttcttccactgaagtcttaaattcctgaaagtcgtcacctatgagggttgaatcaatgccttccaaacttctgttaatattgatgttttgacccactttcatgaatctgaatgtacttaatggcatctagaatagtgaatgctttctagaaggttttccgtttactttgcctagatctatcagaggaatcactgtggcagctatagcttcataaagtatatttcttatataatgatactcgtaagtcaaagttactccttgatccatggactgcagaatagatgttgtgttagcaggcataaaaacaacattcatctctttgtacatctccatcagaaccttggatgtcaataagcagtcatatttgtaaagaaatctcttattctgagcaataggtctcaacagcaggcttaaaattttcagtaaaccctgctgtaaacagatgtgctctcaatccagcttcattttttcatttatagagcacagagagcatagatttagcataatcctgaaaggccctaggattttcagaatggtaaatgagcattggcttcaacttaaaatcaccagctgcattagcccctaacagaagaatcagcctgtcctctgaagctttgaagctggcattgacatctcactatctatgaaagtcctagatggtcttttttgcccaatataaggctgtttcatcttctattgaaaatctgttgtttagtgtagctaccttcaattatcttagctagatcttctggtaaacttgctgcaatttctacatcagcatttcctgctttaccgtgtacttgaaagttacagaggcagcttctttccttaaacctcatgaatcaacctctgttagcttccaacctttattttgcagcttcctcaccacttttagctttcgtagaattgaagagagttagggccctgctctggattaggctttggtttaagggaatattgtggcctgtttgatctttctacccagaccactaaaactttctccatatcagcagtaagtctgttttgccttcttatcatttgtatgctcactggagtagtgctttgaatttcctttaagagcttttcctttgcattcacaacatggttaactggcgcaagaggcctagctttcagcctctcttgggttttgacatgccttcctcactaagcttaattatttctagcttttgatttaaagggagaggcatgggactcctactttcacttgaacacttagaggccattgtagggttattaattagcccattattgttaagtcttatggaataggtaggcaggaggagagggagatagactggggaaaaaggcaggtcagtggagcagtcagaacacaaaacagttgtcagtgaagtttgccaccttatatctgcatggtttgtggcatctccaaacaattacaatagtaatattaaagatcactgatcggctgggtgcggtggctcacacctgtaatcccagcactttgggagtctgaggcgggtggatcatgaggtcaggagttcgaggccagcctgaccaacatggtgaaaccccgtctctactaaaaatacaaaaattagctgggcatggtggcacatgcctgtaatcccagctactcgggaggctgaggcaagagaattgtctgaatcccggaggcggaggttgcagtgagccgagattgcaccattgcactccagcctgggcaacagagcaagactctgattaaaaaaaaaaaaaaaaagattacagatcaacatactggatataacaataatgacaagttttgaaatatcacaagaattaccaaaatgtgacctggagacacaaagcgagcacctcctgttggaaaaatggggccgatagactttcttggcacaacttgcttcccacagactttcaatttgtaaaaaatgcaatatctgtgaagtgcagtaaagtgaagcacaataaaaagaggtatgcccgtacatggaaatttatagcagctctgtttgtaatcaccaaaattgaaacaaaccagatgtccctcagtcagtgcgtggataaacaaactttgggacacaaacataccatggatacataagaactctgcagaaaggaataagctatcgatacaagcagggtcatggatggatggatctcaaaggcattattctttgaggctgctttaagaagcagcctcaaagattttgtactgtatgattcaatttatatgacattttaggaaagaaaaaactataccaagaacaaatcagtagttgccaggagctggtggggagtggagggagagggtgactactaagaattaatatgaggggttttgagggtgagggactagtctgtatcctgacaatatagtcgtggtagttatatgaatctatccatgtgttaaaattcgcagaactgtacaccaaaaaaggaaattttactgtaagttaatttaaaaataaaataaaatagcaatataaactcattatgtaaatgtaacgcactttttatgaaagttaaccatattttcaaaaacaacaaaaaattagtaagaacagtggcattgttttacattttttgtaaatctctttactgtctagctttatatagagagcggagttctcatatctccttctgcattcactctgttgtgatatcacatgtcacatcgtttctggaaaaccctactatatatacacttgaaagaggatgagagtgaaaaaagccagtaatgtcttagtagttttaggatcattgttttgaccctgtggaccatctgaaatggtctcagagattcccgagggtttctgaacccactttgaaaaccaatgatataacacattgttccaaattttattttcatagcatcttgacttttatttttctggctatatccacatgttccctgtgtttacttaatgcctatgttcaaattggcccttttttaaaacttgctatatctcctataaatagaaaaccagtaccaccttcccataaatagtaaatacaaaacaaataagcaatgaaaaacttaatatacattttaaaagtttatttctgggccgggtgcggtggctcacgcctgtaatcccagcgccctgggaggccaaggcaggcagatcaccagaggtcaggagttcgagaccatcctggccaacatggtgaaaccctgtctctactaaaagtacaaagattagccaggcgtgatggcaggcacctgtaatcccagttactaaggaggctgaggcaggagaatcgcttgaacctgagaggcagaggttgcaggagctgagatcgtgccactgcacttcagcctgggctacagagtgagactccgtctcaaataaataaattaatttaattaaattaaaagtctacctgtgaaccatctaaaatcatctctgcatgccacggtttggaaaacaccaatttagagaagaaataacaatgatcatgatagctaattctgacatgctacttcatttgtatcaacccattgagtcctggcaattactgctggacaaggcagacagaattattataaaacctgggtttccctttttttcttccccaaaaaaaaaaaaaaaagaaagaaaaaaaaactttgaagtacaaggaggctgaagaagttgctcagtgttccacagcaagtaaattccggggctggaatttgaacccaagcaatctggctgcagagtccaagatgctgtcttggcagataggaaacctggatctttgttcaagtcctgccgtcagttggttcttggacatgtcactgaacctcactgtcctcatcagtaaaatgagaaaggtgaactaaatcaatgttacaagtttaaatgtctggtgcccacgggggccagatagttaagggaaaactggactgaatacaatgcaatagggagtggtggggattttacatcttgtctgaagaaggcagcttctatcagtttcaactgttttttatttttattttttggcctttattttattttatgagagaagattgaggtctgggtatttttgcctaaagtttcccaagttttagaacacttggaagggcccgccatgcacatgggctgactggtttgtgacttcttgactggatgagctcctcttgacttagaggatttatgattaaatgagctgtttttggacaatggtagaaactaaatccaaattacagaaataggcagtttaaaacaatgacgaaaggggataaggacttagaacgtggctcaacacagcttacataaatattgattaagagctgggttaattgaaaagccaaggtacattaatagaataacaaagtgtatttctttgtgttccttttgtgttgtattagagtaaatcagcaatatttatccagtgctaattctcagtttgcagagagctaatgtaatcatgagatgagcttattgaaattcttttcttagacatagagacttgcccaagaatggtgagtattaggaactttagtcagcacttgctcagaatagtaaatgcgaacatgtgatttatgccattgtgtgcacaaagtaatgtttcctgagacattttctatatatatgttggctactttttgttttcttgtggtgggaggggggtgttggcttgctgtttccccctcctctccttatcagatttccttctatggcatttgacaatgttgcagggccagtttctctgtgaatccacagtaaaacatactggtggtttcacaattaagccaaacttgggtttatggcttatgcatgtttatgtgaattcctgcatttgtttttatgtgtgtgtgtgtattcatgaaagatctgtttgagagagggagaaaaagggaggacaaaacctatagactgaatcataaaagatgggtttattcattaatgacatcataaggatagtattttctcttggttaatatactatttgtttggagggtgttgtaagccatccagagatagtcatgccatttcttggaaaagatctgaagcaactagtaattgaaatgataatcatttgatcagagagctatttgaaaataacactcatctacaaacttgtctcttctgggaaactgtatttagtcaaaatgttgccaaattctctctttactaatgttgagactgatacacctaattattttccagtacattctaaacttgatttctggtgtcacctgtccagaagctgttcccatatgctttgaaacaatatctagcctgactttattctgacatttaataatcaccatgaaatagctataaaatgcatgacaactacagatcttttatttcaagaggatggtgtggtgaatctgagggaaatcatccgttgaaatggtactttgtaatgggccccattgtttataaagtactcaaattttttcttgagcgcacgatagaaacacagtttccactttgtctcccatttagtggtagttcatatttaatcatgataagggaaaggattccattactaaagttttacttttcatttttgatagagtatttgttactctgctgctgcctaatagactttcttctcagaagcagcttggaactcaatgaggaaaattgaaattttagatcctaccttaaaacatcagaaaaaaaaaaaaaccctcaacccagggcttcttattatgtgaagcttaccctaataacctttttttgttcgaattggagaagtgtgtgtgtgtgtgtgtgtgtgtgtgtgtgtgtgtgtgtcggtggggcagggggaggaggaaaaagtcatgtttggggaggaggaaaaagtcatgtttaacagcaaaattagccaaaatcagttgtgaattccttttgtttaatagctttgagacatcttcctgttgttgtttgtcaaaaatatttctaagattttgtaatcttaggggttttcacagccaagctttcttcagaaatgtgaaataaaagaaatgaaagaagtcagttcaagttgaaatgtcagatgcttaaataacttaacttaaaacccagtgagatgatcttcttgagccttttccaaagaatctttgggtgaaggggcctccctttgttccatgtatggatgtctattaaagatcttgctgaattaattctgagtcagaaaagttggttgtttcctagaagcaattagagatgcttaacattcaaatttatgatccagaggagaaacttgcatttcaactacttttcttaaattcaaagactttttcctcactcaccctctcaccctctaccccatctgtattaaaagaaaaaatcagttcatttctcagcttacaaagtttttgagaaacatgagaatgtgtaagtttctttcagtgggaagcacataacatttatgaagtatttcttttgggattacatcacagttttatttaatttttaggacaaaagttaaattcaatatttgtgtataagccaagggaaaatgtaccataaacataggaatttgggggtgagtcagagttccaagaatcctagatttacttagaccatttatgtagagacaggctcaccattagtcatctagctttcactttttacatttgcaattaattacacctaaaaactagctttcacccaagtggtcagctaggtagagtgtgaacttgggcaaccaacattaaaaatggcttattagaattactgtcctatttttggatactttctaattgtataacaaacataaaaattattccttaactaaacaactagcagtgaaaaaccattgaaatgaagtgagttactaaagattctgtgtcaccagaatgcacacagtctccttgcattaggttaaaccactcacatggcatttcagatgggccttgtggagagtggatcatttccctcaaacctataaataacgttttttgttcttccccaaccacctcttgtaggatgaagtcattgctgtttccgaaaaggtgattgtgaagcttgaagacctggtcaagtgggtacattctgatttctccaagtggagatgtggcttccacgctggaccagtgaaaactgaggccttgggaaggaatggacagaaggaagctctgctgaagtacaggcagtcaaccctaaacagtggactcaacttcaaagacgttctcaaggagaaggcagacctgggtaaatatgacttgtaattttaaatctaatgtgtgggcgtatatagtaacttttcggttgaagatttttctggaaacactatcatttatatataaatgtatttcaaatttctttaacctcaaagggtcctaagaatatggatggagagatgactggatgggtaagggatgagtgttacctgttggatcaaaggaccttttatgtatggacccttgtgctggggtgatacagtggttctaaacaattttcagtgtgatgtcaaggcatacaatttaattagagcacctaaaattgaattaatgaagagtttaaatacttgctataagtatgtagtatgacatctattaacaccatgtcccaatttcatgttttacattgagtggaaaacaaactgaggaaaagggatgagttcctcaatgtggagcaagagaacaatgtcaagccaggggatccactggttggcaaccaatggcataggtttgcttgatcttttagtgttcagtggtaccatcaactatatatatatatatatatatatatatatatatatatatatattttttttttttttttttttttttttttttttttttgcttccctcttccactgtaagtttaaaggagaacttgggctttggagtagttgtgctgattggtgtttacatactaactctgctgcttcttagctgtatggccttaggcaaataatttaacttctaagcctcagtttccccatctaaaaaataggggaactttacagggttattgtgagatgtgagatagaaggggtagagcacattgactggcataaaggaggggcttcataattagttctattgctttttcttaacactttcttctccagtgacattttgtgtcctttcattgctttttttttttcttctgtttgtattcccgtgtcattcactgatttattctcctagcattgcccaagacgaaaattgttgtcctctgatttagactagttatttcctctttaggcaaagaggaactgcactttaacatattaaggcatctttttctttcatttgcgcacaatgctgatttttgcagtcctattttacgccttaatgtgacaacttcctggtttttttttttttaaacccagaacttaactattacaacaaacctaggcaatttattttaattggcataaagagactgaataacaccagtaactgactgtggctttcatgtgaccctggtttgtgatgagctgtgctgtgttttgggaatagcattaatattttcttgcagtttgagtttaactatcaacggtttcctggcatcttttggttgatgtcagacagtaacattttagatatggcagcctgattgtcacctgcacatttagagacaattattagactagtggttttccttctaaagccaaagagttttttgataatcttcctatatatactgttacaccccccagttttgtgaacacacaataactagtcttatgacttgcggtaatgctgaataatacatctgttgtgttactttcctaatgtatgatctaagttgtattaccattgtcttatgttttccttaacattaaaacctttcttttgtttgtttaattttgtgtgtgtgtgttatggaatatactgttactaataaaaaattaaacaggaaacccacaggggacaaaaggatgtgtagatggttaagcttgatgtcacacatataaacaagagtatttatagcaaggtttatgtttaaaattgtgtttaaaatggataatttattaatgaacaggaaaataagtctaatttcttaattccacccaaagaaataaaaggttgatcctcttggattctaaaaaaaaagaaggtccatattctacctttttgcagttgattccagaagaaattggtttatagtgaatattcacagtacttgcaggtggtttggcctggaaaatctagatgagtggtttttaaatttagttgcttattagactcaagaaagaaatttaaaaaacaatactgattactgagaccagcttttctagattcttcattcagtaggagtaaggaaaggccaatgaatgtgtattgataaaaaggttcctggccgggtgcggtggctcacgcctgtaatcccagcactttgggaggccgaggcaggtggatcacctgaggtcaggagttcaagaccagcctggccaacatggtgaaaccccatctctactaaaaatagaaaaattagtcacgtgtggtggcaggggcctgtaatctcagctacttgggaggctgaggcaagagaattgctggaacctgggaggcagaggttgcagtgagccgaaatcatcacacctttgcactccagcctgggcgacaacagcgaggctctgtctcaaaaacaaaacaaaacaaaacaaaaaaggcttttaggttgagtctgattttgtttgtttgttttggtctcattttggagacagctttatgattagtgctgaagaagggaaaatgatcaacaggagagttgattgggaggctctctcctggggcacaagaaacaccatgtacttaaaaaatttttaatgtaaaatacccctttaaggatagaatttagggccttgaaattctactcagttgctatgaactgtggggaatttgagacaaatagcttttgtaattggaatgcacactgtgttgtaataatgtggaaagagaaacaaaaactttccttaatgtaatgagtttccattatctgcctaatctaaggtttgtaagtctacattgtcaggatttatattgaggagatagggggtgtcattttctgtacacattcctgtccccacaactttctcttcagcctcttctataacatcaaaatatttgttgtctgtacttttctttctccgcagtggttttcttatctccttttctgttggtcacactgaaaccacctccaataccacattgttaatggaaattcacacacttattaggtttttccttctgtagaacccttccaactcctcattgttcttaccaaagaaagaagatgaactgtgagattatttgaggccccccccctttttttctggtggaagtaagcaaagaacggaaagatctcacctttctatggataaagtaaaactccaacatgttatcgttttttaactgagttatttcataatgttgaaacatgaataataacaaaataattagattggttcttagagaagggattttaaaatataaaagctcattaaagcacttttcttgcttagtgtttaggtagaataagttcgctttaattccagtttgtgtcacttcctgtctctctctgaatagtaaaaaaaaaaaacaagaatgttctcacaaatgtgtgtctgccaacaaattaatactccacaaagagaaactctgccccacatggcagcttccaataaatgctctgattcaaatcacaactctttcattttttttttatccccttcccccttgagggagcacatttagacaatatttgaggatgtcatctttctgctttttaaaactctctagagttttcatttaagactcttaatggttgatgactaaaactacagatctggatagtggaaaaactaataatcttaaaaaacacttctgaaatgtggtaaagtgcattcattctcttccctcctctttgtccttttcaaagaaagaaagttcaatatgaaaccaatgcaaattatgactttactcagtgagatattttaccttctttcagactgtttcatactgaagtttataaaaaaaaaagaaaaataactatgttaaaataggagggttaaggaatgtattattcataagcataatgaacacaagaacctgtttttccagaagaattgggttgattaaatcattcaccacacaagcctctagttatttatttttgtctttagaattacagtacttagcttttataataaagtggacttgatacccatatttggtatggcagttgaaagtagtcaaatgaagaattatttcattttacaaaatttttagtaagtaaggaatataaacactatcagttaaacatagcaaacttgcatttttttattccttgggctatagtttgaaaaaaaaatcaaattattttatgtaacactgattcttacagagttcctttaagcgaagtatgaaagctgcagtgtaagctttattggcctataaatatgtcattatagttggactacatttatatgctttggattgttgtttaagccaagaaaatatgtctctacaggttgactttttattgaagccctttgaggcatacaacagaatgtattttaggccaaggttattaaaacagcattttcatttttttgcagcagactcattgtcaattatgctgccacaaactgtctgtggatgggcagttatgaatggtttcatctccaaatgtgtctttagaaaaagaaagaaaagatagaggagtctgagctgaaactgagaaaaaagacccaaagattatgtgtgggggtctggctgaatttaatgatgggggttccctcagttcaatttctgtttctaaatctgtcccatcaaattgagaaagagtagcttccccctttcttctgttgctgggactttcactgtactttttgggagtcaacagcatggtggggttaaaagagcagagggtgggctgtcaggagaatcttggctctacatgtagatctgtcaccactggaaaagtcactggaagacactgtatgattttttacctgagtgctctcatgaatttattaggatttgaagacatgcctcttattggaacaatccttccttcctttctagacttaaattttatgtgtatatattttttgttttttatttttttcagtgaagagaaataacttttattaatgagagcaatgaattcttaattctcagccacaaaaaaagataaaatacaatgagattttcaaatgtaaaataaaatatctgtactcacttcattgctgcagagataaagtgaaatattattatacagctctaaggtgacatgaaaagaacacaactgttcaaccaaatggctcaaagtaggtttaaattttatgtgtatattaaagagtctttggaaggtatttgttgtttatattttactttggattgctggtttcactctgccattttccataacactgcaacttgagaagtttcttaaatgatatattgtttatacattcagctttgttttgtctaaaatgggcaataatatgtacctggctgtttctcattggatttttgagaagaccacctgagaacaaattagttaatatctatggaaacatttgtgatactgaagtctaaagtggtattattagtacattattattatcagaagcaggttctgtatgatagggagccatgtggtacaaggttagcttatttgtcccttttgaatttccctaatcacacacacattctagtaatttagaacagggtttactctcattactgtctccctcgatagaaaactattataaaagtcctttaggtttttgcttgtttatatgtatatatataaatacatattatatatgactattattttaatatatatttatttcaaataataaatgtatgtaatatataccatataacataaacattttatatatttatatattaatatatatttatattttataaacttttatcctcctgaaaattctgtcaaaataaactgagccataagtggccagttgtataggatatctcaaatactcttggttaaaaattagctgtagtttttgcttggagattctggaggcctcgtattgcaaatggttgtttcagatcacttttgagtttgatatgtcaggcagcttcctgagatgtggacatgggaaggattctcactttttgttgaagaaaacaatataaatgtctgtaagaagcatgctaaatgcagacatcttgtcatagagacttttcactgctaatgaatttactaggattggaagacatccttcttactgggacaatccttccttcctttctagatttaaattttgtatgtatattaaagagtcttttgaaggtatttgttgcttggattgctggcctaagtctactatttttcttaacactgcaacttgagaagtttcttaaataatatattgttgcactatactattcatgaatatcatgaagaatcattacagagcaaccttctaactaaaacgaatttgggccaggcgcagtggctcacacctgtaatcccaaaactttgggaggccaaggcgggtggatcacaaggtcaggagttcaagatcagcctggacaacatagtgaagccccatctctactaaaaatataaaaattatccgggcatggtggcatgcgcctgtagtccgagctactcaggaggctgaggcaggagaactgcttgaacccaggaggaggaggttgtagtgagcagagatcacatcactgcaccccagcctgggcaacagagtgagactctgtctcaaaaaaaaataataataatttggcctttatagtatccttaagttcaacatggaaactaattacatacgagacttatcaaagacttgtaaagatactttccaaaggattttctctctgacaatattgttgtgttaaccatgcattcgttaaagaattttatcatagcccaattaacattggaggagatactctccaagtacccacatgactcttcaagagattgcctcatgccgttataatgtgacaacccaaaggacttttgatggagtacaagaatctgcatccaagatattcagagttttagaacagcttattaccagtatatcttctcacttactttctttttttttttttttttttttttttgagacagggtctcactgcattgcccaggctggagtgcagtggtgcgatcttggctcactgtaacgtctgcttcctgggttcaagcaattctcctgcctcagcctcccaagtagctgggattacaggtgcccgccaccatgcccagctaatttttgtattttttcagtagagacggggtttcacgatgttggccaggctggtcacagactcctaaactcaagtgatcacccgccttggcctcccaaagtgctgggattacaggtgtgagccactgtgtccaacccagtatgttttctaagaaactaggaatacatatggttataacacataggaataagattattcatttcatttgaaatttaaattttggcttgaccatctaattaaatagttgaatattgccttgtaatagtggtagaatgagtgagtaaaagtggctcaaataagtaatattcatttatgctgtctacactcagccatcttggctattcctgctagaaaagaggtctttgtgaaatctgaccaagtctgagccaatcaacagctggtcgttgataatgctgcccaggtacttgtactgccatcactcatgaaggcacaatccaagttaagaccctttcatttggaattactgttgacctgaggattttctagtgtttcctgcagccacgaaagcttcttagaattccaggttcatttcttcttctgatgacggactgaagatggaccatcagctgaaaagaagtttgtagaattttggaatttattcctacttttccatttggagatgtcagggcagaagtagaaaaaaagtgaaattggaactttctgtgctatttttagtatccaggctaccagtatttacctctaggatacaatgtatgcaaaaggagtaatggagtacaagaatctgcatcatgcttttctgaaactctttatagaattgtcaggctggaaggggccttcatgaacattgttttctcctctttttccttctaacagtcgtcaggcctctcttttcagttcttccctaagatgtgctttcagaatccctcaccatcacggttacttatcttaggatacactttaggtaattttttttttttttttttttgagatggagttttgctctgtcaccaggctggattcggatccctgcaacctctgcctcctgggttcaagcaatttccctgcctcagcctcccgagtagctgggactacaggtgcgcgccaccacatccggctaatttttttgtattttagtagagacggggcttcatcgtgttggccaggatggcctcgatctcctgacctcgtgatctgcccaccttggcctaccaaagtgctgggattacaggtgtgagccaccatgcccagctgaggtgatttttttataccatttaactcatttatattgcaggagctcatttttactaagaatcctagagccagaataggagtagattctagagaaaggccccagtgatccattacgcatggccagaactctaaggagctggcttggcatcctccagatacaacatgacattagcaaaactactggactcttctctagagctgtatggccttggcctttttataagtaagagcaaaaagggggaaaatattctgccactacactccctgaagtttaggtacctatttttttgtttgtttttatacacagtaatattaagtgtagactagtatctaatgaacatcgttgttaatatggcagctactgtggctcaatatcaatgttgtgccttttgagcttctgtagttcctgtagttttttactctagcatttaggatagggcttgcccaaactgatttttgcctcagtaacggtctacagttgaagaccagcttggtgtctgagagtctgtttaagctattccaaccaaataatataaaaactgcaagtctttcctaaattttcatatgtgatagtttaatcatgttgttctcttggacttaagctgttcttgtttttgttttgttttgtctattttttctagcagtttgtttttttacagccatatctatgataaaagaccatgatggaggctgggcacggtggctcacgcctataatcccaacactttgggaggccaaggcaggtggatcacttgaggtcaggagtttgagaccagcctgatcaacatggtaaaaccccgtttcctactaaaaatacaaaattagacgggtatggtagcacacatccataatcccagctacttgggaggctgaggcaggagaatcacttgaacccgggaggcggaggttgcagtgagtcaagattgtaccattgcactccagccttggcaacaagagcgaaactttgtccacaccacccccccacgcccccacaaaaaaagaccgtgatggataagacagtgaattcataattttgttttagcttcattaatttgaaatgttaatttcccaaagaactgtctgtagagattgccatctgatgagaagataatcaaaagatgaaagaataaattcatttatggtcctattccttgctatgcctttagtttcttgctgtgtaccttggattgactggaacaagtcttatgcggccttggcttcatacaagctcataaattttcattatcactgatagattgccaaacttagaccagtaattctgtttgcatttggtgataaaagtgggtctattgtgaaggacaaacccaactgatccaccatgttttgttctttttttttgagatggaggtttgctctgtcacccaggcaggagtgcagtggtgcgatctctgcagactgcaacctctgccttccgggttcaagtgattctcctgcctcagcctcccaagtagctgggattacagacatgtgccaccacgcccagctaatttttgtatttttagtagagacggggtttcaccatgttggccagggtgatcttgaactcctgacctcgtgatctgcccgcctcagcttcccaaagtgcttggattataggcgtgagccaccatgcctggcccggaccatcatggtcttttaaatatcttttgagaatgcaacactgactctgtacctcagatgtgcttttaaagtgaggtctgtctgggcacagtggctcacgcctataaccccaacactccggaaggccgaggtgggaggattgcttgaggccaggagttcaagaggaacctgggcaacatagtgagacctgtctctgcaaaaaaattttaaaaattagctgagtttggtgacgcccaactgtagccccagctactcaggaggctgaggcaggacaatcacttatgcccaggaattcaaggttgcagtgagctaagatgataccactacactccagcctgggcaacccacactgcattccagcctggccaacacagtgagaccctgtctccaaaaataaataaataaaataaaaatgaggcttgattcagcagttcccctttcagttggaggtgcatgatgcttttattttgtcataactctaaaatgtttttgtttgccttctacctctcacctcattagccactgtatgattactgacagtgagccattattacagctgctatcatgatagcatcaccttggaacacaaagcagatatatcctacatgtgaattgatgtggtttttccagtgggttctgtgagcaggtatctgatttgtgcatttactcttaatactcggtggtattgacactgattcttttgaacagtttgtttaatctgttagagtacttttaagtctgaagttctgttgcaacacattaactttcctaaatgtcagattcactcctctcctgtaacattatgtgtttaagtctgtagtttatgcaggtcactgcagaggaaagctgaggtttggacttttagcttattttaataaatgtatttatttaggacagactggaataatagtgggttttcaaagacttcgtgaagtgcttcatgcacagtaggggctgagcaaatagtgctgatgatttcaggcttttcctagttgcctcactgtgtgttttcatttggtgtgcttggatgaagtggtattgcttctttcttccctaaaaccccagagcctgtgccttgcctagaactctcttccgttgggcagccccacttgctttttgaatttttaactatttctattatcttttacttctgaccttaaatattggcattccgcttaggatccctgtttctttgcaaacttcatgcctacgggataaaatacaaatgttacaggagtatccagtgaacttccaggctccattttcttctctttttcattaagtaactttcattattgttattttttgttactaccaatgttatccatgtttgttttagaaaatataggcactactgacaaacaaaaagcagaaaaattaatgttgcctattttcctcccactcagaagtgctgttagtatttgtatatgtaccaatgcatatgaatgcatgtatcagtgagaatttatatggatattatttttcctcataaaaataaaatctactgtttgggaatctaccttcccatacttaattttgtacagaggtattataaatatgcccccatattgtaaaatatcctatactgggtttttttttcagctgctgaatatttcattacagaggtgtttcatactttaattatcgttgggcatttcagctctttctgattcccacaaactttataaaactcttgtagttatgcacatagccatgactatttctttatacatttgtagggggggatcgctggttcaaagtgcacacagaacgttaagacacctatcccctaccttatctcctctcctaaaccttctttgccctagcctaactagtctaactgcctggttttctttctctttaaccacatgtactcagtcccctgccttccaaactctccagtgtgttttaagtggctcatgcctctctactcgtggaatagcctttctaggagtcctacctgtgggaattctgcctttcgtttaagacttgtttaagcctctgaagcccttctcagccttccagctcagaggaattgccctgctttattgagctcttatcttatcacatttagtgtctctaccaccttattgatcaccttactctatacctaccaatataatgcagtatcttttttcatgtgtttatcttatcttcccaaaaagtcttaactctatagtgttagcactcagacatcaaagctatacctagtaggttaagtaaacatgcggcttttatgatcagactttcctgaaatctctggagttctctgttcttagtctacttgagacacctatgtgcatttgaaggttgatttgagttcttttagagcacttcctaagacactctctagtggagaggctgtttcattggtaccctgtagaagcagcagctacttggggtattagtttgctaactattcttggtctaattagtagtcatctattcatcactcattctagaaaacacattgagagatcacgtgaacatgcttgaagctatcctgctagcctgaggattgtaggtggtgttataggtgtgtgtgtgtgtgtgtgtgtgtgtggacattttacatcttaatagtggtacatattaatgcctttctcaagggaatcttcttcgtgtttcagggtcatagtagtgacaaaaatatgcagggaataaatccagattggacttgttccaccttacctttttttttattattatcggcttgtttgtaatctttttttaagatgacaggttattaagaagatgattgtagcacgacatctagtgctgcttattctaggcaatcacaccgttttaatcttcgcctcccttaaaatggttgcttgctaattatggtggaagatattctccatcttccaactactcattctacaacttttgttcacaaagaaagtattctgttaggccttacaaaaacaatgcttcatgcctggcctattctctcaataggaaataaaacattgttttcatagcagagctgataataaggcagagttcaaagcatgatgaaacatatacttttctagcagagaaaaacctatagttacctggctaattaactatcacgtgatggctgtgtgtataaagatacaggcttttcacatgtgcggcctgtatctgggtttcttttcttttttttttaattgagaatgctcatttagttcccattgatttgtattaatgttttccatcaaagatttagaagaatgagcaaacacagaagctgccattttagggtagcttctttttgaccactgtactaaacctcagtagtcagttatgttgtagcggaaagagcatgaactttacaaagtaagatggacctggattgaagtccttgctccataaactgtatggccttaaaagctttcactctgctttgattgcttatctataaatcagcgttaacaatacccatctcacagttttgtctcccaggacttgggaagattacgttagatcatctataggggtacccaacacacagtgggagcacttggtcaacaatattagtttcctttcccctttcctttagaaaggtaaacccttactcaagaaagcaaagtgagtagatgcaacataaaaagaataccaagacagagattacagtagtatgttatttcattttatttaattcacaaacacttgagttatctattataagacattgaaattgattgagggttaagtgagccatgatcccagttctgtaggaattttgaagtttttaatgtgatttttaaaaaatataaatttcagccgggcacggtggctcatgcctgtaatcccagcaatttggaaggctgaggtggtggatcacctgaggttgggagttctagaccagcctgaccaacatggagaaaccccgtatccactaaaaatacaaaattagccaggcatggtggcgcgtgcctgtaatcccagctactcgggaggctgaggcaggagaatcacttgaacctggggggtgggggttgcagtgagccaagattgcgccattgcactctagcctgggcaacaagagggaaactgcatctcaaaaaataaataaataaataaataaaaataaaataaaattatatatataaatttcgatgctaaaatttacctgtgtgtattgtcctacagacctgctttttacttcctctgatcactcttagatcatgattaacagctgatgctagttggctagaaaatttcgtgccaggaattcagaatgtactctggatgatcacatgtaaaacatgtgtattgctgagctcctctgatgtttctctggctgtgaactggtgttcttgtggtttattggatgtgcatgagtaggtgtgtgaatacgcttgtgtgtttgtgaaatcatcccaactggaaatctcttttgtccttgtggtatctatttattccataagaaagcaaactatgggccatgagcagtggcctgtaatcccagcacttcaaggcaggtggatcacctgaggtcaggagttggagaccagcctgaccaacatggagaaaacccatctctactaaatatataaaattagcttggcatggtggtgcatgcctgtaatcccagctacttgggaggctgaggcaggagaatcgcttgaacctgggaggcggaggtcatggtgagccaagatcgcgccattgcactccagcctgggcaacaagagcgaaactccatctcaaaaaaaaaaaaagcaatctatgatgtgccatggttttgtgtgtgttattttctcttggaggttatgagtaagaattttcaagtttagaatagcctaaaggatgctgtagtagcaacatttctaaaacctcaatagctgaacacaacaaagactgacttcttgtttatatactgttcagtgtggggtacataggactctaagagcagttttcccctctacagtggccctgctttggacctccataccaacacatgcttctatgctcacgcagaaagggaaaaaacaggcacaagtggagtactggcaattaagtgtttattaatacatacattaataacatgcagtaacatgcatcacttctcacatttcattaatcaatgaagtgattaatttcatgaccatgtcttgacttaaaggaggtggggatggatatatgatcttatagcattcttagaaggagaggggaattgaatgtgaacattagtgatatttcacacatgcatttaggataatgatgtatatcataggataataaaatctcagggatgaaaggaactacagataatctagttacaagattttagtaatgtcatctttactatacttactatctcttcaatgccctttgcagaaatctttttttgttttgttgttgttttttgagacaagctgtcactctgtcacccaggctggagtgcagtggcccaatctcagctcactgcaacctccggctcctgggttcaagtgattctcctgcctcagcctcttgagtagctgggattacaagcacctgccaccacgcccagctagtttttgtatttttagtagagacggggtttcgtcatgctggccaggctggtctcgaactcctgagctcaagtgatccacccgcctcagcctcccaaagtgctgggattataggcctgagccactgcaccaggcccagaaatcttgattagttgactttttaatattttcaatgagtgggaatttttattactttgtgagatagtcccattacatcttttatccatctctttgttagacattcttacttctgaaaaataaatttgactatatggtttataacaggggtccccaatccccgggctgtggactggtactagcccctggcctgttagaaactgggccgcacagcagaaagtgagtagcctgcctgaacattactgcctgagcttcacctcccatcaaatcagtagtggcattagattatcataggagcacaaaccctattgtgaactgtgcatgcacgtgatctaggttgtgtactccttgtgagaatgtaactaatgcctgatgatctgaggtggaacagtttcatcctgaaaccatcccacacagtccatggaaaaactgccttcgccaaaactggtccctagtgccaaaaagtttggggaccactggtttatagcataaacaattgtattaactgtatactgttgtttccagttctattcttataacaacatggcacaaatcacatttttctttttcttgatagcatttcaaatattttcatttcagtttccaggcctcctcagcactctctgtccccactcccaattttcccttctccaggtcaaacactaataacctcaatctcacattccttatacagtgtgatttctagttccttcacctttctggtggcccttatctaaagaaatctaagttgtccctatcactctcaaactgtaactacatttgtctgtatttaaagaaaaggtgacatctcaatctttctctccttaattttactttttatataacacacataaaaatgtaagtaaaaaatccttcttcacctcctttccagtcctactcctcctcccagaaataataaattgctaacaatttgcgggtattcctccagttatctgtgtgtgtttgtgtgtaaattggtttttgtttttttgaaataggatctcactctgttgggatcatggctcattgcagcctcaaccgcttccaggctcaagtgatcctcccacctcagccttttaaattgtttttctgaaaagacaggaacttactatgtgcattttagtgtttaacagtagtgcagagctctgctgtccagtatgatagctactagccacaaatagctattgggcatctgaaatgtggctactacagttgacaatttgggttttatatttaattttaactaatttcagtttaaaataaaaaactgaagcagtataaatttttttttgttaaacataactttattgtcttgtttttttgttgttgttgttgagacggagtttctctctgtcgcccaggctggagtgcagtggtgcgatctcggctcactgcaacctccgcctcccaggttcaaacaattctcctgcctcagcctattgagtagctgagactacaggtgcaaaccactatgcctggctgatttttgtatatttagtagagacagggtttcaccattttggccaggctggtctcgaactcgtggcctcaggtgatccacctgccttagcctcccacattgctgggattacaggcgcaagccactgcgcccggcctgtcttggcattttaactgtcatatatttagcatgcagactggatgtactggaagtgcaaaatacactggatttaaaaaacttagtatgaaaaagaatatatatctctctaatgatttttatatagatggcatgttgaaataatatttttgatatgttggattaaataaaatatattattgtaatttgaccttttaagaaattttaatgaaaatttaaaataatgtatgtgtctcactttatatttatattggacagtgctgatctagagagatttggacaaatgcagtgtttagcccaatctgttattttgaagtagaatcaccatttcatgcttcataaggccagggcactatatttgctgtagaaagaatatgaagacgaaagggacccagtcactgccctcaactacggccttcattttgaggttgtccacctggttggttggtgggtttcctcttttagattggagggtttctggttttcatgcatgtgtaggaaggaaggaactcacaggtagcagggcaaacagctacaactatgttataaggtagagtctagccagtgcatggatgaaggcgtaagcagtgttccaggagcttggatgaaggttgcatgagtacgtcttgcctgtgaacaacattgtaaaaacttaaaagagtaggcattgtgacctctttttctttctttctttctttttgagacggattcttgtggattggtgtgatctcagcccactgcaacctccgcctcccaggttcaagcaatttttatcctcagcctcgcaaatagctgtgattacaggtgcccgccaccgcgcccggctaatttttgtatttttagtagagacgggtttcaccatcttggccaggctggtctagatctcctgaccttgtgatccacctgcctcagccttccaaagtgctgggattagaggtgtgagccgccgcgcccggccgtgacctctttttcattggtagtagtctcatacacatgattgttgaatgaatgaggagactcccatcccatgtactactcttcctattctaccaggatattactagaaataaagaatcttgtggtcagctctgacttagattttctttttgaaaggcctagtcatcccactaggaacttatacttagttcaaacccagctttccaaatagaaaccctgtgcttgatgttaaatactgacctttttgttgtctccgataagtgcatagtggttcattttgaggttgtctggttaacagaagaaatatgtatattgtatattccttgtcaaaattcctaatattccaccaaagctctagcacttccatccagaaagtgttctgaggagttgaaggctctttcttattttgatttattcagtttcatttgcttcataattatgaagactgtccaggcctacaaatggctgcattggcaatgaaaggctgtcagttgaagctcagaatgttaataatttatcctctcattcactatccatgattcatcactgcaatattttcatattatattcttagggtacaacctacaagctaggggaaaacattagcaattttagattgcaaatgatagaacctttccatgaaaatgtcaactttttgcctagttatattcatggttgcaaatggggctagtgtggttaatcaaattgtttcatataaaacaatttctcctgaaggcaatgttagtggtggatttcacaaaatcacagaattcaccttgggagaactttgtggctgaataaaacttctgtcacatctctgtctggggagtgaaggtagggcaattttatctagaatctgtactacacctaataggttcagtgtttggcaggagatatactgataatcattattcccccaccccaccttcaaaaaaacctataaattgggctacatgtcaagtgcctaaatgttctgctgggaaataacctgagtaataggatcttaattaagaactgatggataatttttgtggagatgctaccccctgccaaaatctgcatgcagaattttatatgtaaacacacattttcttgggagaccattcatagcattcatctgattctgaaaggtattgatgatgattttaaaggttatgatatacccttttaaatgcccaattaccagttactgttctccccaagaagccactcaggcatctcagctaagttttatttactgtattttcctaatagttcatgcacgtgtgatagggaggacaggtggttggtcacctagtctagtggggctataacttgggagggcagcatggatgactttgagaatccaaagaaccctatggactgtctacccagaaaacgtttacatccacaaaatttgaatgacatttgaggacactcatgaacagccccctcctgaagttggtccatgaactccttgttaaggactgctggatgatttcctttaagaacacagaaccattatgctgtgaagaaggaaaacaaggatgatgtgtgtctacccgcttggttggtgggtttcctctttcagattggagggtttcttttttcatgaatgtgtaggaaggaagggcatgactgtcttatttcatatatttttcttttatattttcaaattataaattttgacaacaggagacaataggtaatattcattctctactgtctggacagcatggaaatactacgtacagtaatgtcttcagtagttactttctctttagaaagctccaaggaagctcacaacagtaggaagtcctactgaaactccttttggtaaagtggagcacgttttgtaatggaaacacattttctatggcttaatttttatatatagggttttcataaaatgagacttgcctaaggattcttttggaagccttttgcctcttttaacagcaatgtgtttattataggaatcagtctcctgctcacttataaaatattctaaatattcacttataaatattctaaatatttataagattatgagttttgtcttttaagtagggagttctgcatattgtttttggccaaaatgtagcctgcctccttgagcatgagttgaagcccaagatgagaagcccttttttttcccctctgaccaagatctcatctgccatttactagattaggctacttgaagggaaggaaatgagggcccccttcttttaatccaggacattgttaggtatatcataggtgctccgtaggtatgttggatgaatggatggatgattagaccttaaatcttgtacttggcagcaacataatgtagtggtaagggactaaaagtctggcagacatagactagcactctggatccccaatctctagctttatgcccttcggcaagttgtagagtatcagttttctcatctgtaaaatgggtataataaatctatctgatagggatactgtaggatttaataacatatagaatcccaggtgcttatggacatttttctggtgccataaagcacttgatacatggtagcattattaaactcttaagccttaaatcaggatatcctagactttagtcatttataaagcaactttatagttcttgccataccaataacactgttttattatttacttaatttttctttaaattaattgctttttaatttaaagaactttaagtaggaaattttatatcatcactgtaaatggaaaacctgtatcacttgctataattaatggtgaaggtaaatatataatccttaaaataaaaaatatgtttatccatgtaccacctaacattgacttgggtaccgctagtgtataccacagttaagtcatttcctttgaggcttttctcttgggcaacagcctaacctaggttatcgatagctttgagaccttctgagaccatgcaagcctcgtgtcaacaacaagctagaaagggttggaaccggttgcgctgaattaatctataggctcagaagtgtaactgccacacagatgtgaagtctgaaaataacccaccgtgcacctgcccttttcgcgtgtcagttacagtgttaactgagcaccagaggatgaaatgctgtaggaacagtaaaggcatgaatcttaccttccagatgctcagactcttatcagtggtttgatacctagccccttgattgggcttggggacctcagtgtctcaattctgggcaatttctttctttctttctttcttttttttctgagatggagtttcactcttgttgctcaagctggagtgcaatggtgcaatctcggctcactgcaacctctgcctccccggttcaagtgattctcctgcctcagcctcccaagtagctgggattacaggcactcaccaccacacctgaataattttttgtatttttagtagaaacagggtttcaccgtgttagccaggctggtgtcaaactcctgacctcaggtgatccgccagcctaggcctcccaaagtgctgggattacaggcgtgagccatcgcacccggccttctcggcaatttctgaatacagatcttagcagggtgagggaaacggtaattgttattactaccaactggccccaaacagttattgcataacgttgcacaactgagtcctgggtaaaatgagcttcttcagaaattgcctcgccaaaggtgatttgccaaggttgaatccttcggattgtctgcattggaacaacccccttgcccaagcactgagcttaagctagataaaaggaaataaacactgctttaaaagggagtgcactttagcagcacacaaaaaacaaaggtgaaggctcacatctgtgttgcattgcataattgataaaagctgaagcaccattagaaacagcctcatcatccatactcctctcctaatcatttaaatatgtacagcatgttttaggatgcttgttaatgactctacgggcacgttggtagtcagaacattacatgtgggtttgagaaataggcctggatcatttgccagacaatctaattctgacagtgtagtgaaggccatcttcaatttgactgtgctccactctgttatgctgtgaaagaaaaagataattcagctgagcattctgccgttggctagaaacaccgcagttctgaatacaaatattatgcaggtaaatgaatcattaaaagaatagaggcataaaatatctgacagatgaactcctaaagtttggactagaataaattttcccatatatgagcagtaccttcatccatcgactaacagtgttagttatccgttaagtcaccaaaaagcatttatggtcttagagtaaatgattggtaattatgacttacaaggctataaatacatggaggggatttggtgatatcataataaaccacgaaagaaactgcagtggtttttaatgttagtagaaacttaagaaatatttagagccgtgttcgcagccctacagttgttttttttcttttttctgggagtgtgtgattggtgttttgtcaaaatgtgcaactctaccaatggactcaactcaactaatgtaaattagggccaatgagagtgtccgactgagattagtcctcaatttgtatgacatgtgtctcaacaaatagaaaatattcttaaagaaaaataagatattcccgcatgtctctcttttttagttccctaatttctgattcctttcttctgaatgagttttctgtaagttaaaaaagacaacagtgaaaggccctgttcctctcagcttcttaaccccagtttgcctggtttatctcctgttttagattctaaaaaggaaaacattaatcatgcttagccctggactttgtttccctacctgttacctcctggtctaatggcagagatactgaaaggggcacagacccacaccagccaactgacctagctcatagccacaggaagagcggcatgtccctggggcagtgagagcgagactgcacccagaaccactgtctcatgacaccaccccacatctcaattgaagatccagatggacagctgacctatatgtctctccctgactggaccagctcggcagagcatcctagatttgagtaaagagcaacacaattctttgtaaagccattggccccacagaaagctccatggaaaatgatacatgagggtgttagtgggaggttgagaactgcttggtgcattcttgatttctgtgcctgtgtcctgatttcaggagacttcggtcatctttgattactgtcattactctagccccttctgtgtgcagttactatagttgtacctagtgtgttcaaggcaccggggaagaaatgacctgtgcccccagtgtacctacagccttggcatcattagcaactctcagttaaaggagcttaacacagagacagatgtgcctggtgtgaaaaacattgccaggatctgccccagagtgattttatttttgcaggtttctgtggtcctcaaatcccttttagatttgcacctttcttgattttgaagtctggggtcaaatatagagatcaacttgctggataatcagatgtagtggggagagaatcaacacattagcaactgtagggaataggcaggcatcagtctaaatggacacaaacctcagggccacgatagcagccagggacctcttgtgtgtgtcaggagttaacccttcagtgtctggactatagggtgtccaggaactcccaagggaagaccagagatagggaggaagagtcagggagcactagggagaggagatggggcagcagctatttattaacctgcagggacgtctctcagtattttaaactgatgaggccattctagtgcgttctagcccttgctgcagtcctggtgtcagtgtgttaacccaggggcaggaatctgtctagtttctgtttgtagcttactgaaatcccaccctataatgcttaactgaatagtgctcttcaaaatgcaccaactaaaaatagtttcatctgcagtgtgaacatagtttcatatttatactagcatctggcctaaggaattgaatactccattctttaaatagcttcactccagctctggaatactctgagaagaaaatctcccccaatcaaacaccttgtttacataggcatgcttaaatgcaaacaagctccctttttaaaatgcagaagaatattaatttgtgaggcaatggtgctttggggtagttttttggtgagtgaaagtaaaggggttaagtagagaatgaattttttaaatgtctacttagtaaaagatttctgagatgcctattatgttttaaatttttcattttcctaaatttgattcaagaacacattaattgtacgtgtgaattcggaattccttctttaccatcacatgtgaagccagttagaatgaagttcttgggaagaaaaatttatgctgccgctaatgcccaacaataatagaaatataagcctagatatactttaactttttctaccagcaaatgctttggggccggaaatcatttgccagcatgcaatgaatgtacttttgttagtcttagggggatactaatggttagtccccatgaagaaaaatgtgaaaataacacacaaaaaggtaaacattgcgaatggatggctaatgattagctgttacagtccaaaggggcagggtattttttttatagttttatgacccttggcccagcctttattgaaagaacattgtatgttcagagttatatatttcaaacgtacatctcctttgaatatccctctttaaagataataggaaatttttccatgttcatttttatttgtagagagaggaggattttaaatgtatactagttttaactctgtattaaagaggaggaacggttatttttaaacatcccattcatgaacccacagagtaagatataataatatacctttaccctccacccaccccagccatcctgaaaatgagtgaatgtagggcagtatgattactctgtcatgtagatgagttagtattcggtacattactaccacagtatagttatgatatgtccctctctgaagtgaatggtttttgtgcatatacgtcaattcagaaaaaaaatttttttctatttaaaataaaaatggcttttttgagttcccaagggttctatttttacaacttgcaagaactactttagtaaataaaagaatgtcagtagaacactggccactaaaatgttaacatatgggtatatttgaggagtagtaacataaaggcaacttttcagtcattgatgttaaaattagatttgaggccataatctcaaagaggtaggccaggggttgtttttcatggtctacgaaaataaatgctttggttgaactaaagttatgtgcattatctgggaaacaatgaaatgtcttaatttagacatcactttcatttttcaccagtgggacttttctagatgaaaatctaatcctgttctaaatcatccttttaaaatgtttttccccattacaaatgtaatatgtttgtgttgcagaaagtaaagatatgcaaaaagaagagataaaaatcagccatagtcccactatgcagaggcttaccactgttaatggtttaattccaatttactatattttctttttactaagatgtcactggttgtatacaatgcgtcattgatttcacaacagcttttggggaacaggaaaccatttcatcctaaatatatgcatgattttaagatatatactgatttcagaaagttaaaaagtggtgaggagaggcagggagcacgttttaaaattagtttttaaaagccagctctggccctcctcccccaagaagtcatctttctccctgtgtttccagctcacagtgaatgctctccctagtccaagactcctagaattgtaaggaattgcaaaaattcaatctaattttatttgcatccatcacagtaattttcccatcgttctctcagtgatattgagattacttgccttacacaactgtagattttttttttcacatgctctgaattttagaaaattctttgtttttacatggaccaaataccctggctttaccacattttcccgttgagactagttcccttaaggcaccccataagatgagggtataaactcttatcccacatgaaagtccttcagatactttaaaagcagtaatctgttgctttcaagagctcctgaaatcttcctggttcttctgacatctcctaatttctaggtgaaacatccctggtgctttcaacctggagtattccttaaagtgcacctttgtcatgtgcttcagttaatcaatgcccatttaaaaatactgcctgcagaccatatatgttgtgtaaccaatgtggcatattataagatctataacattttttatcctggacctatatttccatgaattctgcccgcattttattatttctcactagcagtactctgtatattggctcgtatagaaataatggttagctcagaaaaccgggcctttttttcccccagaacgtatgtaagattgcattttccgttactagatttagcattaatactatctttaggccattttttagccctttaagagcattttgctcttcactcacatacatttggattatatcttccaatggtgtcatctgcaagtttgagaaggcttctataactttactcaagcagctgattaaaacaagcaaacaccaaacaaatatgaaccactcttatttggatgttaccatatttctactttaagatatatcttcctaacttgactccaacctagtgtcttacaggaagaagcttatcttaccggtcaatatttgtattatccagagctcttagttcaaagtaaatttttaattgatccattggccgttagtgaatcatatatctaccttacttatcttcagccaccaccacaattctttgtgtgtgaacacaggggaaatatgtggtatgagacaacacatcgaacctggctggcgatggtttgttcacacagtgtcatgcaccctacagcaaaaaagttcttttcttgcatccatatgctttgttgtagaatgacaagtggagctggttgatggctaaatgtgcatctttcagctagatgatttgtactgtgtagacaaactgcccaaacattcaatttttccctttccaagcagatgttttgctagaatgtagacacagcctccaaaaatacctttctggcctgtgaatgttaatgtctctcttatgtgtgtgccatttacaacagaaaatataatgctggcattttatttcaacagaatgttggaagtacagatcgatgttgtaaaggtaagttgtccaggcccatggaacagttcatataaccttttggtttggaaatgcttgtcgcattcttgtagataaccatctatttgtacattcttatttttcttggtttattcagtaaacacgtaagggcctattatgcccaggctccattaagccttggatttttagaaaaattattgaaaatgcgcattttcttattgtacggcaagtgggtgggggtggctcatttcatgaaaattacctaagtaagaatttataggtctataaacacacctaatctagtgtgccacaataataatacatttaacatggcaagtcagcacacacacacatatttatacacacacacacacacacacacacacaaacacagtttcaccaggcagtacttaccccttaccgacaatgccctctgacattttcttttctattatatcctatttcatttttttaaaaacccacccgattggttttataatcctattaatgggctacaaacctacagtttagaaaatactaacatacacataatcgtttttgcctgatgtctctttctggttaagcacactatttccaaacttaactaagtgtttatggatccaaattcggctaattgatacttaggttcttccaaccctgtaacaatccctgcagaatttgcatttcttttccaaagtctaaaaatgaaccctttcaaggtatcctatttctaaggcaccattactggtacagttccgtgctctttttggtaatctaatatattgtcatatgttactaaactacccatgtctaaaacagaagaaccccacagcacaagtccatttatgatacagtgcccttgatttttcaaaatatgtggataggtttgctgttcttctcatatacagtgtgttttaggaatccatcttttaggcattgtctgaatcagcgtattactccttgatagagaaagagtgataattcctgctttttgcccaggacctaagagaaactgctttcaacaatcccaaagacaaagaaaagcttctatttataggctccatatggtttctaaagttttaaccaaagtgaatagaacaataataaattgctttcacatttctgcccatagaattgtttatttagcattttctgtaaaacaagaggccttccatccacatgaaaagactgtattttgattgcctgggagattcaaaatgatttctaatcttgccacaactgtcttctgctgtataaatgaaatgtttcattttcaaagagactgtcaggatattctgaaaagagttccttagctgctctgcaataccctcccccccaaataaagtgctttgttttgtattttccaagagaacaatggcattacttctcatattggaagatacgattttcagcaagtcctaaaatgcttatttgctagcagtttgtttcatcaggttcctcataggaatatcttatttaattcacttacaaccaaaaattcccagttttgtgaggtggtcaaacaggatagtagccttctgcatatggaaaaggaattgaacctataatatgcattatgcacactgttatccttttttttttcagagtcatggtaataagtgtctacaacaaaattcccttccttcattgaaatagacaggtctttgctcgacagctggacagaccataccagccataccaagggacctggcattttgtgaaggtgctgaggaggactgagttgagtttaccaaatcagccttcttgacccttcggcttagcattttcaagtcattgacattctcttatacctgtgccgctgatctctagacctgccatgagtgtgaaagaggcttcgttttttagtgacactttacccaaccaattttcactcaagaatcttcatattctattgtctcacaatcagaataaattggcattttcctcactcagtctactaggtgctttaattgtgtttagaaatagccttttgattcttttggatttgttttttgccctaagagtcttgatttccgtactaaattacctgacaaaactcactctctccaacatcaattaaagggatttaaaaaatataattacacttaaaacactagaaagagtcaagtttttagcatatgttatggcttgccagtacgagaaaagtgacttaacatccaaataaagaaaaatagttagccaatccattcattatgttgatatgatcaggtctccaagatgcatttaatcaatatattctgccttgattagccatattgaaatacttgaaaacataacctacaatatgaaaatcagacatacttataaatgccaatagcttttatttagagtcaacaagtgatgaaaaagctcttacttaaataaattgactttgagaacaagaatgcgaacagaaacataattcgttcattgtataattgtttttccctgctgtggacattagcctttggcatatggtctttgaccataatctatgggtagatatagccagggcactggaggaacacgaaggtgaattccagttgggtaacactggagaattccagttaaaacaaggttgactaaaatctaaaatacactgtaacatagacaaaagaattcttattgtagattaaatgtatgtagaagatatagaaggattattgtgtctgtttcagatgtaatttcatgcctgagaatttacattgaaggaaaaatggtctggatcccattagcgaaggccctgttttgctgtcagtttaattaaatggaaactgctggcaagagcgccgaggaggttgatagaagcaatgctattttgtatgttggaacaggaaactgttaggtcttccagtttgaaaaggatacaaaaatgaaacctgtgattcatttttgtttacaaactccttcctagtttacaatgaccttagtgataaattaactaaaataagttatacatagtgagcaggacaatagcttgatcccaagatatgaaatactaatctctgatgaagaaggtagaacttatttttatgtgactttccccctaaacaatggattcctcaacaaaagtaattgtttcctttggtttatttttctgtaagtagattgagaaaaggaggaggggtattagtttgcttttaaagtgtgtgtgtgtgtgtgtgtatgtgtgtataaaacaaaagaaagagaataaaaaagaaagaaaagggaaaaagagtaaaatagagaccctgaaacagtgatttatctgttaagtgtatttggcatcctgccttttggctggaatttttgagagaaacatatttggtttactttaatgggcaaaagctctgaacctcatttgtaggaaaaaaagtgcatgttttcttttccctttttcagttcagtttattatatcttgacattctgtcttgtaattgaatagtaattctggatttagagtggagaagaaagaaatttaagtcagtcctcctcccctccttatgtttcagagaaaaggactagctgatcccaaagttttaacttttttcacagccaccctttgaactggcaccaaaaaaatgattgtttaattttgctgaaactctgtagctgtctttgttccttgactatgctgagggttgttgatatgtttgtgtctattctaataatgcaaagtcagtatgtgttatccgatggaaattttcgatctcagttaaggaaacagattggcagtgaaagtactctattagatattgccatggtggatacatgacattttgcatttggcgaagcctgtagaactgcacaatacagaaaatgaaccttcatgtaaactgtagtcattattataataatgcatcaatattgtttcgccagttttaacaaaggtaccacactaatatattaaatttttaaatgttttgtgtgaagatactagcaggaaaaaaagatgtcagtggcatgtaaacctaaattgaattttttcctaacttggtgcagctattttatcattatttttaattgaatatatattggattgtcatcttcttgctcgttgtgttgagggggatttatcagagttacaaaaacatgaaagtttggtatatttatttcaaaaaggcatgagcaagtatttgagccatccaacgctgaagaacttatatgaggttattttctttctctatgtccacgtttttcataatctcttttaattgtgcttattttgttataataaaaacaatccatgtttatcataagacaatacaaagaaacagaaagaaaaaaattatccagaataccaccatactgagataactagtgttgatatttgcctgttattctatattttttatctgcttatatgttggatattaatttttaacattatactgtatctctagtcttatatcatgctttttttttttttttttttgagacagagtttcgctcttgtaatccaggctggagtgcagtggtgccatctcagctcactgcaacctccgcctcccaggttcaagggattctcctgcctcagcctcctgagtagctgggattgcaggtgcccaccaccacatccggctaattttttgtatttttagtagagatggggtttcaccatgttggccaggctggtctcaaactcctgacctcaggtgatccacctgcctcggcctcccaaagtgctgggattacagccatgagccaccactcccggcctgtatcatgctttcaaaaacacttaatatgctctttcacacagtaaatattcatctgtagcatcatttttagtgatgaactccactgtattctattatggaagtgccatagcttatctgactatccccctattgctggactttgggttttttcctccagcttttgtatataataaacagtgctctcagagacatccctgaagtcatattattatttctttaggataaactcctagaagtggagcttgtcagatcaaagttcaaagcagaattctcagacttttcctaggtgctggtcaaactgtaaaaaacattttcggtagaattaggatcttgtgtatattgaaaatccctcaatgattgcatttgctacagccagtgtgaaatgaacaaatttattatcaagtttcatgagaagttgggcaaacttagatatagccaatcttggacagacttgtactttctgtgcagaacatgtttctatatccagaattctatctccagctctcagactatgatgaggaaagacaacccaacactaagagagctcctgatcattccctcctctacctatgagaaccatccacaatgagcctctgagggcctatatttgtatcaaggcttccagttgaagagacatacccagtgccctttagaatgttctgggtctatgctgtttgtatgtggcgggggagg

SEQ ID NO: 139 - DNA, 13774 bp, Homo sapiens
cggctcctctcagcggcggtggcccaggtagaggggtccgcgctggcggcggcggcggcgctgttccccgcgcggtccgcggagcggggtccgggctgcgcgacgtggggcggcggcggcactgcggccccggcccaagcccgaccccggtgagtgcgaaccccagggcggccccgaggacaccgacccggtagcgggaaacgggccccgcggagccctcgccgcccccgcccggtccgcgctcctggcaggccgggctccgctcaccgccctccctttgtctgctcccgcccgcagggtcccctcctcggccgccccccgcccggccgcccgccctcgggcctccccccgggccctcggtcccctcccccgctggcggggcccggacagaagatggtgcagaagaaaccagccgaacttcagggtttccaccgttcgttcaaggtgaggcccggggtcggtttgggggcgctccgggctggaccaccggaatggccggcgtggggggcgcggggcccgcccctaagatcggctcccggggctcgtgcctggcccccgccctacacccggggctgcccgggccggccgtgcgctgaagcggggtcggtgtgcgaggatgggggttcagcaggccacagtcctctctccagccatggccgccgggtccttcctccaggacccccaagtgaggctgggagcaggagccccctccgggtcagggcaccaggctgtgtgtcccctgcaagcccccgccgggtatgttctggggggtcagcaggctgcagtcctgtcccagtcgctgcatgtggcttatggggggtgtcccctgcaagctccagctggttgtgccctggtggggacgggtcagcgggccacagtcccattcccacctccatgtggcttctggggactttctttcagaatccccaggccgggctggtcaggtgcacccacccccagggggcctgtgccgtgggggaggggatgggatgtcccctcagccctgcacttcgcagacaccccaggcccaagtgctgtttcctgtcggagcgggaagtttctgcgcagcccgggtggtgactgctgttgagtgctggtttcagatgagcaaatcttgggggggaaggggagggcaggtgctgggcaggggccccgcaggacctggcccaggggacgcagtgatgtcagccggcccgccccacccctcaggccggggttatgtaatcgcttcactgggcttccttgggcagggacctgttgcccggtagggaaggcaggactggagagaggaagagagagtgtgagtgtatgtgtgtgtgtttgtgtgtgtgtgtgtctctgtcttgtgtgtacacacaacgcggtgctccagggtgggaggagcaaagagagactgggaagaattcccaggtctgtccagccagtgccccagggcagcactccacccctgccacccctgcccagttttcccctagggcagcaggcctggcaccatcagagtgtcaggggctgggcgggaaagaggaggacctgacagtggtcttctccctcctagggccaggcatgagctgatacagagtcagtgcatggggccagccaggcagctaaagcacacttgaactttctagatggttccagccacctcctgccaaggcctgctgactcgagtcccacagccagacctagaacagtgggaccaggaccgcccacactgcccaggattgtgggccggcctctgtgcatggccagggcagcctggctgggagctgggaaggtgggcgtcttggtggaggagggcctggcaggcagtcctggctgtgaggtgttcctccaggtggccgggaccggttgctctaggaatctccccccacagcccccaccatgcacggctgctccctggattggggccacctctcctgaaatactctccttgcctccagcaggcagcagcccagcagggaggcacgtctgtgggtgccttgggtttctttccgttcgcagatgggaaagtgaggctctgagactgcaggcgcgtgtgcctggggctcccctgtacacgggcgaggaggccgcggagtctcgtggtgcctggcccctccgctgtggtggctgcggccgtccatctgtagctttgctgagttggaggctgtggctggcacaggggaacggtggccagacagggccaggagctcacgctgggctctgtggccccttaggtcatttcactctcgtgagctcccacgagttgggggcagctgcctcccgtctcaccgctgacagaccccagggtgaggtcactaggccaaggtcagacagcaggtgaactccagtctggccttagaccctggtcacctgccttgtggtggctgccccagggccaccaggggcctctggacaggagccttatgggaatgctgactcccatgggggctagttggagccccccccttccttccctcctcccccagcagcctcctggtagctatctgcccgagccagggtgggtggggaggcaggagggcagcttggctcacggcccctcccagactctgccctctggcctccacccatctcctggccttgggtctcccacgggctccactggagtctcacttctgctgaacgaccctcttgttagagccccactcaggttgtctggggcccagagaggggcagtgacttggcccagagcagccagcatcctcactgggactgggacccccgccacctctgtgggcccctcccgcctgggttcacccagacgggtgaagctgagtgagagctcagtggtacaaggaacctgaccgggcctcggttccccagcttcaaaggcccggcccctcgtaaagggccggcagtccctgcgctgggccatttgctctgtggaaacgtacatatgtatgccaccatcttccacgggggctgggcaaagcctactctaatctgcactgttccttgcaccctggtcagggtcttgctcccatggtcctggggctgggtcaagaaatgacccagccccagcctgcccagtgcaacaggcctggatttgaatcctggcccccagggcccaaggcggcttccttagccgggtatcagggcccaccaggggctccctccaggggtgtctggcactgaaatgggagagtgcaggatgtggtctgggcagggcctggcacactcgcgcctgtgggtgcctctcccgtgagcccccaggaccagtacagcactgtgtatactgactcggtaactggtagctgcggggttggggggctggaagcagatgagcctctggtgggtggcgggggcgtaggtgcacagagctggcaggggaaaggtgtgccgggcagctgcgggacatgggcggaggaatgcaggtgtctgggcttgggtaggggcagaaggcaggggtgatggaagcagagcccccaccttcagcaggccccagagcaccaggcactgaattcttaccccgccagccccaggcactgagcgaaagggaggggagcagcttaggggaaggagaggtggttgtgtgccatcttagatgggggaaactgaggcccagggaggactcagctgccctgagatggcccaggaggccgtgggaaagcaggcacagccaccaggctggcagcccgcctagtgactcacctccttcccactgccccgctgcctttgatccccgcgacccgccccagaggtcagccgtccccattctgtggacaagcagacggaggtgcaagacacggcttgggccccacggtgactcaatcctggcatcagaggcagggttcccaagagccagctgcttgtgtctgtcccctccccgcaatgcacccctttcccagaggcccccagggctctgcaggtgggaggaggtcttccccacggccctgtggaggttggggcccatctttctctggggtggggctgtcctgggcactgcagggtgctgagcagcacccctgccccaccccactccgtgccaggagctcccccaaccggtcacaaccacagatgtccccagacatggcccagtgtctcctgggggacagaatcaccccctgggttggcaaattccatggaccccctaagagactctgcgtcccctgatcttgccttgctgaggtgctaggaggcctcacgccttccacatgtggcccacacctgtgatcccagcactttgggaggccaaggcaggaggatcgcttgaggccaggggtttaagaccagcctgggcaacgtagcaagactttatctctacaaaacataaatttaaaaaagagagaaatccacacacacactgagtgtggggcagcgaggaggtgaatcccaggagcttgggggtcccctggtttatgctgtctgccccttcgggagttgatcctggtgggagttgatcctggtgtgtgagcggggacggagttgatttttccgtaatgctcagcgcagggcttgtcagtgtggacgctgcgacactggggcaggataggtctccctgctgcgtgggcagggatggggcctgagtgcctctcctctcctctcccctgcaggggcagaaccccttcgagctggccttctccctagaccagcccgaccacggagactctgactttggcctgcagtgctcagcccgccctggtgaggggcccgagggggaggagggcacagggcagctgctgtcgctgccatggcagtggccagcccctgcaggggggtgggggccggccggccagggccatgtcctgagccccctgggcgtgcctcctggaacagacatgcccgccagccagcccattgacatcccggacgccaagaagaggggcaagaagaagaagcgcggccgggccaccgacagcttctcgggcaggtttgaaggtgagcggggatggcgggcattgggggagccgggagcggggaaaagccagggtccctctcacgcccgccccgctgcccggcagacgtctaccagctgcaggaagatgtgctgggggagggcgctcatgcccgagtgcagacctgcatcaacctgatcaccagccaggagtacgccgtcaaggtgggcccgcgccgcgccctggggaacccagcgccttgggatcggtgttgagcgggggtggaaacagtgtgtggcattccggctgtccgtcctacagccgggaagacccgtgtctaaaagtggccaccgggccctgagtccagtcgggaatgacagtgagggtggcccctctggtaccagggtgggggcttcagacagaggcactgtgcccattgggtcccctgggccgtccctgcctctgagctgtccctgagggtacatgacagtttggtttcaaggatcaaaatgcaatgtcatatcccagggcccagaggggctctgcgtttggggaacctcagtgcaggcccgtgagagccccctgtgtcactctagccctgggcggctgctggacccagggtgtggccgaagggctgggagcaggagccctgttgaggctctggttgtgaccctgtgaccttgtgggccggttggatcccgtgttccaagaaatcttccaggcttccctcgtgacctggcatccggctcccgggctgggtggggtcccaggagggctggctgcctgggaaagagggccaggtgtgccctggcgagcagggctcgccaggagcctgtgggtcctggtggacggccaggctagagctttcctctgaggagaaggaggaagaagaggggtggccaacctggggaggttactggctaggtgctgggaccacagtggcagcaggcagggacagacacagtacggacggtccctgcctcctgggagcccccaggcaggccaaggcaatggtgcaggagcactaggcccctccggaagcacttccacacagcaggcgttcctctgagcacagccctctcctggtggcccagccttgcttcctgtctttgtttgacagatagggacactgaggctcagggggttaggtagcctgactcatgctgtgtggcctctgggggatcctaactggtgtctcagagccacctccctggtcatcttgccacattgacctggtgtggtcagtgttgggatctgcagagcctgggggacttcctgctggaggtgttgttggccactgacgtccgggagttggtctggccaggtggcagtgggaggaggaggtgtcctgggcgagtcagagaggcgaatcgctgggcctgtgggtctgaggagcgttgtttcgttctatggggactggggtgtgggccctctgccctcggggtcatgctgcgggaagccaccctggggtcacctggtgccgtgaggctgctggctggatgcagagcccccatgctgggacctcagaataggccccttccatgccaggaggggctgcgccccctccctgaagcagcattctagccagccacccaagggacaggacgaggttcagttttgtccagaaccatctgcagtgcctgctgggcacagctttcagcagcggcctgggtggtggtatttcaggacaccctggcgtccagttgttctcttgcccctcgctgggacagtgttgtctgtcagtatagacatgggactgcagaggcaggagccagggactcaagggtggaatgccacatccctgctgccaccaggccatcgcactgggcagggaaccctgggcagagtgctcatgcagccaggcacccgcccagtgagaggggctaacatgtccagcctggcaggagggtcccagcaggtgccaggggaagctgcagacgcctcctcaccccacctctgtgagtgaaggtggcagggagcagctggagctgctgggggcagtagagtggcttcctgaggctctggggctcagggaggctggatccgccagtggctgggacagccaaccagggtgggcccgaaacagatattggctgaggcggcaggcaagtgtctgcccaggctggcacggagctggggagcaggacttggtgctgtggccacatgtgaggtggggcctggtgggctggcagccaggtgtcctgaggcctccctagttctatgggtgaccaggtacccaccctgtggggaaagaggactacagctgactgtctctgggtcagggagggtggccgcccagggcagggaaccctcacgtcctgtgggggtattttgcagaagtcataggtctcaaatgtgtctctgagggctgtcagggtcacaggtggagagcagcctccactggctttttttttttttttttttttttttttttgaggcgaagtctcactctgtcaccaggatgctggagtgcaatggcgcgatctcagctccctgcaacctccacctcccgggttcaagtgattctcctgcctcagcctcacaagtagttgggattacaggcgtgtaccaccacacccagctaatttttatattttcagtagagacagggttttgccatgttggccaggatggtctcaatctcctgacctcatgatccacccgccttggcctcccaaagtgctgggatgacaggcgtgagccctgctttctagagttgcagggcgttaagtgtggtgaattccagccgtggcagtggagtttctggccccttctcgactatgagcgtcccaccaacccaggtgctgtgtcctttcgcctgtttcagatcattgagaagcagccaggccacattcggagcagggttttcagggaggtggagatgctgtaccagtgccagggacacaggtaggtgagccacccttgccaccgcactggcctgagctgtctttcagtggatgaagggcctgagtgccacatcacccccagcaagcgtctgtagggcacccagtttcccaggccctgcattcccctccctgaagcaggctggctgacagccccaggcgggcagtgtgaagctggcctattgccccagtcccagcttccggtggacaggccagcaccaagagggtgggcccctcctaggccgggcagcaggtacccaggggcctcaggaagcctcagctcctctcctgcccccacccccaccccaggaacgtcctagagctgattgagttcttcgaggaggaggaccgcttctacctggtgtttgagaagatgcggggaggtacctgggggctccaggctgtgaggagggagggagctgggaggtattacgggatgggggcctagtgccacctgcaggagggggcttgtggggtgagtgtcctgcccaaatggtggctcaggggtgaggcctttgtgctggaggaagccagtgtgggggcgtccccgccaaagtggaggtgggtgctggccttgaggggactttgaggtgacctgcgtgttccccctgtcctgccctgccctgccctgcccaggctccatcctgagccacatccacaagcgccggcacttcaacgagctggaggccagcgtggtggtgcaggacgtggccagcgccttggactttctgcataacaaaggtaggtggtgaccccgcccggagtctcctagggccgcctgccaaggactcctggaagacctccagaccctcaccccgtcgtggttctgtggcttctcccccaggcatcgcccacagggacctaaagccggaaaacatcctctgtgagcaccccaaccaggtaggccagttccggcagggtggccccgcgggaggggtggaccgcgtgggaccccaggctcacggaccttttggcccctcccaggtctcccccgtgaagatctgtgacttcgacctgggcagcggcatcaaactcaacggggactgctcccctatctccaccccggagctgctcactccggtgagggcccgcggggagggctgggggctcggccgcctgctctgcggttgcataacctcgcggagcctgggccatccagcagctccaggccgcggagctcgggcttccgcctagcaacagccgctgattggttgggcggggtgtcgcggcggggcctcgagcaggcgccccaacgcgtcggtgtttggccgggtggggcggggccgcggcgggggaggggcgagctctgcacctgctgattgggcgggggcgcgttcccggcagccgctgattggtcgggcccggcggggcggggtccgagccggctggcgcaggtgacccgcagttacccgggctcggttcccacgtaatgctgggaaaccccggctgacgcgcccctcccccgcccgcagtgcggctcggcggagtacatggccccggaggtagtggaggccttcagcgaggaggctagcatctacgacaagcgctgcgacctgtggagcctgggcgtcatcttgtatatcctactcagcggctacccgcccttcgtgggccgctgtggcagcgactgcggctgggaccgcggcgaggcctgccctgcctgccaggtgcggcggcccgcgcaccctcctctcctgggcaccctcctcccccgggcctgccctgaacaccccctaaccccaggggacctgccctgcgcaccctctaagtccaggggacctgccccctgaccaccccctaaccctcggggacctgccctgtgtgctccccagacccccggggacctactctgtactccccctaacccctggggacctgcccggtgtgccctactccctgatgccatccacagggcagtgccgccctgtctgccagtttcccgaaggcttttcaggtttgcctgcccaagggaaaccccagacagggttcagagagctgagaggtggagtgaggcccctggtttggggggatcaggctcaggctccctgcccgcggcttaaggctcagcatctgtggcctgtggtccctggaaccaggtccctcagagctgcttttttgtaaatccagctccacttgggtggagctgactctcctggtccggctcccagccccctctgccccaggcgtgcgtggtctagggcctggtctagggcctggttggggtccggttggagccacgtgtcagtgcacagtatccaggcccttgggcaggtctaagctcccctgtgttctatgtccccagaacatgctgtttgagagcatccaggagggcaagtacgagttccccgacaaggactgggcccacatctcctgcgctgccaaagacctcatctccaagctgctggtccgtgacgccaagcagaggctgagtgccgcccaagtcctgcagcacccctgggttcagggggtgagtaccagccgcacgggcggcaggaggggtatgggggcgctgcagggtggcctcagagcgagcatgggaagccctgagggtgtagcctggacaccctgagatgcactgaggcttgagagcacaggctctgccctgggatgaggggtgcagccgaaatccccaccgcccgcctgtgcacggtgcccgctggccagccaggcggctcccaggagcagctactcagagaaccttcctggagggtggtggggacccacagcctgcagcaggctggagcgaagcgggcagcgagcccagctcacatagaccccagcctagcctgccgtcagtctcaagcccaggctgtgcctccacccttccctgtgtggcctccagtcgaggaggagtcgggtgtttctcctgccagaggtcatctgagctgagctgccaccccagggagtgaggatttactaaaaatagaagctggggtcactctgtgtccccaggcgaggggctgggggcctccaatctccttgcagaagcatccagagacccatgggttaagaggggggcggaggtgggtttgggctgggaacagccgggagagatggggcttggggctctgcccccaccctcactgggtcctgtaacaccaggcctcagcctggcccagcctcgggttccctgggcagggggacatggagcctcaccatagggacctcggggtgggcgcttggctcccggggcacccaggtgcactcctggtctccggtggggtcctggtgatgggatgggcatggcatcccttggccagacaccccacccagcgccccaggcggccccagctgctctccagccctgcccccgcccactctcgttgcagtgcgccccggagaacaccttgcccactcccatggtcctgcagaggtaaggcccgcaggggtgctcgggacccctgagtccagggggcggggtttccaggttaagacatttgtgaaagacccggagaactgctttggggtcggggaggcaggcaagcctggtgactcagtgaagctcccggtggggccctggtgctcagaggagccccagggtgggggctgggaggggggcatgaagccccttcccccagggccttcacagaccccaggggtcccctgaggggtgcctcttggtgaccacctacccccaccccgtttcccaggaacagctgtgccaaagacctcacgtccttcgcggctgaggccattgccatgaaccggcagctggcccagcacgacgaggacctggctgaggaggaggccgcggggcagggccagcccgtcctggtccgagctacctcacgctgcctgcagctgtctccaccctcccagtccaagctggcgcagcggcggcaaagggccagtctgtcctcggccccagtggtcctggtgggagaccacgcctgaccctcccatctcccctctgtacataggtcacccgtcccccaatcaaatctaaaggttttttaagctatcgccagccggtgtccagcgggctgcccctcctctgcctggattcccaggcactaagctcagctgaggggggtgttttatagaaggtttttgcttttgggttttttttttcctgtttccacccctccccgttattttttcctttggatggttaaaagcattgcaggcacccgggaaggtgagcagagggtaggtgggtgggcttgtcccctccccggtcccccgccctgctcacctctactatgaaggtgcccccaggtcacctgtgctgcccgccatctgcccacgtggcttgcagtgactcaggagagcaggcccacagcgtttgccatcttgcagagctggggaggggcacaggaccctgccctcgtgttccctcccagcccgcagtatttcagggacaggctcttcccctctatccctcaccctgagagcacccctggtggcttggttggggaagggaggggctgcctgtctctggaggtgtcaggcaggcaggtggcaggcagctcacccacccaccccatgggatcccccagcccttcacccgcgcctgccttgtccccatgatagttgacaatcggggcttcctgcaaggcccgtctgtctgtccaggactcctggtggccagattcggcctccgaccttgaccttaaactgcagctgaccccaggggctcgccgctgcccctcccctccacaccaaggcctgagacagcaggagccccgcctggcccgaagccgtttccaccgcagcaggcagaggggctggacaggcactgtcagccaatgtggggggtcctgaagacacccccttggggcacccgagtgccccttctcagggctcagtctgaccgtagccacgtcctgcctcgcgccgcccctcgggcctgacctggaagctccgtcagctccgtccttgtccttagagctgagcccagaccccggggtctggccgaatcctcacccccagggcagtgtttttggtctgccaccttcaggaaaacggctgcggcctcggcctcccttcgggcacccaggaatgcgggggtctgctcagtccccccaccctccatgctccaacccccgggggctgcggagcctgctgccccctccccgcgggtggggacgttctatgcaatacagggttccactttagaagtgcgcgcggctagggtcaccgcccgcccttcccggcgcagcccccgagctccacagctggggcagcccctctggcttctaaatccgcggtcgggattcttcctcctgtttagttttttagtttttccttaaaaaaaaacaacacatcgatggactttgcttccctgttcttgaagaatacttgaatgtcggggggcctgggggtgggggcctcggagaccgtctgcctggccctgctgcccctcctgaatctcgtatgatggtcacagtccggtggccgtgggggtgctctgccttccctggtccccactgcccatatctgtggactgccccttccaaagacccctggggggggtggggcattccgcccacccctttcccccatcacttctcgcctgtcagtgattccatgtttcgtaacgggggattctctgcctttttgtatcaaagaacaagcaaatggacccccgcccgctgcaggcgcccatagccatcgggtctctaaagctgagtggctagcagcgtttgtttgtttgtttttttttttttttctgaaggtgggacagtcacttcctcctccctccccacccctgtcgcatccacgtgcgacctggaggactggtcagaaccgttactgtgaatgagtgaagatcctggaggaccctgggccccaggccagctcccatcgctgggggacggtgaacggccatgtgttaatgttacgatgtttttaaaagacaaaaaaaaaaaaaaaacctcaaaagtttttttaaagtgggggaaaaacatccaagcactttaattccaatgtaccaggtgaactgacggagctcagaagttttcctttacaccaactgtcaatgccggaattttgtattctgttttgtaaagatttaataaaagtcaaaaaacttgc

SEQ ID NO: 140 - DNA, 4244 bp, Homo sapiens
gctgcgcccgcccgcgcccggggtgatgcagttgccccccgcgctgtgcgcccgcctcgctgcggggcccggggcggcggagccgctgcctgtagagcgggatcccgcggctggggccgcgccctttcgcttcgttgcgcgccccgtgcgcttcccgcgggagcaccagttcttcgaggtgcgtgagcaaaagagggaaaaagtagttgtaggatccagtggggcctacggcggcgaggcggggccggagcctggagtgggaggggcctacgactgcggggcggggccggagcctgggacaggcgggacctgaggtggtggggcggggccggaacgtggagtgggcggggcctgaggctgtggggcgggaccggagcgcgggatgactggggccacgggtgtgggcgaggcctgacgcggtgggcgtgccgcgagtcacctggccccgcccacggcgcacttttcctgcaggatggggacgtgcagcgccacctctacctccaggacgtgatcatgcaggtggccgacgtgcctgagaagcccaggtaagcgaatgggcagtgcctagccagtgctactcctgcgccgcctccctgaccggtgcctggtccctggggctgtgctgccgctcttccatgtgcggccgccccaccgaggcgctgtgcctgtccagctttggcgtggccgactcttccaccacctagcctgtttgtgaaacttaattcataaaaagagggtttgggattgcaaaagatgcataggggctttattggacgtctcaaagggaaactgtgcagaaagtccagcttggttcctcgcaccggaggaagggctcctgaagcacgtctccttggcagggtgcccgcgtttgcctgccaggtggccggctgctgccaggtgttcgatgccctggacgactacgagcaccactaccacacgctgcacggaaatgtttgctccttttgcaagcgggccttcccttccggacacctgctggacgcccacatcctggagtggcacgattcgctcttccagatcctgtctgagaggcaggacatggtgggtgacaactgcacagccgccgaggccaccccccattggtgatgggctcagagtgctgcccccagctctcgggtgctcgggcaaggccggggacacctttccgcccttggcagctctgctacgggggcatggcggtgggggagggccaggggtcagagggaggtgacacggtctccatttcagtatcagtgcttggtagaaggctgcacagagaagttcaagaccagcagagaccggaaggatcacatggtgaggatgcacctgtaccccgcggacttccggtttgataagccaaagaaaagcagaaggtagggagccgccaggctcagcacgtgtctgcttttgattttaggaaaaggtttccaactagccggaatgcatagacggtcagacttattaagcacttgtgtgtcacctaatggggtgttcacctgcaggtacctgaagccctggcaacacagctacaggtggttgtgccagcggccaccctgccgaagggaggctggaggggagcccctggctgcccagctctgtgccggtggaggcagcagagggggtgtgggaatgagcgggcgcagcgcctccgcactcacacccctctgggccatgcctgtacctcctgcagcagtcggccgtggtcatccgcactcacacccctcggggccgtgtctgtacctcctgcagccgtcggccgtgctcacacatcatgcagccctggctttccttttgtcctggttggttgtgcgcatatgaacttgatgacaaagctgttgattaacatgttcctgcctagagtgcactctgggaaatacttccaggaacaatctttttttttttttgagacagggtcttgctctgacacccaggctggagtgtagtggtgtgatgtaggttcactgcaacctccacttctcaggctcaagcgattctcccacttcagcctcctaaagtgctaggactaccaacacgcatcgccgcactcggcaaaattttctattttttgtagagacagggtcttgctatgttgcccagtctggtcgtgaactcctgggctcaagccgtccatctgcctcagcctcccaaagtgctgagattgtaggtatgagctaccatgtccagccggaacaatttttaaattgtgttatatttcttctttttttaactgatgaggtgaactttcataatcatctacaattttattgatcagagtttttcagactctacattttctcaagtagtaatttgctctttaaaataaaagaactgggagaacccactgcaatgtgggaggctttacaaagacttacgtgtaaagtaattgtctcctttccgagggatcattttaaggagaaaaaccgtgcaatgctggattaagacattcgtattatggaagagactagtttatagtctctggttaactttagcaaatttctcacactcataaaaagacccgtggcaccgttggcaccataaaaatactattttcaaaaaaaagtatgattgttacagttaagtttataagatgcagactctattatataaacaatggccttgctgtaatcattctccttttcccagtatcttaaaccacactataaaatcagactatgccaaaatagtaagaaaatatgctacttacagggaaatccagtttctttcttgcatgttcatttctggggaacacaggggctgtgggagccgtgcagggcagttactcactgctctctccccgcagcccagcctcagcagaagccccaggggacagtggagagcggtcagaaggggaggccatggaaatctgctctgagcctgtggcagcctcccctgcaccggcaggtgagaggcggatctacagacataggtcagtgtctgagctctttctgaaacccgttctcaacatgtgttcggtgctgaggattctgggctgcacctgggccgcagctcttctcatactgaattcagaaaggtaacgctgggtaagaaaatcggcttccgccagagaagaaagtccagatatctcaggtcctgtgaataacttagtttctctcgcatactctgtttttgagccattgaagcgcaggaatgccaagcaccactcacttttcctcattgtctgagtgggatggaaagagtctcacttgcagttgcttcagtcacaacccaggcgtctgccttaatagcatcacctgtgccgtctgcgtttctagcgtcacctgtgccgtctgcgtttctagcgtcacctgtgccgtctgccttcctagcatgacctgtgccgtctgcctttctagcatgacctgtactgtctgcctttctagcgtcacctgtgccgtctgcctttctagttaaagttgattttaaattaatttgggaaaaacggtgaacaagtggggaaaaacatcaccaaagactccaaacaggtggaacgatgaacttaatgttccctgcaccctccttacagatgcctggactttggcctgtgaatgagccccggggggctgggacagtaggggttttcatggaatggacatggggtagcaggaagtctcagccccagagggcttggcaggagccgccctctctgcggagttcttcccagcgggtgtgcgttggtggctggcggggaccccccacaggaactaggtctcaggctgtggaaagggagctgccccagggcccaggagggccggctctgcattccgcatgttcccagagtgaaagagaatgagaaggagacacacaagtgctgttatgacctgggttgttggttggcaaatacagcatctaatagaaactttcttccatcccagaataccctctaccatctgctttggtcagggtgccgctcgaggatttaaaagcaacaagaagaaaaccaaacaatgctgatagactcagaaaaggagtggggggcagtcaccactgctgggcgtggcatccgccttgggcctttctccgaccttctggtgtggccgccctgggggccaggccctcgccatcctccccatccttgttcctcagcaaatggcattagcagctgtcatcagaagctgtgagggacccacagattttggaaacgacctggacacactattgggaaggagatgtggacggcctgtctcctcctgcagggcccaccctaagaatgtatttttaaacacatgaaataagtatttttcactgat

SEQ ID NO: 141 - DNA, 71470 bp, Homo sapiens
aacacaaacacaaacacgaacacgaacacgctcagcgtccccggggagggcggactgaagccacctcaccattcatcgcccctggaccccgcagtccccctcggactcagggccagagccttctgcgaagcaacctagccccagggaaacggtagcggccgcagaagccccgctctctgtaacggccgcggaggagcagcaagcctccctgtgagtcggtgggagacaagacggagcggcggtaagggcggtagggaagtgaagcgcctctctccaccttgttagaagcgcgctgaaagcggcctgcctacccaccccatcgctgccgttttgcagtcgtcgctcccaccttccgctgccgcctggagggaagccggagcgacgggggtcacggcggcggtcagagggtaaaggtcttgctcccagcagcctccgcggtggatacgtcgccatcttggatccgcgggacaagaaaattcatgcggtgagtttttggtaaattttcggaagtctggcagcggggcgcgcggcgggggcggcagattcggggcccccgcaaggcgggggaatgccccggggccggtccggtcgcgcccagggtccgccggtagcgtcccggcccaccgcttcccgttgcttttgtctcggctccaatcgagagacggagagcggagcgggcggggaggggggtggcggcggtggagggagggagggggtgtgtatgggggtggtggtggaccggacgtaaagcgtcgctgtactcgggccgctgcagcagcagcagctccagatcctaggcccggtcccatccgcgagtggtggggcttccccagactccactcccctaggctcccgccagcgcggaggagccgctgccgccgcgctgcttcctgggggagaagagaaggcggcagcggccgtggccgtggccgacgagctcgagcccgctttagacggctctgccgccttcccggcagctggtgctgtctgtggcttcttaccttctctcaatacacgtatatcatctgccagttatgtgtatttctgttagtgtgtttgcaagtgtcagatgggagacactggactggctaacgggtgtcaggatcctgcaggccctgggataccgaaggctgtgcatggtggagggagaaggaatgcaactgcgatgccgcctctgccaccgcaccaggaaggtgaagcttccgtagtgtcgtagactgagtccggatgatcctggggcggcggaggaaccacagacgcttctgtctgtgaagttgcaagtcctgggtttctacttccgcaggggcctctccaccttttgctgtcgtaggtctcgcttaaaagtttaacagaagaaaagagtagggttaaaagaggcctttgtagttcttcattgaagcactgttgtctgtccgggtgaaagctgataactcttggtaactgtggtccttagcaaaagagaattggagttttcttttatacaaagtatttccaaggttttagaccttatatttattccaggcctgtaggtacggtattactaccacaaaagtcttacattaagggtaccaccctctcagagggaacctaaacatcaacttccttcgaatccttggagacatcttcacttttcaacatccggaagactgagtgcaacatattttgtttcattttcataaaagtcttggtcagagaatcccactccttttaaaatcgtttgggcaattcctcataattaagtacactgctttgaacccttagttcttggcgaaatggtaaaaagtactcagttaaaatcagttcacgagggaggccaacttgaatttaaggttcaaagttgaacatatttagtgtcatgcttaatattaggaatttttagagctcggaatcataagtgtgactgttgatttcccttttgaagcaatataaatggaaagaataaagtatggggtgagggatgagatagaaattttaaagtatccatttacatgcaaggttgatgttgagtttgggaatgcttggcataattgacaacagttctttccaaacgtcaatgaataaatctcacaattttgtaaggtaactattgcagattgaaagggttaagaatcatagttggctgaaatggttaagtgtctatattcacatcccagttcattgaaatgttttataatggaccaagataattagtaagctctgtatgttgaatttgtttagtttgtagttctattataatgttaaatctaaagaaaaaaatacaaaatacacttaaagacaaaacatgttccactctactcacttatttcttgactttgtaagatccttactgtaaaaaaggtacttttctctcatattttctgagagcttgaattgtaataatttttgtgaatactttgtattttagagaggaagtgagaaactgctgaagttttttttgcatcttgattagtgctttatcaatacaaataagttaatgtaaacatttgttggcaggaatctttttctaagtatacaatgtagagatatctgtaacctaatctgatctcagggaatgagaattgcctgtttaaccaagcaacaaatacagcctatacaatttttcaatttctataatactttaatttacatggtggaaaaatgagggcaaaatgcttgtgtatgagtgatttatatccccaagtacctgctcttgaagataaaactcagattgtggcttatcttctgatgctgggcaaaaaacaaaaacaaaaaaattcagaatgatacaacttcccatatacctccctacaagaactaattacctttgtttttgctttataactttggatgttgcactttttgatttttcagagatgctttacagttattgtaatctgaaaattatttgttcaaaagtaaataaaattttcaggtgtatgaatagattttattagaagtgattctaacccagttctcatttgtattcctttagtagatactggtgttaaaagtacctgtattttgaaagaccattacagaattttttacaacctgtataagttatagttttatcttttctagtgacagacttacttcataagattttctgataatatgaataaaatgtatgcttcacatgtatatatgaaataatgagtaagcattaatagaccaatgaaaagaacttagcttacaatttattttcttgctctttaaaagcagtggtaaataatagcttttttttgttgttaaaatttgtaactgtagaaagttcattctgttgggatcacatatttgaaggcaaactaacaatgccatgtgcttgcttgaataggcatttgaggacaggttattttcctgagatttcaggaaaatataccaccaaacatttatgatgttatttgttacctggatctgtagtggattttgtaacacaaagaggcagaatatccagggtaccaggtagggcagtttaggggcagagttaatatgaggtgtactgtaatgtttgagtggaattacatacagtgttaatcaagagatctagtgctatggtagaacttattctgcttgatgatacaggtgactgttcttccttactaagagcagtttctacctgtgatacttaaagggattgaatttcactgtgacttatatcagatattttgaaaagagctgtgctaaagttgatgtcattgtagaaagtttgccttgaagtggaatgaaagttaggtttttatttctttggtttttctgtttgacatcctttgatttctattttagaattcaactcttatgactaatcatgctgatgtggtttgttcatttattttctttgtctatactattaggaatgtcctggaaatagaatttgtactgtgttttctgagagcttgttctctgaaatacagatgcaaatctgttggtatctgttggtatatcccttgggggtgtgctgcattataaagtaataaaacagtttacaatgtttgctttttgtcaagagcttatgacatataatatggaaatacaaaaaagtgaattatttaggaaaaaatgggaaatttttccttttctgggcacttcagggttttgtatatgcgtagactcaggatctaagtccacttagatatatagttagatattttggactatttgccacttaaccctgcacattttcttttccttattcttttttttttttctttgagacgaagttttgctcgtcgctgaggctggagtgcaatggcgtgatcttggctcgctaccacctccgcctcccgggttcaagcggttctcctgcctcagcctcctgagtagctgggattacaggcatgcacccagctaattttgtattttcagtagagacagggtttcaccatgttggtcaggcatgtctcaaactcctgacctcagacgatccgcctgcctcaccctcccaaagtgctgggattacaggcatgagccaccacgcccgtcctattctttttattcatgtgtatgttattgcatgtatgtgtgtggggggcaggtggtagtgcatattttatgtatctttcacttctctgttgtttgatgaacttcttccatactcctctttggtatcactttcttcataaatctttcctgactccccaaatcctttgctgtattgctttttactcttcaaacttctattatagaatgtcacactgtattgtaatttactgtccatctggactgggagcacctgagaggtatggccttgacttgtttatgtttatgttttgaatgcctctatagtgcataatacttaataggttctcaatacgtatctattaaactgaactgttgctagattgtcatttgacagtgctgtttcacaatccacagatctgaagcaacagattggaaaagtggtggggagaatagcttcctgtattccttcacttccttgaatcctttcttacagttttgcttcttaattacatatggaaaaatagataactagcttcttagggaagtgtgtgtaaagttagtatggaattagggaaggatgttagtaatagagtgattaataccctgttttgcttctggcaggatgtttagatctgtatttcttgcatttctcgctgtattttgtatggttatggctattatgtgaaggagatattttgtatttgtctttacaaggtatcatgtttaccagtacttacccatgagctcatattagatttggggcttctgaagatagattctgtttttctcacctttttcctcctaatgcctggcccattggttagtagaaagcaggatttctctagtttgaataaaattgcccttatggaaataaggtgagatgtgtcttattggaggtccaaaatttaaaaagctctgaaagttgatcatttcttttgttttgttttgaataagcaaggtgagaaaatatcaactggaattatacctgtgaatttgattattattatctttcttaatctgattttcctacattttcatatggaaatgttcacgtgtttgactgcaggtgttgccattggcagatgttacatcatatatgatacatacaacattttacctttctcaaatctgaaactgtgttttgagaaacatctggcctttataggtttgtttaagagattgtgagccaattttctgcccattttagagatgtagaaatcaaaacaggatagatgactctcagaattgcattttagtagatatgctaatattgataatgattttaggaatattatgtcttaattgcctgtatatgttccagagaccttttagtgactaagagctgccaaagatacagagtgtatatttttaaaaagggagtatgatccagtactcaggacaccagtcctttctctgccttttctgaatggaaatgtctttccttatacgtgagtagatgaaaatgcacatttagtaagtttttactaaaacttagtaaaaactaatgataaaatgagtgagggaaaattatgtatcctggcaatttaggtaacagtgagtagacttgcttgtttttcaaacatattgatatactatttttccatttgtgtattcagatgttgaaacagctccagtttgtattagcatctggacaaaatgtaatgactgattatgtaatacaatgtgtttgagagaggagcatttggttttgtgtcatatctggcaagaatgtgcttttgtattactttctacattgtaaattataatgcctatcctgcatacaaattttgtatttagttttctgcttgtaagaatctttcataggtcagtaaaataaaatattaagtttactatgccattccaagcacctgactacttttggctttgctacttaatatttttaaaatgttttacagcttgcagagaggacttttatatacattatcttaattttatatatattaaaataagtttaaaacttagcatttatgtttataaacaagctattttggtcaataagaaaattagaagttgggaattatgaaggccgttttcatcttcagactggactcagagtctaatttctttctcatttattttagcgctactttatagagaaaatcgtgatttattaaatcaaatagatgttaatggaagacttgtttttgtttgcatctgatcatcttgcagatcctggatatttaatcaaattgatgcagaagtttgaaagacaagcagcagtaggaaatttttgtttcaagcttgacttttctgacaatatccaacagctgctcatatttttaaaaattagaaacattcactgagaaacgttaaaaacttaaaagcaaatactgtgttataatgagaataggtaataacatatcattgatgctacactttacatattattgcaccattattctgaggtaatcatatgccgaacagattactgcacaaagtaatgctttaggggtgtagtttttatgggaatgaacatgtctggcctgaaattagaaaaaaaattggagccataatctttctaatctatgcttgcttatgagaaattctaggtatatttatgtcaggccaaactatttgctacagcaaaccggttaacctgacatctgagatagtctttaaagtgtttaagtttggtatacaatgcacttgtgtgtgtatatgactcatcctaaaatggatggatgtgtgtaaaaaaattgtaatccaatgcttaaatgaatttgtgaagcacaaataagtgaaacactaagatgtttcagagcatagtttgaaaatccctgtgctcgatcaccaaagtcacttccaacagtaaaattctgtgtattttaaaagttctttttctattccctgcacatgcaaaattcatataatttagctgctttttagtagtatttggatagaaattgtttattaaatttaaagttgaggctctgctggttatatgttagcactctagatgttttcaagtaaatcctttagtaatatgagtgtttagtctctgcttgacattgttattggatatatgacggtgatccagacaagtctccaccttcattaatgtaacattctggaggaggagacagacagtaaacaaataaataaacataatttcaggtaatggtaacttaggaaaaaataaagggggataaaggtacagcaattgattagaaatggaaaaaagattaagtagggtgatgagagaagacttctgtggaggtatcagttgagcagaaaggagtaagccatgcagaaatgtggttgaatggttttccaggcagaagtaatagaaggccctgagatagggtcaagttttgtatgtttgaagataagaaatttcataaacaattacttagtgctttctgcataaatgggggtaagctctaaaggggagaagaggtgattaaagcataatgatctgtgtctttcacttcagaaaatattgtggtggacccagtaatctgtaataggttttacaaagagcaataggaaggagggattattttttattaaggtgccttgaaattgttttctacatcagatgaattgcaggggttgaggggtggtctgtctggagtactggaaaatgacataggaaagcaaactgaaaactttccttaattcatgtgtttatgtagaataataaaacctatacttttcttagaaattagtaataagtttcatatttaattagattttcttgtacagtccaataaatgttactttgtgctgtgcactattatagttgcactgcgtaattcctcaagttaaatttttgtcatactgtagaaacatcctagagtagagtaactttgtttcagggagttaatgagttggcttcaaggaggtgataagtgagctctgggttctgaagggtgatttgtagttaactaggtgggggagggtagggaatcagcattgtaaatgcacaaatcctaggaaaatgttctagatttggagaatggtgaggtaatcctccatagcccttgatggaattctgggacctcataggagaagttagttgaaggaatgaagtagccacagtatgaggtcttatcttttatgtgatgagggaaccattaaccattaggaggggaaaaaaaagccagtgagattgataagcagattcgtgtttcaggggaaagtttagattccacagtcgatttacaattaaaattataagcttaatggtgtatgtttatgacatttttgaaagattattttctctccattaaacaaattgagtactttgcattcatataagcaggatttttatttgttaagaactgtatgactttgaaactctgtagtctatcttttagagaacttgttatatatgtaaatgaatgccaactgttcaagatttttccgttactggggtggaatttttgtatacgttttggggcaggcaaagtttgagtattatcatctgatgtaatgtgttaggcatgagatttaacattcttggataaattgaaataataccaagaaaatctaaatcagtgataaaatccctacataggtgctgatatttatgttatgttactagaagtgcttattttacaatgctatgatatgtgtttgtgtgtttctcaaaatatataacacttggatatattaggttgctagcattatctgttaattgacatgcagaaacaaatcctaaattaatgtttttaaagagaaagaattgcttctctgagaatgtagtttcagcaagttatttttatttttatttatttatttctttttttgagacaggtctcactttgtcacccaggctggaatgcagtatcatgatcacggtgcactgcagccttgacctcctgggcttaatcaatcctcccacctaagcctcctgagtagctgggactacaggcgcatgccaccatgcccggcaaatttttgtatcttttgtagagacagggttcctccatgttgcccagggtggtcttgaactcctgcgctcaagccatctgcctgcctcatcttcccaaagtgctgggattactggcctaaattattgcttttattgtatgcattatatactattttatcataacaaaagttaatggttcaactatggcatttagagctgcccacgtagcctgattgtctatttagttcacttttgactgagtaaaatggagctgatctatctgctattaaagagagttatattctgaaattttacatgatgttcataatgcctggaactaaccagcctgaaatggaatcaccgttgtactgttttcaattggctaggtgacttattctccctatacttcagttttctcatttgaaaaatgtagataaaaataaataaataaaaacaaagaaaaatgtagataaataacaatacttacccagtagaactgatgtaaggattaaagttttttgtgggttttttgttcgtgttcgttttggagtgggacttgttaggttaaagaggagcttctggggtatacaagaattagccacaatttatttcatagagtgcactatactcttttttgtatcagattcgtaaatgtaaacaagaatgcagtcttgctcttagagtctaaacatgtttttcctaccaggaattttgtttagatgaccttctgtgaagtaagatgtgtaatattttgagtaacataaataaatcgtcatattgctctgtctgtagtacttggcaaagcacagggcacataataggcatttaataattcctgtgttaagtgggataaatctaatgggttaggattcagacagactggtgtctacctttttcaacctgaatagtgcagagttagttacctgtagtagttttttcttctgtgcctgttttcttccttaaaattaataaaatattttcttcccttaagtgtatttagtaggtttaaatatgaccctgtaaaactcctgacaagtaggtatttactgttgttggttcccatgccatttcctttatttagagcaaaaattgcaaaaatcctggaagttcagaagaaacacttagcaccttttatttatttttttgaaagttgagaaatgtaccattgagtacgtgctcatctttaatgaagagataatatattattttggaaagacttcacactttgattcagatgatgggttccagtctgggctctataaacttactagctgtgtgcctggacaaatcaattagtattgaagagcctcagctgtttgataatttatacctcccagtgttgctgatggcaactcagataatgaaagaaaaagtgtttaactgtagagcatgtcaaagtatcatgataattattcctgattattagttactgtagtgaaactagtatagtagtttccccttaattcaaggggaaatatgttctgagaccccagtggatgcctgaaactacagatagcactgaaccttatatgtactgttcccccctatacatacatacctatgataaagtttaacttgcacattaggtacaataagagatgagcaacaatagctaataataaaataggccaggcgcagtggctcacgcctgtagtcccaacactttgggagaccaaggcgggcagatcacgaggtcaggagattgagaccatcctggctagcacgatgaaaccccgcctctactaaaaaatacaaaaattagccgggagtggtggcacgcgcctgtagtcctagctactcaggaggcggaggcaggagaatcgcttgaacccgggaggtggagtttgcagtgagccgagatcacgccactgcactccagcctgggggacagagcgagactctgtctcaaaaaaaaaaaaaaaagaacaattatataatataaaaaagttaaatgaatgtgatctctctctcaaaacacctcttgtactgtacttcttgtgatctgtcagtctgataatcaagatagttactaatgtgaataaggggtgggtagcatatgtagcaaggatatcatgtcccaggtgggatggagcgggatgtcagaaaatttcatcacactcctcagactggtgcccaatttaaaacgtatgaattatttatttctggaattttccatgtaatatttttgtactgcggttcaccatgaataactgaaactgaagaagaagaaaccgcggataaggggagaactactgtagtttcttaagttgtatgattgaatgattcattcatttttacctggtgatgctgctgcatttgggtgctttgccctttatgcatttttatttaaatagatatctggtttattaggctaggcgcagtagctcatgcctgtaatcccagcactttgggaggccgaggcgggtggattgtaagttttaggagttcaagatcagcctggccaacatggaaaaccctgtctctactaaaaatacaaaaaattagccaggcatggtggcacgtgtctctaatccgagatgcttgggaggctgtggcaggagaatcgcttgaacctgggaggcggaggttgcagtgagttgacatcatgccagtgtacaccagcctgggtgacagagcaagactgcatctcaaaaaaaaaaaaaaaaaagaagaagaagaaaaaaagaaaactggcttattggactttgggaggggagtttggagagattgtgggagtggtaaaaaaagattctgctatgttcatcggagcaggccagttaattgagtatttttgcatgctgaggtcctgatgctttctctatgtatctatagcaggaaatttacttcatcttaactcctgcttcattagggtaaaatatcatgataatctttggggtattcccatttttgtaactgtatttgtgtcctttctctttatcattgttagccaagtgtattttttgtgaacatcgtgtctgtttttttgaaattcatttttaatttatagttagagcattgagaatgtcagtgcagtagtttgaaactcttgtgtattcttgtgcatatgtgtatgaataacttacgctgttctttgtcccttaaatctgtaagatctcttgggtactgagccttttgaagcattaaaagtaaataccatataaggcaagcagaatagtactaaatagctgcagtagcaaagcaaggaaagtgaatcacagagtaatgaatttggaaaatgactgtcgtgcattgtaggaaaaggcattgcttttactatcatccttgtaaaatctagttgctgacattaagtatttgttgtatgtgctgattatttaatcgtgtactgtaacaaaggcacttacaagcaaaatactttttcttctaaaaacatatactgaaactctagaaattggagtacagctaccctaaatcctcagttagtttgctattcaattctttcatattaactaaggcaaataatttaaaattgagcaaataactcatatctaaaacttatttataaaacatatttgtaatataaaacatgaacttctagaagatctacagattctggtcaagatatgcccctttataatttcaatagtttaaataatgattgtcaggcacagcaaaatactcaggcatcagatactcagttaactctgttatgtttgctattcttagaagattattaccacactttagaacagttttcaatatccaaggctgtttgcttatttcactggaattaactaaaagtaattagggaattcattcctcagaataatttatatcctaagctttatgatgaagaaggcttttatttctaattgtatattccagccttggaccaaaaatgtacatgctaaaatatcaagacaaggcaaagatatatttttgcttttctgtcacttaatactatttcaaaatagtttcagatttatcaattggcccagaaaaagagtatttaattcctttgatttggaacatctgattcaaattaatgatttgagaagtttttaatatactttgggaacttcaacttggaattctgaggtaaattgttttaaagggaagattcttttgtaatagaaagtttctctataacttacctattttgtaattttggattcttgtatattgatatgtattattacagcataccaaggaagtaatagtgttatttactggtttttaaatttttatatggagtgaattaaatgtgaggttctgctgaaggagacctgtgggtaaaaaaaaaaaaaaaaaaaaagtggtaatagcatatacttattacagaaaaagtagaaaggttggtgagagaagaaaataaaaatcacttccaagcctataacctagagaaccgttgttaactgaggcaaacattgccatttcctttgcatgcatgtgtttgtaagctctacagtctctcgtttttctctctgattattaaggtaatatgggggatgtgaaaatgcaggagagttgtaataaagagaggagaaaaagccactcagagacatccatgaaagtttgcatttttgtgatgaagaaattggagtagacatggtaatttgtaacctgtattgaaaaaacaaaactgacaccataagcattttccagtgtcatatatttatccaaaacaggattcttaatggccagagcataactgatttaatgattgtgtatgattgaacattttattttttttttacttttataaatagcactgtgatgaacattcttgtacctgaattgtttgtacatttatttctttagaagaaatttctataagtacaatcatttcaaagtatatgaattttggaggtaagcaggtccagtgcttagccaattgctgtgtccttagtgagattacttttcaagccttagtattctctctgtaagaacaggtataatatacttaactcagaggttagaaggagtaaatgacaacatatgtatagcatttagcacatccgatagtatacaggatactctcagtgagtctttccccaactacccccttttttttttttttttttctttttgagacggagtctcgctctttcgcccaggctggagggcagtggcaccatctcggctcactgcaagctccgccttccgggttcacgccattctcctgcctcagcctcccaagttgctgggactacaggtgcctgccactgtgcccggctatttttttgtatttttttttttaagtagagatggggtttcaccgtgttagccaggatgctctcgatctcctgacctcgtgagccacctgcctcggcctcccaaagtgctgggattacaggtgtgagccaccgcgcccggccccaactacccttttcttaagtagactcttcttccctagcatctattgtaattagctattacgctaaaaaaattttgtctttcattccaccactagatcatgagtagggacaagttcagtctagttcattaatgtatattgaaaactcgtacaggcctaacaaatgtaaatatgttggatgtatgaaaagttatcttccaaagcttttaatattcagttgctttttttcttacagcaaagctgtgccagtttacattctctgcagctctgtgtaaattgtgtcctttttaatttactgtcactgatactgagtatgttgtgttaacaaaaagttctaaatttcaaagttataaactgataattttaaaaacttgtattttttggctttttctctgaagaagcaatattttatattcacttctattttcacgttttctgtttatgtttttcattcttactaataagaataaagacaaaataagagtaatatgttatagtcctgtccgtggtcccctcccaagcattattccatacttcctgggaagaaaaagtaaatagcatcacacaattatgagacagggttaatatacagaagtaccatatcaaaactgatctccaaggggtttaaactggataaacttacggtgaaaaagtttaaaagaatttttgcctaatttaatttactgtattaacactgaaaatgtaggttaagatgttatgttaaaatcagattgtattttcagtattaagcttatgttttctggagggcttcaaaatcactttcatatctgtggatgtatttgaaaatagtattttgcttgtgggaagtaggcaaagacaagtaatatttaggtattgtattagatattttatgttactcattcattaatttaacaaatatttatttaactcctaccgtgtgccccaagtgctattccaaaagaatatagcagtgtacaaaataaaatctatatagatacatataatctgacagatggtggtaaggataaggaggaaaagaaactaagggaaagtatggagtgtgtatgaggtgcagatttaaataggctggtcagggaagtcctttcccactgatttcccctcaaggcgtgagcctgtggtgagggagcaatcctgtgcttgttcaggagaaagggctttcaggaagggacaacaacaaagaacaaaaaacctgagagagacggattcttgatgtcttatgattaaaaaattgcaaagcagtatgtgtggctagagtgtagtgggaaaggaagagaatggtagatgggtacagaaaagggcaaatgaggaaagactttgctaggctaccataaggacatttttacttacagtaaaatataccttgtatatactcttcacagttgttacacgaggttagctgaatttttcccattttacagttgagtaaataaggtaggttctagcatataactggtaattaacttcttcaaggtcacataagctagccagtaagatccagagtcaggtctttgacttcaaaacctcctgaatttttgtttgtactgttcttgttcaagcatacttacagagcctttcacttttacagtgaaattcagaccgggcttagtttttagtgttgatctagggtgagttttcatgcagggcttatttttttttaatatccataggaactaataccattcttatttttaaatcaactttgtcaaggaagtttacatataatacaaggtacccgtttaagtgtccttttttaaattagttttcacaaatttatacacccgtttaaccatcaccatcattcagatacagaatattcccatcaaccctcaagttcactgattccatggagaccccaatcatggccctggcaaccacagatctgctttctgtcagtatatttgagattttttctagagattcgaacaaacgggtttgtaggtactgcattgttttgtgccttcttttgctcaacataatttcatgacttatttatgttgcatgtatcagttgttcacttctgttggatattgttttgttggctagtactcttctaactggtgcctgaaacgtttgttgaatgaatgcatataataaatatcctcttcccccagttttgccgctttcctttatcatgagactgctaaaacctcttctagattttgtatgttgctagacttaaatttgtgtatagagtatttgaagagataatagtgaaaaatgtgcatgatttggagctcagtatttgttaaaaagactgttttctctatttatttatcttagtacccttctctaaaatgagctgactgtatatgtgaagctttatttctggactctcaattctgtttcattgattggtatgcctatccttatgccagtatcccttgattacgatctgcaattttgaaaacaggaatttttgagaatcctccaactctgttctttttcgagattgttttattagtatctgctccatgaatttccatatgaattttagaactagcttgctaatttctccaaagaaaccaggtggaattttgatagaattgtgttgaaactgaacatgggatgtctttctatttatatagttatttaatttctttttttttaatcaattgagtaccaaaatagactttaatttcttttaagaatgttttgtagtttttatggtatgttttgtattacttttgttaaacttacacctaagtgttttattctcttggatgcttcagaaatggagttattttcttaatttcatttttggattgttcattgttattgtatagaaatgcaattaattttggcgtattgattttgtaccctgcaaccttgttgcacttgtttacttaattattataaaacattactattaataaaatcttaagtattaaactgctatgtaaactgttgtatattttcaagtctcctgttgacttatcttgtatctagttgttgtattcattattgacatggagtattaaaagtctcccaaccactgttgttgaattggctattttctctcttcaggtgtcagtttttgcttcattcatttcggtgctcttttgttaggtttatgtgtttataataatctttttagtggcttctttaggattttcttatctatgatatcatgtaatctgcaattagaggtagtttcacttcttcttttccaatccagatgcattctattttttttttttttgcctaattgttctggctagaatctttagtacagtatgaaatagaaatggcaattctgtttagtggacaaccttgtattatctctgatcatataaggaaagcattcagactttcacctttgagtatatacctgtgtttttgtttttttttccatggataccttttatcagtttgaggatgttcctttctatttctagtatgttgagtgcttttattatgaagggctgttagattttttcagatgctttttttggtgcatcttttgagatgatcatgtggttgttctaatatgttgtattacattattttgtttttatgatgttgaacagttcttgaatttttgggataaatccaactggtcatgttgtataatccctattttgctgtatttgttttctggtattttgttgtggatctttgtgcctattttctttctttctttttttttttttttttttttttttttgagacggagtcttgttctgttgcccaggctggagtgcagtggcatgatctcggctcactgcaacctccacctcctaggttcacgccattctcctgcctcggcctcctgagtagctgggactacaggcgcctgccaccatgcccagctaatttttttgtattttttagtagagacggggtttcaccatgttagccaggatggtctcaatctcctgacctcgttgtcctcctgcctcagcctcccaaagtgctgggattacaggcgtgagctaccacgcctggccagtttttgtgcctattttcataagatatatcagtctgtagttttcatttcttgagatttctttgatgttgttaactggataataatggtcttgtaaaatgaattaggaaatgttccaggttccaaaactcttctctgttttagaagagtttgtgaagaattggtatcagtttttcttaaaattggtacaattcaccagtgaagctgcctgggcctgagattttttttttttttttatgggaagttttaaaattactaatgcaatctcttcacttgttacaggtttattcagattgtctgtttcatcctaagtcaattttgatagtctgtgactttgtaagaatttgtcccttccctttagttatttaatttgttagtattcagttcacattatttctttacgatccttgttatgcctaccctacaaagttgtagtaatgtactgtttctttcctgtttttagtactttgagttttctttttttttcttttcttggtcagtttagctcaaagtttgtcaatctctttatctttttagataataaactttaaaaagtatttctcatttttttattctctagttcacttatatcggctctcatctttattatatccattgtttgcttttggtttagtttgctcatctttttctaggttttgttttgttttgttttgtttgagacggagtctcgctctgtcgcccaggctggagtgcaatggcgcaatctcggctcactgcaagctccacctcccaggttcacgccattctcctgcctcagcctccgaagtagctgggactacaggcgcccgccactacacccggtcaatttttttgtattttttagtggagacggggtttcaccgtgttagccacgatggtctcgatctcctgacctcgtgatctgcctgccttggcctcccaaagtgctgggattataggcgtgagccacggcgcccggcctaattacataattatttttatcagtctgtcaagtttgctagcagtgaattctgccaatccatcttaatctccaagtttattttgccttatttttttttccggttatttgtgttttttgcgatggagtctttctctgttacccaggctggagtgcagtggtgtgatctcggctcaccgcaacctctacctcccgggttcaagcacttcccctgcctcagcctccagagtatctgggattacaggcgcctgccaccacacctggctatttttgtattttttgtagagatggagttttgccatgttggccaggctggtcttgaattcctgacctcaggtaatctgtctacctcggcctctcaaagtactgagataacaggcatgagccaccacacccggcctattttgccttttttgaaggatggttttgctggatataaaattctttattgacagttttttcttcattgttttgaatatgtcatcctacatctttctggccaccattatttctaatgaaaagttagttgtgacaagtcacttttctcttgctgctttcaagagtctttttgtcattggcttccaacgttttgtgctatgatgtttctgggcatgaatcgttttgtttaccctacttggtaactcttcttggatgtgtagattagtgtttttcttcaatttcagaggttatcagccattatttcctgaaatatttttctgttcttttctctctcctttcttcttactcccattacacatatgttgattcacttaatagtatcctatgcttttttttcctgaggttttgttcacattttttaattaatttttctctgaattgcacaaccctatgaatctgttgtcaaatttacattctccttgttctcctggttcagatatgcttttgagcccctcttatttttgagcctctgaatttttcagttcattttacttgttaactacataatatctctttttttcttatctctttcttaaagataagacattgtcacatcacactttcctttacgtctttgatcatgatttccttaaattattgaatatatttttaacgactgctttgaagtctttattaagtctgacatcttggctcttaaacaggcagttttcgttgactgctttttcaccctgtgtatgaattacttctatttatttgcatgtcataatttgtgggcgagaggctggacattttacatgaactttgcagcatctctggatactgatctttcttctcctttgtgcttgtttgcttgtttaatggcttggctgggctttttcaatgaagttttatatttcttgccgtgtgaagtgcctgatgtcacccatgagagggtacagccttggacatgggcaattatattgggatgacagtgattttagtaggaccatttccgattgtctttttcacttatatatatctgttaaaacctctgcttctgttggtgtcacacccagatatgatagcctttactaactgctggtgactgctcttttgttattaacagttctctggagcataaatttctccacagtgagatcaaattaaattttggcccctttgtaggggcatttttttgaggctagtcttcagtgtttgttatgaactgcggaggtctgttcctagctatctctcttcccagttctctttggtacactagctagcccgtggtttaacttgttcctgtcttagagctaccagcttccttttagttgcttactgcccaaatctccatatttttgagggtacccttaggcttgaacttctctacactctgtcccaaataaagtcttttctttttgggaggcttttagagttctctgctcttaggtctgctcctgctctgcagcagaatctctgagccactaccagtgggcagggtggtagcctctagtctttttggcttacctatccctgtgtgtaaccacggtcttatgagtgagatgggttgaaggcaaatggggcccctgtgttctaggcctgtcatgtttacggtagagcctctgcctgtgttttgaggctggtggcagaagtgagggagttgagtataagaaattctgttggcctgtctgtcctggagagatactctaacccttgactggaaactaggcagggagagagccctgtcttgaccccatctgccaggattagaaatttcattatgctgagcgggcagagggaagaaaggggcagtgtggctcagatactatagattcttgctatttctattgagatttagtagattatttaaaataaaatagtttttcgtttgctgtattcccttagaacactccccagagcactgagtttttgttttcttttcaagcagttttctccaattatgttttttttcattgattgaattttgacaattaagtcagtcttattttctctggataaaccttacttgttcgtagatctttgggcattttattgaatttgatttgctaatattttgttgagaatttttgcctttatatttatgaggaatattggtctttaatttttttttgtttgttattgttttcttgtttttagttttggtatcagtaatgcctcaaaaatgacttaagtgttttgtgtcccattttctggaaaacatgtcaagttggtattacttcttctttaagtgttttggtagagttcactagtaaaactaccaaacctggagtttcgttttgtttcttctcttctcttctcttctcttctcttctcttctcttctcttctcttctctttctttcttttttctttctttctctctttcactgtgagttcatttgtttctgtaggtgtaagacttcaggttttttgaggaataggtgcatttcatctaagttgctgattttatttttatagagttgttctggtattattatccttttaatgcctgtgggttctatattttctcttttattcctgatagtggtagtttctgacttttttctttgtcagtctgccttagaggtacatcagttttggtgattttccttttaaagaattagattttctgttttgtttaattctttttttcaatttctgtgttttttcctctcatctttatttattatttttgtttacttttggtttattttgtgccctttttcaaggtttttgagatgtaagcttaggtgattgacctgagagcttttcaaagataagcacttgaaattataaatttccccttgagtactaatttggttacatcctacagattgtatgttttatttttgttttcaatcagttcaaaatatttctaaatttccctttataatacctctatgaccatggattacttagatatgcacagttcaatttttatgtatttggagatactttccagtttctcatgtcactttttagtgtaattctcttatagtcagaaaatatttgtatgaattcaattcttttaactttttttttttttttaaaagaactaagatgcaactaatttgatgaatgtttcattttctccttttaggaatttgtaatctactgtcgttgatgttgtattattattattattattatttttcagacagagttctctcttgttgcccaggctggagtgcaatggcgccatcttggctcaccacaacctccacctctgggtggaggctgaggcagtagttcaagcggttctcctgcctcagcctccccagtagctagaattataggcatgcaccaccatgcccagctaattttgtatttttagcagagatggggtttctccatgttggtcagacttgcctcaaactcctgacctcaggtgatccgcccaccttggcctcccaaagtgctgggattacaggcgtgagccacagcacccggccgttgaaattatattctataaatgtcaattagatctagttggttaatgatggtgttctgtttttctgtatccttgctgacttttgtttacttgctttataattacttagaggagtattgaaatttccaaatgtaatgctggaatggtcagtttctcctttcaggcttattagtttttggtatttttaacttgaagctctgttgtaagtgcgtacacatttaagggatattatgtcttcctggtaagttggcctttttatcattatttaacatacatttcttagccctggtaatattttttaattgctctgaagtgtacttattctgatggtaaggtagccactccagcttctctttgtttactttttgcatggtatatcttttttcacctgtatgtttcctgtagacagcatatagtcttttttttgtttttttaaccattttgacaatctcattcttttggactatctatatctaatataattattgttctatttggatttagataaaccctttgcttttttaaattttctgtttgttccatttgctttttcactcatgtgattgattcttctttcctgccatcttttggattatctgactacttttaatattgcattttacttattgagttttttagtatattctttgtgtatttttttttagagattactttagggattacaatgcacattcttaacttttcagaatttacttattatgtcagtttcctggggctcctataataaattgccacaaactgtagcttaaaataccagaaatttattctttcatggttctggaggttggaagccccaaatctcaaggtatcatcagggccgtaaatcctttgaagggtatagagaagaaaccttccttctagttttggtggttgccagcaatcgtgttccttggcttatccctgcatcactccagtctctgcctctgttttcacatggtcttctttctcttcccactgtgtttctgtacttaatcgctcctttcttttgtgaagacacaagtcattggatttagggccttcataaatccagtatgacttcctgttaatttggtgagatttgcaatgactctgtggccaaataaggtgaaattcagaggtcctgggggttaagtcttgaacacatcttttttgagtacacaactcactgcactgcacttatatcacttcaagtggaatgtggaaaccttgtcagcatgtagttccctttactcatccccttttatgttgtagtttcatatgtattacatttgtatacttcagatactcgtcacacagtgaggtcacttgctttcaactatcatcatgttttaaaggatttaagaggaaaagaatagtctatcacagggattgcaaactatggctgcaggccaagtctagcctgacatctgctttttgtaaataaagttttattggaatactgccacatttgttagtttatatattgtctctggctgcttttgcactacaatgcagaattgattagttacaatggagactgttaggcttgtgaaacttgaaatattttctatctggccctttacaaagtatttactatctgaccctttacgaaaaagtttgccaactcctggtctgacatgtacacacacatattttccatttttttcccattcattcataaaactctaagttttctaccggtattattttcattttgtccaaagaatcttcctttctttatagcaggtctgctagcaatgaattctcttagtttctttcatccgaaagtgtctttatttcacctttgtttttgaaggatgcttttgatccatgtagaattctgggtggacagttctctcggtagcaattagctagagtagagtagcagcaactgccttctttaggtggtctgtggaccttccagtttgccatactttttgatactttctcttgtctctttgacattgatacccactgccattcttgatatttactattgtgcctatgtggtggtttttcttatcaaaggatcagaagaaagtaaaatttatttgttattttctgagacagggtcttgttctttttcccaggctggagtgcagtggtgcagtcagggctcacttgcagccttgaacttctgggctcaagtgatcctcccaccttagcctcccaagtagttgggactacagggtgcgtgtgccatcacgctcagcttatttaaaaaaaatttttttttttttggtagtgatggggtctcactatgttgcctggtctggcctcgaactctgggctcaagtgatttttcctactttggcttcccaaagtgctgggattacaggtgtgagccaccacacctagccagaagtaaaatttttactgtactcctgtttctatgtagtgggaaaacaaaatcataagtccgtgtttcaagaaatgtgggagaaacaataatttttaatggcatttggaatgtttatacatgtccggtatgcaaaaaggatcatacctgttttcagacttgtctttttaaacacttgagttggcatcttatgctgcaacatatattttcaaaatgctttaacatctcacccatcattttctttttcaaagtagcactttttcctgtataatttatgtctttccctaataactttttggcatatattttcagtgtctttgccctgtcttgctttcttatagccaagtcacatcaaagttgatttagccctgggttgtgaatcagaaatgctggattctgttttctctcactctgtcactaattagctgtgtgtatgagaccttgaacaaggttaggcctaccagactacaatgtatctctgaaacaaggtgtttaaactcaatttcgctctgaagctttttttttttaagctttttttttttttaaggtctttactattcgaagttactctctgccaacaaccttgttcatgctgtgatattctcatccagaggttattaatattttttgttccatgaacctttttggctctctggtgaagaatgtggaccccttctcaataatagtttacatgtgcaaaattaaatacatatgcttatgaggtcaccagttatattggagtacagtttttaaaatattgactaaacaaactcagtaacatgcatatcaacacgaagtctactggtatatagtattaataacttttagacttgtgatgaatataaatgataatttgagatttgaagcaactaaagtgatatgaaaatatctgtggtttctagtggtaacaaaaatcatcacaggtgcctctagcaccactgtggcttgttacctacattttaaattaaggaaatactaaatttcagttagaggtttgtaaaattaaagctctagcttttttaccccagccaagtttatgtaccttctgcattcagtcaaaagactgaagatttatagaacctggttaagaattctgtcttttccagcccatgagacatttggcttagtgcctaatatatattaggtgaacataagttatgtgtaatacatatgaaatacattcctcagtgaaaaagtattgctaataaaggttttaatattattgccatttgtgaccttgtgttaattataattagtgctttataaatccatagagaacaattggcaaacacagagttttatttactacctggcatatagtagggctcagtatttttggaaggaagttagaagagtctctgattattagtatcaatgatttttgaccattttatttttaaatacttgtttcaaaatctctggtaaatttctgtgtgaaataatttgtttactttagtatttcttgacagggaatacaggtatcccctataaatggcaagctgctatagttatccttagtataacacatgataaactgaaacttagttcttagataaataaagcaaacaatacgtttgtctgcactgcctgaaaattttgaattgcacaatttttcaaatattctcaattcagtagcagtgaaacaacacatattgaggttaaagttctttacattaatagtatactaccactgttcttagagtagactcatacccctacttctttgattctaggtttactctaattttaatgtttctcctggaaatgtaagtcctaagtttttatagggctttttagttgccttcttcctcctcataggaaaatatccatttgttaaataaagatattaatatatacagaaatatgtttgtaaccaatattcttaaacctacacttaactgacccactcttttaaacaaaccattattttagattcttagtcctgagtattctgagcatttatagctagtaaactactctctagtttacccttgtacccttttctccaccaggttagttatatgcctaacaagaatcagtttttatgccaatgttaatgtaatttttactttaaatgtgatctaagtgaataaaatatgagcacagaaagatagaactattgttttaatgaaaagcacggtgaatggttcggaaggacttatataaagttctttacaaattgctaaaggattaggtgtggataagcccagaggtttaggaaacttttggttcaattgactaaacagtatggaaaactattttctcacatatctggaggaatggaagcttttgtgtggttggttaatgcagtggtttaataattaattccagggtcagattctttctgtttgttctgccattgtcagagtgtcagcttgtccacaggctagctctctttatggttacaagatggatatagtagctctagttgtgctattctgatataacaacacctattggggaaagagggtctgttttttctttctttcctagaatcctaccatcagtttttcccttatgtctcactagccaggattggtttaaatgccctttcataaatcaattactgacaagagggataggattaccaaattggcttacactgatcacatttccttttttttttttttttttttttgagacagggtttcttgcccaggctggagtgcagtggcacaatctcagctcactgcaacctctacctcccaggttcaagcgattttactgcttctgcctcctgagcgactgggattacaggcacccaccatcacgcctggctaatttttgtatttttagtagagatggggtgtgccatgttggccagactggtcttgaactcctgaccttaggtgatcagcccgcctcagcctcccaaactgctaggattacaggcgtgagccactgtgcccgaccagcatttactcttgaaccatgtgggaaagtttgaatatttggacaactatggtggtcacagatagaagggcttttagagtgtcaaccaggagtgtttgctatggtgagacagctattaaaaaattagaaagtatttgttaaatttcagaaagattctgctatttatttgcctttaaggtcttgttcaactttaaacaaaattgaaactggacatcttaaaagatgcattatagatgtgcattatacaaaaaatgatgtgaaaagttaattactaatcctacactcaaaagcttgtcctacgtcagactatcaagggggaataaatgtccatttgtattttaaaagtatttgatttggcaggaactaacttttaaaattaaccttccggttgctggtctttttcttactagacaaggtgcttctgctgcagtccttgtaaggaaaatgatgtttccataaaattaaagttagtaaaggatttagtatatttcttgtgcttcatttattcagtaaaatgtatctgttatgtatcacttattgtaggtacttgtgataacagtgataagcttaatagacaaggttcttctgcttaaggaacttcagggatacagacagaaaacaaatgagaacaaaattcagactgttgggtgttcagtgaaggcctttctgaaaagagatagtcaagcagacatgttaacgtcaagaagcagtttggcatttggagatttggggtaagatcgttgaaaaggagcagcaaatataaaggccctaaattgagaactgactggatgtgtttgagaaacacaaagaaaggcaatatggctagtacttactgagatattctcacttcttttcttactctttgttttcttacctatcattagtaatcactatattgcttataccgttaagtctgttgcttctctcatgcttcttaatactcacaacttttggttaagtctgcttctacctatactgttcctgcatccctgcagttgtgtgtggctagagaacaccagcctcccatgggtccttagtactacttggcaattctacctactgtcgttcctctaatcccttcactctccctttcttagaagaccttttcctccctcctcagacctgtaacacttcctcccatattcttatgctcacccgataacttcatttcttattttactaagaaaacagaaacagctgaatgagaacttccatagcttttattactatggcctacctgaatctgttcctgtttactatctttgtttctgtttctattgatgatatatctttgtgcctatctaaggccattctcttattaatgccatccacatctgctcagagtcattactccagtaatttctctctctccatcttgtatcatcagcatttccctctgtgccataatttttcctgtctttaaaaaaagccttctgtcaacgctaaattttttcagctattaccatttttcacttttatggcaaaacttcttgaaaatgatgtctgtactttgtctccagtttctctcttcctgttctcttgtgaatccagtctagttagtacatttatttcaccaaagctatctacgaagattaccaagtaggtgatctccatgctgcaatccaaagattaattctcatcttttttttttagtcaacagcattttgaaacagttgattacattcttccttgaaccacttattccagttaactttcaagatatctaccatactctctttggttttcatctccctcgctggctgctccttctctaaaccatgaactagaccatgcagatatattattttcatttataataggaaattaaatcacacagaagctaagcaacttgtgtaaacagatgtacttttcgggcagcaggaagactagaaacagcccctgttgtctgaatttcagaccccagttttatttaagcccatatcaaatgaagagcttttaattttcaagcctgtggttcagaaattattgaacttttgtcgtttaagatcagtaggattccctttataagtattcacttcatttgaaacttttaagccacagtagaagaaaatttctgtctcgagatggtgggccttttagatagacctgactctctacttatagtaaattttgtgtatcagatgtgtagaatcctccttggagtatggatgtgagacaactgtacagttgagttaaaagtagtaccactgtggaaaatggaagacacatacaacattgttataaaacattatgacaaccagagagcaaattcatttcaatagattattgttaagttgtatttgtttttctttgtagatataggcaacttttcattttacatgctaattataggtctgtgaaacccatattactaaaatactcagagaaactgttcttagttaatatggcaattttcccagaccaggtatggtattcttgagttttatttatttttatttcactgaaattcttgagttttatttatatttatttcatctgtccatcaactcagaatttttaaaacatccatgtgatcaagcaaaaaattagttcataagggcaaggaaatatttatgtgactgcagtctacctattaagaaaacattgcttgatgtagttctagaatttgaggaacccttattttaaagataatggctaaatgcatttactgcatgttttattgagctccagtgaaatcggtcacatcttgtagtttgtcctaattaatagccaccccagaatgtaatgtcttctgttaaaaaaagagaaaacctgttcagctggttcagctgtcttaacctaaccaaattcatattttaactttgagtatggtaatgactaccaaattacagatattttagatactattttcagcttctaaaaggtttgggcattgtttaaatactattgagtaatgaagtgggatgaggggaacatggggaaggttttttaaaaagtttaaaagaagaaaaagttaaaaaagattcatctaagtcattttattttatagcttaggaaactaaggccagagagaagtaattgatctattttttgggtttgtaattttgccttttccataatgtcatattaatggaattgttcaacgtgtggcctttggggtctggtttgtttcctgtaatgtagcaaaaatgcacttaagattcatccatcttgcatgaattaacagcttcttccattttgttgttgagagtattctgttgtgtagatactctgtttatccattcacctattaaaggacatcacgtcttcactggaatgaagtacatcttcatacatgtactggttttggtgtgaacctgttttcagtttatactggtaaataactttggggcatagttgctgagttgtatggtaagcttgtgtttacctttataagaaactgcctaaccttctaacatggctgtacttaccttcatttttgaaagatattttagctgggcttagaattctttgtagatagttttcttttcttttctatactttaaatatattgaaccactctcctctgatttgcattgtttctgatgagaagtctgatgtcattcctacctttgttactctatgtatttttttcccctgctttaagattcttgtttattgctgttttgcagctattttactctgagatgttgtgatcatgtggttttgtttttgttattctctttagaggttgttgaatttggatctgtgggtttatagtgctcatcaaatatatttaaaaaatttagttccagtttcccctccttgtgcttcagcctcaaaactacaggcagtgagctgggtgtactacgtttgttctttttcttgacgatctctgtcctgagaagattgttgtgtgatgtctggaaaccattgtttcatatattttgtctagttttctgtttatttaaggtagaagggtaaacatagcctccttttttcatcatgaaatacatccttgccttatagaaaatttcattgtagttttgcaaatatttgtcttttctgaattcttgaatataggacttggtgggagaacagtgtataaaccttaataaattttggcacctagggtgcatgctgtctctcatacttgttccttttcacagattgtgtctctctttgacgtattgtacatcctttcatttccaatatgaaggttatcaacagaatttattgctgaatatttttatttaatatagtacagtgaagatagtggtgacagatgttaacttttcatgtttatttggaagaaaatacagtgtcttcagtcatttttcttttttgtttattaaaaggagataatgattcttagttcactatagaatattagctcccacattgattagagtatataatggctatggattgaaactccaggccatgaaatatttccagttatccccagaagaggaaacaaagcaaataataaatagattttccctttatacaaaaatccataattcttcaaagtgaacttgtatctggtaaattcttacagattaaatattaatacgtattgttgtggtgttagcctataaatttcagtcattattttttgtatataattaggttgtattaaagatgtatacagcattagggtattgaaaattatcttacctgattatagatttccaacattcttttgctgacattaatataattggaggtaattcgtagaccctaaatattatataagaaggaaaacattttattctataagtactgactgaaattttgcatttattatccactgaattcagagtcaccatgtatgtattaatggtaaggcatgtactactttacaatttaatattatacaacactaatattaaaacggttaatatttaggggatgcataataaaataatcttgctttctttttgtgacaatcgtgaaaatttgagttggagccaaatgtgcgtcatttaacaattcctgaatatccaattcatttgtaactttccttatgaataacctcattgcttgctaaatgataaagattacatttataatagtaaatatgctttaaaactttactcctttgttatttttgaaagagatatttaattccaaaggtatttataaatttggtaatcaataattacaattttgtcatacagcctgactgaagtattttggctaaacgtacactgtaagatagtcagacttaagtaaaaatacaactcccactacctttgtgatgaaacataaaagaggagccagaagataggtttttgtcacctgggttctttttaaaacttaaatttagtaatattcatttttaatttttttttaaatgttctgcccgtatagattgctttttagaggtactccatatatatgtgtacatgtgtgtttgttggttttaataattctaattcactctccttataaattatagattagatgttatctcctcacaaaatgtttgttgatattaaataatagctctgaatttgaataccaatgtttagtggctagcaagattattagttcagtaggtatgcatactacttccttagggagaatgcttaacaaaacttaggtaagagatatctgtcttgaaaatgcatatttacaaattctttgtagacccacctttgaatatttgaactctcattttcaatattcattttaaagacagcatttcttgtgactgtcacctcagcttcagtgctttttttatttttattttttattttttggtgggaggtggtacctggagtgcaagtcattttgacttatttatatctctgcagtttaagaaatcatccccattattttttcgcccaatgtaaaaaagtgaattccctattggagtatgcatgaaattggatgactgaaagacaaaagcatcaaaggaagttgacattttttgctcttctttttggagtaaagtttaatagattattgagttatgtttgtatctcttaatcgtgttaagaatatatgttgcattctcattttgttgcatgggaataaacctacacagaatgaatcggtagctgtgtgaataacttgtatttctatctatcatatataatcatttggaggggaaggatttatagttaaatgattgaatgtgaattgtatatttttgagataactggagaagattcatgtaaaagaaaaaaatatgtcagttgtgggaggggtaaacttttttgtccacttcattttttattcactgtaaatttctcccttgtgtgtgatgtctggcagacagtcttaattgaagaaagtagaagtgggtaggaagaatgtttcatatttaataatttctgttgcaaataaagtatgccagtctagcccgcgaaaatggttacgaggaagactagagtatagaacaattactttttgttttttgttttctgtgtatcatattgaatatttttgctgctgttgatatatttacatgttagtaattttgatggcttttggataattccactctagagggagacgtggtgggcggtccttcctgtgacacgacccttgagtgacagttctatttgattgcctccggtactgtgaggaaaggacacgactctatggtgaggactgatggacatacattatctgagaaaagaaactaccaggtaagaccagtctttcttcttttttctctattggtcttatagctacattgaaactgttcaaatgtgttatatgtaattggaaccagcaaattggttacacctcaatttgaaaatttgggtttataattttaaattaagtactggatttgatagttgaaatagttgggaacacttttcaaaataaagcatattcataatgtatattttttagtgtcaaatcaggttttctgagatatttgtcaaaacttagattatttgatatacaagttatgacttcatgactgaattcaaaatggtaaaaacaaaagtgttgattgcttttacgtatattattcctggaagactaaacccgaagtcttgtgctatattttggataacaaagtatatatcacagaaatgtagacaaaattgagtagagtatagaagaaatagaaatgagaaacccagggtgcttagagacccaaattctattgaatttgttattagtttgctgtccttaaatgctagattcttgttttctcatttaataaggtggttaataatattcattccttattcagtgtgtaggaaggctggaagaatagtggaaatgtaacattgctatttctgagctttgaaaagaaggtgaattttaaagattgtgctattaaacagtgatttaaagaaaaccaacatatttgaatttagttttttaaaggaaatatcctttattcatttgatagtgatctgttatcacatttatttagttatccagaatacagaatactttaaagtttgagtacaaataaacttttaggcttcctgcacagatatgtgtccaacctccccacctcccacacttcctttcactcatcagttcattccctctaggttgtgaaggcagctagtatgatagcagcagctttggttaactaactgtttatctgctaaccatttattttagcccagttaatcttttcttccctcaaattggaaaagttagcagtggagcaaattgtaaattagtctttttggtgtatggtataacaaagaggctttgattataagatctgggttctggtttaggcactgttcctaattaaaaataatgtcatatttaacctttctagaatttcttctaacttggtatctaaagtttcttgccagatctttatgattttaataagccagagaaaactgagggtatgctgaatcagttttctctgtaacctttcttctgagttgtcctcatagacttgaccaacatagcctttgctaatgatctgtactcaggtgtagctcctgcttcccacccacttccaattaccttgactcataagattttaattggtcacacttcttggacttctgcatcttttggtaggttctgccaaattattttaagaattttgtgattctgaattatatggcttttcagtgctcataatccaatttgtaaagtgtgaatgtagaatttttatgtgattacacactatagttaatttgtctcatggaaccacattaatatagaattccaaaatttatacttaagaaagaaaacagaattatgttttatacatgaagagatttgcttattcttgctctttctacactaaaagtactccattgtttcagtcatattatttacaaataatccaggtttttgagcatacctggaaaatgcatttttggttatgggtttgctgcctcaaaatgttttcccttttctctcttcgtttattgatacataattgtacgtatttatggggtacatgtggtattttgttacatgtatagaatgtctatataagaatgtatgggaaattcaaaggaatgttcatcactaaagtaacatttatatttgtactggtagtctaagaatttttatattcttaatatattcatcataataccaaacaggaaattttgtttctatacatgtgcttttcagagtagggttcaaaaataaaataattttacaatccagctttaaacagctgtttccaaggtatacttcaatatgcatttagcatcactaagtaaaaacaaaagagaaaagggacatagagggataaattctaatgttccatagcagagtagggtgactataattaacaagaaggtattgtatatttcaaaatagctagaagagagaacttaaatcttccgaattgatgaaaatgattttggatttttaaaaattctactttggaggaaatttatgtatttttcatagataaagtagaatttctttgtgtctatgtttataaccattttcatttatctttgagggcttttgcttttgagggacacttaatattttatatttatttgaacattctgataataggctaatattgaagagtttaacaagaatttttgtaaaatttatccaggtctcatttccttacagacctgattaaagccttaggaattaagtttaggaaggtgcattcccttggctctatactaaagatagtgacttttaaatgggcttggtttgaagtattgatttttatggtggtatctactttgtgtgttttctttcttactataagtttaagcccagttaggtatttggagtttgaatacagtagctgaagtttatttgcagagatagactggcatattagttcagataaaacaatttattatatggctcatggttcatttttggattgtcaagctttttccaaggaaatgcaccttcagtttttgtaaccattttcttatcttcctctaatttagactaacttaccctagctatgagcatgcacatgcacaaatgtaaaccatcttaattaccaatttaactaatcaatggctttccctttttttttttttttctttttttttgagacggactcttgctctgtcacccaggctggagtgcagtggtgcgctcactgcaacctccgcctcctgggttcaagcgattctcctgcctcagtctcctgagtagctgggattacaggcgtgcgccaccacacccagctaatttttgtatttttagtagagatggagtttcaccatgttggtcaggctggcctcgaactcctgacctcgtgatctgcccgccttggcctctgaaagtgctgggattacaggcgtgagccaccggtgcccgatccggctttccctttgttacataacatattcaagcttctaaacattacctttagactttccaaattctggcctccttacatccatttacctttccaatatatctcctgttactttttgtagtagattttcccatttaataatacaacactgcttttaatctccctgccatgcagtttcacacccacaggggtttacttatattggttattttcatgtaatgcctcacctttgttcacatgattcaagaattaagtatcagtttttccagacgtcaccctatggtagattcagtgttcctttccctttctttcatagcctttacatacttctagtttagtgtttaccataatacattgtagttgtgtttatttgtccttgtcttcctatagacttgtgcagtccaatgccgtaggaactagtcacaagtagctatttaaatttaaactcatttaaattaaataaatttaaactcatttaaattaaataaattttaaagttcattggtcacattaaccacatttcaaatgctcagtggctacatgctgctaatggctactgtattgaacagtgtagatacagaacatttctatcattgcagaaaatcgtattagataatactgctgtatctaataagcttcttgaaaactgggaccgtatctgtttattttggtactgccaatacctagcttggtgcttggtatgtagataggtgttcaatgcatgttgttccaataaaattaaataaaacagtgaaagaagggaaaggaagaaatggaaagtatactgggtaacataccagtgtaagtggtatgggaaggtagaggtatttgcaagatatttagatgttactttgaatggaacttttcagtatgaggtcattggtcacatcatatgctagctaattcaatgcattatctacaaactgggtctaatgcatcctattccgtacgtttctgaagaatgattcataatctaaaacattgtatttttgtggaatatagtatgtcagagaactgtaaaaatgattgtattgccattttcttccccaacattaaatatcttacttccttttaattaactttaaaaatcacagatgcctattaccaaaacgttgaagaaaaatacggaatataaaatacagtgtgaaagtttgccttgacaactttactcttaacagtttggtgtgtacctcttcagatctttactagtgactatatagtgtagatgtgattcattgtctttgtctctaacaaatgtgtatttttctgcattgtacttaatggagctatttccgtttcccattctttcctctgccctcttccccagaagtaatcaatagttttaattttgtgtttcattctttatatttttataacttattacatatatgtttttcagtatattgaggtacatcttttttatgtattgtgtggcaattttttggaaagtggtgccccatattttattattttgagtaggaaaaatcataatttccagcccacttaagaccctaaacaatttcctagatatagctaaagtactcaacacctacttgataattcaccaaggatttctgcataatacagagtatttaaaatacaaactacttaatataaacagaaacaaatgaatcactaagtatatttccatttagtatgtactgtattcagataatactttttcttttatactgcaataaaattgtaattgtaaataaacagttaagtgtatttcctttcttttattgttaagtggcacattattgaacatgtttctctctctgaagtcaggatgcatcttacagctgatggtgacttcaagtcatagttgtgacaaacagtaccagcaccaaagcatcttagaatctatgatatatagtatgttaaagatatataatgaatataaagaacacttaataaaataaaatcatagctgagtgtagtgctgtgcacctgtagtcctagctactggagaggctgaggcgggagattagcttgagccccagagtttgaggctgcagtgagctatcatcacaccactgcactccagcctgtgtgacagagcaagaccctcagtcagtcgattgatagatagatagatagatagatagatagatagatagatagaattttattaaattaatacttaacaattgaaaagttgtcagatctggtgcccagagaagaaaaattgagtttgtagttattattgctgcttggtgttaggtgaagatgaataagagcgacctaatgaaagaatgagtttaaaaaaaaaaaaaaaaaaaaggaaaaaagcctgaatccaatgaattggttcagtttcctcttctttgctcttgaaagccttgcaaccagatggctgtgacatgttatcactagccagagataaagtaaaggggtagaatgactttttatgtgccctttacttgcatttatacagctgcttaagatgaagttgctcttataattacatttttgattgtgaaagctctgttcatgtcatgatcacatgatcagcaacggaagtcactttgacttcatgatgtaaatttttttttttttttttttttttgagatggagtttcgctcttgttgcccaggctggagtgcagtggcgcgatcgctggagtgctcaccacaacctctgtctcctgggttgaagcgattctcctgcctcagcctcctgagtagctgggattacaggcatgtgccaccatgcccagctaattgtgtatttgttttttggtagagacagagtttctccatgttggtcaggctggtctcgaactcctgacctgaggtgatccatctgcctcgacctcccaatgtgctgggattataggtgtgatccactatgcccagcttttttttttttctttttgagacagggtctcactctgtcacccaggctggagtgcagtggcaccatctccgctcactgcaacctctgccacctgggttcaagcaattttcgtgcctcagcctcccaagtagttagaactacctacacgcaccaccacatccgactaatttttgtatttttcggtagatacaggattttaccatgttggccacgctagtctcaaactcctgacctcaggtgatctccctgccttggcctccccaaagtgttggaattacaggcatgagccactgtgccgacctaatctaaatttttaaaaataaaatttgacctttttttttttttttttttggcattcatggcttctctttgtcctctttctcaggccaaccagtaatgtcaaatcaagttaaatgaattcccaagttcctcattggttggctcattgccgtgtgatgctaagtgttaacctttctttgaatgcattatacgttctgatactttttttattatcatctgaaatcatcaaataaggtgacatttgttttccaaaaaataagtttcaccaagacacctggtttatagcacccttagtgaattggtaattttttcatagtgcccttgggccaaaagaaactctgctaaataagtaattaggtccaaatcacttatattcatatgattatctgatagatattgctgtatttcctaagaagatataaaatatctagtagcacccctgtgtgttcgctctggtgttccttttggcaacgtatgacgtagactttatatatgaaatatgaagtgttctctttcagaaaaatagtttacatttaagtggtttgccttaatcatgaatgtgaaatgtgtactcattaaatcaaaagttaagacattaatgcggatatttctgtgaatcagagaaaatacagaagcaagcaaagttatgttttgattttgtttttgtttttgttttttttttttagacgaactcttgctctgttgcccaggctggagtgcagtggcctgatctcggctcaccgcaagctctgcctcccaggtttatgccattctcctgcctcagcctcctgagtagctgggactaaggtgcccaccacgacgcctggctaattttttgtatttttttttttttagtaaagacggggtttcaccgtgttagccaggatggtctcgatctcctgacttcatgatccgcctgccttggcctcccaaagtgcttggattacaggcgtgagccaccgcacctggccgcaaagttatcttttaagaggttatcttaggtcttgcgtggagtctaggatgatagcactgatggtggcaggttagttttttgtttttttttttaaatctttctgaatttccacataaaaatagaaccagctagacagcaaaactaaaactcgtgaaacataacagaacttcttgacaaagtgtccccatgaaccccaatataagcagatgagaactaagaaaaagacctacagttttcagtttttatgcataaaatgagacccattgggatgtctgatggacctgagagtggaggcacccaatgtagtcaacaggtattcactggtaagtacaattagccagtttgaaattgggagagattttgtcaacctcataaggtgagtgaggaacccatggtaaggctaaagtgattggagcagcttagctctctgacctcttgagagtgacccaccagtgtgtccttctaggattccactgaggagaggaattaaaattgagcaggaaagggacaacagtgacattggaaagagaaggtccagataaaaatgggagaggggagcagaaccaggaaatctcagtaaataagcgatcatattttcaaacactatgtgaaaataacagaagagagaactttatgacgttagagaagtttatctgaacaaagcagtattctaaaacttcaggaagattacattcctaagaggtcttctaggaatgtatttgggagtgtttataccaattttgagccccatcagtagtcctcatattcatctgacatttgataatttcagaattaaaatttttttccatctattgaggttgtgtttgagatatattgagatattcttcatagtcttttaaaaaagattttttgttttgtcttccatatttaatctacctgaaattgatttttgtacatggtgttagaagtacagtttcctttcccctgcacctaaattatcatattagcattgtgtaccaatttattctaacctccttaactattcagtagtgctagctctattgtaaatcaagtttctctttatatgcatggatttcttatgtctctgttaccttgatgtgtttgtctgtgcctataccaatatcatgttttcttaaatactaaagctttgtgttaaatcttcatgtctgtctgtcaacctttttcttcataagagtcttgacttggccttttgctctgtgacaaatttagaatattcatgagaatgctcccctccaacacaaaaagaagtattgagtttgtaagtggaattgcattgactttagttttctttgtggaagaatcgataagtttatgtattctttcatgttttctctcaaagttttatatttttttcataagggacttagaaatctttagtccaatttatgactacttttgttgcttttcttggttgtaaattaaaaaaaaatttttagttataggtgttattgaaatatagttgacttttaaaattgatttttgtatctcaatgttgctaaactttttaatttttataatttatctgtaggctttttggggggttcatataagtaaacacatcctttggaaatgacagttttgaaattgtcaccagttttgaagttgtcatcattaaataatatttgatacaggattttttttatagatatactttatcagggtaaagaaattgttcataatgctaccttatatatttttttcctctgtagcatctttttcttcttaaggttgtttactatgtgcgttttccccttatttggtcagacttactagtgattcgtcagttttactaggggtcaaattttagcctttatttatttctaaaatttaattttgttttctattcatcagtgttctttaatgttttcctttcacttcttagggtttgttatactgttctttaatcttacgtttttaattttccaggtaattatcaggtttgtctagttatctttttgttgctgatttctcatataattccattttggttcaagaatgtggtctgtatgatacaattatttgtttatgtgtttgaacaaaatgtatattaaccaaattggcaggtgtattgctttgtttctctccattagatcaagtgttaatcttattatgtacatcttatgtatccatataatcatttatccctttgtttagatctagattccaatatatcttatttctttaattattttataaatttttgtgtttagcctgtgataaatccaacaattggaagttgtcacatattatgctaatgtttttgtttctgctggttctcattgtgccttgtttccttgtgtgtatattaagctatcatttcatgtttcttagaactctgggaattctttgagcactgggtagaaggggacatttctcccaaggggattttcacttgtttttgctaagaccctaaggcactaccaatccagaaccaattccaaataaaatattagcttgaggttgcagtccacataggcaatgtgaatttatgcttttttgtggctataaattttcagagcattccttcaccactttttgcttaccataaataacaggaacatcaagattttttgctgtcctctttactaaggggttattacaattatggtgtagctcttttttttttttttttttttttttgaaacggagtttcgctcttgttgcctaggctggagtgcaatggtacgatcttggctcactgcaacctctgcctgcctggttcaagcaattctcctgcctcagcctcccaagtagctgggattacaggcacctgccaccatgttcagctaattttttttgtatttttagtatggatgaggtttcaccacattggccaggctggtctccaactcctgacctcaggtgatccacctacctcggcctgggattacagtgctgggattacaggcatgagccaccgctctcagccagggtgtaacattttaaggtacatgatttataaaaagcttttttaaatagcttctcctttagggatataagcttgtggcttctctggaattctagcttttactctcatttaagggtgttgaatttcccttcctcccttgcaggttcagctgtacacttaaaaatgtaacctctgttagtgtttattttgttcattgctgtatcctcacctgagaataatgtctggcatgtagtaagtattgttgattggataaagttagtattttatggagtgattttagttgttatttagtggggcattctgggttcttagttgtactaccaaacaacatctattttaattattctttagatctcagctgaaatctcacttcctaagggaaacattttctgcttagacttctgttacattttctcattgttcatggtaattttagggatggtggtaatgttatttctgcgttttattatcattcataatggaataggtttgttgactctttttctctttttcttcccatcttttcctgtttttacttcttatccctttcttctctcctttcgctttttttttattccctcccttgccctgctttattttcttgctcacttctcttccttttttctttcttcccttctttcttcataatatttttcttctacctaaaggattaaaaaattttttttctaaggcacttctagtggtgatgaattattttaggttttgtttgaaaagtctttatttcacctttatttgtaaatatactttcactgagtctgaagttcaaaattgacgggttttttgcttttagaattttttaaatgatgattcgctgtcttcttatttcctatgaaaagtctgctgtcattcttatgtttagtcttgtgtgtataatatacctttttctctctggctaatattaagatttttaaatttgtcacttattttacacagcttgattaaggtctatgtcggtataattttttttatgagtcttacacgtgggatttgttgagcttcttgaatttgtatgtttatacaaatttaggaatttttttcatccattatttatttgaatatattctctgtcttcactgtcctttgaggactccaattacgcatatacctaattgcctggagttgtcccatagcttactgatgctttgttcatttttttctttctttttttctcaccatgctttagttaggatagtttttattactgtttttttaagtttgctaatcttttcttcagcatgccaattattctgccttcttttacatacaaaatgtaattataactccttgcatatcattgtctactaattctgttactcatgtttactaatagaaactatgtctgtttctattgagtgttggtttttttttcctcctcattatctgttctcttttagggcttctttgcatggctggtgatttttgcttggatgccagtctttggaaactttatcttgttgagtgctatataatgtttgtatttctgttaatattctttagatttcttgtggttgcagttaagttacttataatagaagccatttgatctttgagacatccttttcttttttttcttttttttaggtcttgtttaacagaaccagagtaatctttagggttaattttcttccaactacttaagcaattcttttctgaattatgtaaattatgtttttctactctggctcataggaaaataaatgattcccagccctgtctgggccctggggattgttttctctgtttctttcaggtggccttttttttttgttttttttagcttctggtagtttccttccatgcatgtgctaatcagtacttagctgaaatctcagaggaaccctctgcatattttcagagatctttctctgtgccagtcattcttgtttagtatcccagcctattctggctgcctttaattgccctcttctccacttcctcaattcacaaagattgctgggctccaccaatctggaatccctctccctcactgcacactgaaaattctttcagtcttataagcaagggtagttgttgagccctcaatgattctttctctggtctcaaggattattgtcctgcacggcctgatatcctgtgtctgaaatcaattgtttaatatattttgtccattttcaagttgttttaggtgggctgctgctacaactaatactaccacactactctctcggttggaagtgaaagtcttaatgtttcattttttaaaattattttttcttattaaaattttttttatagagacagggtctcactatgttgcccaggcttgtcaagtgatcctcccacctcagcctctcaagatgctgggattacaggtgtgagccactgcacccttatttcatttttaaaaactatattttggttgagaagatgaatgaaaaccatccctgataaagagaataagcttttgtgtcaatattcagataaggcttggatgctttctcttgtataaaatactatacagtgtgcaatatacacaaatttcagaccatttctcagcatttaaggtcatttagaatgaaaaataaaacagtacaggtcagtaaatgaattccagttcttatgtagaattgtcatagtcctgattcaatttaacttaaaaattggactgtttcctctgaatttcctgattcccttaagattccctagaatccagtaggcccatagatacagtggtcattcattttctcagctgtcaggtaaaaattttaccaataagcatttcttactttaaaaaaatctgtgttgtatagcataaaatagtatattatctctgtattgttttatctggatcagtaaattaaagacattataataaatgtgctaatgaaaatataagatgttttcaaggaaaaaggaaagacccttattagggccaaaaatgctaccggcacatgaaattttacacctattcttttctaccaaggcacttttctaaaggcactgtgataaaactaaaacaaatgtgcttggtagagtgaagagcctttagtttgagccactagtcttcacattctacctgaatcacttgggtccatttatgtaaagtctttgacaccgtgttcatagttaacagtgaaacctttaaaagatttggtttgctttgttaaagcatttccattaaatagagaaggaaagtagaaaattaccattaaaacaccatggtaggccaggcgtggtggctcacgcctctaatcccagcactttgggaggctgaggcgggcagatcaccaggtcaggagatcgagaccagcctggctaacacggtgaaaccccatctctactaaaaatacaaaaaattagccaggcgtggtggcgggcacctgtagtcccagctacttgggaggctgaggcaggagaatggcgtgaaccagggaggcggagtttgcagtgagccgagatcgtgccactgcactccagtctgggcgacagagtgagactccgtctcaaaaaaacaaaacaaaacaacaccacggtaatagatactgcgagcaatattcacggatgaatgctataaggagtggacagaaatgtaagggcagacaggtatttgcatgttctcacagtactccaaaacatttcttatttaaaaagagaaaactagtagtttacagtggagaaaacttccagatgcaccacttcacctgtaataagacatattaacatcatatgcactcatatattggaatatatgcatcacatatgatgcacttgagaagactacatcagctctgtggtgatgtggctttcagaatgcataacttcagtctaatgagaaaacatctgacaaaccccaactgtgggacattctgcagtgtgtatgatataacatcaatattatgaaagaagaaagactaggataagtctcggattggagaagactaaggaaatgtaaaactaaatgtaaggggtgggggacaaagtgttgtaattttaaatacacaaggaattccttactgagatgacttcacacctgaagtaggtgaagtaggaagccatctggatgtctagaggaagagcattcctggaggataacaaaggcaagggcttggagacaggagtatgtccgatgtgtttgaggaatagcaaggaggccagtatggcaggagcacatgaagagaaggggagaatgctaacaggggagattagagataacaaagagtaaggtcatgaaggccttggaggccttggtaatggtgcaggagtccattgtaaatgtgtttcacctctattccgtttgatttctgatgttcttttattctgagcctgaaggggataaagtgtataagtataaaatgtaatacctaacatctagcactgtgtgtagtagatgctaactcagtgattattgaattagtgtacatggtgagatgtttagaaacattttaaagatcatgtcttcccttgctaaaggaatacttttcatttttaattacttcctgtaacataaattaggattctgatacctctgtatatttttaaaatgtaaaggttttaaaataatttgtcaccttcaataatatctatttatgctattgaacagatgtcttaaataagcttctatttttattagttttagtatttgtaatagagtttatttttctttgaaaataactcactttttatattttcaaggattcaacatttttgtaaaagtgaattgatttcatatcttttttttttttttttgagatagagttttgctcttatcacccaggctggagtgcagtggcacgatctaaactcaatgcaccctctacctcctgggttcaagagattctcctgcctccgcctcccgagtagctggggttacaggcatgtgccaccatgcccggctaattttgtatttttaatagagaagggtttctccatgttggtcaggctggtctcaaactcccgacctcaggtgatctgcccgcctcagcctcccaaagtgctgggattacaggcatgagccactgtgtctggcctggatttcatatcttatttaaatcctatattcagattgttttgttttaaaatcttaaaatttttctctttattatcttgtttggttaaagtgccaggttttttttgatggaggggtccttatttgtttttatcagcatggagcagttaagaaattcactttttcccaaggattgtacttatatcagagttatgtgtaggttttaaaagttcactggtccacctttacgaattttaagtacatccatatagtacaactttaattctgcttgttgatggtgttaatgtgtatgagagccttagatttaatgttgagtactcaagagagcaagagagtgtacaaggagtggataggcacaaagtatttgaacacactgtcttacatgttttcataatggccaggtaagctctgtctttgcattttctggaaaagtgtgcaagtttgtggtgagcactgcttttttttttttttttttttttttttaaacttagtactttgaattagtctgaaagatgaatctgggtttggccagtaatgaagaggtgaacagggagtcataatgttgaaactggacattcagatctttatagcatgatttccttatttttcaaagagcggaagaatcccatcgtttatcatgttctggttggactttcttactgtttgctggagttgaacttcagagctatggcgtcaaccctgctgtaatatctcaggggagctcctagggtggggctggtgccatggctcaccctccaacctttccttcttcacttcagcctccagctctgagctttccaatccccagagtagcaaatgttgaaagaagttgcacaggtaagtatgtggtggggaaagccgggggaaaaatggtactgtcatcagtattttgagggtggatgttgggccattttatcaatgagtcattttgttagtttagaaatataatgtttgttatcaattatttttctcataaaactcataaattatttaaaaaatagtgaagaaataattttaattcttgttagatgtgaaataagaaaaaaaccttaataaactattaatattataatgcaaaggaaggttcttacatttttttaaactttatattctccacagtgtatatagcaggtccagaaaacccatgttcaaaaaagaagctaaaaaaaaagttggggaaggcctaagtccatagactataattttgccatatgtaacttggtctcaggaggaggcaagttttagttttcttccactagctttagatgtgctattttttcctgaggtattaggcaggtagctatgttttaatctttacagaaatagaaatttcaaacatctttttccttgaagtcttgacaggaggactggaacatttctaccaatctctaggtttgaagttaacaaaaataagtatagatatctggtacgtaattcagcaaatgtttgttgaacgaatgaataaactcatcagatcctgtgtcgtgtgtgtgtgtgtgagagagagagagagatgccaacactcctggcattttctccttgtctgccttgcactggaaatcatgatctaaacatcacagatttaattttgtagggatgtagctctgggtcttcactaccttacttttgagcttcttctcagaaagctttcaaaacgtgtttctttcgttctcctacatctatcccatataattcatgttcattgatttatagatttttgcacatacaagacattcacattaaacccaagaaaaacagactcttaagatggcccatggttgctaagtttcttcagagaaagtatgtgagggttaaaagagattggggttctagtgtatttggtatttcaggtctcaaaacaagtcatcaaaatacagacttcccagcagtttgtctccctttttttcttgagttttttagataactggacgctctatataaacacatctccctcagcaaagtacatcccgtttttttctcaatatgtattcatattcccttccttcctccctctttatcagacccatctttgcctaccgtcttttaaggatttaaaatattctcattagaagattttccttctgtatgcatagaggatttgtttttattctaaatgtagagattttctactgttatatgtccttccatttgtattttatagttttacatcctaatatttaaagataaagtactactttaattttaggctctattatgtgagttctcaactccaacttcttactgctcataagaggtactaattatatttagttctttagtatatgtgtacttttttcctatggattagcactttttgaataattagaattttggttttaggatgatgcacttagcttttaaagcttatatattaattgttcaaatgtgaatctatataaagcatattggtgcagcacattttaagattctagaaaaccacaaaatctgtttattcatgttgaaacatacagaacatattctccctagatcagagtcaaacttgtggaggtatttgtagcattttggtaacactccctagagaatttgtagactttgggggtgcatattaagggataacatacatggcttttcagaatattttctgaataaagcagcttcagacaccagattttagtttttggattaggaaagagtgatgtgtttttccaccctcccctcccccaccaacacacacacacataccctccccatctttcagatataggccatcttgttttattggatgagccccccaaaaatacacagaaatatgctaaatatttctgtaaaccttggaaaggactctgccaggatatttatctactctccaaaatagtgattgtggaagtgtttgtataggtccctagctttctactaaagcctatttccaaccagtcatagatttttgtgtgtgtgtgtatctacatgttaactatctttggtattcattgaggccttttttgcttatttatggttattctgcattggctaaaacaatgagttgctcttatttgtttccatgctatcgatttgatgatttgtaattctagactttaaaatttatctatatcttcacttttcttagatccatcctaagcagattcatgaacttttcattatacctatatcatattaaaaatatgaaaccatagtattctagaactcggaggacttgaatttgtttctcacatgaagagtttttttttttttggtaaagatttccaggtattaatatctttgttctttaagaagctagaatttttttgtgcagtgtaggtgcctttctgtcctttatttaagcccccccccctttttaaattgtttttcaagaattaaataaaattagaattatttatagtagttgcgaagcaggataagcagtttaaaatcctatcacaaaaaatactactgaaacaaaaatatctttgttaacaaatatttccaggttgtaacaatataatatttgatatacgaatattctacttccatagaatttgggcagtctgtgagatttttacctatcatgttttccctctaaagggcaattataaaaacgctagattatcttcaggtattaggactcctcatcattggtttcagatgttaattggctacaccttgataaaaggcagataagtgttaatggcagttggctgtgattttatattaagtttctgcctattttatagccaagaacttgtgcatatttgtatattgtttgttgatattgaatatggaattcagagagaaaataagaactcaaattctaaattactcagatctccattaggaaaacagtgcctgagaaacactttttcccccttctcaggtactgtatatcttgcagttagcagtcttcatcttgtataatgcaagcagactacaaactctgtagctgggagtgaaaatttgttactcagtatgaagcagtgaatgagacaattgattttatcgtgtgacacctgtaccaacatgttagcagtaaaactcctccctacattagagaatctacaataaaaagttgctactagggaattgtttttgttttaacacaagttctagatgtgccctacatatgtaatgctataatgtctacattagagctattataatgaaattaagagtttggttataattatcctaattccttgaaaggttaaattgtgttcactatacttaagtacctaaaaatgttagttctttgggaacatggaaaccaggtatatatagcttttagtagttatttctacttatctgaagccctccttggataataatttttttttgttttcatttttgagacgtggtctcactctgtcacccaggctggactgcagtggcgtcatcttggctcactgcaacctccgcctcccaagttcaagtgattctcctgcctcggcctccaagtagctgggactacaggtgcgtaccaccacgcccaactaatttttgtatttttagtagagatggggtttcgccatgttggccaggctgctcttgaattcctgacctcaggtgatccacccacctcaacctctgggagttgagtgggattacaggcgtgaaccactgcacctggtggataataatttttaattggtataatagtatttcttttaagcataacttcattttcaaattaatgcaactttctgtaaaatacatgtgattagtcttgtagagactggcttttgtctcacatgtctataatcagtcataatcagtccattcttgttcttgtgctaaagtgatctttttgacacacataaatattcgattgtggtataccctacttaccattgttcacaatataaggaccttcctcctccaatcggctttttatttgctccttactgcttttccctttacaaattcaagaacaaaacacacattaaattgttagttgtatatttgagagtcagtgtactatcatggttaaaaagggggactccagcaaattggtctgggttcaaaacccatctccgcatttatcagatatataaccttaggaagttaacctaacttctctggtccttagctacaaaatagggatagttaattgttcttactttctagcgttatcttgataattacataaataaattttaaagcatttagaatattccctggcacaataatttattattattttatagttatgataaagtgttttcagagactgtataaaacaagagtcctaatttagtgtgaaagtttcaaagaatgggagaaagggcattttaagtagccgtatcagcatatgcaaagaccgggacatggaaactaacttctgttctgagtaactgaaggtatggcaagggtttggtggtgtcaggggacttaggagagaagttagaggttacaaaacatcttataagccttattgatttgggagtgctgttgaggaatttttatcagaaagtccatgaagataaataatttttactttaaaaaatcactttgatgtgggagagtagaattgaggggaagaagaatagattaataaagacctgtttggaggctattggagtggcttgttctagtgtattattagtccgttctcatgctaacaaagacgtacccgagactgggtagtttataagggaaagaggtttaattgactcacatggctggggaggtctcacaatcgtggcagaaggcaaatgaggagcagtcacgtctcacatggcggcaggcaagagtgaatgtgtgcaggggaacccccctgtataaaccaccagatctcatgagacttattttttttttaattttattattattatactttaagttttaaggtacatgtgcacaacgtgcaggtttgttacatatgtatacatgggccatgttggtgtgctgcacccattaacttgtcatttagcattaggtatagctgctaatgctgtccctcccccctccccccaccccccaacagtccccggtgtgtgatgttccccttcctgtgtccatgtgttctcattgttcaattcccacctatgagtgagaacatgcggtgtttggttttttgtccttgcgatagtttgctgagaataatggtttccagcttcatccacgtccctacaaaggacatgaactcatccttttttatgactgcatagtattccatggtgtatatgtgccacattttcttaatccagtctatcattgttggacctttcggttggttccaagtctttgctattgtgaatagtgctgcagtaaacataagtgtgcatgtgtctttatagtagcatgatttataatcctttgggtatatacccagtaatgggatggctgggtcaaatggtatttctagttctagatccctgaggaatcgccacactgacttccacaatggttgaactagtttacagtcccaccagcagtgtaaaagtgttcctatttctccacatcctctctagcacctgttgtttcctgactttttaatgattgccattctaactgttgtgagatggtatctcattgtggttttgatttgcatttctctaatggccagtgatgatgagcattttttcatgtgtttttttggctgcataaatgtcttcttttgagaagtgtctgttcatgtcctttgcccactttttgatggggttgttttttcttgtaaatttgttggagttcattgtagattctggatattagccctttgtcagatgagtagattgcagaaattttctcccattctgtagaagcctgttcactctgatggtcgtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagagtttttatggttttaggtctaacatttaagtctttaatctatcttgaattaatttttgtataaggtgtaaggaagtgatccagtttcagctttctacatatggctagccagttttcccagcaccatttattaaataggcaatcctttccccattgcttgtttttgtcaggtttgtcaaagatcagatggttgtagatatgtggcgttatttctgagggctctgttctgttccattggtctgtatctctgttttgataccagtaccatgctgttttggttactgtagccttgtagtatagtttgaagtcaggtagcgtgatgcctccagctttgttcttttggcttaggattgacttggcaatgagggcccttttttggtgccatatgaactttaaagtagttttttccaattctgtgaagaaagtcgttggtagcttgatggggatggcattgaatctataaattaccttgggcagtatggccattttcacgatattgattcttcctacgtatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggagttctttcatgatttggctctctgtttgtctgttattggtgtataagaatgcttgtgatttttgcacattgatcttgtatcccgagactttgctgaagttgattatcagcttaaggagattttgggctgagatgctggagttttctagatatacagtcatgtcacctgcaaacagggtcaatttgacttcctcttttcctaattgaatgccctttatttccttctcctgcctgattgccctggccagaacttccaacactgtgttgaataggagtggtgagagagggcatccttctcttgtgccagttttcaaagggaatgcttccagtttttgtacattcactgtgatactggctgtgggtttgtcatagatagctcttattattttgagatatgtcccatcaatacctaatttattgagagtttttagcatgaagagctgttgaattttgtcaaaggccttttctgcatctattgagataatcatgccgttttttttctttggttctgtttatatgctggactacgtttattgattttcttatgttgaaccagccttgcatcccagggatgaagcccacttgatcatggtggataagctttttgatgtgctgctggattcggtttgcctgtattttattgaggatttttgcatcaatgtttatcaaggatattggtctaaaattctttttttgttgtgtctctgccaggctttggtatcaggatgatgctggcctcataaaatgaattagggaggattccctctttttctatttattggaatagtttcagaaggaatggtaccagctcctccttgtacctctggtagaattcggctgtgaatccatctggtcctggatttttttggttggtaagctattaattattgcctccatttcagagcctgttattggtctattcagagattcaatttcttcctggtttagtcttgggagggtgtatgtgtcaaggaatttatccatttcctctagattttctagtttatttgtgtagaggtgtttatagtattctctgatggtggtatgtatttctgtgggatcagtggtgatatcccctttggcattttttattgcatctatttgattcttctctcttctttattaatcttgctagcggtctatcaattttgttgatcctttcaaaaaaccagctcctggattcattaatttttttgaagggttttttgtgtctctatttccttcagttctgctctgattttagttatttcttgccttctgctagcttttgaatgtgtttgctcttgcttctctagttcttttaattgtgatgttagggtgtcaattttagatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagaggttttgagtgagtttcttaatcccgagttctagtttgattgcactgtggtctgagagacagtttgttataatttctgatcttttacatttgctgaggagtgctttacttccaactatgtggtcaactttggaataggtgtggtgtggtgctgaaaagaatgtatattctgttgatttggggtggagagttctgtagatgtctattaggtccacttggtgcagagctgagttcaattcctggatatccttgttaactttctgtctcgttgatctgtctaatgttgacagtggggtgttaaagtctcccattattattgtgtgggagtctaagtctctttgtaggtcactaaggacttgctttatgaatttgggtgctcctgtattgggtgtatatatatttaggatagttagttcttcttgttgaattgatccctttaccattgtgtaatggccttctttgtctcttttgatctttgttggtttaaagtctgttttatcagagactaggattgcaacccctgcctttttttgttttccatttgcttggtagatcttcctccatccctttattttgagcctatgtgtgtctctgcacatgagatgggtttcctgaatacagcacactgatgggtcttgactctttatccaatttgccagtctgtgccttttaattggagcatatagcccgttcacatttaaggttagtattgttatgtgtgaatttgatcctgtcattatgatgttagctggtgattttgctcgttagttgatgcagtttcttcctagccttgatggtctttacaatttggcatgtttttgcagtggctggtaccggttgttcctttccgtgtttagtgcttccttcatgagctattttagggcaggcctggtggtgacaaaatgtctcagcatttgcttgtctgtaaagtattttatttctccttcacttacgaagcttagtttggctggatatgaaattctgggttgaaaattcttttctttaagaatgttgaatattggtccccactctcttctggcttgtagagtttctgccgagagatcagcttttagtccgatgggcttccctttgtgggtaacccgacctttctctctggatgcccttaacattttttccttcatttcaactttggtgaatctgacaattatgtgtcttggcgttgctcttctcgaggagtatctttgtggagtcctctctatttcctgaatgtgaatgttggcctgccttgccagactggggaagttctcctggataatatcctccagagtgttttccaacttggttccattctccccgtcactttcaggtacaccaagtagatttggtcttttcacatagtcccatatttcttggagactttgtttatttctttttattcttttttctctaaacttctcgctgcatttcattcatttcgtcttccatcgctgataccctttcttccagctgatctcattggctactgaggcttgtgcattcgtcacgttctcgtgccgtggttttcagctccatcaggtcctttaaggacttctctgcattggttattctagttatccattcgtctaattttttttcaaggtttttaacttctttgccattggttcgaacttcctccttagttcggagtagtttgatcttctgaagccttcttgtctcaactcatcaaagtcattctcggtccagctttgttccgttgctggtgaggagctacattcctttggaggaggagaggcgctctgctttttagagtttccagtttttctgctctgttttttccccatctttgtggttttatctacctttggtctttgatgatggtgacgtacaggtgggtttttggtgtggatgtcctttctgtttgttagttttccttctaacagccaggaccctcagctgcaggtctgttggagtttgctggaggtccactccagaccctgtttgcctgggtatcagcagcggtggctgcagaagagcagatattggtgaaccacaaatgctgctgcctgatcattcctctggaagttttgtctcaggagtatctggccgtgtggggtgtcagtccgcccctactggggggtcagggacccacttgtggaggcagtctgcccgttctcacatctcaagctgtgtgctggtagaaccactactctcttcatagcagtcagacagggacatttaagtctgcagaggttactgctgccttttgtttgtctgtgccctgcccccagaggtggagcctacagaggcaggcaggcctccttgagctgtggtgggctccacccagttcgagcttcctggctgctttgtttacctactcaagccttggcaatggcgggcacccctcccccagcctggctgctgccttgcagtttgatctcagactgctgtgctagcaatgagccgggctccgtgggcgtaggaccctctgagccaggtgcgggatataatctggtgtgccttttgttaaacctgttggaaaagtgcagtattagggtgggagtgacccgattttccaggtgccattcgtcacccctttctttgactaggaaagggaattccctgaccccttgggcttcccgggtgaggcgatgccccgccctgtttcggctcacgcatggtgcgccgcacccactgtcccgcacccactgtccggcactgcccagtgagatgaacccggtacctcagttggaaatgcagaaatcacccatcttctgcgacactcatgctgggagctatagactggagctgttcctattcggccatcttggctccaccctcatgagacttattcacaatcatgagaacagcacaggaaatacccgccttcatgattcagtcacctcccacggggttccttctgcgacacgtggggattattacagttcaaggtgatatttgggttcagacacagagccaaaccatatcagctaggaaatgaccgtagagatgaaaagatattgatgatataaataatttcaataaatatatagggttggtttgatcagcttgaattttaattgttgaagatcacaaaggttacagacagcatttttgagagttaaagtgacatttttcagagattaccatgaacagtaacaactgtgaatagccaaaattaagctgaaacataagatttgtgttgggttctaagatagttagtgctgcaaagtcatgttgaggtgatgatctcagggatttttaggtgtatcctctgtgtatcttcaggcctgcctcttacttcgttggttccctaattgccattcatcctgcctgtatcagggaccactttacccgtcttctctgaagttcttggttattttatctgaagtttgtttttttttttttttttttttggtaaatttctgtgattattctgatttaccacatttggctttgaaatactgtatttaaatgttgagaatgtcatgccttaggaattcatagctagtctaaactaaataatgaaggaggaatatactgggaaaatccagccaacttaagtggctccattacgtcttccagtttaattctttattactttctgagaccaattccttttggggatttggtttggtacagaggattagcttacttatctctgtatttttaatttaattttattttattttaagacgtagtctcgtggtgtcggccaggctagagtgcagtggcatgatgatcttggctcactgcaacctccacctcctgggttcaagcagttctcccacctcagcctcctgagtagctgggattacaggtgcatgccaccatgcctggctaattttttgtatttttagtagagacagggtttcacgttgttggccaggctggtcttgaactcctgacctcaagtgatctgcctgccttggcctcccaaagtgctggcattgtaggcatgagccaccattcctgacctctgtttactttttagaatatgctgcttagttcttatgaaatcaaaggaaagattaaatgtcttgattaaacgttttagatctgtgttcaaaaaaggtttaagaaacattggttttgctacatgcatatattctttcctggtaaaaaaaaatctcaatttgtcttagaaagtctggtgtgagtgtcaagtaaaaaggtggtcacttaacaaagtatatataagcccttgacttgtttgcttgaataaagctgacaaattgtacacaccaaagattctaatgctgtatatccaagatgaagtctgatttaattttaaactacagccatagtttaaactacagccataacaatgggagtacattctgagaaatgcgtcaggcacttttgtgaatgtggaccatacttaaacaaacctggatgatataacctcttgctcctaggctataaacatgtacagcatattgctatacgaattctgtaggcagttgtaacacattggtatttgtgtatttaaacatacctaaacacagaaagggtacagtgaaaataagatacaaaacatttttttaaaaaggttacacctttatagggcacttatcataaacggagcttgcagaactggaagttgttctgggtaattcagtaagtggtgtgtgaatgtaaaggcttaggacattacagtatactactgtggacattggaaacactgtacacttaggctacactaaatttatttaaaaattttcattctcgaataatgagttaaccttagcttaccgtaacttttttactttataacctttttaattttttaaaatcttttggactctttaatacttgacttaaacacgtacagctgtacaaaaatattttcttcccttatattcatacttagcttttttctatttgaatttttttgtttttttactttttagatgtttttgttttgttgaaaactgatacacacactcatgtatttgcttaggtctatcaaggcatcactaggcaataggaatttttcagcttgtttataatcttacgggaccaccgttgtatatatggtccatcattgactgaaatgtcatgctgcacatgactgtcgtttattaaaatttttatttaccaaattaactttttaacatacgttgtaaccagtaatttcaatgtatttcgatataattgacatatcctctttgaaatttatagaaattgatttttatgtaccctaatttctctttcagggagaagatgggtatagtttaaccctttcatatcatccatccatccattcctactagttctgcctcagagtatatcctttattcaactactactcaccaccctattaggccatcattatctatcactggcctcctaatgcattttcctgctttcgttttataccctctttagcccattcctcatggagtagctaggacctttaaaaaaaaaaaaaagccaaattaagttactcttaagcttcgcctaaatcctctcttgatttcccgtctaacaaagaataaaatccaaagtctctcaggctctcgaggtgtactatatggtctagccccaaccagtctctctgacatgagttcctacccttcaccacctaagttcatgctgcctgagccataccagtgaggggtttactgaccctctgaactgactgcttttccttcaagcatttgcctggtcagttacttctctgcttgttttcatctcagttttatgttccctgattatttttaaatacttcctaccctgttccatcattctatgtagaataaaggacgggcactttaaaattaaataaatctagctttatgaaaaacctgtgttgtctttttctcttgtgattttgccatggattagaattgtctcataccagcacccatctctggatgggggtttgcattcatgggggagagtaaaacacccttacctctccctccctccatctgtctttctctctgtctcactctcgttttgttttttaattatttgctgaagtcatgtaagaataattagtattgtcactgatgtgtaatttctgtgccagagcacacaaaacagaaattaagcttaagtttggtatattttctctctctctctctctctctctctctctcacacacacacacacacacacacagtgactcttgagaaaatctggtattgatggaaaaggaacatttcttcattttctttcgtctggaacatatgtttaattttgccttcaaaccaaacctttttgcaagatattaagcataaaaattttaattctatacaattaatttcaattttagaattctaggagtctataatggtcttgatgataagtgttatacaaacagtgtcaaaagaagagtttatcaatttgagcttatttatgtgtataaaatttgatgagagatgccttgatattcacctgaaactttattgaataattattgaattatgcattttccatgtttattctttcttagaattagagctcaatagtaagagttctataaagataattaaatgtatctttaactttcaaaaaacaaacttctaaaatcttatgtgtagtgaatcttaatttgcaagctctaaagtgattttttgccactgtttcctttttgaaattactcactaagaaacatctgttttccccctagtagggactacttagggagctggtggataggcatgcgggatcctggtctgaaataacagagttacagaatagcattctgagattcaccaggagtctgtttcccaaaaaaagattaagtacctgtgttctaataaattgttagacccttaaaaaatatctttgtatatttcacacctcaagcgattacttgcctaaaagcatatagcaaagtaataggttagctgtccttagactttatttatacctgactgaataggttttcagacctcaggaggaaagacagtcaaataattaagtttcctacatatttaacagggaacttaaaatatataagaaatattaaacagcatgggtgctttcaacagagttacacgtaaagtttggccttcaaagtctgcaacatagttcaccacgtctactgatatgtaatagtgactacagcattttttgaaatgagacatggaaattgttcactcatttataatggaaggaaatattcttagtcataatgaatgtacaagacagatatcaaatttgagatgagttttccccaaaaatgtacttgtgaaaagacatagtcaccttgtattcaagtctttaaaatctcttttctcattgacattggtttaccttgattttcaaagtactgttaggagaaagacacattgaccttaaataactttagtcagttaatagttttgataattttatagaggtcacattttaaaaataattaaaaattaaaattagcacagattttaataattacagttggcccttcatacccatgggttctgcatctgtgggtcaaccagctgcagattgaaaatatttggggaaaaataatggatggttgtgtctgtactgaacatgtacagactgttttttcttgtaattattccctgagcaatacagtgactatttatatagcatttacattgtattagatattataagtaatctagagatgatttaaagtatatgaaaggatgtgtgtaggttatatgcaaatattataaaccattttatgtgagagaattgagcatccgtggattttattttttaatccatgaggggagaggtcctagaaccatttcttcacagatagcaagtgacaacaatttatgttggtgtgagctcaaaattgctaatgttggatgttacaaagactggaaaaacaaatgaataagcaggttatatcattgaaataataactttataccagtatgatcaatgaaagattgtacttcagttacatgagtgggtacttgcttgagataaaattctagtatgccactatatatgcactgattcaaaaaacggtatatttcagtaaacttagattgtaaggaaagatgaatgcttgggaaaacagataactgagaaaataaggtgatgacagatacacaaatgtggaagatgcatgtgaagattttgaataattaaacctaaacttaatttttaaaaaatctatgtatgggaaaatgatattggccatttttgaagagtaaggtatacttagttttttaaaaggaaatggaattgttaagataggctttatgtgattctcctacttttagggtctggaaataaacatctaacactttattgttataatcagatttatgactttatcacatgcgccactagccattagttgatcaatttctgtatcttagcaatgctcccttcatgttctgttttccacataggagtaaggtaacactgaacattttccaaagtattacccctgataaaagtaatatttttgtttaggtgacaaacagcatgtttggtgcttcaagaaagaagtttgtagagggggtcgacagtgactaccatgacgaaaacatgtactacagccagtcttctatgtttccacatcggtcagaaaaagatgtaagttaatcaattatgttgtattttttcagcaatgtaagtctgtgtctgggttcctgaaaaacagcatatcaagtgcagaatactgtctgtggttgagtgacaatcttttcagcacagtgctagtccctttggtgcttgtatccttttgggatacaaagacaatgaatttgtattctaatggggaaaataaatatcccatgattctcaaattgggatatggtaatactgtgatagaagtactcaaagacatggagtaaacatggtataacttctagatcactgattttttttgtttgttcaatatgggaaataacttgtttgatattaaaacaaatgcagatatagaacagaaagcagatttacgcagacttgaagatataatggcaagctgtaataaaactttatgcttattgtgtcatctagctgtaattctggacctcaggtgtatctctcctctgttcagccatagggatactataataggaaaaatttggaagaactgtattcaaaatgtgatggatgatatagagatatgaattaaatgctttggaaggctaatagttcaataatcccatttgggataaaaggatttagaatgcaaccaagtcataattagcaaatttataaaatacttaaaaatgaatgtaattactaaaattctgttaagctactttaaattatacaatgtactctctagtcacaccagttgcattcttatactttgtacacctgcccagctttttttacctttcacactttataaacttgctatgccaaatctccttatgtataaaacaatctactctagctattaacctaatgagatttatactgatgtttgaagcatttataaagttctaagatatggaacaaatgcccttgtttttctttgaagttgatcattagtaaatcacttcctttgactttgcagaattttgcaaatcagcttaacctactaggtttatgttaggatgtttgttattctgtttttgtattttccttttttattttgatttgaacattcttgtgtcattttgaaaacaaactatcaatggcattattgggcttttttcaactaatgtgtgttgtggctttgttgataattagtgtgtagtttaatagcttatggaataatgtcatctaattttctgttatcttattgcgcttttagctatgtgctatgtaacttataattgaattattatttacacaggtttctatttaagtattgaccttgtaaataaagaatttgggatatatttttggtagtatcgccgcagaaacgaaaacctacaatttgtgtgtattgctgtgattatataatgaaagttaagtttgcttggaaaatgttaatgaaatatttattactgatgaaatgcatttattctaattaggaagataggaagctttcagactgaaatctaaaagtatataaagagaatgaatgacaaagagatatatgtcttctcaaaagcagaaatactatatgtctacattttaaaatcagaattagtatatatacttacacacatactcacaaatgttggccaccattctgatccagctggttggcacagaagtaacagaatggtttgattcacaaaaccttttttaaaaaaacattaattaagaacatagtatggcataggaattaagaacttggactctaaagcaatacaaatatgtgtgtttggatcctgactttgcctgttagcaagaacttctccaagtctcagtttccttttctgtaaaaataggagtaataatatattggctaccttatacattggctgctgttgctgttacttttttaaaattacaaaatagcacaggtaaattatacaaatttttaaaaatacacttgaagaaaaattacctataatgctatcagaaataattgctaaaattctaattttatgctttaaatatttttattgaaaaatacacaattatttaaatcttctaggtcatacagacatattttccatcaaaaagtttgtaccagtttttactgtaatcaccactctccatgccaacaagaataccagcaattacatttaagtctttgctaatagacaagcttattgttttcatgtacatacagtaaaacatcattaattttacacacacacagtgtgatgggtcttttccatatagttattggtcatttgtatttcttcctttgtgtaccttttttgtgtcattttctatttctctattgagatcttaagtcttactagtttgcattctccatgtattgaggataacaacctcttgtcattcattacaaatattttcccagtttttcacctttaattcttggtatatgtagtatacgtatatttgtcattttaattaaatgtgatccatcagtcttatttttaaatggcttctgttttcgagatcatacttaggaagacatttcccaattactttcttataatacttttatgttttgttcttcacatataatttatgtccattagaaatgtgttttggtttaacctgtgaattgtagggttccaaatactttttttttctacaagcttatccaattgcaccgacaccatttatgctttaaatcacgggtcagaaaactttcccttaaagaaccagatagtaactattttaggctttgtggaccaagaagcaaaatcaaggatatatataaaatcaaaacctattttgtataataggcctttatataaccatctgtaatgtaaaaactttcttagttcatgtatcttacaaaaacaggcagtgtgctggatttgtcctgcaggaaataatttgcccacccctgggttagatcattaatttatggctaattaaaatatccctttattatatgtgctagtgtctcatacattcttgggcctgtttctaagatcttgttctgtttaccatactgatcctgtgtcagaactacaacataattgaattgccatagctttgtagaccactttaacatcttgggtaagaatctttgacatcctttgttttaaaaaaatggtttttgattgttgcacattaatatcaatatagatggtttttcggaaggatatttctccctttaatcttgttctttatgcgttttaatagggttttgcagttgccattttcattgcatttttcagattggtttttactgacctatggaatactttgtgtagttattttataacaaactgccatgtaaaagtcttctattagtttttggtgattgagaatgtaagccctggaaatcctactatgtaagtttttatgtcagctacctgatttgctagctgtgtgtcttaggacatcagtctctgtgtgtctcagttttctcatctgtaaaataggaacaatagtacctagctcatgaaggattttttttttttaagtgggagaatagttagtgtttgtgaggggggcactgaagtgactgctgtaattaagacaga

SEQ ID NO: 142 - DNA, 14733 bp, Homo sapiens
gctgctcctctgtcgagctgatcacacccacagttgagctgcgctggccagagatgcctgcccacagcctggtgatgagcagcccggccctcccggccttcctgctctgcagcacgctgctggtcatcaagatgtacgtggtggccatcatcacgggccaagtgaggctgcggaagaaggtatgtgcctccctgggggtccccggcctgggtcatacttgcttctctccacgtcctgtcaggaaagccccgggatagggaaacatggccaaggtgtgtgcagggctgggaggtgagcacctcttccagccccgccggggggcttcctgccagtcccacgtgtcagcaaggcctgcaccttctcctctctggcttaagagcacttactcgcttgccgtgccaccgggctgagttcttggcatggagagagccagcgagtgtctgtgagagaagcaggttctggagggtggagtgtgggagcgtgacagcacaaagcctctgtctaacctggtggcttcccggcacgggaggtctgatatctgggtggagtgggaaccggcaaaacaggagtccgagaaacgtttaagtggaaattcccaactcctggcaaatgtcactaacaagcccactgtagcctccaaaggccagctcccagccgggcaccgtcggggtgctcagcgaggaatttccccactaatccgagcccctgaaccaaaacaacattaacgagtcccagagctgggccggggcaagttccagtagcgtccgtcacactggttggcgagtctgcaaagtcataggctgagcttgtcggctgtcctggcggcagaatgcagaaagaccccaggcacctgttacttcctccccaggtattttaataaagcaatcatttcctgaaactgtctctgtcttcccctgtgtccagttcaaaggcgaggtgaggcaaggctggctctggcactgcatgcgggtggatcctggggagtgaggatcttggccacaagccaggctcaggccctgctgcaggtacaggcaggattaaaggcagggcagctgcccaagtgataggatgcccggaggctacagcacactgatagcttctgacttctccctgccttggctggtcctgggatatgggatccgggcatcaagtagaacagctgcattcactcattgaatccttcccagaggaccgaatgtggcccggagctgagcatgagatccccgccacagccctgagggcaggggaggcgccatagtcatcctgttttctaggtgaggaacctgggctcagagaggagacatcacttatgaaggtcacacagcccggtttgaactccagtgtccagcttcagagcccacatcctgtcttggaggcgggggtttctgttttgttttttttttctgctgtccaggctggagtgcagcggcatgatctctgcttactgcaacctccacctcctgggttcaagcaattctactgcctcagcctccccggtagctggcattacagacacacaccaccatgccctgctaatttttgtatttttagtagagatggggtttcaccatgttggccaggctggtcttgaacccctgacctcaggtgatccacccgcctcagcctcccaaagtgttggaattacaggcgtgagccaccgcacctggctgaggcctgggttcttaccagcaggccagcgattccttttttttttttttttttaattattatttatttattttagagacagggtcttgctctgtggcccaggctggagtgcaattgtgcgatcatagctcactgtagcctcgacttcctgggctcaggtgatcctcccacttcagcctcccaagtagctgggactataggtgtgcgtcactgctcctaattttttatgtttttggtagagatggcttttgccatgttgcccaggctggtctcaaactcctgggctcaagtgatcctcccatcttggcctcctggagttctgggattacaggtgtgagccactgtgcccagctgtgatttccttttaacacgaattcggggaagggaggaggtgaacctgtcccagagcctttctgcctgattggcagggacaccgcagaaggaaacccccactccttgggctgctcctgaggtgttcctcatgacaacgtggccccctcttatctctgctctgggcgctaagtatcatccaggaaggacttgctggaggtgacagtcacaggccctggctcctccacccaccagcctggggacctggaaaagtctgggagctcagtgtcctcacctgtaaacgggggtcgtgacagcagcgccaggagaatgcaacgccccaccaatgtttgtccttaagacttataagtaactgaaattaacatgagcatcgcagcctcaggtcactttcaagggacctcaaccaaaggctggcctccaccccagctaaggtggcacctcggccgctgacactgggggcttcctggcctgcactgcagctggctctggcctggctgacttgtatctgagttgtatctccagggggagcaactccatgggcagtggactcctaaaggcagtgcccactgtatgctgaggccccttgaaacgtatcacagatccacggacagagccttcggtgttggtgattcactgatttcagggccagcagagaggaattttgggtgtgaaggttccaatctcgaagatctgagctgcattctcctctggggtagggcagggcaggcccaccagggaggacaaaccagcccttgggggacagtcatgagtcagaagcacaggatttgccgtcagctgaacaatttagaaaacctgctcctgagattcaggctctgctgtgggcctggtggggtctgactgtctggatgccagcagggaacagtggagcaagagtcatgggcctctgatgatctcagtgtgactttatgtctctgctttccaatgagagaaagtgacaattcactgagcacctccttgtgctgggcattgtcctagcggcttctccaggtctccctctcactcgtcacacagcacatgagctgtgatttctcctgagttttcagagttcaggatcctgtggttaatcagcgcggagctgggttttcagcctggggctctcaagaccttctcatggcttttagtgcaaagtccaaattcttcaggtgctgccaggacccctgatgacccctgtccctttatcttgggcccctgtcccttgccctctgtgctcccgtgtgctggttttctgttcttcacacatgcccagcttcttccagcctcagggcctttgcacgtgctgtcccttctgccttgaatgttgttgctccagccctcccttcatctggttaatgtcaatgcatctttcaagcctcagattgtttgttttattttttttggagacagagtctggctctgttgcccaggctggagtgcagtggcaagatcacggctcattgtagcctcgacctcccaggctcaagcaatcctcctgcctcagccctcctgccaagtagctgggaccacaggtgtgtatcaccacacacagctaatttttgtattttttatagagggggtttcatcatgttgcccaggctggtcttgaactcctgagctcaagtgatccaactgcctcggcctcccaaagtgctgagattacagacatcagccactgtacccagcttgtttgtttgttttagagatggggtcttgctatgttgcccgggttggtctcaaactcctggaagctcaagcaatcctcctatcttggcttcccaaagtgcttggctcacaggcgtgagccaccacacctggcttgttttagagatggggtcttgctatgttgcccaggctggttttgaactcctgggctcaagcaatccccctgccttggccttccgaagtgctgggattactggtgtgagccacctcatccagccctaagcctcagctttcatgtcactgcctcagagaaactttctcagagcctcagactgggtcaggtcccacgtaaacattctcaaggccagccgtgccttcttcttaacaggtgagacaccctggccttccctggttcataggcaactcccccatcggactgtgagcttcataaaagcagagacaggggggccttttcatggtgagctaccagcccctggcacagggtaggaatcgtggatgatggttggatgggtgtgtgtgcaactgcacctctgtcctgccactgtgaactctggtcatggacaaaacatagccccaggtgactgggccgtttgtctcacgaggagtgactctcaactggtatatttcaggcctttgccaaccccgaggatgccctgagacacggaggcccccagtattgcaggagcgaccccgacgtggaacgctgcctcaggcaagtacttcgggcccctggcctggccacacctggccatggcctgccctttcagaacttcttctgcacacaggggacttggaggactcccaggggctgaggttttctgtgttcctgatcttctctgactgttttactttattcaatgatttaatttcaaatgaactttggaaaagtaagacgtggtcatgactcataattacaaagtgagaaaggtggtgacttcagtgaacattcagtctccctcctacctctgacctccaggcactacgcagttctactggccaggggcaaacactcctgccaatggccatgcatcttcccacagagatttgctgcatttacaaacatgtgtgccacgcttttcccgttctgccccatagaatcaccctttatcctctggtctgtactatgcttttttttttttttttttttttttaatatggcaacagagtttgttccatatcggctcacagaggagttgcattcactgtattggtgctccagtatttatgttgccactctgttgaatgtacagcccataacttccctaaccaattcccctgcgatgggcatttgggctccttctgtgttatgaacagaaggcctcaatacctctttttttttttttttttttttttttttgagacagagtctcactctgttgcccaggctggagtgcagtggtgccaccttggctcactgcaacctccgccacccgagttcaagcgattctcctgcctcagcctcccaagtagctggggctacaggcgtgcaccatcatgcctggctaatttttgtatttttagtagagatggggtttcactatgttggccaggctggtctggaactcctgacctcagatgatctgtccgcctcggcctcccaaactgctaggattacaggcatgagccaccgcacccggcctcaacacttttttcatttgcctttatgggtatgtgtgagtaaaaccgcaggatgcaacaaaatcatgtcccactactggtgtgggagccatttttccatccctctgacaatgcaactgacaactcattgtattggcatatttgggtggattcctaccaaggtgataggtgaaaatttatatcacatttttgttttgctttgcacttctttattcttagtgaagttgaacatcttttcatatgcttaacatccccctggtcaattaaaatgaatttcctcattataaaaatcagaactcattacagacgatttgggtaatactgaaaaaacacagagacagaaaggaaaaccactcacagttctaatcacagttcacacttgcatctctctcctctttgtcttctatagctaaatattttccataaaattaggcatgcattaggtacacccaatttggagttctgattttcttttattaacattattttgcgaacactttccatgttggtaaatgttactaaaaaaattattcttgaccagatgtggtggctcatgcctataatcccaacattttcgagggccggcagatcacttgaggtcaggcctggccaacatggcgagaccctgtctccactaaagatacaaaaattagccgggcatggtggcacgggcccgtagtcccagctactcgggaggctgaggcgggagaatggcatgaacccaggaggcggaggttgcagtaagccaagattgcgccactgcgctccagcttgggggatagagtgagactccatctcaaaaaaaacaaaagatccttaaaaaactggcttcgtaaaatcccatcagagactaaatgctaatttcacataatcacagtcaatattaaatttttttggcagtttctgctctgccatcttttaccagttagctggagagtgaggcgatggcactccaggggttggggtcatcggaagagcttgaaggggaagtggggaggacggagagctggacaggctgaggccggagacaaactgtctcatgggtctcaacacattcccctgcatcacaggcggaaatgggtgggacactgtcatttaaataatacaaatttctttcacttgaaagaaagtctgtgggtttttttcttatgtttttcttggccattgacaataatatgtccacttgtggttttaaaaaaattacagacctgtgtcatgtaggaagtgaaattccttgctattttaccctttcaaatccttcatatgaggcccgtctctccattaatgagcccttactacatcccagacactgtgctaagcactggctgtactttcaagaacaaaagccttctccatacatgacttccattggtgactcttgtccccagctgtggcggccctcctggacagtggagaaggatgggatgagctgtccaggcagcaggaggccaggacggtgggttgcccggggccagctcacagcagccaccaagaggatgcgttttggctcctcccaggctgcagaggttttatgtagcaaagctttcatgtggcacaatgtggcacaggagtggccaagtggccttacagatacttggtttatttttactggctgaaaccatgccccatggagagacgatagacccgggtggcgccgagacatttccacccaaccaatctttttttttttttttgagacagagtttcgctcttgtcccccaggctgaaatgcaatggcacgatctcggctctctgcaacctctgcctcccgggttcgagcaattcccctgcctcagcctcccgagtagctgggattacaggcacctgtgaccacgccagctaatttttgtattttttttttagtagagacagagtttcaccatgttggccaggctggtctcaaactcctgacctcaggtgatccacctgcctcgggcttccaaagtgctgggattacaggcgtgagccattgcgcccagcccaaaataacccctcatctacagtactggggtttaaatggtagaaattcatttcagcactttctgagtgcgtcttatctaataatactttatagccatttggtgaggacttactggaagccgactgtatactgggcccaagtcagacctggggagtgcctgggtcccctgggcccctcctctgccacctgatttcacagaacctcatggaaacttgagtgtgcagaactaagagaattctatatcctgccgtctgctaccggagaactggctggaacccgaagggggagaccacctggaagcaaaagttggttaaatattagaccagggtttatggtatgattcgagtcacccttctgtcaaataggaaagcacttcagtcttggttcttggagcatgaatctgccttgcaggttagcacatgctgcagtccaaatgtgagcctagttctgggagaagccagggactagccaccttttcaggatacctatccggagttcccggcaatgtgcgtctgggccagaatctgaggttgggtgtgtggaactgcacggaggggttacctgtgtggtcccaaagaagagaggcaaacgtgcgacctaagcttggagcatttctgtttggagtgtatagacttaaactgagtgaactgatttgtcaggaaattgggtcccaaaatgtcagccctagaagtcccttagatgtcatccagcatgtacattttgtacatagtgaacgcagtcccagagagtgagagagatttgcctgaggccatggagctaataagcaccacagcagaactggaggtttccagcctaatactcccttccggctgcaccacgaagtactcaaaaaaaattttttttttttttgagatggactttcactcttgttgcccaggctggagtgcaatagcgtggtttcggcttgctgcaacctccgcctcccgggttcaagtgattcttctgcttcagcctcctgagtagctgggattacaggtgcgcgccaccactcctggctaatgtttgtatttttagtagatgcaggatttcaccatgttggctaggctggtcttgaactcctgacctcaagtgatccgcctgcctcggcctccccaaagtgttgggattacaggcatgagccacctcgcccggtcttttttttttttttttttttttgtgacagggtcttgctctgtcgcccaggctggagtgcagtggaatcccggctcactgatgccttgacctcctgggctcaaacgatcttctcacctcagcctcctgagtagctgggaccacagacacgtgccaccatgcctggctaatttttaaatttttattgttgtagagacgggatcttgctatgttgctcaggctgattccagcacccaagtgatcctcccacttcagcctgagatcacaggtgtgtgccaccacacccagccccataacgtgcttttgattcatttggccggagcatctgagggcagtcagaaagtctggcaaagccaagagggtgaagtgagctttagcgatggtgtccaggacagggctggtgatggcgatggaggagatggcggcttgcttaaaatctccctactcagtcaagcacagtggctcacatctgtaatccctgcactttgggaggctgaggcgggtagatcacctgagcttaggagtttgagacgagcctggccaacatggcaaaaccctgtctctactaaaaatacaaaaattaaccaggcgtggtggggctcgcctgtagtctcagctactcaggaggctgaagcacgaaaatcacttgaacccaggaggtggaggttgcagtgagccgagatcacgccactgcactccagcctggggcacagagcgagactctgtctcaaaaaaaagatcttcctactcagtgtccaggagtgttgtaagcactttccaggaattcactcacttggcactctgaggaggggcctggcactctcggctctgctcctgaggctgtccctctatgggaaggcgatttcactgtcttgtatacctgcctttgaaacgaagcaggcactgcattgcgtcaaccctgatacaaagtcaaggaaattggccccaccgtggatgccagcagggctgggggagagaagaggagaccctgtggagcggccagcagctgtccctgtcctggccatctggggatcactgtcctcaccgctgtcacctatgcaggaaaatgcagctggtgtggaaaagtctgtggagggtgaaggcaggcctgatgctgcaggaggcaatacaagtccagtctagtaggaatttgctttgggtggcttttaccttaaaaaaatggttattatttgaatgatgcatttcacccgagcacgtctgtggtacgtgcctgcctccatgtctctcggtttggagcctggaggtgggaggagggaggtgagctttcttccatcattccttggtgtctccattgctccctgtccctggccactgcggcctcggaggggcccctctgcggtttgagacagaccagacgagtgagggagggctgggccagccccaggggctgacagtcagagctcctgaccacctctcctcccacgctggtgaccgctgaattgctgcccaatggctggaaatagaaggtggggctcagtccccgctttttctgcaaggcctgctcctccccagcctgcagacatgccaggcagagcaggatccacgtctgccatgaacttcccgtcttgttcctccttcccaccctgtgttccccaacttctttccttcacccactcttcagggtttggctatgtttgtgaactatctgtactatgattctcttaacagctttccaaacattgacttactctttttttttttttgagacggagtctcactctgttgcccaggctggagtgcagtggcgcgatgttggctcactgcaacctctgtctcccgggttcaagagattcccctgcctcagcctcccgagtagctgggactacaggcgcctgccaccacgcctgactgatttttgtatttttagtagagatggggtttcaccatatcagccaggatggtctcgatctcctgacctcgtgatccgcccgcctcagcctcccaaaggacttactcttaaaatatcaacacatactttaaggaatagctgagtgaacgagttgcatatgctggttgtgcttttcctgaaactttcaaataaacattacaaaactcctcatccaggtggcactcccttgtgaatcacttgtgacaggcagacctcattttgggacataatcaaaaatgggttttccaagggtgtccctctaatcagcctgtagggggatgtgggtacccacagctcaattgccagaggacggagtgatttttgttttgttttatgttttttttttttttttttttttgagacagagtctcactcactctgtcgcccaggctggagtgaagtgacacgatcttggctcactgcaacctccacctcccaggtttaagtgattccctgcctcagcctcctgagtagctgggaactacaagcacacaccaccatgtacagctaattttttttttttgtacttttagtagagatgggattttgccatgttggccaggtaggtctcaaactcctgtcctcaagtgatccaccagcctcagcctcccaaaatgctgggattacaggcatgagccactgcacccggccaaggatggagtgattttggaggaacacctattgcctttcctcatcagtcctggtaagggacttacttgacagggaggtggccccagtctttggtttctccctctcttttattttatttatttatttttttgagagggagtttccctctttttgcccaggctggagtacaatggcatgatctcagctcactgcaatctccacctgcccggttcaggtgattctcctgcctcagcctcccgagtagctgggattacaggcatgcaccaccatggctggctaattttgtatttttagtagagacagggtttcaccatgttggccaggctggtctcgaactcctgacctcaggtaatccgcccgccttggcctcccaaagtgctgggattacaggcgtgagtctgtaatctccctcttatgtcttccctgagggcagtaccccaggatctatccagagccagcctctgacagacacaggcaggccacagtgttccccaccgctgggtgagaactgccctgccacagacttgctttccttgtgtctgggttgcaaggtcaggatctgggggaaaaggagaagaggggttcatgtcagtctcgggatatgcggacccagatgccaggtgctgtgtcctgagtttggcctgagaaagatctaggccctgctgggtttacaggagttttgtacactcagattgaattcctctccctctcttatctgcctcactccctcttgtgcaccgcactgtagccatgggctcacctttctgcacattgaacatgctgtgcttattgtgacctcaggacctttgcacacactggtcttccttcctggaatgcttttcccctgcagggccagcttctcatcattcaggcttctgcacatatgtctccttccctgcccacccccaccccaggcacgctgcagagcttcctacagtgtggggtggccaagcactccaggccccctctttccttttggtcaggcccacacaccatcgcactggcccaagaatcgtcttgccagtgagagggaagaggaggaccctgcagcgggtccccactcagtgctgctagtctgggcctggcccgaggagacggtgttattggtggaatgtatgtcagcaggaaggcccggagaacatgcttctgttcctgcacctcacacgcgtggcctgtccttgggggaggtcatgccctgggcactgaattcctgtttatttgagcttccaatgtggcaatctatgggtttagttgctcattcagtctctaatttatgggactcaacctccccacccttcataaaggaagccggccattagtaggagtctggaaaatgtgaaccagcagaagtaggtgagttttctgagttttctttcttggtcatttatttatggtggggttatacagagcccctccgcccccaccacacatatgcacatgcttgattcctttcaacagaaaaagaggcaggaaaggatgtgtaaaatgaagagcttcaccgggggctggccatcggttggctccagtgagtgggagcggatcttgttatgattgtccctgaaaggacaggtggtagttagatttagggggaaaaggagacagagcccggcattcatttcaaaggcctgctcttgggctctagccccttctactcgggaggggcccaggaagctgcattcagaaggaggatgacctcaggcctgactcagagaagccctgccctggaggtaaagagcacaaactccagtcagaactcggttccaatcccagctcctccactcgttggctctgtaaagcactcagcacctctgagtcccacttttcctgcctggtatccaagggctagagaggaaggtgggggagagtatggcaggagtggggtcccggcaagccatagaggtatggtaagagcatcctggaccagtagccctctgactcccagcccatgacgtggcctcgctgcctcagctgcttgcaagcataagcttggagctgccttcttctggactctggggtatccatctccttgacctggctgtgaatggatttgagtgtgtgatatgcctgaaatgacccccagtgggtcaaagcacccccagcttccatgacactctcaaaagggcctatggccccaaagctaatacctggctgaccgcacccctcttgtctccccagggcccaccggaacgacatggagaccatctaccccttccttttcctgggcttcgtctactcctttctgggtcctaacccttttgtcgcctggatgcacttcctggtcttcctcgtgggccgtgtggcacacaccgtggcctacctggggaagctgcgggcacccatccgctccgtgacctacaccctggcccagctcccctgcgcctccatggctctgcagatcctctgggaagcggcccgccacctgtgaccagcagctgatgcctccttggccaccagaccatgggccaagagccgccgtggctatacctggggacttgatgttccttccagattgtggtgggccctgagtcctggtttcctggcagcctgctgcgcgtgtgggtctctgggcacagtgggcctgtgtgtgtgcccgtgtgtgtgtatgtgtgtgtgtatgtttcttagccccttggattcctgcacgaagtggctgatgggaaccatttcaagacagattgtgaagattgatagaaaatccttcagctaaagtaacagagcatcaaaaacatcactccctctccctccctaacagtgaaaagagagaagggagactctatttaagattcccaaacctaatgatcatctgaatcccgggctaagaatgcagacttttcagactgaccccagaaattctggcccagccaatctagaggcaagcctggccatctgtatttttttttttccaagacagagtcttgctctgttgcccaagctggagtgaagtggtacaatctggctcactgcagcctccgcctcccgggttcaagcgattctcccgcctcagcctcctgagtagctgggattacaggcgcgtatcaccatacccagctaatttttgtatttttagtagagacgggttcaccatgttgcccaggagggtctcgaactcctggcctcaagtgatccaccggcctcggcctcccaaagtgctgggatgacaggcatgaatcactgtgctcagccaccatctggagttttaaaaggctcccatgtgagtccctgtgatggccaggccaggggacccctgccagttctctgtggaagcaaggctggggtcttgggttcctgtatggtggaagctgggtgagccaaggacagggctggctcctctgcccccgctgacgcttcccttgccgttggctttggatgtctttgctgcagtcttctctctggctcaggtgtgggtgggaggggcccacaggaagctcagccttctcctcccaaggtttgagtccctccaaagggcagtgggtggaggaccgggagctttgggtgaccagccactcaaaggaactttctggtcccttcagtatcttcaaggtttggaaactgcaaatgtccccttgatggggaatccgtgtgtgtgtgtgtgtgtgtgtgtgtgtgtgtgtgtgtgtgtgtgtgttttctcctagacccgtgacctgagatgtgtgatttttagtcattaaatggaagtgtctgccagctgggcccagcacct

SEQ ID NO: 143 - DNA, 71540 bp, Homo sapiens
gggcgagtgacagccccggctccgcgcgccgcggccgccagagccggcgcaggggaagcgcccgcggccccgggtgcagcagcggccgccgcctcccgcgcctccccggcccgcagcccgcggtcccgcggccccggggccggcacctctcgggctccggctccccgcgcgcaagatggctgacccggctgcggggccgccgccgagcgagggcgaggagagcaccgtgcgcttcgcccgcaaaggcgccctccggcagaagaacgtgcatgaggtcaagaaccacaaattcaccgcccgcttcttcaagcagcccaccttctgcagccactgcaccgacttcatctggtgagcgcgcgcgcgcagggcaccttcccgggcccccgagggcagcgccgcgccagggaccccctctccgcgccctctgcgccctccgcgccctccgcaccctgggaccccgcgtctccggactcccggctccggaccctgctgcccgggactcccggatggacagtcctgccgttgccctgtccccaccctggtcccagacgggccgccgcggggcgcctcctgccctctcctgctctcaggcgcctctagagcgcccaggggcggcgtcgcgggagcctttgctccacctgactaggagcgcgcggggtctgtgcctgccctggagggcagcgcctcgggtgctctccgacccggggttccctatctctccgcctgcttccgggcgcgaggagccctcgccccccaccccttgtttccggggggggcggcgccctgggtgtccttctctatctccctgcgggcatgggacatcctttctcactcctctgtgcctccgggcagcgccctgtgttatctcccattgcccctccccgagggcctgggttcccctttccactcctcggtcacatcactgcgggcccctttcttccccagtccctccagtagtggggcatcctttcctccttcccagtccccctcccagaggacaccaccgccgcggggtcactctcgccctccctctgaatgcgtctttatctcttctcttttcccgagggtgctcggggcatctatgggtacatctgtcgcctgccttcagcccctaccccgacggaaacgctccccactatcccgccacctggtggtcgcagcctcctctcttctgcaggagtgaaggcagatgggggttacagccgagctcccacctacccccacaaaggcggaagactcttgggcacccgcctgtggctgggagtttgcacctggggtacagaggcagggaggaaggcgggtgactctgtgggtaactagctggaggctgggccccccgggctgcctgacatacacctccttctgcttttgcaggggcttcgggaagcagggattccagtgccaaggtaggctctggggctttggggatgctatttgtgggaagagagggtgaaaaatactttatagaagaagttactgagttaggcagagagtgaaagaatcacgttggtcggagtgacctcccaggctaggaattcttcaccacaacagggtcctttcaaggggtgtgtgtgtgactggggccgatggcgcttgggagtcttacatgccaaggaagttcacctacccttcctgccttcccggctctggaagagtcaaagcggtctcctgaagcaatcctggcatggtcagttccgctgggggagaaagtgttttcccgggacgtttctgggagaacctgtcctccttagttcccctttctctgcccatgtcccttccttatctcacccagggaggttctgcctctccctgccttgcagaggtctctgcaggtggctgccgctcctctgcagatggtgcatcccctagaaaggcgactgtgtttgtcgcctgggcctcctctctctctgaaagaagtatttccagagggagtgtttctcagatcctggtttaaatcaccctatcttctgggttgaaacagaaaggtctccagggcactggttacctgagttcttgcatctggcttgagatcctggactctaaccaggggtatcaaacctgctggtggtgagttgatcacgtgtaaagtgtccccctcccccgtctttggggctcatgtctaaaagacagattgcaaattggctctccaggaccaaaagttacccgcagctctgtgtagcccttagggtgtcttacttgtgaatttgatgtgaacgttttagaactgggagatttcacatacacatcctaatttccaactttaactttgctgagaaatggtctcactttcgcttgaaaacaatcgtttggagctgagagccgtcgtcgtagatggggaacagccttaccattttgtctcagttgatcccagtggggaacacttcacccatttctggcccctgtgggcatttaagtttgcaacctctcatctggaaagtttgtgtgttatgttttctttttaatttaaattttaatttttcactcttgggcttggtaagattgagtttggtaagaaacggcacatttctggggtattgtatctttaggggcaaagtgaccaccaccctggtgagctgggtttaaatcaaaagaaagtatttgagtgtggaagagtctgacgtgatttagcactgactgacagttttgtggctgcacctccaccctccagggaaaagtaaagtgatccctagtgagtgtaggtggcatcgtcagtggtgcagaatgtttgcttgctggcagcatggcactgtgctcctctgagactcttgcatactcttctgagatcggggtcccggtgggctcagtgagccctgccaacctacccagcctgtcttaccaagatttggatcctctgcaccacaccagaggactcctcaagtctctttaagtggcaacaacttaggccctggtgcaaacaaatttggattgttttctagaactttgacccctcaaacaaaatgccaatggtgtcttggcaccggaatgtgtaatttcttctttgaggttgcctttcacttccatgaatcagtttcagtctttgtctcttgctgagatcgggggcgatttttaaacatttttaccacggatcttctatgccacctgctctgctgttattgatggatgggaaagtcactttggaatgtgcaaggcatgacacatttgaaataggagatcctttaactcaaagtctggaagataataggaattttctgatgttaagagaaaaaggcagaattaaagtttgtaatgaaatatgggcgctctagagataggagtgtcttttttttttttttgacagggtctcactcttttgccccggctggagtacagtggtatgatcagagctcactgcagcctcaaactcatgggctcaagtgatcctcctgcatcagcctcctgattaattgggactacaagtacgcaccaccatgcctggctaattttaaaacaacttttgtagagaaggggtcttgtgatgttgcaagactggtcttgaactcctggcttcaagcaaccctcccacctcagcccccaagtgttgggattataggtgtgagccactatgcccctctggagtgtctattttttaaattgcctttctttttctcttccctgcctccccaccaagaggcagcgtagagaagtgggcatttgcacaggctaccaggcaagtccctgtcggtctgaatcctagctttgagacttcccaggcatattacttagcctctctgtatttcagcctccttgtctataaaacggagtcagtaacagtaccatagtgtggctgagcagctccaactcattgcaatatccaagattcttggaccagagcttgacacagagtatgctcagaaaatatctgctcttatgattgtccccagactaccccaatggtggggcagctggcacgagagaagactggctctgcagggttgctttgctatggaactgcctgccaggtaagagtcaaaactcagccatgaacttctggtcactctgtgtagctgctttgacagcatattccatttgggcagcagtagggaggagtgaggggaggggcagattggcagtccctgaaattgagatgtttagaatgggaacatataggaaagagggaaatttatccctggtactcagcattgcctgggactaattctggaaccactgaggagttccttagtatctgattgttcttggtatcagatatttcctctgaaagtaaatccacttacgatggaatcaacagtttatacaaaacacataaggttttatgatctcacttaagtcagcaatccagagcccagggcctcaggttcctttgagttttctgctccactatccctggggagtgacaattatctcatggtccaaaaaggatgctagacgctggagtcctcacacccttctttcagctagcaggaaggaagaaaggggtaaagaagggcatatagcacatgctcggtgtcacttgtttaagttgctcaagatccttctacctacatcctcttagctagggtttaatcacatacccacaccttgctgtgagggagcatgtgggaaatgtagtgtttatttcaggcagccactatttagaggatgtttccatttcaaaaatacaagcagagagaggatgttgtctctgccactctggtaggaggtgtgtaggatgatcgcaaggcaaagaaaccattgagagtaaccttcaggctctattacattgtcatggaaattggggacactgctatgggttgggagaggaaggatggaaaactcataaaccttgggaaattatggatttctgtgtgctcaggggagcttaagaatagattttcttgctttcgtatgatgataggacgaaactctaggttgactgcctcataatttctccctttttgtttccactctgtctatttcttataaaaccactctctgggaggtaatttaagaatgtgtttgatgacagggaactggggctgaagatccctattgtaaaattgcctaaattctagagtagaagtggaactcctttgacaagcaaggcagatttctctctatggcatttttttctttgccttttatttatttatttatttattgagacagagtctcactctgttgcccaggctgcagtgcagtggcaccatttcgactcacggtaacctccatctcctggggctcaagcgattcttctgcctcagcctcccaggttgctgggattacgggggcctgccaccacgcctggctaatttttgtatttttagtagagatggggtttcatcattttggccaggctggtcttgaactcctgacctcaggtgatccacccgcctcggactcccaaagtgttcagattacaggcatgagctacagtgctggctgtttctgtggcattctttacaggaacttaggacctgcatttgagctttaattttaattaaagtcttctctaagaagatttttggtagagagaaaaaccttcttcttttattttaaattttgtttttagagacagggtctcactgtgtggcccaggctggagggcagtgacatgatcatagctcactgcagcctcaaactcctgggctcaagtgattctcctgcctcagtgtcctgagtagctgggactgcaggtgtgtgtcaccacggcccttttttttttttttttttttttttgagacggagtcttactctgtcatccaggctggagtgcagtgacgtgatcttagctcactgcaacctccacttcccaggttcaagtgattctcgtgcctcagcctcttgagtagctggaactacaggcacgtgccaccatgcccggctaatttttatatttttagtagaggtggggtttcgccacgttggttaggctggtctcgaactcctgacctcaggtgatctgcccgccttagcttcccaaagtgctaggattacaggtgtgagccactgaacctggccaaatacatattttttaattttaaaattttttgtagagatagtggatcttgctttgctgcctgtgcctggtctcaaactgccagcctcaagccaggagtctcattctgctttggcctcccaaagtgtttgttgtttttgtaaaggaagtgactttggtagaaatagagaggcaataaaatatagagattcagaattcttagcaatgagttggagtccagtagaattgggtatgtatctctgatggagccgcttactccctgtgtgaccttgggcaagtcgtcccccagcagcaactttggtctcctcatctgtaaaatggggataatagcacctaactcatagggttatggtgaagaataatgaggtggtgcatgagaaatagccacagcaagtatcaatgactctaagtgagaccatcagtattacttgattagctgtaggaaactgtgtcaaagtgggacggagttcattctggaacttgttaaatgactaggcctctttcatgtacttagatagtttctcttcttgggtatatttcttcctgggtattgggtaacaccagtgagtgctcagttcagtgtctgggcccagaaacccatgcctggttagcattgtcttttcttctgagaaagatctgaacttgccatggactctctagaaaaaccccagtgtacaaattttctatgaaaagctagaattgatgattataatgagtaagttggctcttccttttcccatgtagattagaaaacatgtttttaaatcttctaattgaaattattcttaaaaaaccccaaagtctgacatgactccaactattgttgttttcatcaatatcaatcctatcaaatcaaagtttattttagtgtgtaattaacacatgtagactagaaaagtttgcacttttttatatcacaaaaaaggttaattttattttctatggaaagctagaattgatgataatgagtaagtcagctcttctttttcccatgtagattagaaaacaggtttttaaatcttgtagttgaaattattcttaaaaaaccccaaatcatgacatgaatccaaccattcttgtttttatcaatattcaccctatcaaatataaagtttattttagtgggtaattaacatgtgtagattagcatagcatatgtgtatttatataacaaaaaatgaatcaaaagttaattttattttgggcagtgttccctagaaacttataatatggccccatgcacttcaggttgaattttcttagtaaaatcataaagaggtccattttttcaaaaaatcaccaagtcaggctgcaagtttagaggttacttctattgtttcacttctctttcttcccagaagcagaccccagagacctgtgagccaaactccactcaccttttagcttattctaaatgtgtcctgcgggcttctctgtgaataaaaggcagaggctttttgacttcgtgtttgatgatttggcttttttcttttttttaccacctgacgggggatttcaggctcaatgtcccaatcgaaataagaatctttgagtgggttaacattgagtcttaaaaaggagggctgatttgttggagaggcaacaacgaattcatttttcactgtagagcactcaggaggagtctgaagctttgtcactgggcaacagaatgcctttctaagtaaatatggaaaatatgacctttgaaaatctagctgatatgatatatagattcttaggatataatttttaaaaaatatattatttccaagcactaatgatactccagagatactgcccacaaccagatgcagcatgtttatagtgtatctaggccaaaaaaaaaaaaaaaaaaaaaaaaaaatagaagatacagaagaaggcaattggtcaaaagattaactgaaggtttgaaaataattttatacacatttgtactgttggggtctctcttctctctgtctctgcttatccttctgtctctgtctctttgtttccatcacacatgcacacacacacacgtgtatacacacacatatatgtaagtagatcaatatgttataattttcacaatacgcatcttcttttgctacttttcagatacaggtcattaaattactaagtataatttaaaatatatggtctggccttttaactctgcagttcaattaattcttgggtagatagggggatctgctgaaaagtttgtctctgacgccttcaaaggtaagtcccttatgttctggcatttgctctaataacatgaattctttgacttcattcatccaatctcttcattgaaattgtgtgaaattccatagatagaatgttagcctttttacagagaatacaacatccacagtgtttacatatggcatttggaggtgtgatggctgcttgaaaatccagtaggaaatttgtctattcaccacatacattcatttattcatccatccatccctccatttatccacccacctctctattcatcatccgtttttctgtttatctatttgtccatccatgcatccatcccttcactccattctccttctaaaagttcttttttttgagacggagtcttgctctgtcgcccaggctggagtgcagtggtgcaatctttggctaactgcaagctccacctcccaggttcacgccattctcctgcctcagcctcccgagtagctgggactacaggcgcccaccacctcgcccggctaattttttgtatttttagtagagatggggtttcaccatgttagccaggatggtatcgatctcctgacattgtgatcctcctgcctcggtctcccaaagtgctgagattataggcgtgagccaccgcgcccagtctcttttttttgtttagacaaactctcactctttcgcccaggctggagtgcagtagtacgatcttggttcactgtaacctccgcctcccaggttcaagtgattctcctgcctcagcctcccaagtagctgcgattacaggtgcccaccacctcgcccagctaatttttgtatttttagtagagacagggtttcaccatgctggccaggctggtctctaactcctgacctcaagtgatctgcccacctcaacctcccaaagtgctgggattacaggagtgagccaccacacctggcctcactgattaagttctatgtgtcaagttctatttgtcaggaactattttaggtgacagaatacaatggtgaatgaaactgagaaaatttctgttgtcatggagcttatgatgtagcggggggagataagacattctacagatcatttcactcatatttaacctcatttttattaggtactttgaagaaaatggactgggtaccgggagaatatataatgggaagctaacctatgtaatggctggggatgcagtcagtggtctgggaattaaaaaaaaaaagcccaacttctcattctcattttctgaggtaactggagaaagtctgagttgtcaaggaactagagctaaaaatctgtattgtaaaactgcccatatcctggataatatatgcaacagggctgaaggcagtggctcatgtctgtaatcacagcactccggaaggccaaggcaagaggattgcttgaggccaggagttcgagaccagcctgggcaacataacaagaccctatctcaattaaaaacaaaacaaaatatgtgcaggagacttatctttgtgacattctatggagaaaccgtaaatatttatttgtatcatggctgcaagtaagatgagtaagtatttggtagaactagcctgttaccttgagatggcttctttcccagtttgacagagaacttcatctcctcttagttaataactcagataatgagctgacttcctttttgtttagggtttacagtttgaggtggctgttctaaagaagaaaaatcagacaatttcagaggtggaggagcaagtctgggccaatagattgaaaataaataaaaagagagagcacggcatttcagtgagaggcattttgagctgaaagtcagttttcagggagcacaagattactcacattgcctgccaaataccttcctcaccctgtgtccatctctgatatattacaactcttcattcctttggcttaggcagtattttctcttgttcagaagatactttttaagtagtttaacaataaacagtgttgactcacttatagagaaaggacttttgtcaagtctgtctttctgatttcattaaggagaaagtctcagttggtgttaatatatctttaacaaccctctaacacaaatctgggcacttagtagatatctgttgaatattctttttttttaattataaaggaactacagggaattatgagaatgtaaaactatgggctgggtatggtggctcatgcctgtaatcccagcactttgggaggctgaggtgggtggatcatctgaggtcaggaattcgagaccagcctggccaacatggtgaaactccttcactactaaaaatacaaaaattagccaggtgtggtggcatgtgcttgtagtcccagcttctcgggaggctgaggcaggagaatcgcttgaacccgggaggcagaggttgcagtgagccaagattgcgccactgcactccagcctggcgacagagcgagactccgtctcaaaaaaaaaaaaaaaaaaaaaaaagttagtttctacctataaaccaacttttttttgagtcagcgagggtacacttttacctaatgttgagcctggttctgttctaccctgagcttgattctgtactggctattcctccttgtgaacagagaagggaagttcagtgtctttcctggaaatttttggtgttgtaaggatgctcagtgttcctgaaggttgagaggaacagcaaggacaggatctggtagagatgtcgcttttattcagaagtgctaagctgttaatcattaccatggttgttattaccttttaattgccatttgtcctgcttgtttgtggtctcctgggcatctccttccccctcagcccacaagcagaaagttgccctacagagtcaggaggagaactcaaacccagaccagagagctctgatccactcctatgggtcttggaactggctaagtagatggaaattaactgattcaagatatgcaacaccattagttcaaccatagctgtgttcctggggtgaattctagctttcttttttctttcatcttgctacttcccagagaccagactttgggcctctagggaaggagtatcaaattgggcttgagagttcaagctcaaaacagacctgattttaaatcttggttctgcttctccatatcttcatgacctttgggtgggtaaaatatgatcctgcctctatctatctatctatctatctatctatctatctatctatctatctatctatctatctgtccatctatctatctatccatccatccacctatccaccaatacatccatccgtctgtccatccatccatccatccatccatccatccatccatccatccacccagctattcttccattcattcatccaaacatccacccatccacccagctattcttccattcatccatccaaccatccatccatccatccatccatccgtctggctatccaaccgtttttccattcatttaatatatatttattggatgcctaccacatatcaggtactgttctaggcattggaactagaacagtgaacagaacagcatcgctggcttcatggaatttacattctagtagaataacagtaataagtgaataacatagaacgaatatattgtataatgtcaggttgccatatgggctttgaagagaagtaagacactgtcctcacccttaaagatcttcctggtcttttaaaaggagaacagcacatggccaattagttctgagacataatgtaaagtgctacaccaagaatgtaaaaacactttggatggcatccctactcctcctcggaccggtgaagattccacagaggaggtgacatttgggaacagtcttacagcaggagtgggagttcccggattgacaaggggatgagggcaggggagggtgtttcaggcacaggacaggacaacgcagttgagatagtgaggagagagaatagggcacatgcagggaacaggaagaagagggtgtgagggagggaggagcaggtgggaggtgaacgtcatatcagaggggttggcccctgtgaaggcagtgtagtgactaggaagtggttgttgtcactgttttaaagtgggatgtgtgggggtgagtgaaatggccaaatgtttgaaaaagaggagcatgagatgcctttggcaacaatacttgccatgactcaaatcctgaaattctaggcctgcagtgatggaagtcaggcaggagaaactgaaatggccatttagaagcagtgggggtgccttaccggagcacctcgtggctgttgctatttttcacaccctaaagagacatttggaatttcatgtcagtcatattgttgattgttctattttgagggtggttactagttatttttatggttctaacaatagggacatctctcttcactgtatccttagacgcggagggccgtagaaatgaattttcctctgaaaggcatcctcccactccctctccctctccactgctgtcacccagtgggtacgtgtttattgagcacatgctgcacatggtggtgaagagttggtgttttggagaaagaaaggcttcgatttaaatcttgacttcttgctgtgggaccttaagcaagttacttaacctcttcgagcttctgttttttcatagctaaaaggatataataataaaacctactttatgtgaagtgtttcttagcaccctacctgacatatatacagtaagcacttgataaatggtagctatttctgttcttcctaggactgggcactgtccttgtccttactgagtttataatcctgttggggaggcaagatgaatgctcttgaatcaaggagacgacgcaagaatggatgtgcttacatgtcgtggtcaatagcattagctgcaccttacagtggatcttagagagaaatgcttggttggggccggagaggtgatttgagtgtgagtgagcacagtgctttctgagaaaccctttcctggcctgcaacactttaatttgtgggaaacctcaggaagtagaattgcaatctgtgatcgccccatcggctgacctcacttcaaaaatgtattggtagcatttcaactttaaatagatttgtgaccatttcacccttctaaatttgggttcccttcaccctttgggtggagtgtttatatcccttttcggttgaagaagctgacagatagtgtaggtgaaggtggagggtgaagtctgaaggacggtcgcttgtctcattgggatagtcagggcagtgatttttgtgggatggccctatattgaagatcttctttccctccctaaaggtagagaccattctttagagtttagtgagtgctgcaaatgaagatttgatcgttatttggatttttttgcatgtgtatgtgtggattttttttggtagttatccagatacattttgtggcaaaatttatggctgagggtattgataattgtttctgagacaaacagtgcacttagggaaacaggattgacatatagagtagagaaggacttctttttatttcagttggatattcatcttttggtggctagctttttttaaaaaaactattaatattatttttgattgacaaatcataattgatggggtacaatgtgatgttttgatacatatatacaatgtgtcatggttaattcaaactaattaatataaccatcagcttgtttacttattttttatggtgagacatttgaaatttacttagttatttgaaatatatgatacacttattattgactatgttaccctgctgtgcaatagatctccaaacctattccccttgtctatctgaaactttgtatcctttgatcaacaactccttccctcatcccagattctggtaaccatcctcctactctctacttctatgactacgactttattagattccacatatacgtgagatcatgctgtatttgtctctgtgtttctggcttattttacttagcataatgtcctccagattcatgtatattgtcacaaatgatataatttctctcttttttttaaagtctgggtaggattctattgtgtgtatacaccatactttctttattcattcatcctctgttgaacacttaggttgattccctatctttgctattgtaagtagtactgcaacaaacatgggaatgcacatattctttgacatattgatttcagttgctttaaatatatgcccagaagtgggattacttaaaaaaaatttaatttaattttttttaatttgagactgagttttgctcttgttgcccaggctggagtacaatggtgcgatctcagctcactgcaacctccacctctcaggttcaagacattctcctgcctcggcctcccaagcagctgggattacgggcatgcaccaccacgcctggctaattttgtatttttgctagagacggggtttcactgtgttggtgaggctggtctcaaactcctgacctcaggtgatccacctgccttggccttccaaagtgctggaattacaggtgtcagccaccatgctcggtggtagttcacttttttgtttttttgagaaacttttagtactgtttttcataaggctatactaacttacattcccaccaacagtgtatgggtccccttttctctacatcttctccaacatgttattttttatctttttgataaaagccattctaacaggtgtgaggtgatatctcactgtggttttaatttgcatttccctagtgcttagtgtgctgaacattttttcaagtacctattggccatttgtgtgtcttcttttgagtaatttctgttcagatcccatttttaaatcaggttatttgtttacttgctattgagttgtttgagttctttgtatattttggatattaacttcttatcagatacagcatttgcaaatatttttcccattctgtgggctgtctcttcactttgttaattgtttcctttgctgtgaggaagctttcagtttgatgccctcccatttgtctccttttgcttttgcttaatcattgcccaaaccaatgttgtggagtttttcccttatgtttttctctagcagttttatagtttcaggttttaagtctttaatcaattttgagttgattgtgtatgtggtttgtaagataaaggtctaattgcattcttctacatgtggatatccagttttcccaacaccatttactgaagagactgtcctttccctcattgtgtgtttttggcacctttatcaaaaatcagttggctataaatgtgcaggtttatatctgggctttctatcctgttccattggttgatgcatctgtttttatgctagtaccgtgctgttttgattacaattgctttataatgtattttgaaattaagtcgtgtgattcctccagctttgttctttttgctcaatgttgtcttggctatttggggtcttttgtggtcccatatgaacttagggattgttttttctatttctgtgaaaaatgacattggaattttgataagaattgcactgaatctgtagattgctttggctagtatggacattttcacaatattaatttgtctagtccatgaacacggaatatcttttcatttatttgtgttttcctcagtttctttcatcagtgttgtatagttttcagtatacagatagtttgcttccttggatacatttacacctaagtaattttttttttgctgctattgtaaattagtttgttttcttaattttctggtctggtagtttgttattagataagctagtatataaaattagaataattagataatctaatatagaaacactactgattgtatgttggttttgcatcctgcagttttattgaatttgttgatcagttctaacagcttttttagtggattctttagggttttctgtatataaaatcaccttgtcaacaaatagagacaagttcacttcttcccttcctattaggatgccttttatttctttctctttcctaattactctggctgggacttccagtactctattgaaaagaaagggtgagagtgggcgtcctgatcttagaggaaaggctttcaacttttcagtgctgagaaggatgttagctacgggtttgtcataatagagcccatagtgtttattgtgttgagtgcatttcctttataccttattgctgagtacttttttcatgaaagaatgttaatttttttcaagtgcttttttttcctgcatctattgagatgatcatatgatttttatcctttattttgttaacatgggtatcacatttattgatttctatgtgttgaaccatccttgcatcccagggagaaatcccacttgatcatggtgaataaaattcttttaatgtgttcttcaatttggtttgctaatattttgttgaggatttttccatctatgttcatcagggatattggtttatagttttcttctcttgtgtttttgtttggctttggtatgatagtcttggataatgagtttagaaatactcccttaattttttggaagagtttaagaagaattgattgacatccagatcaagaaacagaacatgctggtaccctagaagcatcatctcacaatccctatcaaccgtatccttcaggagtaatcactatcctaacctctatcacctatgattactttcatctgttcctgaacttatgcccacttttctgttatgcaactccattgacttatgcccatttttctgttaaaaaatttaaaaagtgcagagctttaagttactgaggctgagcctgagaaatgttagctgggacttttttagttttgcatagaggaagtgaaatccgtatgggagacaggcaccttctggaatcacccattggggaatggtgccgtttgccttctttggggaacatctgcttcctgtttcaatgttgcccatcggttccagactgttcaacaaggaagccagggcattctgacagtttttccacacaataatttagctctgtaaatactaggaaaacttgagctcacaaactatttttagggcttaacatttcaaaaattctgtattagtaagaatctattaaagctgctgtaacagacaaaccttgaagtctctgtggcttgacagaagggagtttatttcttactcatgtcactaaccagtgcaggtggtcctggtcaggacatcttccacagagtcacacaggaccccagggtcctccccattgggccagtggaaggggaaagggaaattgagaaagcacactcatttcacaacaacttcagctggggaaggaagtcacatcacttctgctcacattctatttgccagaacccaggcaaagaggcaaccaacggaagggggtcctgggacatgtcgactagctctatgtccaggaggaaaagaaaacaggttttgatgaactcagtaaatctcactccagtctccaaagccataatttcctttgtctttctttgcggtgatgtatctagttttatctctcacttgactggtaaaactaagatgcaaaactctggacgtctttatcttatcaaacatagcagggaaagagtgagttctatttgtgttcctaaaagtgaaataaagaagcacttttcttgtttttagttattagaacaatctggctcttgtcagactttctagtttttcaatcagtcagaattcttgcctctctggttgcctgttgtattaatccattctcatgctgctaataaaggcataactgagactgggtaatttataaaggaaagaggtttaattgactcacaattcagcatggctggggaggcctcacaatcatggcagaaggcaaaggaaggtcaaggcacttcttacatggcagcaggcaagagagcgtgcacaggggaactgccctttataaaaccatcagatctcgtgagacttattcactatcacgagaacagcattagaaaacccacccccatgattccattaccttccgccaggtccttctcatgacacatggggattatgagagctacaattcaagatgagatttgggtggggacacagccaaaccatatcacctgtggacatcccaagcagatctctttgaggccgggttagttctcttctaagctgacttgttatatagaagaatcctttgttggttctacttccagatatttgactggacacccaacaaatcaattatctattgctggatagcacataacctcaaggcttagtggcttaaagtagccactgttttatttagttttagtttctgtgggtcagtaatttgggctgggctcagctgggtggtctgtctgatctgggcagggattggctgttcttggctgggctcatttaccttcctggggcctcagcagggatgtctaggacaactggggcctctcttcaggtctttcatcttccagtgggctatcctgagcatggtcatatgctgatgggtgcattctctgggcatgagcaagggctgcagggcttcttgaagccaaggctcagaacatgcataacatcacttctgccatattccctggtcaaagcaaatcacaagcccaccccagaagtaaaggaggaaatagagaagagaatagagatgcctcctcttgatgggagaagctgcaaataatttgtgatattttttggaacccaccacactaatttcagtgtggtcctcgcaattgcttggctgtctaaaaacatactccagtctagtgtgcatttctgaaaatgaacttgatcaaaggcaggccccaaatgagtgctcaacatttacacctgataataatactacctacctcctagggaaatggtagggccagatgagatgctgtatgcaaaggatacggccaggacttagtgcacacgcaacactgaatactaccaccatgactactgaatactgccatcaaatactaccgttactaccacttggcactccctaaaagcttgagattcagagaaaggaagacaaagcccctgtacttgaggagggagagaataaagagagccggcgggggagggggtggcaggagagagagagagagagaggcgtgtgagtgagttcttgcaacacagtgtggtcagtgtgatcacagagctgtgatggagtgcggatgaggtctgatgacttactggtcaagagcatgggttcaggcctcagttcctccccaatcacatgtggggtcttaggcatctttctttttaatcttcagtttctttgtctgtgaaatgaagataatggcacagagcctacctcccagagttctatgtggattaaatgagacaggcaaacaacaacaaaaaccacaaacaaacaaaaaacaaaaatgaaaacaaaaatcatgtgattgcttattaaatgttagttatagaaaaaaatataagttcttaaatgtgcccttgtaaaaatgtcctaaagacctcatctttatttagttcttctgcaactctggctagcatcattgataaattgtcttaaaagatgaagatttgtatgcaggtggtttattggggatgtagctcttgggaacaacatctataagggatagagggaagcagggaagaggtagttgaactgtggtgcaatagttgtaatagaggccaaagccaattccatggctggagctgagacggcccttcagaactgggacaagccaatgcatcaagtgggcattgattgtgggctgctctttggaaggcagcattaccttgggcaaagcagctcccttcttcaggggaggagtcccagggaggacacagctgtgagcaattggttttcccagcagctgggggaatgagtgccttgtccctatagatggttttgagggggctgcatttgggggaatgccttctggggttcactgcgtgcttctatgtctttcttagaggttcatttcaaactataccttggttcattcacagtactgatttagttactatccagattcatagactgtacttgctggcactggaatatcatggacagagagtcctaatctgactaggcctagggaatgacatgggaatagcttgtcctgggtcatccagctaccagagaggagagctgggattcatatccaaccaacgatactttatacctcacattacttctgttatgctacacactcctgagtcacaggagattccaacttgtatttcaagcccagactgcatgacttcaatgtcctgttgcccttaacccctgtatcagattgcagccccactctggaaagttttcttgaattcttctatgtatgttttttaaactgtgggtcatcactcattagaagttcatgaagtcaatataataggtcaagaataccatgaagaaagcagaacagaaaatatcacagtgcatcactctcaggaagggtagatattgtttcacgaaactttttttttttttgagacagggtctttgtctgtcgcacaggctggagtgcagtggtacaatcatagctgactgtatcctcaacctcccaggcccaagagatcctcccacctcattctcatgagtagctgggacttgaggcacatgccatcatgcctggctaatttctaaaactttttgtagagatagggtctccctatgttgctcgggctggtctcaaactcctgagctcaaacagtcctcctaccttggcttcccaaagtactgggattataggcatgagccactactcctggcctcatacaatttttatttgatataaacatatatagccatgagtgaactgggtcaaaatgtaaaatgtgtctcttactgcaggtaactgtcaatgtagttcgaatatcactgtgaaatatatagagaagaggctctgggggctcatgaacttggcccatggactgttgaggctttttttttaatctttagagatgatataaatgtagtgctttgaattctttataattagaagttttattcttaccccatcaccatgtcccaagataatttttattatcatctttcagctttaacatatcacagacaaaagttatttttccaaatagaattttaagtatggtataagaggtttttagaaatggaatgattggttttggcggaactgcctggcctgacctgtcactcgggtgaagtgtcagagagctgtgtcgaatgctggcggagaactgtccctctcctgcagagagaaggagctgcttatcctgggggataatgtgggttgagaaagaagtgttttatgagcagaatcagcacagagggagggaggaggaggtgtttaggggctgcagagagccgccagaagatgtgggaacagtatgccagcacggaggtgggtcagatccccatggtgggactctgctgagggttgcctccagccgagacttccaagggctgggattcagtgtgtgtttatgttctctggtgtgcctgataggtgggggcccacatgacagctggcctctctgtgtttcccttctggccgtctctgatttggggcccaagggccataggggggccagggcactccagatgggacgaaaagtcaagtccaagaaaaaaatgaaatccgggctaggcttgtccctgcttgaggatgtgagagagagagagagagtgtgtgtgtgtgtgtgggtgtgtgcgcacgtgcgtctgcagtccctagaaggatctctattcattggacagagaggccaagggaattttccatttcctggatgtcttcaaagatttcaaatgccattaacttgagctgacatttattgagtactcactcggtgactggcactgttctaagtactttacatgtattaacttatttaatcctcacaacagccctgtgtggctgctactgttattgttgccattttatgctgagaaaacagcacaaagaattgagaaatttttccaaagttacagttaggattcaaaaatagacttggttttaggattgtgtaacttcagaattgatggtgacaatgacgttgatgatgaggatgatgatgatgatgatgaaggcagctaatatttcagtgtctgcaatgagctgggcattttcacaaactttatccctttgaatctttaccttccactaagatttgctgctattcttatcccttttgtagataagaaagcaagcttagagaagataaaacatttgcttaagtaactgcagagcgtagattgaattcaggtccattcgagtcagactgtctgttcaccaaggtgaagggctccgggggtcacagaggagcaccatggtgaggaaggccccgtaagagtgtggcagaatggcaaccaggaaggatctggtatacgggatggtgataaggcccatctctcatggccaggaaagtgtgcctgccacagcaatgaatgaaactggcaacatttgacaggaaggggaaattctctagtgggaggaatacttccatcaaactgttttttttttttcccagtgggggagtttgcacatgtgtagatttttttagccatagccttgaataaggaattcagaaagtggcttctagtttgaggactttcattggccacgtgatcacagtaggctgatttcttcatgcctaagttaccaggctgggaggacaggctgagaactatgcaagctgttgagtcacttggaaggaagagggttacatacagcaggcactttcatggaataatacttccctgaagagctgcactaatttattgaggcactgagctggatgcttcacacacatgatctcattgaatgtccacagcaccctaggaggttgatctcattattaacttcatgaagtgactgaggcttagagatattaaatagcttccagcctgggaaacatagtgaaaccccatctctgcaaagaataaaaaaaaatgagctaggtgtggtggctcgtgcttatattcacagctacttaggaggctgaggtgggaggatcccttgagcttgtgagggttgaggctgtagtgagctttgatggcaccactgcactccagtctgggtgacagagtgagaccctctctctaaacaaacaaatcccaggagacattaattaacttgccactggtctctaagctaagtagttgaagagggcaacaaacccaggtggtctgactcctaggcttgaaggtccaggttcagctactccaccagtatccctggtcagtctttggccagggcacagaaggtggcatatcaagttgtggggtctgatttggaaagtgtgagatccctcctttgtatcttttccaaagtccactcagaagagagtagtgtaaaaggagtgatagcacagcgtggtctggctggcatagtcagccgccctgtgatgggcagggggaagctgctttctgtcctcaagcagcccctaaacttgtaggccagactcataaatcacacattgataactcagtgtgatgtgtgctgtaatggtggagaggggggagaaatgccaggagcagctcacctcccagggtcctggggaggctgcacagaggagcctgagttctcagttgggttttgaggcagaggaagcagtgaaagagagaggaagaatgtcagtgaggtgcggggagaagcaagagagagaagacacttggcaggaagaagtagttgaagtacccggggatgtttagcttgaagaatagaaaatttggaggaggcagagaaaaggcaggaaactttaaaagcaggagagaaagacctccaggttcccaaagggagcatggcacttctcaagggggtgaggttgacagcattaggagagagagagagagaaagagagagagagaaagagagagagcgagagagttgtcaaggaagggaaggacccatggaggggagagcacaggtgaaaatgagaagtgatgggaaaatgggtgggaaataaatgaagttttgaggccagttgagaaatcttgcttggtggtttctattttctttgtgaagcagaaaaaaagaggaattagacagacctgcattcaaatctcatgaccccaggcaaatttcttatccttagcttcttcattttgaaaaaggggtgaatgataataggacctacctaataagagttgtcaggatcaaatatgttagtgcttgtgtaagatgcagtggcaccctggcacttagtaccaaaaaaaagtactataaatgttgtcacctattgagggagtccgggtttgggtgcttgatacatagaaatatcatgaatagcagcagagaatacaagaagaagagaaagcttgggggagaagatagagaattatgcgttgggtatgttgaggatgaggtgcctgtgccatatccgggtgtaggtgcccaaaggcaactggaagtcatgagaagtcagggatagaggtaaatgtttgggagttgttaatacaggggtgcatttttaaaatatctgaagtatgttactggtggcactcaaagatttttaatgatgtaaggtattcaacaacatggaactacgtagttttaaaagaaattctcttgtaggccgcgtgtggtggctcacacctgtaatcccagcactttgagaggccaaggtgggtggatcacttgaggtcaggaattccagaccagcctggtgaacatggtgaaaccccatctctactaaaaaaaaaaagaaacaaaacaaatcaaaacaaaaaaaccgggcatggtggtgtgtgcctgtactcccagctactcgggaggctgaggcaggagaattgcttggacccggagtcagaggttgcagtgagccaagatcgcgctactgtactctagcctaggcaacagaatgagactcagtataaaaaagaaaaaaatgtttttttcttttaattcttcgggttaaggagagtgtcttagtttggtgctatcatgtcctaaacatctttctaatgcatgcaaatctcccttttaagctaaaagaatgaagcaatctcagactcagagctatgtacctgctagaatttaataatttaaattttcattgtgttcttcatactcaccttctatttatagcaagtgttactagctctccaattctggaggttgtttcagataggatgcattagttctttttttttttttgagacaaggtcttgctctgtcacccaggctggagtgcagtggcacaaacacagctcactgcagcctcaacctcccaggctcaagcaaacctcccacttcagcctcccaggtagctgggactacaggcatgtcccaccattcctagctaattattttattttttatagaaacagggtctcactgtgtttcccaggctggtcttgaatttgggctcaagcaatcctcacacctccgcctcctaaagtgctgggattacaggcatgagccaccatgcctgacctgctttggttcttaaaaacagaatatctggcgagcctaacaaggaggctggtggttccagggttggtttaatcaaagacttaacactgtcatcaagcgcctctcagttatttgctctgccatcctcaaaatgtgatcagtgtctcccttcttggtcccaggaaggctgtgatagctcccagaatcacatactcacagggcaaagcaggaaggaaggggacataggacaaaggatttgtgtttaagtatttcatgtcacatttgcatgtggtgcttggagctgtggcagctatgttttgaccatgagggacaaggttggcaagctgtaaatggcagtgtaaaaagagggagaggatctgtctccttcacaatatccttgagcccctgaattcactaatcttgatatagctctatctcttgaaattttgttttgttagataattctcttactgcttaaaacgtcttaagatgggttttctgttctttccagtagaatgcattgtatctcacacaatttgaggttattgcctcaacctactctgaatcattgctcctcccccttttttcctggttgattagcttctcttgagattgtgtcttatcttcctggttttttgtatgtcgggtaattttggattgtatcctggacactgtaagtgttgtgctgtggagactctggattcattcgtatttctctgaaaagcattgatgtttttgttttagtaggccattgacttggttggacagtagactgtctctgggacaccagctcagatgtcagttctgttttttattttatccttgagtcttctttgggactgccccatgcatgcatggttcaagagtcagccagacatttgggtggggtttagacacagaatttggggctcttctctcttggctgtctctattatggaattccttcctcactttccagaagccgtgagtgacctgaaacctgtcctctggttctgtacaccagaaagacttgaggcttcatgttgaagttttagctgacagcagcttgcgttcaggggaaaagctgtaaaatgaccattcccttcttccaagtttcaacctctctgcagaatctgctttcttttgttcactttcgagtaatttcaggaaaaaatttttttttcgttgagagtttttacttgttacctatggaaaggttgggtctagctgaagcttgcttgcccataacagaaacgagactcttttctgtctaacacatgggaaaactaacgcccagagaggtgaagtcatttccccaattgtcagaggcacttgagccagagtgactccatcttgagtaagggctaggaaaataagaccgggacttgctgggctgcattcccagaaagaaaggtattcctagcctctagatgtctacagttaagggaacagattgataatgtttactaaacagagccaggcttggcagtgtccagctatcccgatatcttgagaacaaaggcattcctaattttgctttaaggataataatattgattattgcaaaacagagtaattaagaaaattaatcctttatcacaaacccttgtagcagaacacatctctccatgatttttaaaatcatatatatatgatttatatatatgattatataatatataacatatatgatcatataatcatatatatgcatgtgtatgtgtatatatatacacatgcatatatatgtatatatgtgtatacatacatacgtatatatgtgtatatatacatacatatatatgtgtatatatatacatatatatacacatacacacacacacacacacacacacacacacgaatattttacctagggtggacgtgctccttctcttacttttaggaaccccctactctgtctatggagtaactgttctttcaccactttactttcttaataaacttgcttttgctttgcactgtggactcaccctgaattctttcttgtgcaagatccaagaaccctttcttggggtctggatcaggactcctttcctgtaatacaatgtcacagagctcttaagtggcagagcttggggccaaacttaggctgctgcacccgatgtcccagctcctctgccctatctagctgtggatttgtgcctcgaaatagaattgcattttgaatgcagtttcattttcgtatggaaagtgtctatcctgtaaatgtaactgtagcagccccaaagctgagctgggcagttttatggcagcctggagtcagtcttgtccgcttccaatcagggttcctggactggctcctatattaaaattggtattagtagacaatgttccaggcagagttttggatagaaactatccatcagcaccaagaatgtgcctgatttggtaatctttttaccaaagtaaaagtcagtagtaagttgtggttaaaagagaggaagttcagagttcagtacgttatttctctctctctctctctttgtttaaataaaagaggaagttactgctcttatttttgtaccagcccgtcagtaatgggtacagagtaaaatcttagctaagctgaggtcaaacttcaaaacttagtaataaggatctcccttgttcctttgtagggcgactaacatgaaggttctgactcttaacccatagagccacaaaaaatagtcctaggaaaatcatatgattttatttattttaggaacagaaatggtcccttccgaagtagaggcatttctacttctttcctaaacaccatctctgctcagtgagctctcccaccctcaggtactgtgtttcaggcttattgctgtattgctagaagtatcctcaccttcgagattaagaaaagatatttattgccgggcacagtggctcacgcctgcaatcccagtcttttgggaagctgagacgggaggatcacttgagcccaggatcttgagaccagccagggcagtatagtgagaactcatcttgaaaagaaaaatttattgagctcctactgtatactggggatacagcaataggcaagatagcccttgctcctcatgtaacctacagataataaacaagattacaaacaaacaaaataagaggtcgttctagattatgataagtgatggaaaagaaaaaacctgtatctacttcttatagcagagacctgcattgggagttgctgtgatcaaacaggaaacggaaggtggagtttgcttctgtatccctccatccctgagtggaggctgggtgcttctcacgaccagggcctctgagatttctttttttgttttttttaaattattttagattaagggagtacatgtgcagtttcgttacgtggttatggagcgtgatgctaaggttagggtttctattggtcgcgccactcacatagtgaacctagcatctgataggtagttttttgacccccttcccctatgccctctccctcttggggtccctagtgtcggttgtttccatctttatgcccctgtgtacccaatgtttagttcccacttcgaagtgagaacatgtggtatttggttttctgtttctgcattaatttgcttaggataatggcctccagctgcatccatgttgctgcaaaggacacaatccaaataagcacaatcagaaatgaccaagctgacattatgactgatcccacagaaacacaggagatcctcagggatgactatgaacacctctatgcacacaagttagaaaacctagaggaaatgggtaaatttcctttgcacacaacctcacaagattgaacgaggaagaaatagaaatcaagatttattttctgttttgtttgtgtgtgtgtgtgtgtgtgtgtgtgtgtggttttttgtttgtttgtttgttttttggacaggatctcattctgtcactcagactgaggtacagtagcacaatcacacctcactgcaaccctgacctcctgggctcaggtgatcctcccacctcagcctccagggcagctggaactacaggcatgtacaacaatgcccggcatatatatatatatatatatatatatatatatatatatatatatatatatatgtgtgtgtgtgtgtgtgtgtgtgtgtgtgtgtgtgtgtgtgtgtgtgtgtgtatatgtatatttaaatttttatatataaatatatatctatctttgtagaaatggggttttgccatgttgtgcaggctgaaattgagatttcctaatgtaagaaacagagccccaaggggctcttcttgggctggtcgctgtatttcatcaggtgcctctgtgttggacacttacttccctccattgcatagattggatcctttatgcttagcctagactctgccctttgggatgcaaggagctgagtgaaggttctgggagagtaggcttaagcccagaagagggaggcctctctctggatgtcatgctagagcctgccttttagtctttgtgtttccactctccatcctcctcttctggagttcagaaccccttcctggtcaaattgcccccgggctctatgggatcctgtgggattctatcctttgagtctaccccacccttcaagtacttcctgtcttttcacacctaagtgaaagaaagtaggataagaacagcagttgttaacttgattgattgtaaattgccttcattagaaaatgttaattatcgcccctgggaagggattaatcctttaggtctctaggttactagactggcaaaagccaagtgtgccttggttgactgtttctttctgagagtaaagagaaaacatcaggggaggtagaaacctcagtcatggggtaatcattatggccatgtttatccccatacacgtatcttctgctgattctggagtcagctagattttgtgacccagcatagatgatatagtgacattgtcctgctgtgttaaaaaatttaagttcataagaaatgcataagtacaatctcatcaggataaattacacaacatagataagattgaagaccttttaactcttttgacgtctcaatttagtcccctctaccttccccagaagcctattgtttgtaaatttggtgtctcttatagaactctgtagcattccaaagtctgaactttctcccatgcatatggccacttccctgttgatgaacatttagattcttttttggaggggttgtgtctattacaaacagcatggcaatgagcatctttctacacatctcatcaatatgcaagtgtttctcgtgttcctcggaagtataatggcttagccctggggtatacacgattcagcttttaataggttttgccaaatgttctccagaatagctggaccactgtatactcccaccagcagtgtgtgtttccgtctcactgcatctttcccagaccatgatattatcaggccttaacacttttgccaatctgatgggagaaaaatggcatttaattttaatgatcctttcctgtccccttctcttctcttctcttcccttcccttccccttcctttcttccttcccttccttcccttccttcccttccttcccttccttcccttccttccttccttccttccttccttccttccttccttccttccttccttccttctctctctctctctttctttctttctctttctttctttctctttctttctttcttttctttcttcatttcctttcctttctttcctttcttactttccgagtctcactctgtcgcccaggctggaatgccgtggcatgatctcagctcactgcaacctccgcctcccaggttcaagcgattctcctgccttagcctccttagtagctgggattactgccacctcacctggctgattttttttgtatttttagtagagacggggtttcgccatgttggccaggtgggtcttgaactcctgacctcaggtgatccaccggcctcggcctcccaaagtgctgggattacaggcgtgagccgctactcccagccacctcttcttactagtgagactgaacatctttttacatatttattggacaattgtatttcatcttctatgaatgtctccctccccacttttttataatttcatattgatttgtaataatttttatttcaatctactagacactgatcctttgctcgttgtttgtgtttgtgttgtctattttcatcaagtcctgggtcctgtgtcactttagtgccataagggaatgacagactcccttattattggtttagctcttgaagcctaacaaagtgtttccaaacagttcattattcccactttaaggatgtgaagactgaggctcagggtcacaacttgtgcaatcttgggtagactttgaatctctgagcagacttagaagtagaccaaactgctgtgagccacagggagattattattgctaacttttccctgttagccaaacacttctgcttggtccctctagagagaagtctttaattattcatctctttccaagtaattggcgacaagtcctgcagctgggagttggaataaacttggttgctaaaagcatccatcacacataaaacaggggagatctggctccaaagaatggtagatgtagatcttcccctacggatttgttttctgaagatctccttatacactgacctcagccttttgctgacctatccttgtgaactgaaggctgaaaaaaccaatgtagccatggtccacatccatttatcactttcagaaatggcccctgcactttatatttcttcaggtcctgcaaaaaatattgaaaatcctttacaaatagaggcaaggtcaggccatccctgtgggatttccagggagcagtgcactgacccgttttgcagaatgggaagcaaaaaataaaactcagacttagacagctggcataagcaaggacttccctattctgagtgccaaatgtcaatttgaaatacttgaacttttattctctgggacatgtactggcattagtaagaatttctatttattgagcatttatttggggcaggcagatgataagttatacacattaattatcttatttgattttcacaatgacctatcagttacataattgattgtctgcattttatggataaataacctgaggctcagttatttgacttgctcaaggtgatgtaacaagtaaatggcagagccatgatttaaataacaaaacgcatgctcttaatcaccacattaatgtcttgatatcaattaatagaaccatttcccctccattttctctttagtttcagaactggtaagagtttgtctaataagatttttataaagtggtgacatgaatggcttgtggggatggagactggggccggctgccaagggtacccatctcacacgaagcatcaggtccacttgggtttgtttttggctgattacaatcttgaatcaaacttttcagtacagctggtctcccaagaactttctaatgttgatttgagcttccctgaatgaatctcagaaaataagaaagggagagagaatgcctgtgtattgagcttgacccatttcacagatgccgaaatagaagtgaggcgacttgcccagggtccctgtggtggattgtgttgttgtctcaattatttgctcccacctcatacaaggattatacatttcacacatggctatgtgacatacatgtctacttgcagaagggacacactttccttcccactgatgtggagcattggccaatggaacgtgagcagacacaatctactctacatttaaacagaggctttgagaagctattgtgtggtttagccattgttcttcccacctctgccacaagaccaagaaagggctgttgcctcagctgcgtcctgggatggaaaagacacaggaagtagaatcacagagccacagacaactgcagtgacacgtagcacgagtaagagctaaacttcgaatattgtaagtcactagaattttggggttgcttattattgcacttacctaccaaaagctgactaatacagtcatatagccagtaacttgactaagctggagcttgagccaggtcgaactcccaatcctatccatggtctttttcttatttcagtcttccctaatattccattctaacttacatcatattttctgtgtctgtgtgctgtctgtccttttttcttttaaataaatctttttctaccaaagatatagaacaggaaataatatttttctttaaagagtctgttttttcatttcaacccatttattttgaaggaaattttatcatcgtataaatagaaaaacagtgtcatcacaaataattcataactataagcagtggctcacgcctgtaatcccagcactttgggaggctgaggtgggcggatcacctggggtcaggagtttgagaccagcctgaccaacatggtgacactccatctctactaaaaatacaaaaattagccaggcatgctggcagaggcctgtaatcccagctactcaggaggctgaagcaggagaatcgcttaaacctgggaggcggaggttgcggtgagccgagatcgcgccattgcactctagcctgggcgacagagtgagactccatctgaaaaaaaaaaaaagggtaatttaaacaatattatgaagttctagctaggtactgttggcagacaagaatctgattttgaaatatcgtctctctatgttccaaaaaggagtttggcaaatattagaatggtgttcaaaacatacaagcaccaaactgatactttctcctttgataaatcaggaagattaaaaaagaatcagaagaacaatttcttcctagtatggcttggtgtgatgagtgtcatctgtattccatataaaattctttcagatatcaccaatgagtgatatgttcattacaatggggggtgtccctttctttggttcatgtataataactggaaacatgtatatagcatgtggtatgtgccaggtactcttcaagatactttagttatttaatctattgtcagataaggaaacagaggcttggagaggctaaacaacttatcctagctagaaagaggcagaattggggcttcaagtcaggtctgtttgattccagaggcaacatcctaaagcaaagtttccttctaactgctcacttgggacttttaaacgaagccattaggtgcttcactttcttgtggcatgccagagtggtagctgcttcagggcatcagcctggggccacatcaggacctacctgcacgtaggttgatcaggaccctggcagggctgtcaggtacagccacaaagcaagctgtttctgactgtgttcccacactttctcaggcatccaccctggtgtatgaatttgcttcttctttataacaaactacctctaaactgcactctagtctacagatcagctgggcaatgctgttgatctcggctgggcttgctcgtgtgtctttggtcagctagcaggttatctggggcctgattggtctaggatggcttcacttgcacatctggcacttagatgtgtgttagctggagcaatagggggcctggaccccgtgggtctccttttccagcaggccacttgggcttgttcacagggcagatgggcccagttcaaagggtctgagaacacaacggtactgcaggatgagctttggaactgctgcaccgtctcttccactgcattctgcatacgggccctaaacaagtcccaagccttctcagattcaagacatgggggatgggctgtatctcttatggagagagtcacatagcaagggtgtggctctagggaggaatgaagagtggtcaagtgcagcctgccatgctggctccttcaccagcctgtcagttatatgagccaatgggctgaatcatagtcatctttctctccacatgcctggcccgtgaaggatttgcctgcccagcagagaccgtggaatgaatgtgtgctccaggcactctgccttctctctcttctttgacttctctaagctcgttcctgcccctgtccccctctgtctctcttccccaggatcatggcattagtcggatccttcccatcattttcattttagctccagtatcacctctttgagccttccctgactacccttccagcattctctaatcccatcaccttgttttttttatcttttctttttttttgagacggagtctcactgtgttgcccaggatgaagtgcaggggcacaatctcggctcactgcaacctgtgcctcctgggttcaggtgattctctggtttcagccacccgagtagttgtgattacaggcatgtgccaccatgcctggctaatttttgtatttttagtagagacagggtttcatcatgttggtctggctggtttcgaactcctgacctcaggcaatctgcccaactcagcctctcagcctcccaaagttatacaggttttttttttttttttttttttaaatcttttcatagcatctgtaactgtttaaaatattagtttgacttccttttctagaatgtaagctttgggagagcggggtccttgcctgtcttgttctctgttacttctccagctcccagaatggtggctggcactcagggggtgctcaacacacataattgtcaagaacatgctacatcaaggcctgagtggctttgccacggctcttcttgtgactgcaggccttggtgccagcagccaccccagttccaagaaatggtctcttgctggccaacttagcaggaagaactggcagcgttcctgttacagcacttccaggtggctgcttttccctgagtccatgtggcttctccatgtctctctgttggagtcacaagttgtggaaattcacttaggccaacttagaccaagaagtggaatagttaatagttaaatgtcagtctgggcaacatagcaagacttcgtctttacaaaaaatttttaaaaatattagctggtgcggtcgtgtgcacctgtagtcctacctactcggggggctgtggtgggaggatcgcttgagctcaggagttggaagctgcagtgaactatgattgtgccactgcactccagcctggatgacagagcaagaccctttatctaaaaaacaagaaaaaattaataaataaaagttaaatataaggtctctggaggtatcctgtttgggttcagattctggctctgccacttcctagttgggtcacttttgggaagttacttaacctctttgtgcctcagtttttcacctacaaaaatagagcaaagtgtaaaaatatgaactacctcacagggttgtcaggaaaactaaattttgtgtatggaaagcactgattgctgagcagatggtgagcatctctgagtaggagctcctgctgccattattattattattattattggaggttatcatgtgtgattgaagagcaggaacttcagctgggcttcaggagcaactggttagaaaaacggaagacttggcccggcgtggtgtctcatgcctgtaatcccagcactttgggaggtcgaggcgggcagatcatctgaggttaggagttcaagaccagcctgaccaacatggtgaaaccccgactctactaaaaataaaataaaaaataaaaaaaaaattagctgggtgtggtagcggatgcctgtaatcccagcattttgggaggtcgaggtgggtggatcaactgaggtcaggagtccaagaccaggctggccaacgtggctaaaccccgtctctactaaaaacacacacacacacacacacaaaaaaaaaaaaaaaaaaaagaaaaaaaaagttagctgagtgtggtggtgggcgcctgtaatcccagctacttgggaggagactgaggcaggagaattgcttgagcctgggaggtggaggttgcagtgagccgaaatcgtgccattgcactccagcctgggcgatggagtgaaactctgtcaaaaaaaaaaaagagagaaaaaagaaaaaaagaaaaatggaagacttatcgggaatgcaggcagctgtgcgatttcagcttctctttgtttttggaccatgggttttctggttcttctttggttcctgcaggtctgactttctcctttttctgttgatggtctttcttggcctgtgtttgcaatgggtcaaccatgtgctttctggccatacttcacacttacttcccaactgggacagatagcatttcttaagtctaattccaaacttctgggataatctgattgcccttcattgagtcagaagccagtggatagggacatggaagatgctatagctgggctccacccttgcaggtgagaggagcagtttcaggaaagtctgccaggcatgagctgagaccttaagagatgtcagctagaattagccactgtcagtatatctgcttctgggtcccactcttcatcctgcttttcaaggttttcaaatatacactcctactcagtctcatgaaaattattatttttaaaataccctttagcacatttacctctaatgatactagattcttgcctcctgcctctgtaaatcactcggtcacttcccgatcttatatttggctgtcaagaatgtggaaatctcacagaacccttgaatttcaaagttggaagggaaaattgcttgtctatgcttataaaaaatacacacctacacccacgtacacatgtatttactaaaatagtattaggctaaatattcagttgtacagctttctgatttcattaacaatgtctgtctttccgtgtcagaagagatagacatttgaaaaaacggcagcgtaggattttgttctatggatgagctaaaagttctttcacctgtccacaaacttccacctagtccgtgtgccttataaaacacaaattctgaaatcccatgtaacgtgtcagctagattctgcctatcactgagtagagatgaaccatcacatctcatgttctagatttggggttacaaattcaaattcctacaggggccaggcaactgtcttagatgtgtgaaacgtcctagatataagaaatgcctgtaaatgaaaccttaagagtttttataagcatacaaataagtatgtaatattttgaaacatacttattttttggtgtacccacacaggcctagcatcaccagattcttctctctttttttttttttttgttttgccccaagagaggcaggaaatgagtatatttatgggagctttcctaattgtgaagtgttggtaagttcattatttttaaaaaactaaaaaccaacttgcaggccaaacaaaatgtgggccaccaatgtgtaatcactgatgtagataatgcacttcaattaatctaaaatcatcaactattttggcagccctctcagactgctgactcactgagcttttcatctgatgaaatccttaagtgattcacaaatacttaatctgaaaacctcttaatctaacttgtgttcctggacttgtaaattgggtttctggaccttaatacttgctcatgttaaatccattctgttacttatgtttaaggtcctacatctgtcttccagcctgatcacccatcttttcagccatgtgttgtttttgaattcaactcatttgatcctttctctatgtcctttttttttttttttttgagacggggtcttgctctgttgcccaggctggagtgtggtagcacgatcaggactcaatgcaacctcgacttcctgggcttaagcgatcctcctgcctcagcccccacaagtggttgggactacaagcacgtgccaccacacctggctaatttttttgaattttagtagagatgaggtctcactatgttgcccaggctggtcttgaactcctgagctcaagtaatcctcccagctcagtctcccaaagtgctgggattacaagcgtgaaccaccatgcccagcctctctgtgtcttatgataaaaaaaatactggatgagacaagactgaggaggaagacccagggaccctttttagcagagcttaccagcgggtgtccaaggattgaatttcccttcctagacatgttttgcttcaactaaaaagatatatatatatatatatatatatatgatgtatatcacacacatatgtgtatatcacacacatatgtatgtatatcacacacatgtgtatatcaaacacatatgtatatcacacacatatgtatgtatatcacacacatatatgtatgtatatcacacatatatgtatgtatatcacacatatatatgtatgtatatcacacacatatatgtatgtatatcacacatatatatgtatgtatatcacacatatatatgtatgtatatcacacatatatgtatgtatatcacacatatatgtgtgtatatcacacatatatgtgtgtatatcatatatatatatgcatgacccatatttaaaagtaggatatttcataacgaaataccagtattaggtatcttttgaaaaagtgtcgtaactgacagcccaagtctgcattccttcatggcaccagggctagaactgagaagtagctgactttttggggtggatatgggctcccctagtcatgctatatgcctcattttatgtgactggccgggccccataggcgtttatgtttgccactcttttagaggtccctttaaggttgacatatattcattgattgatcaactcatttacacacgcatgcagtcattttttggacccctgtctatgtgctctgcacaatgcgaggtgtgggatataatggtgaccaagacagattccaaccactcactcacagatcccacagcctaccagggaagccagatatggaacaattatatacgtaattttacttgtaagtgccacaaagacaaattgtattaagtagtaccatgtggctgtggaagtttaacttgtcactaatccaccaaactctgagaagacagcatattttccgtcattcccaaaagactatcacaggcaacattgaggaatgctttgttaaactccagggatatattccacatcacacttcccccgtccaccagattagcaactgtccaaggacaaaacaaaacacacactaaaaaggaaatggggttagtccgatatgtctccatctccttatgctggttcttttgtctgcagaagccacggtttctttttctttttgaaaaaaaaaaatgacatttgcgtacctctctgcgtttctctttctccaggattcttctgggatcctaggcagtgtggtttggtgatctcactggtgagatctcttggagccctggaatgcaattcatctgggccagaagagttgaactaatttaaggacatctgagtgcttcactgatgtatttgttctgctctgtcccttcaaaataccactactcaaaacaatgttcagctggagaaagtggttaacactggaattttctttttttctgagacctaagtgacagggaagggtggatgaaggaaacatatcctttgaaaatcctttagttagaatcctttggttgcaagtaacataaatgaactctgattaatgtaagcaaaaaagaatttgttagaaggatatggggggggagggatggacagagatgtgaaggaaaagatgaagaaccaggctttagaaagtcctgaaaccaaatgaattctagggatctaggaagcagggactaatgactgtttccttcaggacaccagagatggggtgaataactctgtaaaagatgcaaatttcccacctgggtaacatagtgagaccctgtccttaaaaaaaaacagtagccaggcacagtgcctgtagtcccagctatgtggaggctgaggcagaaggatcacttaagcccaggagctcaagactgcagtgagctatgatggcactgctgcaccccagcctgggcagcagagggagaccctgtctcttaaaaaacaaatgctaaattttagagagaatagagagaatcttttcttaaaaaggtgctaagtctggggaaggagcttctgattgtcctgccttgagtcacacgaccatctctgacttgttgacccctctacaatcccatataagactccccaagagtagattctgagcaggtaaagcccatgggtgttcccaaaagtcggcctcaacctgaagccacttattcactctgagctcatcaccaatggcatgccgcactgtcaaaactctctttctgtgcatttgtctgggccactcaactcaggaaagttagttgttctgtgtgagtccccatgttctcactgatttcatttcagtctttaagctaaaaatctgtgtaaatggtaatggagaatggctacatcacacttagtatgtgtcaaagcagtatcctaagtgccttagtggtatcagcttatttaagactgacagtactctgaggtgcagtcacttctttttttttttttcctttttttcaaaacagagtctcactccgtcatccacactggagtgcagtggcatgatctcggctcaccgcaacctccgcctcccagggtcaggtgattctcatgcctcagcctcctgagtagttgggactacaggcatgcaccaccactcctggctaatttttgcatttttagtagagatggggtttcaccacgttggccaggccggtcttgaactcctgacctcaggtgatccacccacctgggcctcccaaagtgctgtaattacaggcgtgagccaccgcacccggcctgtcacttcttgtcattcacagtagttatgttctgtaaagtcactgcaaacactgaattaataaacactgaaccattgttcctaggtgaaatacaaagttgggttcctgtgagcctttggtcacagcattttcatccactgatcaacccgtaagcttattctgtgtgtgtttctgtttaaagacaccttaatatatattgttgactcattaacatctaactcactgccaacagcactccaactcgtgcctgatcaaagcttatataacacacgcatgacacatctcggactccttgcacttaggaacaccagatagcacttcaccattaccctatgggaccattttacagcaacgtcaccctcaaaaagcagaaaaatgggaaaaagcatgctgctaatataccacagagagaatgcttgtttacagcatgagagctgaagtctgaaggtagaacatggttttgttcatcctcagctgggaacacatgttggctgactcaaatattttgccactccgtacatgtccgtgagtgatcatgaaagaaccttgagtatggatttggcggttataaataaattttagcaagaggtgaatttgcaaataatgaggattgactataacccctgttattagctctagttaacagatgggggaatggaggtaaacagctctctgcaggtcttgcagccagggagtgtagaggaggctttgtcattctgggtgcacagcctgcgtccttaagaggcaatgtagtgttggctgggtgtggtggtggttcatgctgtaatcctagcactttgggaggctggggtgggtggattacttgaggttaggagttcaagaccaggctggccaacatggtgaaaccccgtctctactaaaaatacaaaaaaatcagtggggcgtggtggcacgcgcctgtaatcccagctactcaggaggttgaggcaggagaatcacttgaacttgggacgcggaggttgcagtgagctgagagcgtgtcactgcactccagcctgggcgacagaatgagactccatctcaaaaaaaaaaagaggcagtgtagtggttgagtgcagtgtagctcctgctgagagctggttttcatgttttgtgggcacacaggaagtagagaatgctgagagctgggcactgaagcagtaggagatatgggagtgggaaagtggttttctttagtaagtctgggctgttttcatagcctaggatgaagttcagcaatactcaaccttgaggttttccaggcaccttctccttgacatgaatctcctgcaaacagatgtcatagtaatctgggaataaacctttgttgttggtcctttagctatccttttttttttttttttttttttttttttttttttttgagacggagccccactgttgccaggagtgcagaagcatgatctcagctcactgcaacctccgcctccccagttcaagtgattctccagcctaggcctcccgagtagctgggattacaggcatgcaccaccatgcctggctaagttttgtatttttagtagagacggggtttcaccatgttggctaggctggtctcgagctcctgacctcaagtgatccgcccgcctcgacctttcaaagtgttgggattataggcgtgagccactgagcccggtgccctggtcctttagctttctaagacagcagcatagtagttcagagcataggctcttgggccatagcttcctgagttcgaatcctagctctgctgttttttaaactctgtgaccttgggcaagtcttaacctctctgtgcctcagttttcttgtctgcaaaatgggattaataaaaacaccgatctcataggattgttgtgaaaatcgagtgagtatgtttatagtgtttaggaaagttcctggtacacaagacatgctctgaaagtgtattaatattatttgtccttagactcagtagtactctgggggaatcgaatccccacccctaagccaggcagcatggtagaagctaggtcagctggcaggctcctgggtcttttccattctgctgcaggagatgcctgactcacctcttgtgctcacacagatgacagctaaatagaagggctctttcctcctagtattagcttaattataggggctccctagaacagtggggaaaatgagctttgagaatccccccaccacacacacaaggcccacactagcacctgaaagaggagtgaacattgcttcctgcctccttctccccctccttctcacatatgcctttgtctctgtgattctgcacgtttaatttttaatcccgggatgggttctattagtttttgtgtattttctctgccctggtttgagctccaaaaggtctgtttgggtctctgtgggtgtctgacagcctctgcaggcctttctgaattatataactcaagctttgtattttctatttgttactgggggttctttctgtgctataattttactcttagaaaatgaagtagggtactagaattttctctgggatcccctagggtttccttctgaatattttttcctgccatattttcttcgctaaaacatttttttttcttatttcagaagcaatacatcttcattatagaacattacaacaagatgcagagaaagaaaataatcttatcaagcagaaatgttaataccttgctatctacccatgtctctctgtctctgtctcctcaaacacacacaaatggggtcaagatgacataagagactatctgcttttcaattcacattttacgatctttttttttgtatggttctgtagtctccactgcttggcttgacgatctttaacaggtgccctccggatggtcatgggggtattttccatttctcactgttacaagcagtgctctgatgaaacaccttttgctggcattcctaattatgtcctgagagcagacttctagaagttttcagcagtgaggttaaagggaatgtttgcctctcctcttcactctgtgatgctcctgggggcccaggcccatgagtctctgtgtccatcttcccaagatgaaagacaaagaatgggcagagcattgacagggccctgtgttgactccttttctctcttttcccagtttttttttttttttttgagacagagtctcgctctgttgcccaggctgaagtgcggtggcgcggtcttggttcactgctacatttgcctcccaggttcaagcaattctcccgcctcagcctcccaagtagttgggattacaggcactcaccaccacacccagctaattttgtatttttaggagagacggggtttcatcatgttgcccaggctggtcttgaactcctagcctcaagtgatccactcaccttggcctcccaaagtgctgggattacaggcgtgagccactgcaccctggcccattcccgttttttaaaaaaatattttattccttttagactatttagccacagttttccattctattccttgggataagtgaaaacttgatttttaaaaaataattacaaaattttaaaatcatggtaaaaaacacataacataaaatttaccatcttaactatttttttaagtgtacagtatcattttaagtacatttacattgttgtgcaacagttaggacttttcatctcgtaaaactgaaactctatacccactggcaataacttcccatttcttcctccccaccgagcctctggtaaccaccattctgcttcctgtttctatgagtttggctattttagatgcctcatgtaagtggactcttgcagtatttgtcttttcatggctggtttcttcctttttttcttttcctttctttctttctttctttctttctttctttctttctttctttctttctttctttcttccttccttccttccttccttccttccttccttcttcctttcctttctttctttcctttttttttttttttgacagggtctccctgtttctcgcaggccaggctggagtgcagtggggcaatcacagctcatggcagccttgacctcctgtgctcaagggatcctcccatctcagcctcctgagtaactgggacttcaggcacacactaccatgcccggttaatttttttcttgatttttaatagagacaaggtcttgctatgttgcccagggttgtctcaaactcctggcctcaagagatcctcccatctcagcctcctgagtagctgggattacaggtgcacactaccatgcccagttaattttttttcttgatttttaatagagacaaggttcttgctatgttgcccaggctggtctcaaactcctggcctcaagtgatcctcccacctcagcctctcaaggtgaagggatgagcctcccaaagtgaaggcgtgagccattgctcctgggatgactggtttatttcacttagtgtaatgccctcagagttcattcatgttgtagcatatgtcagaattttcttcctctttaaggttgattaatattccattgtatgaataggcaacattttgcttatatattaatcggtcaatggacatttgagttgctttcacctcttggctattgtgaataatgctgttgtgaacatgggtatacaaatatcttttttttttttttttttgtagagatggggtctccctatgttggccaggcttgtctcaaactccttggcccaagcaatcctcctacctcagcctcccaaagtgctgagattacaggtgtgaactactgcacctggctgagactccacttccaattcttttggatatagatcctgaagtggaattgctgatggtagaaactgtctcgggaagatttttctggggatttggcttctaactgcaccacagctccagtggaaacatctattcattaaactggcatttattgaggaccagctttgttccagtcactgaacaaggctgggggcatagcgtggcttacataggtccccaccctccatggagctgatattcagcaagaagccagacaatacacaggtaagcaaattgaaaaaaacaggatgagatccactggcgataaatgtcatgatactgaatcaggatttgacaacagagtgatgtggtgagtggctactttagatcagaaaggccttcctaactgggtgacaggtgacctgagaactacaaggtggggaggagctagccacacagaatttgggaaaataccattctgggccctgggatgagcaatggaaaggtcttgaggaggaaagtggctaggcgtgatccttgttgctggggcgtggtgggtgtggggccagatcataaggggccccacaggatgagcctctgtgctaagtgcagtgggaagccactggagagttttaggtaggcgagatgcaaaggatcagatttgtatttaacacaccttccattggctgccaagtagagaatggattgttggggactggagcagaagtgggaggatgagtcaggagtcaattgcagatttctaggtgagagatggtgtctttgtctgcacgggcagcagtgcagagggagagacacaggcagatttgggaggtaaaaggacttactggtaaatgggatatgaattggaagagggaagcaaatgcacagctgggcacctggtacactttacatatgacgtctttgaacttcgtagcaatcccataaccacattttgtagatctgtgttgtccagtagaaatataacatgagccataaacctgagctgtgtatgtaatttaaaatgttcttagcaatcacattaaaatggtcaaaggaaacaggtgaaatgaactgtgagaatgttttctttaactcagcatattccaaatattcccatatcaacatgtaatcaatataaaattattaatgagatattttacttccccgcatagcaagtcttcaacatttgatatgtattttacacgtacagcacatctcaattcaaccacacttcaagtactcagtagccacatatggctagtggttaccatattggtagcacagttatagatgaggaaagagagtctcagagagtataagttcttatgcaagcttatagaattaggacttgaaccctaatttgactctggcacccgtgttgtgctcaaagcactgcatccacccccaatgatgaagacattttcaatgtaagcaaaagtcctggagatttccccacatcatatacatggggacataggaactaacatttgtcatatatttatattttcctttccaaagcagatcaaccccaagttaccttcccttagctctcgttttctgcctctctttgcaaatatcacttcattaaaaattgtgaacattctctttgccttcccttatgggcttcctgtttgaacaccacatccagggcaccctgggaactgaaccatctccttttctttttctttttgagtcagggtttcactctgtcgcctagactggaatgcagtggtgtgaccgtagctcactgcagcttcaatctcttggcctaaaacaatcctcccacctcagcctcctaagtagctgggactacaggaacacaccaccatgcctggctaatttttttatttttattttttgtagctgcaaggtctcactgtgttgcccagactggtctcaaactcctggactcaagcagtcctcccacctcagcctcccaaagtgctaggatgacaggtgtgagccacaatgcctagcccatatctccttttcttttgtggcattctagtagccctttggttcatgcgatcatttagttgttcagcaaatatggatgattgaatggatataataggtgcagggcactcccaggttctcaagatggatgatcttgggcaagttatttaatttctctggattttagtttccttgccagcaaactcaagataatagtaatgcctacttttaagtagttattgtgaagattataaggaattaacaataacgataataataagtaataatgatacatgttgtttattagagcctgctatatgccagacactaactctatgatttaaccttctcctgctaccctttactcttattatttctttaggagtgaaattcactaatcattaagctttttaactaactgaatcaattctgtttcttaagcagatgggagatcctgtggctttttaccactatccacagctctttttttctttttcttttcttttttgagacggagtcttgctctgtcacccaggctggagtgcagtggcatgatctcggctcactgcagtctccgcctccctagttcaagccattctcctgcctcagcctcccgagtagctgaggttataggcgcccgccaccacgcccagctaatttttgtatttttagtagagatggggtttcaccatcttggccaggctggtctcaaactcctgacctagtgatctacctgccttggcctcccaaagtgctgggattacaggcatgagccactgtgcctggcctatccacagctggtttcccctctttgcccccttttctggcattctcttctgattcactctcaactctgatttccaagctacccagctccttcccctagtgtgaatctgtatttgcactggatttatttttaaatgggaaatgaaagccactgtgtgctggaaaatatatatttcagacacgaggaagctggcggggaaatattttttggatgtctttctagatctcttaaaaatcctgtgagccatcaccaggttgatcttgtagtaaggtggccttggccttagtgtatttctttttgactcgatattgggcggcaggaggtttgaggattgtgatactaacaacattaacaacaacaaactttcattgattgattgccatgtgctggaaatgtgctaataaattacatttattttctctttgaatcctcaaaccaactctttgagacaagtgtgttgtattacagctgtagaaactgaggtcctaagaggtcagtagatttgctgaaggtcacagagctgagatccaaatctaagcatcacagcaagaagtatccttaaccatcatctttgctgttggttggcattagtctggctgtgctaagaaagtttcctttgacttgcagatggatcaaggcttttcttgagagaggcttctcttgcctggttctccttgattcttttactctaggagactcagttcttctcaaatccctgtctgtgggactttgggcaaaacattcaacgtcatctttacctcttagagtcactgcgagggttggactatggtgtgttaggtgttttttttttttttttttttttttttgatgaagtctcactctgtcgcccaggctggagtgcaatggcatgatcttggctcactgcaacctccgcctcctgggttcaaccgattcttctgcctcagcctcctgagtagctgggattacaggcacgcaccaccacgcctgactaatttttgtatttttagtagagacgaggtttcactatgttggccaggctggtctcgaactcctgacctcaagtgatcggcctgccttggcctcccgaagtgctgggattacaggcgtgagccaccgtgcccagccgtgttatgagttgaacagatttcttggcttcagcaggggctcagtatgggcctatcatcattttcatttatctccttttatgcctcatgctctatctgtccccttcatctctgcctgtagcagccacagaccctctctttccttggtgcatgtccctccttcccactttcctaatttcagcctgacttagttctctacctgtcagcttggacttaaggaaaggaagttctcttttcttggggggtcactggggccatgggcgtctttccactccatttcttttccaaagctgcctctggaacgaatctgtaaatcccagggcattgcatgagttttcttttctttctttccttctttctttctctctctttctttccttcttgctttcttgctttctttcttgctttcttgctttctgtcactgaaagcaaatattgtagacagatatgcttgtaggatagaaataaaatgccccattctttgaaacatattttgttttttattttagattcatggagtatgtgtgcaagtttgtcacatgggtatattgcgtgatgctgaggtttaggcaatgaacttgttacccaaatagtgagcatagtacccagtaggtagtttttaaaccgttacccccttctctccctcctttccgagttcccagtgtctgttgtttccatatttgtgtctgtgtataccccttgtttagcttccactataggtgagaacatgtggtatttggttttctgtttttctgtgataattcacttaggataatggccttcagctgcatccatgttgctgcaaaggacatgatttcattttttttatggctgtgtagtattccatagtgtatatgcaccacattttctttatccaatccattgttgatgggcacctaggtggattccatgtttttgctgttatggacagtgatgcaataaacatgagagtgaaggtgtctttttggtggaatgatgtgttttcctttgggtatatacccagtaatgggaatgctggattgaatggcaattctatttttagttctttgagaagtctctaaactgcttcccagaggggctgaactaatttacaatttcaccaacagtgtaagagcgtccttttttctccgtaatctcaccaaggcactgcataagctatctgagtggccagcaggcagaatgcttgaaggattctccagctgggggtgctgggcccaaaggctggcagctgtatggtcctggcctttttctctccagcagggtccccatgatcttcccaggtctagttttttcttgagcacacctgcatctgacagttaattgcaagaatctgacttgctgaactctcatttctccctcctcctttagcgcatcaagtccccttctttgttttcccagcttggttcttgcaaggactacctagaggaggacttcaggcaatccctttctccctggtgggctgctgtgttctcaccaataaatcaatgctctctctagtttcaggctgcctcttaggacagatgctgataccaagtgacttttgaggttgttgagttgagacacttggaccaaacagcggaaggcacagcttggctcagctaaaggaagctccgtgaaagctctctgagtgggcctattggctccatgagttggcaggctggccctcctctaggagatggtgggtcctcatgggctgtagcagggccaggccacaggagcagactgctggaggagaacatttagggccatcttccttgctgcctttctgtgatctcttcacccaggaagctgaatgctgttggcaagcaaaagggtgcttggtaaccatttcttttttaagtgtgtgctggtgccagggagggagaaatcctcaaaacccattgtgtctgactcaggcaccactggtttggccataaccgctagtttatcctccctccctctgccaccctcgtcatgtttctcgaccacaacctgtctggaccttccctgggttggccagggcttgataatctttttctgtaaggagttatcccttcctcatctgccaggatggggctactgtgcagggactgggtaacaggcttgaagttgcaagagggctggaagggtctcactagcaagcacacattatgtcttatataggtccctggccttgtgcttcagaccctatcacagcttttccacagctggggctgttgagaatgtaagtggtgacatagctggatggctaagatggggggagtatgagacctgcaagcgtgtgagtctccttttgctagcagagtgtgaatgaaatgtatttattttcccaataaattcgacatgactgatcattcatccacccacttacccacccatctactcactaacccacccactcagtcatctacacagctgttcactcgtccatccatccatccatccatccatccatccatccatccatccatccatccatccgtccatccacattcaatgtagtgtaatgattaagagcatagagtttggagttatcctgcttaggtttgaatcccagctctgccactcaccaagcatgtgatcttggttcagttttaaaacctctccttgtctcagtctcctcagctataaaatgagattgatgttgaaattaataacagagcctaccttacggcattataaaggttatgtgagtcagtatgtgtaaggtgctttcagtagtgcctgggtcatagcagtgctatctaagtgttagctattagcattatggcatctactcacctgtttatcatctataatagtcattaaaggtcttcaataaatatttctggtctttggccttgcaggccaatggtaggattgcactgcttgcctcccttgtgggtaggtggggccgtatgagtagctctgaccagtgagttgtgatccaaagtgatgtatgttcacttttatgctgggacatgtaattgctggttctagattatccagaaaaaatctttgagttatggctgctctatcaacttgctcctggagacatagaacttcttccttagctgatcaggcatgaggctgtagtatgtgagaaaaacaaacttttacctattttgagggttattactgcaggataacccagttctatctctgtctctctcatctatcatctatctatttacaataattccagtctcattttatttcccttcccttttctttttggcacctattactagctggcattttcttatattttttggagtttcctcccaaaatttatttgttattaattataagaatatgttttccatgagaaaaaggacttattcacttatctaattccaatagttagaatggtactttacacatagtagacactcagcacatatttttaaaacaataaatcagttaatgaatggatctacttgacttttagtaggtcctattgaacactgcattccacagctccttgaaaatccttactgaggcagctaatatttaagaaggaacaccctgacctttcactgtccagttttattgcctgaatcaagaaaaatatccctgagatagacctcactgcctctctgcaaacctcttaatacccttagtcaattgtaagaagctgcttggaaccctgtaagatggtctttggccagatcaagtcttgctcctcttcctctgaatcttgtaggggcctttaatctttctgtaactgtgattccccagaacaggatgcctttgttagcctagcatcttttctgttacttctatgaaacaaggagagacgctccctgggacccttaactatttctggaagcaaaatgacccttgccccactgaagacttaggagcctggtcacttccaaccgggcttttcatctttgtgactcccagtcatgggcaagaggctagctagctccaatcctaatgcccgtgccatcaactgcttcatttctggtttcttccttgcttttgtgataccctcattgactctttccactgtaccctgtggacttgcctctatgggacacttcctccccatcctgcctgaagaggaaagagcctgcctttcttctgggaacatcatcccattcagaaacaacaacctttctggagtcaggagtttgctttcctcttgttctttattgctgcttcctggagattgcattcttgtttaaaagctcacctgtaagactctgatcaaatgtccattcttccctctcacttcatccctgaagatgaatgggacatttatctttatatatgtatgtatgcctaggggaaaaaactgaaggaacattatgtatatatataatgcgtgtgtgtgtgtgtgtgtgtatatatataatgtgtgtgtatatatatatataattttttttgagacagggtcttgctagactggagtgcagtggagtgatcatggctcactgcagcctcgacctcctgggcttaagtgagcctcccaactcagcctccctagtagctaggactacaggcatgtgccaccatacccagctaattttaaaatttgtatttattattatttttggtagagatggggtctcactatgctgcctgcgctgttcttgaactcctgggctcaagcaatcctcctgtctcagcctcccaaagtgctggaaatacaggcatgagacactgcatccagtctatgatattcttatgtttttacaatgtgcttattattgagtagggaaattatgagtgatgtgtgtgtatgtatgtgtgtgtatacagatgtatgcatctgtgttcaatttttcctgttgagagtgagtaaacaaatatttttgaaaataataaaatacataaatgaggggcaggggctctcttggacacttccaaaagtactttgctcaattttctatgttaggcctatctgcaagaagcataagggtttgtcaggagctattatgattatttattctacaaatcccagttcaacaaagaagggtgaggcttgagtgttcaattagagaagctggccagttgtggtatcatatcagctctacatccaatgctcagttttcaaggggtcatgttgctctgaaaggcctggtgaggttgatgagtgtcttaatgaagccacttgtgaaagataatgtgacatgtttgtccatcacattgacgcaggaaaggagctttcacaaaagacagcacagaaattttgcaggctcggaccagaagggaatttgtcagtgtttagcttggctgacatcccacaccctaccttcttgtgcagttagaatcccttctagtgtaatgtgtgaaaaaccataggccccctgcccacaccctcctagagctgtatcaccaacagctttcaagtgtgtgcaaattgggagacggctggatcccacatctctgggtgacatttgctgaaacaaatgcctgttaataagtggcacgattcccttggtctcagtgataaagatgtacctgttactgggagcccttgagagaaatctttggtgaaggccttcacactcattttaattggtgatagacagatgtgttgagaaaacttacattttttttctccatccgtctcaattagaatgttatgaaatagcaccccctttgctcttcgtgctttatgccctagactttaaagactgacaacgagtggttaaaaaatctccattgcttcaggatgcagtatcagctgatttggtggattaaatcgttttaaggtcctgagctttaattcttacttcagtgattctcaaaccttgttttgcaaaaccccagagctttaatcttaagggatgagcctgctatttccaagacaacaaaattatttctacttcatattaatacaaaacattaaaatatacattgtctttgtaatatagtttattaattcaaagcacttgcattcccatttatctggtcttcatacaaaaccatgtatgagtgagtaggcagatggtcttatttattacttcgttcaatatatagatttttgagtgcctaccggtatacagcactgaacgaaagagaaaaatactagtttggatgggagctcaacacaatctgaggggatatattggacccattttgcagaggaagaaactttggttcaggaagggaaagtgaactctgaagtttgacataaagttagcttcagaactagaatatctgccttctgatctcagcctatcacctatctcaggttctgtctccacgataccatgtgattggaactggctcattaacctggggatggatcaatcagcatcttttttttttttttaacaggattggatggaaatctgcattccttgatcactcagtctatagggtgaacttacaatggccctcatgcttaatcttgaaatacagggatggtctgatggagtgtgctggagaccctgctgagatctttggacaactcctctccagtccactacctgaatcctttctcttctcctcaaaaaaatctgagactatccaaatgaagagtaaataaagggagaagtaagaaggaaacatgagacagagaggcagcaggagcagaatgaaacttggggagcagagggagaagccaagaaaacttactggacttggagccaataaattggccatggcatgaaggtttctgccagcaatatggcagcccattccagctctttccattttcttttcccagctgtgctgccaagcaccatgcttaggctggtttaacagagattatgctaggaggattttctaacattcatgtcctgattaccccttatctgattccttagcagtagccttcagtggcctcagagaattccaggttcagctgtctgaacagttcaatgactgtttgtaagttctgacttacgatcaaggcaggaaatgtgaaaagcatttttaaaaaggaaaaaaaccatccggcgttgttaacatttttgttattccagtattttcccatgcatataaatatgtgtacttcttttatttttcacaagagtactctcacaccataatattgttttataaccctcttttccactgtgctctagtgtaaacattttactgtaccaaatctttttccacaaaaggatttttaattactgcatagatttctattgaacggatgtactaaaatttacctaaacagctcttattattcaacatgattcaaccattgttacaaataatatagttgtatatttatctttatggaaagctatttctgaatactcctaaggataagttcatgtattagttaggttttgctgtgtaacaaatcatcgcacaacttagtggtgtcaaacaatgactatttacttacctctgcaggtctgcattttgggccaggtagttctgctggactaggctggaatcagtggacataggctctggttacttatgcatttgcaatcagctgggggactgcatgggatgatggtggtatgtcatcttccagcaggccaggttgtttccatagcagttagagttgcaagagcagcaaggaggcaaaccctgatgcacaaactttttttcaagttttggttgcatcacatttgcttctgtcccataggccaaagcatgtgacatggccaagcccggagacagtttgagaagacattaccaaaggcatggctacaaaaggcatgaaagtctcaggaccattgttgtaatcaactcatcacagtccccaaaatgggagtttctgggtcaaaaagtgtggccatttaaaggttttcattgtcacattgctctccagagaaattgtaactaatttacacaccacctagagtacatgcatttccaaattcacttgatcactggatataatcattggtttaatttccccccagaaaataatattattgcttttgaagagtacatgctttgtgagggaagctgtcttgaatgtccagcttccaggtgcaagcgcctgcatgtgtgcacaggtgacaccatgtagaaccgaagaaccacctggctgagtctagccaacccagagaattgtgagggaaaagaatatttttttaaggcagaagaaaaatgtatgttcattgtaaaaacctgaagcaatgtggtacctttatcatcaatatcttccccagtatttgattcattctgacattatgttgttgggttacatttatttctattacatttaggacctttgagtctatattcattagtgaaatttgtctgccatttactctttttttttggtttgctgtctttgacaagtttttgctattttcatcaaaacatctgggaagtcttccatcttttcttgttttttaatgcttaggaagagcataaatggcaaaggatttagaatattttttagaagtttgagtggatttaccatacccccaaagcaaaacaatttctgggcctggtgccttttccaagattagttatttgataattttttctggtgtatttcatgatcatttttggtatactttcaaatgtgttatgtttttttaagaataagcatttaattgagtctctaatttattagcataaaactatatatattgtcctgtaatgatgtgaaaaattgccttgccatctgcaattctcttttctcattcttactgagttcctatttttagtttttgaaaattttcttatgagctttgccagagtgtcactgttttatttttcccctcaaacaaccacctcttaaatttattcttcagttcaacttttttctgtttccagatgcattaatttctgctttttaattatttcctcagttttatcactcttcctagtttcttgagctaaatgtccctatgtactttcaattatatctactgatttgtcaaaaattggatagtatgctcgtctcctactatgatagtgatttttcaacacctttgtatttttttaaacaaattttgttttgtacatttctaatgtacttttatgttataggagttagagtttcatgattctccagtcttattgtgaagttactcagatctgagttcaaattctcctgtgctgcctaccaaatgatgaaccagttttagattctcctaaaagcttggtgataataatgccagtgttgcttatttttaatacttaaattaaatgatataattgatgttaagtgctcatcatagtgccaggcacatggaacacacactgctattggttatattgttattattgatgtactctttatgaatacaaaatatccatctttgtcctatgtaatatttttatgctttacattttatttgtctgataattaatatttctgctcatggcagcttttcccaccttttcattttcattttggatcattttattttcagcaagtctcatgggaaccatgtatatttgaattctattttttctttaaattatgaatctttgtcctttaatgggataattcaatccattcacattttttttttttgcaagacacagcatttggcaagtgtttacttctttcttctcccaatccactttcctgcctttgaagattttagaaccagaatttatgaaaaaaaataaatatatttgatttcccatgaattgctattgacacatgcattatttcatgcaattcaagacttttttaaagatgtgactctcaaacttacttcattactcactttttatgttttttggacccatttccctcttattgaattaattgattgattcattaattcaatcaacaaatatttattgaaaacatactgtatgcagacactgtgctagggtctgagagaaacgtatttgatgtaaacctggtctgtgtcttcactgaatctacatttagattcacaaaattagagacacaaaaatagatgacaaattaaagcagatataaaggaaaccaataagggtctcaaggagagattagtgaacgtgcatgtgagtatctatttagcaagtttaatgaggggatgctttttgtgaaggtgacatttatgctggcagcttaagaagtggcattagctgtgtgaagagaggaaggaagaaaggcattccaggcagaaggactagcatatgcaaagggcttgaaaggggaaagagccttatcctaatgttttcatagaaattatttttaaatactcaacaattagcttttgaattaaaggaatgcacacaagtgaagttaatctcttataggcaaaaccaaatgaaggattggaaaatgcctctgaagagtcagctggaaggctcttcatccatccatccaaccatccatccatccatccatccatccatccatccatccatccactcatccatccattcatccatccatccacccacccatctacccacccatccatccatccattcacccacccactcatccatctatccattcatccatccatccaataagcagtcattgagtgcctactgtgtgccagaccctgtgccaggtgttgatcacaaataatacaagcacctcctggagagtagagcctagttgtgtacatgggatggagggcccatgataataaagctggtacttctcatggagtgggatgggccaggggcatggggaaggcacacgtgctgtgctctgtagagctctgagcagggagggacgcagtgggaaagagctgagaacaattcctgccagatggctttattctttcccctgaaggaagtggggacttcgtgctgtgacatgatacacaagaacagtgtttcctgtgggtttgcaagggcattttgaatataaacactacagctcgctgatgtgtgaaaaaattattttttttgctttttcagactttgtgaagggataatcagatcaattttataagtctggaaaacaggtatttggggtgaattttaatgcacacattatagtggctggaaccctaaccaaaggcagctgtcacctgttggtgggttctcttaggcacgttgtttgttcatctagctgtcacctggcagcttatgccctccagttcctggaactgaccagttatctgcaactgactaagttctggtactggatcctgtgtgatttgactctaacctccaagaaccttactgtctttagctgtgaaatgcggagaagactggactacttgatctctcaacactctatatatctttaaagttaaatcatttgttcagtcatttgccctttcttctgccatttctctttccctctctcccatccatccatccatccacccatccacccacccatccatatatctatttaatatttatattatttatgttatttatttatttatttattttgcaatggagtcttgctctgttgtccaggctggagtgcaatggcgtgatctcggctcactgcaacctccgcctcccaggctcaagcgattcttctgcctcagcttcctgagtagctgggattacaggcacatgcaccaccatgcccggctaattttttttttttttttgagacagagtcttgctctgtcgcccaggccagagtgcagtggtgcgatctcggttcactgcaagctccgcctcccaggttcacgccattctcctgcctcagcctcccgagtagctggaactacaggcgcccaccaccacacctcgctaattttttgtatttttagtagagacagggtttcaccttgttagccaggatggtcttgatctcctgacctccagtgatccgcccatctcggcctcccaaagtgctgggattataggcgtgagccaccgcactggaccctgtctaatatttaattgagtgcctgttgtgtgctaagtactgtgctgggttctcatccagtggccagtaaattagacaatcctcccatcatagagcttgccatctagtagggagacagacaagcaaataattacacaggtaataatacaattacagttatgataagtattacaaatgagaagaatggggtaggtgagcatgtgtattaaggctatcggtctcattttgagggccagagaactctttcttgacaaaatgaagtttaaacaaaaactaggtgaagattggcagaaaagcatcccaggcagagggcacagccagtgtgaaggccttgggataggaaggggcatggccacatcaagggaggtaaaaatacataacaaaataataatatgagtaacaatggcaactactactgaaggaggaccgcctatttgccagggaccatgcgatccttaactgtgtggttttgatcaaatcatctaaactccttgcaccttggtctatgcatctataaaatggggtgatagtgatcgtgtatacttcatcaggttcttctgaggcgccaatgaagtaacgtctgggaaatccttaggtctatgcctggaccataggaagtgtttaagagacagccgttgtgactgttatttttatgaatggtattgggtgagaaaaagttcgtgttgcatctcagggcttgccttggaccctgttgatgatttctatgttgaggtcactcttggagtttctgcagaagtagaactcttggaagtctgctattcagcagatgagtgaaacaagtgcttctccctccgctcccacagaaagaggggcagagatgccagccacagcttggctttcaggcagcaggcacattgggatcagtgattggcatttgcaacattggttggcatcacagagagcatggaaggtcaaggtaataattatcaaggacagtttaagggaaacagtacattccattccttatccattgtaagaccagtacattccctgttctttaactcttgggaagacatctcccccagatctctctgctgaggatcagggccatttctctgttaaaaatgtcaaacagcaacttaccagaggaaacagaatggtggaaatgccatctcagcattcaagaagccccagtaccaaactttgcatgtatatacgtttgaaacaagctttgtaaattacttttgttcatttgtaattacttatccataagaactctctctctctctctctctctctctctctctctctctctctgtgtgtgtgtgtgtgtgtgtgtggtttgttgtcacctgggctggagtgcagtgatgcgaccatggctcactatattcaaaatcctgggctcatgcgatcctcccacctcagccttctgaggagctgggaccgtaggcacgtgccaccaggcccagcaaataaaatttatttatttatttatttatttatttatttatttatttatttatttatttatttattgtagagatagggccttgctatgttgctcaggctggtctcgaactcctggcctcaagtgatcctcctgtctcagcctcccaaagtgcagggattacagttaggtatggagagagaaggaaataaggaagacacagttattactctttaggacccataatttaactcaagtgattttgcccccaggtggtatttggcaatgtctggagacattttgtttgtcacaacttggggtggtgggggttgctactggaatctagtgggtagaggccagggatgctactgaacaaaatatacaagacagcctcacaacaaagaattgaccagtccacagtgtccacagtgccatggttgagaaaccttgatctaactgcttatgacataccacttccataaagccgagagatatcaattcttatgcagttatcactgtgtacaggaaattgtgtgtttgtacatgtgtgtgcatgaatgtgtagatataaagggataaaacctttatcttcctttcctaggtatttttacctctgtattatcaattgaaataatttgtttttgaatatacaatgcaaagtttgaaatcctacaggtacaacaaggtatacagtgaataaagaatctccccattccacttctgtcctcaagtcttcagttctctggaggagtactactgtcattagtctcctatatattagtagagagacattccgcatatgaaccttatacccttagtagcacctcacacatatttttttccttgttgcctttttttttcctatgtgatgacgtatcttagagatattttcatatcagcgcatatagagcagcctcattcattttaacagctgcacaggttttttttttttttttttttttttttttttttgtggctgtcccatacggtcttctgttgatgggcataggttatttctagtcttttgcataacaaacagtgctggagtggatctccttgtacctaactgtggacacacatgtgcaagtacgtctgtaatccaaaatcctgcaagaggaatttctaggttaagatggcatgtgcattttaaatttggctagagatttctgcagtgatgtctgatcctgtgcaccgtgcattcatcatgtgacccatttctagtccttcttgaccgccccctctcctatggggatcctgagctgatagggtcacttctgtctctcccccacactggaacagctctctctaatctacaagattaattttttttcctaatcaaaacacaattgccaaggatagtttgaaaaatattaattgtgtctgtcatcctggggctctgagcacgtgagcgtttgggatataatctttgcaaattgcctatagttcatacagcacagcaagagcctctctctctgcagccagtcctttatgatcgatcatacccaccccctctcccaatgggctgtatcctaagggtaagtagacagcatgggttctcttgcttaaaaaaaatcgttaactcaacgggggcgcctgctgcttgattgggagtatgtcggcatttagagcctgctggctgcaatctcactacgcagactggaagttgtggggtgtttttatcagcaggaaacagctttgagagcggaaggggagtgagagtagatggatagatgagggaattcgaagaggaggaagccgtgggagaaatgtcttcttttaaagacagacaaggcagatttctccagcccatctctctggaatgtcaagtaggaatgaaatgggaagttgggttaattctaccaggcctgcccagcaaccagcctgttcaggttccccaggagttgcagcctgttgtctgagactgtgaggttctcttccctgaagtgtcttgtgggaattggctggtggcagcattttctctgaggtcccaaaaattcgagtggtcaagaagacaccctgcaatgatcattccccaacattggaggccataaaagtcagtctgggtttgcaaatacacactggaagtctcagagctggtgcagacatctcagagctggtgcagacagacactgtggctgagtgtgtgtgccttgttcgttatggtttcactgctactggattggtacctggtacacagtaggcactgaaaaaatattcactgaaagaaagagaaaacttgatggcagttgtaggtctgggtctgttggaatttttacccccaggaagagatttgattttaactcaaagccagttgataaacagcctcacccagcagacagagggcagcttgggggaaactggagggtatgtagggtggggtggggctcttatctgtatggacaatgccatatattttctgaaacttggatttttctccttataagggagaagatccaagaagacaatgaaaaaacatttgcccctgcctttagaaaaaataaccttttaatttttggaataatttcagatttttagaaaagttgcaaaacatttacagagagttccactgcatacccctcacccaaagtttccccctaatgctaacatcttatgcaactgtgatgcctttgcccctaccattttgaggttaacaattaagttagtataatacttattctgtaccgagctctattctatatcattttcctgcagttgtttatttgaccctttcagcatcctttgaggaataagcactgttatagcagtccccattttacagacggggaagctgaggctcagctagactctagctagtgttcgaaacctaagttgtctggctccagtctctcacccctcaccattattatctgcacagtaatgatggtaactgtcatctcttgatgataatgcgttcaggaactgagctcaaaagtttttccctccctcccttcctcccttccttccttccttccttccttccttccttccttccttccttccttcctccctccctccctcccttccttccttccttcctttttttgagatagggtctcactctgtcacccagtctggagtgcagtgtcacgatcgtagttcactgtaaccttgaactactgggctcaagccatcctcccacctcaacttcttgagtagctttgactacaggcataagccatcatgtctacctaatttttagttttttcttttctttttttttttttttcctttttctgtagagacaaagtcttgctatgttgcatggctggtctcaaactcctggcctcaggagccctcctgcttcagcctccccaagttctgggattacaggtgtgagctgccacgcccagcctacttatgttatttctaaaccctcccctgactcagagctgtggtaaagagccccgcttttgttgtcctgctcaggacaaaaatacatggccccaggcttttgtgagtaggatccggaagggaacttaagtgtgtgtgtgtgtgtgtgtgtgtgtgcacccacgtgtgtgtgggggagtgatagagattctcctggtttctgtcctagttttttctaagcgtatggagacaggtctgctccgtacatctggggattggtattaccacatcatttcccccctaacagcagcaaagattctcaaagcttcatcagagcatgaacaatcagaaatgccttaattttgttagtcacaataaataatactttgattaattagcaagcacatgccttgggaatatgagaaagtaaatgatttctaccctagatctttcagatagctgggagggaagagagtattaaaatacgcttttaactatgggttttggatggagaagaggagaatgccggagaggggaaagcagcagtggaattgttcttggagataggagaaactgaaactctttccacccagggtctttgcagaaagtggttcccactgcctggaatactttttcttctctttacatggtgagctctcactctagtctcaacttaaatgtctccccctttgacaggcccttgctaacatcctgtttcaagttccttctggatattgattaggatggtaagcttcatgaggttaaggatctctgtttcatccactgctccatcctctggtgtctgcaacgacgctggcacaccataggcccttattaaatatgtgtcgactaaatgaatatgtggtcttattaaatatgtgtcgactaaatgaatatgtggtctatttcaagtcctcgtttgtgtctgccctagaacttagcactgtttgccattagcttgtctatttccttgtgaatagctagattccctcatgagctataagggccacgatggcagggggtgtgtctaccttgttcaccaagggtacccaggatgaacctggcctgcagctaagggggtgggctctagggtcagattacttgggctcaaatcccagatttcctatgttccagctgtgtgatttctgctaattgtcaagccactctgtgcctcattttccacataggtgcaagaggggtgataatagcatctatctcttggggttgttgaaagaattaaatatgtcagtattggctaaaacacttagaggaagctgggcgtggtggctcatgtctgtaatcccagcactttgggaggctgaggcaggtggattgcttgaggccaggagttcaagaccagcctggccaacatggcgaaaccccatctctactaaaaatacaaaaattagccagacatggttgtgggtgcctgtgatttcagctacttgggaggctgaggcagaagaatcgcttgaacccgggaagtgaaggttgcagtgagctgagatcgcactactgcactccagcctgggtgacagagcgagtcttcatctcaaaagaacaacaacaacaacaacaaaaaaccacaacacttagaagagtatctagcatatagtaagtgcttcagtgctttatacatgtcagttattggtagtactcaaaatatttgggatttaaaagttgggggatttttacataaaaggcacttttcctctttgagtggtaaaatctcccctaagaaagaggcaaggacagatggagatgatctgagaggcccaagagatccttaaaaccaggctttttaagaaatctgatgttttatttctccgtattgtcatggaaaaggccagcttttagcatgcctggtgtttctggtgttttcttctcttcactgttttctacatttctttctttgcattggtcctttttttttcttttttttttttttaataaaaaaaaaatagcacagctcggagtcttgcttgctgacttactgctagagtgtgggatccattgcttccatttagagaagcagccggccctggaatgtggccgcagggctgccaggctgactctgtgagctgagctggcgaggaatgcactttgcagcttgcactgagtttggccttacgtctgtggaatttcttctctcttcttactcattcgtgtcgttaaataaataacaacacaagcagtgcatcctcccggttataatggcaaacagtacaatgtgttacaacacacagtagcttgaagaggatatctctctcctgtggtagatgcttcattccccagaacttcactcctcacccccagaataggttgcccagttaacaggatgcctggttcagtctgcattttgggtaaacaaggaacacctttttagtataagtatgtcccaaatattgcatagcaccaacttatcctaaaacactatttgttgtttatgtgctattcaggtttaactgggcattctgtagttttatttgctaaatctgacaactccagagagtctcctagaaccagtttcctgtattttcttccagtaattttccaagcatgtgcaacctatggatatcttggcagacttactcctggtagaattcccatcacctagaacagtgcttaggacattgtaggtgcttaataaatatgggttgaatgagtgattgactctgtacccaccccatttttcttcacataagtggaaatatattatagtgttgtttcatatgtagcttttccttttaataatgtctcatggggattgatacatagagctgcctcatactcctctaagggtttcctagcattcccttttatgatgcataatgtatttaaccagtcccctgatgatcgacattggtgctgttgagagtctttagctattataaacaataaggtagtgagcattcctatatatgtttacctctgtgggtttgacgacgtgcaaggataggtgtcgcattggaatcatgaggacggaggatatgtgctttaaaatgtggattgatgttgctgaattgctttctgtacaggatctgttcacacttccctcagacagcttgttccccatctccttaccaacatagaatattatcaaactttttcattttgccaatctgatcagtgaaaaactagtatctcgctatcatcttaatttacatctctttgcttatgagaacatttttatgtttgaaagctctatttctttttctgtgaactgcttcttcttttttgcctatttttttctacttattgatttttaaccggtttttgtttgtgaaagaacatgtctgttagcctggcatatgttttatatataatgtaatttataaaattggtgtttaactttgaaaaagtgatttattatggattttttaaactctgtagacattaaaaaattcctcagtagtcaatttatgagtcttttcttccacatattctacattttgtgtcttgcttagaaaggcctcttactcaatgagattatagaggaattctcccatattttcttttactactttaacttctttttttttgcatttaaatctttaatccatctggaatttattttggttttaggagggaggtgaggatctagctttattttttaccagatggccagccagttgtcccaataccatttattgaataatccatcgcttcccacagaattgaaatgctgcctttatcatatattaaattgtggaggagggattttatactcattttctgacagcctccagtgccagctaggcagcaaggattttagggggtttcagctgactagaggcaaagatcctgacctgaaggataaccgcaatttattaaaccagaaatactctgtgtaggaacagtgggtttcctgggtggggacagggttggggtgggggaaagtgagtgtcccgtgctgggaggaatttagttacagcaagatttctcaaccttggcattattgacattggggggtggaataggtctttgttggagcctgtcccatgtagtgtaggatgtttagcagcatccttggtctctacccagtatacaccagtattaacttcaccctgatttgtaacaatcaaaaatgtctccaaacattgccctgggtggcaaaatcatcttcagttgagaattactgctttatcaagcctgggtcgagcagacctcccatccatttcttttaaacagaggcagggtcttgttccgttgcccatgcagtgcatgatgtgatcatagctcactgcagcctcaaattcctggctcaagccatcctcctgcctcagcctctggggaagctaggactataccacatgcccagctaattttttagtttttgtagagacagggtcttactatgttgcataggctggtctcaaactgctggccacaagcaatcctcttgcctaggcctcctgaagcactgggatta

SEQ ID NO: 144 - DNA, 63781 bp, Homo sapiens
aacaagcgacctgtttggcaaggaatacagcatccttctgagagcctcttctcgacactatcccacagaccaggacttcctcatgggaaagagcacttaggatcttgctatcagctgccctaaacttttgctgagccaaaataagactttgatgcagaactgaacaagatatttcatttttgtgtgttttaatcttcctggttgcagtcttagttgttcagccctgagaattttgagccacatttgttgctattatttttgcatgcacttttcaaaatgattgacttaagcttcctgactgaagaggaacaagaggccatcatgaaggttttgcagcgggatgctgctctgaagagggccgaagaagagagagtcaggtaagaggccagagaagccttgggcatgagggaaggaagaggcagtctgtacgaaaataggacactggggtttttttcaactataagtggtagttctgactcgaagactgaatttatggattccaattttaggtttacttcctggacaaaacatttttcctcttggtgcctcttaatttatcctactggactcctaccagaaatagggtcttgattaaaaacctaactaaattcctttaacttattaaatactgagataaaaatgaaatgtatacaaccacatacatctacatttgtgtgtgtgtgtgtatttctatccacttaaaaaaactggatctacttttttttaactgaatcatgaaccaaattagaattttaaaaaatttttagaattttgaaaagaaaataaattaaactagctcacatttctgcatgctttcagaaatgttggaattggttttaatggcaactgaaagtattctctgagccaatttttcatttgtcttgggtcccataaagaggagtggcaactttgatacactattcttgttgggtggaacccaaatgttccatgtcaacattcctgccactttcattcacctttgttgtcaaacaagcactaggccaggatgctgaagaacttgactttgtccaggccctgccatttactgcctgtgtaatcttgggctttgaaggcagcgacaggcttcctgaatgtaagttagtattattaattttatgattctcgctccaggagttatccaaaaggagcataagatatgttcttacttcctgggacacaggaccatgaataatggctttatttttaccatttccgtatcttgacactgatttaacgtggatgatttataaaagaacatgctagaattcacttcaaccactacagaatgtctgattatgactactaaaataacttctatatagacagtatttaacaagttgcaaagggcttaacatgcccattattttttatgagctcacatactcttttgcggttggtgggtggagtgggatataattaccccatttgatgtgtcaggaagttgactttgagacaagtcaggtgactcgcccaatatcacacaactggtaggtgtcagaagtgagaatcaaatcccagtcttaggtactcatttgttaactccacctcctctccctgagaaaacaataacagacaggccatcccaggacctggcaatggaggaaggggctggctgtcatggtgtgaagtaggacactgagctatgatgacaagcagtggctgtaggtagtggggatcatgctgttcctcaaaggtcccttgcaatgcacacctggatggggctctgctgtgccttctccgcaaatggtgtgccttaaacagtgtccccaggagaggtgaaggattgtcactaacccaggcattagagcctcttggtagcattaatcctctacccattgacagtttataaagcccttttatgaatgttatcctcttatgttcttcacagcaaccctgacatttggcaaagcagggactattgcaaccattgaggagtaagggcaggaggtgggggagcatagagaaaatattgattctttaagcataaggggaaatggtatttcctttaccctcccaaaagaaaagattgggggaaggacttagaaagcagtagagctgggactgcactgagtctctctttctacctcaggatgtgggcccctgcattttggagaggtgcaagtacctttgattccttctgctcaggaggtgttatttatggtctgcaattctgcccctctagatagtcagcttacgaggagaaagcctcctttcatttcctccctcccttctatcttttcttggcacctgggattccaagctgctgagtcttgtctgtagttctatgattctgtctgaatagagtgaaggtgtttcttgggcacttgcattggttgatgaaaatatcctcaaaaaatgcaaagttctgcctgaaattaggccttataaggggtgtgagtgtgtaccctctggcatcagccaatctacaacttcagcgaaaatggtgtgagtcccttcctagtgttggtgttgcagacactccttctgtctgttgtttctgaaggtgccccagcagctgcgactggtgctgcctttgtgttttgcttttgtgactaaatggcaggaagaaggcttggattggtgaaaagcctggtgtgagtcaagccctacctaccatcattttcccaagagactttctagttaggcaccatgtacctcatgtggacttggccatggacagtttcaggaccctggagctagggagcagtgacagtgcacagatagatggcagacctatggcttgtggaccctgaaaaaggctcaactcatagcctgaccccctctttgctttaggcctgaagggacttgtggggatagtttggaggttgttctgctcctcggatggtggaaccagaactggatctctgaaaatgttactccatgggcttttgtttgtcagcgccttttccattccattgctgtttgtctttgcctcttctaccagagttatagcctaataactatgaaatttttttttgttgttgttccatatcagtcattttacagaaaaaaagataaagcccagaaagggtaaatgacttgcccagggccacacattaagtcagtgccaaagccatgatgagaaatctcttgggccggtgcttttccctctgctctattctgctcatcgttgttattctttcagaaaggaacagtaagggtttgatcatgacacaaaaaactctgctgcttggaaccggagatgaaactgacatgcgtttgcatctcattcctaccactaatgaactgtgtttcactgggcaagttatttaacctctctgagcctcaactcagagtgggcatgatcataatactacatttaaattcaaaagattaatgtcaggattaagtaaaataatttttaggaagcaagagatagcgagagatttgataaaggatacaaaattacagtgacctgatgactatatgttatgtatatcaaaacatcactgtttcctcatgaatatacaaaattattatttgtcaattaaattaaaaataatttttaatcttcctggcacataatatgtgatagttcattttaattcctttattcaccactctacctatacctccaaaaaggggcaggagattctagttagtagactgattccttagaaggaaattactcctaaaactcttaattatttaatgtagtagaagttaattgagcacctattaagtacaaggaactgctctggacaatgatatgaagagaattccagggtgattgaaaacatggccccagctctcaaggaatttactatctaatgacctttatccatttaatggattatcagttgcaaatttaaaatctcaattttgtttccctaacatgactttacaatgcctcattcctcctaggtgttatttggcttagaaacacattatataattatatcagcccaatcaaaacatcattagaaaggccaatttattactaaaattcagacttttcttttaaatactaatgttttatagactttggagtataactctcccgtagccaagaggacatcactaatggatacaccactgttgcctgcaagaccagatatcactttagaatctttttcagtatggcggtagatgagatctggcattcaaatggaaatgttgccattcctaatatgtccagtgctttgacttgttcacagccaagctcattcaagatactttggagatgatttagtttatatgtcacttcccatctttttttttttttttttttttttaaaaaagagagtttctctctgtgacccaggctggagtgcagtgaggcaatcatagctcagtgcagcctccaactcctgggctcaagtgatcctcctgtctcccaagtagctaaaaccacatgtgtgtactaccacatccagctaattaaaaaaaaaggttttgttacttcccatcttgatttcatggataggaaaagtgagtgttgcacagagacatatccagttcctaaatcacttggtctgttaatggtagaacatggactcgtacccaaggaaatagtcactggggtgtctctggggtacagctgagacaataacggttccagatcactgttgctaccacactgtcttttatgttgctccactacctgtagccacaagtactggacccagttattaccatgtatcgctacacagcctgcttccctaactcccatgtggagacatttcacagaccagcagtgaaggagacatcagggtggattctttctctctcttccacccctatcctgtgtcttctctcctgctgccctgacccacctttaaggaaacataaccatacatacacatatgtaattttagtcttttatggtttgaaaatcacatactcaaaaggtggcatttcctgtgctttgcgtcacactgccagcaggaaattgctgctcatgtctgtctgtacaccaccaccagcactgcatcccccacccccatatacacacaaccacatctacagcgatgggtgtttttgcagtagatacgatctcaaccgccaccacatcttatgattctcagctgcctccttagacctagttgtgttttttttttttttttttttttttttttttttttaatgaaggcagttgtcattgaaggactaatttccaggacctctcatggtgtttttctgtcaaagcaaaggggaaaggaactaacatttgtcaagggactgtacatggatcttcacatagattttcctatttcatcttcaaaacagtgtagctgaatccacttaacagatgaggagatagggttgaagagggtaagtgccccgcaggattgaagccttgttgatccaacatcaaggcctgtgcacttcccttacactgtgctgcctctcagcagactgcagagatctacgatgtgtcatgtaaaaggtggatatttcttgttttctactctaaggaaggtttgtagtttgttttccacatgttggttttcagattcttcatcaaagattgagttccttaggagaaagagtgaagtgtgacagccatcttagaaaccgaaatcatgtttggctctctgaggcaggatcgggtagtagaaagtgtgttggctgggagtcagactggcttctgctgccagctctgtgtgaccttgggcaagcctcttaacttctctgggcttctatcattttatctagaaagtgaggtcatttgtaactatctaaggtacctttcagctctcacattcaaaacaaacatctgagagcacctccaaatcacacagtctaaacatcttgcccagtatattctgggcaagatgaaaaaagaaaggctggagaatagaccagtcaacctatctggccagcagctgtccacagttgactaaatactatgaaccaggtcctgcaggtgatgttcgagctttgcctagtcctgttgagtagctggaagctgaggtgtacataagtgagcacaaggagaaaaggggtaggctgagggcaaatgtgttgaatccagcccagagggcatttctgctcttctggctttcctctgtaagtgctcacactcttggcatgaaaaggagttgacattgacagttagggctgtagatagaatttttaatgtccaatttgaagcagatggctggtatgggaattaatgagtcagtgaacaaatagccagacagggtttagatatggcttttagcatacagaagaggtaaaatggccatcttttgaaatggatgaaattctttgaacagcatggtgaaattgtaaggatgaaatgataagaggcttgttaagtgtcagatgtgtggttcagcacaaagcagatactgtgtgctagctgaaggaatgggagaatgaacgagagaatgaccaggacatcccacctgggaggccagcaggccagtgtactttctggattgagtgctcttcttcagccctcacttctgcccaccagcccaccggtgtttactgagcgtcttctctctacttaactctctgctaaacataacgtgtgtgtgtggagaggatggtaaaggataaatgtcagtcccaagaaacttacccctttctctcttcatctagatggtacgataattagagaatcaaatgctcattttgttgatgtaattagagttcagaaaaaaatgagagatgaacgtgggctggaaaacgagaagattttaacagcagcactagatagtgggattctaaaaatgatctacatctttacaaaactttgatgttatacatatggatttatctacgaaatagtacaagtgactaagatagaaaaagaagttgattattaaacctagtagtgatagtcatgtaaggaaatatgtaagtggcacttaactacatttgaaagaatttcctgttcttttgccactttaaaacaagtgagccagaaaccctttccttactataatggctatcagcctttgtagggaccatgtgtttcagggagtcgatgcaaaacctgtgctcattgtgcattgatcgtgggcttacagacagtcatttaggcaggaacagatcaagggttgcacaagaatccccacaaagtgcattttagttgaaaaacaaaaataaacaatcttatgaaaagaaattgggtgttgttctgctataagggtttgtggcctccttcaacaagaatgctgaccgacaccacatttcatgatgttttttcctgttctgatgagagatgagcatgtcctgctgcatcaggaggagacaccattcattgtgatggggtctgaggttcacttaatcacagcagtgacaggatcttcttgatctcttgcctgactcaggatggctgctgagcgtttatttgttctttgatttattcactcaacagacagttattgggtatcagctctgttccaggctccgtgctaggtgctggcattacaaaggtggttaagacatagtcctcactttcaaggagtttgcaaagaccacaggttagtgagtacaacagatgtgcaaacagatcactggaatatgatatagtaaggactgaagtggaggtgctgtgggagcaatggaaaaggagaaactgtaataactgtgccctcctgagttagggaaagcttcccagtgaggcagtgtttgagctggatttgaaggatgaggagcaacgggctggacagagaagtgagggaaagacatcccatgagacttcacattaactggccttgtaccaagatctaggcagtactaagtactttcagttaaacatctcaatcatctcagaagtcctggagggtaggtcttattttccctgatccttaaaaacaaggagactaaagcttagaggagtttggtaaactgtccaagatcccatctaggaagggtcagaactgagatttggatgtaatttggggagccttgaaaacccagagtctttctgccacaacttcctgcctctgtcatctacagaggtcacagaagagcactggagaattgtaagaagctgagcctgctggcaagtggggtatgggcgtgagtgctggaaaaatgaatctgaaaaggtaacctgaagcctttttaggtggtcaggagcctcatctgatattcctccactctgcaagatctgaataaataccccgtattttccagacactaaacaaagatgtattgagtacagaccctgcccccaggaactcaccagggagaagtagaagaacttctccattctggaattgaactcaaacttggtccttttgggaggagaaggcaaaggttcaccaacagtccagcagttgtttgctctgctgaaaacagtgttgaaagcagtgtcaaaccattaggaacatttaataaaaaccatgatatcgttgctgactgagaactatgaagcaatgatgctctccctgttagggtttatagatggggctgtcatgacaaagagaggaagttcctgtaagagtttactctgggtggaaggacactctccaggcacgcttgggagagaggagacattcttgctagacctgggataactgctccccctctttttcccactcccaggtatgcctgtgtgcaacccttacatgcagcgctgctaccaccttggcccattcacattctctgcctgaagcactttgatttgctaattgaggaagagtgcatattagtttgtatgactatcttaaaaccctcttggatttatgttagcacattatcttccaagagtatagtgttcccttacagcttttattccactttattctaagtacatctctataaacaagagagattttgtgatttttttattttactgagatggatagagagatggagaggttaagacttgtcagttagaacaaagtttttagggaagttttaggagggcagactatcttgtttgttctttaggttttagcttttcagtaagcatgaataattgtgaaactcttaaatgcaggatctgcacaaatggaacttgcctgtacacactcctcctcaattttggtcttccctgattccagcagccttttaaagatgcctttccctaacaataagcatcagagacatcactcctcctccacaggcttccaggaaagtctctaataaactcatatcacccaaaatggaaaggactgatgagctaatgactaccccatccagtgtttattaggtgccagggaggtgcagagagctattgaatgaattcactcggttaaacctcaaagaaaccccaattttaaagtccaaaggttactattactaatgcttttttacggataaggaaaccaaggcttagggaagcctaccgtattatccctccctggggtatttgcatttgaacagcagacactgaagaatgcagccaaaaagtgaatctgctcttgagaaatttcaggcatcatacgggaatcgtggattaaacctttatttgaaaaaatgttggccttgtcttctctgacttttcaaaggtgaacatacacttgttagtcatctgggaagtttctgggatcatctgaaatattaaagcttcattttatctgtgtgtttacacatgtctttatgcggtgtcataatgaactcatttatttactgtgggttctcagcaaactaaagatcttttccttttgtagacatttgcctgaaaaaattaaggatgaccagcagctgaagaatatgagtggccaatggttttatgaagccaaggcaaaaaggcacagggacaaaatccatggcgcagatatcatcagagcatctatgagaaagaagaggccccagatagcaggtgagttgacttggctagtgcatttacaacaagcattcgtttgggaaggaggagcggggagaagggaatggtgtcagaaatctgctgatggaaatcatttggatgtacacttttcataatgtgtggccctctagtttaaatttcccttgccttggatttggatggatgagggcagagctaagtgactcagtgtggtgtagaggaacataggaagccctttaggtgccctgttgaattatagtagcatagatagttggggcctgtaaaggatctaccacctcttctttggcttttaactctgaagattcagaatcttctgagtaaaatgaagggcttagacaaaaagatatcagcctctcttttcagtgatcttaacatatggtagtactttcttaattaaccaagtacattatttaagagaccgtaaagacatttttttaatggaaaaaccttcttgtttatttgattaaacaaaaataaattaagctgtataggaacaagtttaaagtccagacagacatcaactttgttttgaggctgtagtagctgacacagcatctccttgctacctactccagccctctctgtggaccacagtgatatattcaagagcctgttagctaacacaggagttttaaaacacttttccattggttcttcacctgcttattgcctgtcatgcctgtggcctacaatagtaacatttaaaagtgaaagtcaaaagaggggggaaataaaaatgccaaccaaccaaaaacccacttctgcctaaaggtttggggggaaatctttacttatccacccatctactgaattgatgggatttatactatcatgacaatgcccatttaaaagtggcaaaggcagccagcatcccaccccagatgggcttgtagcatggtttctgtggccagggaggttactatgatagtgcgtattccttatatcatggcattatttttatgtcttttttttttttaatagacatagagtcttactattttggccaggctggtctcgaactactggcctcaagcaatcttcctgcctcaccctcccaaagtgctgcgattatagacataagccaccatgcctggcaaaggcaatcttttgagggcttgtttaaaattctatcaagttcattaaatacttactggttgccttctctctaattaactctggcttagtccatgtaaagccttgtcaaggtctaccctgtactcaataaggaaaatagccatcatcttttgagcatgtgatataggataggcatttaatttctattatttctaattgttgcagtaatcctgtgaggtaggcattatttcccccattctatacatggggcatatgaagctcagagaagttaagtaacttgcccgagattatgtaattggcaaatggcagagccaggatttcaaaatatttctgaattagtgccatactccttgcagaaaaggactgactgcttagtacgtacagtgcattgtttgtagccctcttgcttttcaaaatcacccagaccttcagaaatcttgagggtactggttagtaccaggtgaccccattttgcagttgaagaaactaggcttacatgtaacaggacctgtggggggatactctcctggaatatgggtatttggaaactggaagctccagcactgcttcatcctaatattgatgaaagtattctgggcacttactggctctgtggccttaggcaagtttcttgaactttttgatcctcagttttcaaatctgtgtacttggaaaatagctctcatagaataatgcatgcaaagaactcagcacagtgcctggtagttagttatcattcagttgctgctaattatcagagatgttcaggtaaagagtgagtgctggatgttcagaggcaaaagaggttattttctgaagcaggagcacagaggttttatgggggctctgacacctgagctgggattgaagaatatgtagttttggatttgtagagactgtggggaggaggagaaggcagcagaggaagacattcctagaccataatcatttgttcccctttgtatcttagagcacatacaagatatttgaacacattgtagctattcagtaaatgcttggtaatgatggtgcttctatcccactgaggacttcctgccctgagcatcccctggccatgcacatttagacctgaccccaactcagttcagattaacctagaggcagtcagaattttgctttaatggtctctggagttactctcacatttaaaggtatgctcattctctcaagagactctgcttggggaaatctaatgtcgtgggaatttactgacttctctcttagatgtaattctgatcaactacttagacccagtgattgccttggcactgggaaggcctgaggttcaggttcaaggcttcagtgataagagctgataagagagttgtaggtcatggaggtgagagataaccttcctgtctttactgtttcctgtttcagctgagcagagtaaagacagagaaaatggggcaaaggaaagctgggtgaataatgtcaacaaagatgctttccttcctccagagctggctggcgttgtagaagagccagaagaagatgcagcaccagcaagcccgaggtaaggcaaagcttctggggagagctgctgcatgtggctttcatggcctggggtgtcacatgggcagaatggcaggctatgagtacagatgccagactggggtcatgggcatggggaaggggcagtgtatgagagaattctgggccccgatgcagataaagcccaagtggtactctttctcagcttccagaatttccaacaaatctatatcttaaataaaataaaaatgttaagtggtgatttcttccagtaccagcaagagccgtttttatttctcccatggatttctccttagagtagaatgaagaggtacttcaatttgaatatcaaggaataagtcatttcagggaaaagataaactatgatcagattgtaacagcctagtgcaatggaagaagctcaagcacaagaaccagatagatgtgaattcaattgccgaatctgcgatttattagccatttgactatgggcaagacatttaacctttctgagtctatattcttaactatagctaggaacaataatatatacctgaaaagctatggcaagaattagtgataaggtatgtagaatacctggcatgatagatactcagtaaatgcctcttaaggatatagattatcttcaatattatagtcttggggttttttggtgtttttcctacatgttgttatctgaccaatcaaaatgtacatttgtacatctttgctgagatgcagccaattgtgggcctacattgctataaaccttttgagccataatgatttgtttttaggtatttaaggatcttctcatgggtgtctgttccttgagggcatagttgttaccctttagtgagaggggcagttgccttttacctgtagctcctcaattaagttagttcaattcagagtcttcaattgggatgaagttgatgaatttactggtgggatgtcactgaatcagggtctaaggctgaggcacctggaaacagggatatttctagcatagtttataggtgtcagggagggtatatgatataagtaccaataggtattttaaagtcaaatatgagtaaagttatatcatgtggataatggaatactgactctatgggtactctaagggtaccctttatttatctatttcccatttggaaaggggatcattctgtttcccatgaatggcaggctgcactgtttcccctctgggactatttgtaatattcttttatatctgtagaggccatctttgctggggataaaacaccttaatagtagtcactaattgataatgtgaccttacagtagtactgacttaactccttggacttttatttcctcagttttaaaatgggaacaataatattaatagtttgctagcagaattactgagaagttaattagccagtgaatatagaattcccagtgcagcccattagcacgtagtaagtgctcaagaaatggaagcatgagctcttgcctacatataagatatttcaggaacaccaggaaggagtgtgaaggacacactattctgtccccctgggtgactccccacttgccacctgcctataatctctctaatggaatgaaggccttccttcataaagaaagatgagacctaaaatattgtcatgttaaagaaacacaaagagagagaacatagttatttatatttaccaccaagaagctgagagaagctcttaagagctggctttgatggggactggggagcactagaacactgaccagctgagggaggagggagcaggtgccacagaaggggaaaggagatgatttgggagcatcagagacaaatagctcattgccccattttatctgggtcagactttccatccttcttccaggaacttattctatctcagtgggcctgagggtcagaggtgccactgtcctcatagcctaactttttcttcatgaaccgtggggctggtgggtattctcccactcttcctcaacttgaggctaataacatagtattcaagattagcatctccgttattttctgcattccttgtgtgacttcaggcaagtctttcaggtctcatctgtaaatcagaacagaatttcctcaccaggacattgtgagattaaatgaaacaaggtatgagaatcagtcagcatttctcaggaagaaagaaaattggccattttccggtggcatgaaaattgttattattacatggatgaagtatgtttgagaaggcaagaataaagatgttaggcgtatccaggatgctttgctcattaaaggccagtcctataacacatgccatgggtggtaattatccagaaagttagaatgagctattttttacttccttctttctatattagaaactactaccttactcagtatcaagttcctgcaatgtttcttacctatactttaacctttgtgaactgggtgtgttaagtgtattttggggcctgtacttttagactaagtgaactttaatagaatgactcaatacctgtcagtatttccttagccaggagtcagaagttggggagtgtaaggtgataggctggttattgtagtttctggagttttgctaataggctctgtggcaacatctttctttctgttgtgggcacgattctgtggggttccacacatgaagaagtaaaacactgtgggtacccagcatgtagtcaagcattggcagctgactgcattctttcttaactcacctttgtttgcacctggagtacaaggaagcagagaggtttatgagcagaggagaagaaaataaggcttgttctggagtagcaaaaggaaaaccctgaatgctcacatttctagttctggttacagacttttcaggtgggcagtgttggttggaccagcacttcataaaccctttgtagtgaaggactagttttgtttcattttaaagtttttatttctaatcatcacagattgatatcttatgtaaaatataatgaaaataaatactagaaaaataaaatacagaaaacaacagtggcatgcaaaagataagcccgtcgatcatgtttgctataaatagttcttcagcacatagcctccgtttctgtacttatctcattgtgaaccagtggcaaacagtgcatggatgggcactggtccatgaaccatatgctgatagcacattgtgtgccccccacaacagaaaataactcttgaatatgtacacagtaatccacaggacatggctgagccaaggtggggagtacagaatgaagactcatcccatgaaggtcaggaccctgtccgtaaatgaggtataatgtttcctgactatcaaattaggtctgttctggttttactaagaagctgtcacttcagaagtgtccccataagccctggcaattatagaaaaatagaggagaatttgagggccctctcagatttgcatagctatgagagaagagcattcaagatggagaactagactgcaggaggtagccaataaacctctgcgtggccatgccctgtccttggcttgtaaggaggcttggctgctgcagaggtttgtaatggctagtaatcaaacatctctagagaatgtctcccaaatgagttcagggagaacaagatcaacccttcactgttgtatttcagtccatggcattggcaggttttcttctgggcacttacctgtaaaatcgcaagaaaatgataaatttccttgcaagaaaaactgtgcatttacacctaactttgtttttggtagaattaaaacactatttggtaagtctttgtgcttcattgcctgtgccttagggatgcttctgacaccagtctccttcttaccgtctgttgaataggaaccaatcaattaaagccacatctttagctcttagttttcccccacaatgctctttttcctgaaagtctttcgtagatattaatttccctctcccagaaggattagctattgcgtttacccctagtattaagatgagtgtaaggtacctagcttgctcccaaaggcagggtagagatgagccaatctgagataatgcatctgatattttttcccaggattgatagcaaatctagtaatgtgaagatttcatttcttggaggcctggcctacaaagtcatttatattgaactcttaaaataataattcttaattctataagagctcagatttactcatatcagttgtagtaagaatagtttcactgtgacataaaaatgcctcatacttttatatgcatgttcaacaactctgtagcctgaacagtgggaacactggagaactatgtatactcacaagtaatattttacttaaagaaatactgacttgaggtgcttcagataagatattttctaatttgcttccctcactccatccctgagccgtttcttcatttgtttgctcatttgttcatgcttcattaagtgccaacacatgccagcacagttctgggtgctggggatgagacacagcttgagcccccaaggaagtcacagtacaaagggagagatcaaaacaacaaaaaacaagtcaacaacacttgtagaatttggttctataaacaacatttaagctaagaaaaaaaaaaaaacctcagaaaaaggcatatctgctactatttttaactgttgtagagagaaaggctggtgaacgttaaaaaccttttttaaatgactgcatgtgcatagaagcaccttgtggctgggtatagcaggcagctgcctgtgtggtataattttaaaacggctgtaaaacctcttcccccagtggcccttcctgatgttatttattctttttatttaagatttcaaagacttgtattaaaatgaagatgcttttaggaggggcaccctgatgccaataccatagtctaatattttaataatcttcttaacaaagtaaactaattctgtctgagtgctgcttctaatgttgcagttccttttttgaagagtgcctgagggaaggttacagaacacagggtatggaatttggcttgcttcatagtttaaaaatcttatcatgtggaatgtatggagtatcttttatattcaggacacagtctgctaccctctgagaggaattctaagaaacagaagacacagtatctggctctattctgtattctcttaggaaaaataatgcaccgatttatgaagatatgaccacatgatagcaaatagtgccaggaagaaaggaaattcctaatccaaagtaccaataaaatgtgctgcaataattgaggcaagagagacatactcctagccaggttgatataagaggtgagatttggactgggcatgaagaggatagggacgatttgggtagacaaagaaagcaaaaagaacacttacaaggagggactgggaataggttaagtggaaatagcagagtcaggtgagtttctggggcagtaagtagattgaccattttgtttggcatgaaaggtcaatagaaaggaagaatgggaagtatattggggcagatggtggatggtctccagtaccttgccaaggagttcagacttcattccacaggccttgaggatcctgcaaaggtaatgaacagaagaaagacaccaccaaagttgcattttggaccactccagcgtagtggtagaacgtagaatggtttaggagagtggaacttgggagtcaggaagccaaatgtgaggccaatagagttgacacaaataaaggaggtgtcagtagaggtagaagagacagatgtgggagtctctgggagggaagaatcacccagacttgcctccagtcctcttgccacaagccactgctttaatgcaagaaaccagaggcagtatagcctagccattaccatgattgtctttggagtcagacacacctgggttcaaatccccagctcttttgccaattttgtaacatcaagcaggtgacttaacctctgtgaacctcagttttttcataagtgagatggagagaatgatagataaaatgatagataacatagagatgatgcaaggatcaattgagaataaggtggttgcagtactgattgcccaataaaagacagacaagcaaaacattatagtatcccttgagagaaacaaagctactaggaagtagctgcattttcagacaaaatttgaggaaataagactcttgttttaattttttcctattaagcagactgtaaactttaactgagtatcccccctcatcccagtttgcccctatcccaaccacaaggtaactgaatgaatcctgtgtgtttctaatattttagtgtctgactatgtgttctgactgttttgtttcttcctctctttttctttccgaatagcggaaacagacattttgtttaatacctgaatagtctgcctcactgcagttttgcaaataacatggattaaaaaaaaaaaaaaaaaaaagccagcctcctgcttactatctgttgctgcttctcctggcactggctcaattggccttcgtttatttagccattcaccagttatgtaccaggcactgtgcaaggcactgcaggggatataaagatgtttgagatactcttgagggatctcccactttactatgcgaggtaagatatgtatacacagaggaggttgcatagtagacatgaaatacatagctaggtacagctcagtaagggagagacctcatctctaggaggtagggactacatgatttgcaatatgggctgttgaggctggcggcctggaggcacaggaactggaatttcagggagcagagggagaaggatatagacactctgcttatcctttgggcttggtgagtgggaaggggaaaggagaaagatggtggaaaaagacaggtgttccacagagacccccaaccatcagcacttggctcaggtcttctgattatgtaactgctttatttactaaggaagattatgcagaacactctgagaaactgagcatagcatcgactatagggatgttgttcctcatatcacccactggcttctaaaaatgacattcaagagaaattgctttctggttctgagctattggttgtttttattatatagagactgaattatatcagtgactaggtttcttttttcactgtttctagatagcttgattcaagtttgtgcacacctattacaggaatggaggactcctgtaatgtgtctattagtcttaattcgggctccattatacattcctattctgttccctcccctttccctcccatcctctattttccccctttctcgcctctatgtaatcaggctgtattttatatccttctgctcatctgctataatgcctttctggaacaatgaaaggaagtaatgaaaggaagaatggcttcttcaagagctcagccttttcttgggagtaattgtgtaaaaatagcaattgaagtacagagataaagaaaagaaatgaggctgcaggaacatctagcccatggttttagtgacaacaatcttggttgaggttctgtggccttgggggcaaattattcccctcctctccaggcctttggttccttacttcatggggaaaagcaggaatcttacccctacctccacaaactaaggtgttttccaagctcctgactctgtgatgccactgagagaactggtggtggtaacaggacacgaaggcttcagccaatagcaacttcacctcctgtgcctgaggcaagaccactggaacaggaagtctgagcaggttgttcctctccccacccagggcctccgtgaccctcttttgcccttctcaatcaacagtcaagggtgtggtggttctggagggagcctgctcacttcacttgtctccactcactcttgccttactctcactctggtgctgtcctgtccctgggatagggaataattctctagagaatccttcttattcttctgcaccagcttcctctcctagcctgctgatagctttccacttcagaggcataatttatgattcctcaaaaggtgaggttttattctctgaattattgtttcttttgcagttccagtgtggtaaatccagcttccagtgtgattgatatgtcccaggaaaacacaaggaaaccaaatgtgtctccagagaaggtagactgagcccagattttgaaaatcttgtatttgttaggaatgccatttttcctcattgtgtcaaagcaccacaaaataaagagaattttgtagtacagttttttggtaccaaatacaggtaattttcactattttaagaagtcactagtttaagaagtcactctcatggtggaaaaagtggatggataccatgtcattgcattgctgaagacccagatttcttgccctagagggtaaaaagtctgaagctatttggtgctgctgctttttagcatatggaataaggcttgttagttccatgtcagtccttattcctatattcctatgcatagcttcctaaatctctgttagagatctgcttctgggagagaattgctaatttattaaactatagacagtaaacattgttattgattcctatattaatttttaaaacctctattgataccatttttatcattagaattgatgataataataatgactatgaagcacttcaagatacctaaaatgtctccaaaatctttaggaaaggtcaattacagttgtattttgtacacttgtgatctagcacactgagagtctggtatggtagaagaatcactggtgggactctgacctgattagagacccaagtttcctttgaccttgatctggtctttgctatatccggggccaagttttttcacctgtaaaatgtgggattttgatttaagtgtctgattctgagctaactttgtaggactctggctttgcatatattttatataatttttaaatggcatatatggtaactctgtgctaagcagattaatcaggacaactgtttttcaaacatgccaaataatggagtttatgggataaaactatcaaaattgaagataataggcatttgccaacactgagttgctgtcatgacatttaaaataagtttaataaacaatatttgtccccagcagaggaagaatccgtttaatagctccaagttgccagaaggtcactcatcacaacaaactaaaaatgaacagtcaaaaaatggaagaactggtttatttcagacttcaaaagagggtaaatattatttttatgaacttgatttttttatctttgttatctgtggactaagggaaattctcagagttccttttgctcaaataacttccaagagaaagtgaaaagtcctgatggttttcttattttacggtgcttgttggtttccttcctgagggagaggaagcagaaatttgagaaactgatagctcacgcattccagtctcagagctgtgacttgttacgtgacttccattgtgtcttggattccctcatcagtaaattgggagattttttgacccaagacattcagtcttccacttaacagtatttattagatgcctactgtgtgttcacaaagttctgtttaaaagggcttgcctcaagaagaaaaagcctgttgacaatgttatgatcctctaatctgtaattctcagcccagccgcccaaaagcgtttgatcaggtttgtggctcaattgatgtaagtcagcctgctatggaattttatcatttttatatactgttaagaggaaatgctaaacatttcaatctcttcaaaagcaacttgaagaagattccacaagcattaaagagtggttaggggtagaaaattaaaaaacagtggagctggggttttcaattagcctgtctgaatattaaaatactttccactgggcacgttttagattacataaaatattttgtagaagaaaatcactggaacatgttagatgtttgtttttaacttttcttttttttttttggccatggagtcccactctattgcccaggctggagtgcagtggtgcaatctcggctcactgcacccttcgcctcccgggttccggggcttctagtgcctcagccttctgagtagctgggactacaggcgtgctctaccacacccgcctaatttttgtatttttagtagaaatgaggtttcacccttttggccaggctggtctcaaactcctggactcaagtgatccacccacctcggcttcccaaagtgctgggattacaggtgtgagccactgcgcttggcctgtttttaactttctgacaaaaataaattttgtgttaggtaatggggttttatttttttaaactgaatttccttttctgatttctgcaggtgaatttaagtgacttctatgtttttctttaagcctcttttgagaaattttcttttcattcttaaaaaaactttctgtattgggtgtaaaataatcacaaactatataaagcacagtaatcttaaatgtacagtgcaatgaagtttatacatgatttttcgaatagacgttattttttagagcagttttaggttcacaatattgagcaaaagatacagacgttttccatatacaccctctccccacacaggcatagcctccctcattatcaacattcctcatgagaatggtacatttgttacacgtgatgaaccacattgagacatcactatcacccaaagtacatcgtttacatcagggttcactcttcatggtgtacattctatgggtttagacaaaagtataatagtgtgcggccaccattgtagtgtcatagagtagttccagtgccctaaaagtcctctgtgctccaatgcatgaatttttaaaagcttttcacattaggcctgtagttgtgccacatactttactgtctttaatattttaatagtttcactaagtgtaggttaagtttatgacaggtattttaaattatatattactctctatatgatatatcacctactgtgttttaattttcagatgaattgtcagagtcaaaagaaaagtcaactgtcgcagatacttcaatccaaaagttagagaaatcaaagcagactttgccaggcctttcaaatgggtcccaaatcaaggctccaatccccaaagccaggaagatgatctacaaatcaactgatttaaacaaagatgataaccagtcttttcctagacaaaggacagactccctgaaagcgagaggggctccgagagggatcctcaagcgcaactccagttccagtagcacagactcagaaacccttcgttataatcacaactttgaacccaaaagcaaaattgtgtcacctggcctaaccatccatgagagaatttctgagaaggagcattctttagaagacaactcttccccaaactccctggagccattaaagcatgtgagattctctgcagtgaaggatgagcttccacagagtcctgggctaatccatggtcgggaagtaggagaatttagtgttttagaatctgacagattgaaaaatggaatggaagatgcaggggacacagaagagtttcagagtgaccctaagccttctcaatacagaaagccttcgctttttcatcaatcaacctcaagcccatatgtatcaaaaagtgaaacacatcagccaatgacttctggttcttttccaattaatgggctgcattctcattcagaagttttaactgcaagaccacagtctatggagaattcaccaaccatcaatgaacccaaagataaatcatcagaattaacaaggcttgaatctgtattacccagaagccctgctggtaagagagttgtcactactagattataaaaacttggtggggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaacaaaaaaaaaaaacttggtgggcttgaaatgcccaggccagctagtcctgtagaagcccaatttaaccttctaggcattccatctacaattcagacagatgccactggaaatgtttatacctcttaatgggcttggagattttcctcaatcaccaataactaaaagtaccaggatagcacagtttctggcccattatgctttaccctaaaatatatataaccatatcaactatttaaacaaatgacaatgtttttagttaaatcaaggtggaatagagtaagaaagacttcctttcattagctaatacctttgtacagggtaaatgtattattactcacctaatgcaaatttattaattacaattttaccagactttggtttctcttgtaatctcaagagaaccttcactttcttagtgtcaaaggatgggaaactagactttgaggccttactatgcaaaagcctcagactttggcctgctcaggcctccagccatttgttcttaggctttaaaagccctgaaggcactttctccttcagcttgtgtgagttgagaggcaatgagggtactgcttttccctgctaactagccttgtcttgaaggtcttaccactctcaggggatgcctgaaactacttttatacctatatgatcatgaagtaatcataatgttttataatcataatttcttatgttttttaaaaaaacagaaacaatagaaaaaaacatgctgtgtaccctctgccatcttcagtaagcctgcatcgaaccctatgatagtttctttatagtcaggataattcacaatagcaacaatcaagtttgcttttttaaaaaaaattttttttaaatatatactttaagttctgggatacatgtgaagaacgtgcaggtttgttacataggtatacacatgccatggtggtttgctgcacccatcaacctgtcacctacattaggtatttctcctaatgcagtccctccccaccccctgcccaccccaacaggccctggtgtgtgatgtttccctccttgttttccgtgtgttctcattgttgaactcccacttatgggtgagaacatgcggtggttggttttctgatcttgtgatagtttgctgagaatgatggtttccagcttcatccatgtccctgcagaggacatgaactcatccttttttgtggtggcatagtattccatgctgtatatgtgccacattttctttttccagtctatcattgatgggcatttgggttggttccaagtttctgctgttgtgaacagtgctgcagtaaacacacgtgtgcatgtgtctttgtagtagaatgatttataatactttagatatatacccagtaatgggattgctgggtcaaatggtatttctggttctagatccttgaggaatcaccacactgtcttcacaacagttgaactcatttacactcccaccaacagtgtaaaagcgttcctatttctccacatcctctccagcatcggttgtttcctgactttttaatgatcaccattctaactggagtgagatggtatctcattgtggttttgatttgcatttctctaatgaccagtgataatgagctttttatcatgtttgttggctgcataaatatcttcttttgagaagtgtctgttcatatccttcacccactttttaatggggttgttttttcttgtaaatttgtaaattttcttgtaaatttaagttccttgtagattctgtatattagccctttgtcagatggatagattgcaaaaattttctcccattctgtaggttgcctcttcactctgatgatagattcttttgctatgaagaagctctttagtttaattagatcccgtttgtcaattttgacttttgttgccattgcttttggtgttttagtcatgaagtctttgcccatgcctatgtcctgagtggtattgcctaggttttcttctagggtttttatggttttagggcttacatttaagtctttaatctagttgagttaatttttgtataaggtgtaaggaaggggtccagtttcagttttctgcgtatggctagccagttttcccaacaccatttattaaatagggaatcctttccccattgcttgtttttgtcagttttggcaaagatcagatggttgtagatatgtggcattatttctgaggcctctgttctgtcccattggtctatatatctgttttggtaccagtaccatgcagttttggttatggtagccttgtagtatagtttgaagtcaggtagcgtgatgcctccagctttgttctttttgcttaggaacgtgttggctatgcaacctcttttttggttccacatgatatttaaacttttttctaattctgtgatgagagtcaatggtagctctgtggggatagcattgaatctataaattactttggtcagtatggccattttcatgatactgattcttcctatccatgagcatggaatgtttttccatttgtttgtgtcctctcttatttccttgagcagtggtttgtagttctccttgaagagatccttcacatcccttgtaaactggattcctaggtattttgttctctttgtagcaattgtgaatgggagttcactcatgatttggctctttattattggtgtataggaatgcttgtgatttttgcacattgattttgtatcctgagactttgctgaagttgcttatcagcttaaggagattttgggctgagacgatgaggttttctaaatatacaatcatgtcatctgcaaaaagagacaatttgacctcctctcttcctatttgaataccatttttttttttctcttgcctgattgtcctagccagaacttccaatactatgttgaataggagtggtgagagagggcatccttgtcttgtgccagttttcaaagagaatgcttccagcttttgcccattcagtatgatattggctgtgggtttgttataaatagcttttattattttgagatacgttccatcaatacctagtttattgagggtttttagcaagaagggctgttgaattttttcgaaggccttttctgcatctattgagataatcatgtggtttttgtcattggttctgtttacgtgatggattacgtttattgatttgcatatgttgcaccagcctttcatcccagggatgaagctgacttgatcatagtcgataagctttttgatgtgctgctggattctgtttgccagtattttattgagaatgttggtatcaatgttcatcagggatattggtctgaaattttcttttcttgtgttgtctctgccagggtttggtatcaggttgatgttggccccacaaaatgagttagggaggagtccctctttttctgttgtttgggatagtttcagaacgaatggtaccagctcctctttgtacctccggtagaattcggctgtgaatccatctggtcctggactttttttggttgctaggctattaattgctgcctccatttctgaacttgttattggtctattcagggattcaacgtcttcctggtttagtcttgggagggtgtgtgtgtccaggaatttatccatttcttctagattttctagtttgtttgcatagaagtgtttatagtattctctgatggtggtttgtatttctgtgggatcagtggtgatatcccctttatcattttttattgtgtctatttgattcttctgtcttttcttattagtctggctaatggtctatctattttattgatcttttcaaaaaacctgaacctgctcctggattcattgattttttgaagggttttttgtgtcactatctccttcagttctgctctgattttagttatttcttgtcttctgctagcttttgaatttgtttgctcttgcttttccagtttttctaattgtgatgttagggtgttgattttagatctttcccactttctcctgtgggcatttagtgctataaatttccctctaaacactggtttagctgtgtcccagagattctggaatgctgtgtctttattctcattggtttcaaagaacttatttatttctgcctttatttcgttatttacccagtagtcactcaggagcaagttgttcagtttccatatagttgtgcagttttgagtgagtttcttaatcctgagttctaatttgattgcactgtggtctgagagaccgtttgttattatttctattcttttgcatttgctgaggagtgttttacttccaattatgtggtcaattttagaataagtgcgatgtggtgctgagaagaacgtgtattctgttgatttggggtggagagttctgtagatgtcttttaggtccacttggtccagagcttagttcaaatcctgaatatccttgttaattttctgtatcgttgatctgtgtaatattgacagtggggtgttaaagtctcccactattactgtgtgggagtctaagtctctttgtaggtttctaagaacttgctttatgaatctgggtgctcctgtattgggtgcatatatatttaggatagctagctcttcttgttgcattgatccctttaccattatgtaatgcccttctttgtctttttgatctttgttggattgaaaacacggttcttaaaccccagtatgcagaacaatcactagaatagctgttagtaaagattactgtgcccaatcttcagaaattcttctcattcaatacatcaatagtaaggcccaggaatggaaatatcctcattttcccatttaaatattgtggataaaattccttgtttagtcttatttgaaagttatttttctaactcctgaaatcacttaagtctgtgcttctcaaacctgggtttaagccccctctagggtttatgatatgtgccaggggatgggtgaagtcataaaatcggcatggcatatcttcctggagtgtcagttttatacaaagatttaaaagtaagagaaaattaacatttaaaatgtaacatggagctgggtgtggtggctcatgactgtaatcccagcactttcggaggctgaggtgagtggatcatgaggtcaggagttcgagaccagcctggccaatatggtgaaaccccgtctctactaaaaatacaaaaattagctgagcgtggtggtgcatggctgtaatcccagctatttgggaggctgaagcagaagaatcgcttgaacctgggaggcggaggttgcagtgagccgagatcccgccactgcactctggcctaggcaacagagcgagactccatctcaaaaaaaataataaaataaaatgtaacatgaaacagaatgcaaaattcacatgtatttttaaaataaagaaggaactacaaagaaatttttcggttaggtctataccatgtacttccaggtctctacatttcctttcctttactgtcatagggcacctttggtagaataccttaattaggacaacttacattttaacccctgaaaaatgctggtataaacagctattggtatagaaagtgcaaatacaaagtgcttttataaagatgatgatgtgaatgattaacagttctttaagcatgctcttttcttatttagaaaagtatttctatgttgcagatgaactgtctcattgtgttgagcctgagccatctcaggtgccaggtggcagttctagagaccgtcagcaaggtaagccccctcctctcccggctctaaaagctaagacatcttcacgttctggtccatatgccactgagataaagaagtcaactgatgattccatatttaaagttctagactggtttaaccgaagttcttattcagatgacaataagtcattcctccaacatccccgaggaatagagtccaaagaaaaaacagactcaaaatcacaggttgctgttgacttggtgacagatgacactactttaagagaaaatggctcaaagaccctatcacccagcaaaattgaattgaagcctgtgagatctgactcaccattccaagcagagggagatatgctggtttctgaaagttgccaagataataatgtgaatatcaaatccaaattcatgaatttgtcccaaaaaggcaccccaaaggaaggcccaggtatattgcaaccatttgaaagctatggcaccccaagtcaagggagtaaaaatatggactatagccaagattcaaaaagcccaggaaaagggaatggggcatctccttcaaatagtaactattcctacagtgttctcaaggaatctgatgcagaaaaccaagttccatgcaacactaataatattggcaacttgggtgaagaagaacccaagtttcatgctcatgaagaaaatagaggacactcagaagtgaattttgactcttcaacagttgtcaaagaaccaggtttgaaagataacatgaatgcagagagaaagagcaaagtaggaaatacctatatcctgaaagcctccttagagccagagaatattaagtcaacacctggggttgccaacaatggctctccttggaagaagcctgaggtccaattccagcaagaagctggtgaggttcccaagaaccaagtgcagagagagaaatacaaaagagtgagtgacagaatatccttttgggaaggagagaaagctggtgctaagataactcatgaaaaacccacatcttcatgtagccaggaacaaccttctgctaaagcatatcagcctgtgaagaagtcacagggtgtatcatccatggacagtttatctacagaccagagtgaatataatcaggccattcccaaacgagtggtcttagatgaggatgatcaagcatcccagctctccaattcttattcctcaaataaatctaaagagaccaagccacaaatagcaggtccatccagatactatctttcagctgagcaatcagataaagtgtctctgtttcagaataagaaaaatgagcctataaaaagatcacaagtggcagacagtttgccttctagaagaaacattactttaccagcactgcaacctccctcaaatgtcgggagtgaacgacatgctccattggagaaagacagacctctagttcgtgaatcaaatgccaactttaaagttatgtccctaaaagaaagaatggatgaacccaatgcagaacaggtctataatccctctcagtttgagaatttgagaaagttttgggacttagaagctaattcaaacagtaaggataatgacaagaatattaccaccacaagccaaaaaaattctgcaccttttaataggcagaaacacaaggaattcagcgacattaaattatcaggtaaaaatacccatgaagcagaggtgcttctaagcccaaaaaaagttatggcaagagaggaaatggagaaattaaattcaaagggcatactccaggtgctaccagatgaaatcacatttcctttgagtccacttagaaagtatacttatcagttgccaggaaatgagtcatcaaaggaaaatgtggaaaagaatacggaagggattgttactccagtgtttaaggaagaaaaggattactcagaacaagagattcaagaatccataataaaaaccaatgttttgtctaaagactgcaaagacacttttaatgacagcttgcagaaactgctttcagaaacctcaacaccagcaattcaaccctctggtggaaaagttcatggaaaacaagtgcttgaaccaagtgtttctgaaaataggacatggcctcaaaaaacagattttgctgatactgaggaagaagtcaaaggacctgagaagatcattaatgagcatgttgacaaaacagtagttcatccaaaggttaaacggaactctttgactgctagtctagacaaactcctgaaggaagcaactggaacttcaccctctcccttgcaagccaagttggcgcctgttatcactggaaccaactctaagctggaagaggggagattttttggaaaagggatagaacagagtcacaatacttcagctgataagagagaaatactagctccttttccagtgagagatgaaacttttggaaatacagctctcctcaagaaagctgaaagtggtgagtgccagctaagcacacagaatttgattcagatggctgcagaagattctcatccattggatccaacttcccagctttccagaaagggttcttttggggatgtggccagccctccccaagatatgctttttccccaggatgctcatcttgttccccaggctagggtacacccttctcaaacggaaatttcggagactgtagagaaagtcattcttccacccagacctgtattgaatgatgtaagtgctgcattacagaagctgtgtggagaagtatggttaagttatccagctggaagggaagtaggtcctggagaagtgaacccagaatttcctgaagcagtacagccagtatgtagccccctaaatcctccaggagtgatatcaccatgggctacgatggacaccatagttccagacaggaaggatttttattcctccaatgtagttcctgataaaactcatgaagttggatcttatttagctgcccaaatgtctccatcagaccagacgcttagctcatttgcttccattgttgctcaatatggcaaaggcctccctcaggaagtggaagaaattgtgagggaaacaattgttcaacccaaatcagagttcctcgaattcagtgctggcttagaaaaactactgaaggaagaaactgaaaccttcccctcaaaatatgaaagtgatacagggaatctttctccatcaaagttaataggtagtacagaggagcccaggcgagccacttctgaatgccatcctgaggaattaaaagaaacagtagaaaaggccgaggctccgttaataactgagagtgcttttgatgctggttttgagaaacttcttaaagaaataactgaagctcctccttatcagccccaggtgtcagtgagagaagaaactcacgagaaggagtcctcacagtcagagcagaccaggttcttggggacagtgccccatttttacagggcagcctcacagacctctgaaatgaaggataaaagtaatggtttggaatctcaagtcaaccaatgtgataaaatgttgggaggagacgcacttgtgactgatttattggtagatttttgtggttccagaagtggagttgagatccctagaaccccacaactttatgtggctcatgaaatagggaccattaaaactgtaacccccccagaggacagggacagtgaaagtggggttgcagggggacaagggactcttcaggaacctggctttggagaggcttctgaagcaattagtgtgtccagaaataggcaacccattcctctcctgatgaacaaagaaaactctacaaaaacaagtaaagttgaattgactctagcatcgccatatatgaaacaagagaaagaggaagaaaaagaaggtttctctgagtctgatttttcagatggaaacaccagttctaatgcagagagctggagaaatccttccagtgagcatttaaaattttttaactcacagtgagtctgctttatggaatgctgatgtaaaggatgattttttttaattgggattaatttgatattcttaaatgatgttaaattcttcttaccacttctgtgttcctgagactttcttaattaaaaaaattatttatattttttaatcaaatgcattacataattcttaaatgatgttaaattcttcttaccacttctgtgttcctgagactttcttaattaaaaaaattatttatattttttaatcaaatgcattacgtaaaacagctttcctataaggctgtttcagagtctgagttgacttctctttaatctacctatagaacttttaggtttcaaaaaatactttttaaatgactttttgggtttggaaagtacctttaatacatttaagctagttttcctcctggaaatatttagaatttcttccttaattggcaacctttatagaagtctggtaagatttgtcgcaaagatgtgccacagatggacacaaatttcccattcgggagcaatatcttaccacagtggtggctaaatgctagggacaaaatacaaggccggaactttccttccctcagataccttgtgctgtggtgttttgttgccactttctccctctcattttcaattatatgcacaatcttccctttctagagtatgactttggccagatgactcacctgatgccacctaagggcattgcctggccaggtacatttctctggctccagccttggctaagttgatgacctgagtcgatctccacattcatctacatgaacgtgggggcgttggttttggcggccaggctgtaaaatgtagggcttgtctcagtttgctatttaatcaacatgtggacattttagcagagaaaccccagagcaaataggaatgagaagctacctgattaaaatgatgaaatgatagagaatgttttttggctgggacattttaaccaaagttgcacaactgatgctgattgccttccttgtagtttagtagaatttgtcatttgtttagctccttttcgttccagtgaaaatagataagctttactgagtggcttactttgaggtgtggactcctttgtaagtagctatagggtctcttcttgaacactgaccaaagaatccacctttaatcctattcagttaagttgaagcccctctaaaaaattttgttgttaataaaaaaaagaaagaaattgaaatatcaatctctaaaaccatacatatttatttataaatctctaattaaatctctaaatttatttaatctctaaagtaaataaatttaattaattaataattaattaatgtaatggcaagaataaagccagcatgttaaacttgttgaggtaggctcttactaaactgcccatgagttgctagtgtaaactgacccacaggagaaggagcgcttgcaaatttgcaattatgttagagactatcatctaatgtgtatcccagcataactgactgaatagtaaaaagcctatctaaaaaggcagcgttaaataatcacctaggctgggcacggtggctcacgcctgtaatcccagcactttgggaggccaaggcgggcagatcatgaggtgaggatatcgagaccatcctggctaacatggtgaaaccccatctctactaaaaaatacaataaagtagccgggcgtggtggtggctgtagtcccagctactcgggaggctgaggcagcagaatggtgtgaaccctgaggcggagcttgcagtgagtcgagatcacgccactgcactccagcctgggctacagagcaagacttcatctcaaaaaaaaaaaaaaaaaaaaaaaaaatcacctaaacagagcccagagaagacattttagaataacaagccaattaagaagtatcaaatggtatagtcatgattttaatttaggtttatatactctaacctaaattattattttaaagcaaactgcagtgggggtggggtgaaaaatgaagagaaacctactataagggtactgtaattttggggagcaagctaacacatttgacttgcggctgagctcttaactaagcaatacctcagtatgctcctttgggaaaaattaaaggttcagtagtcaaatacttttggaaatgctgggccattatgcacagagaaggtccgcagtaaggaacattttaaatttgaacagagaacatccaaatctaattcatcttagaatccatttgctatggaatgtactaggcagaactggaatgtatttcaggaaattattgtctagagaagtggttcttaaattaattgattccttaatcgaatcactcattgattcagcaaatattttgaagtgtttatttccagccactgttctaggcactgagaatacagcagtaataaatgtcagtacttaagcttattcatgatgcagccattccttttataaaataacggcattagtaaatgatagaggcctccctcccgcaactttaaaatgccttactaaaataaaaatttgactatcccatgttatttcccaacatttcattggaaattatactagatcatgaaacccagaaagtctacaacctttgatctggagaatgcactcatatgtgtacccaattatacacagatgttaaacatctgaatcctgccttccacggttttgaattaattttattaatgctcctagaagtatttcatggctgtcttcaaaagctagaatgttaaatgggaagagtcaatgtctggcataggacaaatcatatgtctaaaataggagtaaacaactaagagatcacatttctattaatgtggtaatcttgtttttgtagggtttacgtttgcaaatatttcttgaccaggaaaattatgtttaagagcatattaatagtggagaaattttattttcttctgtgaaataagtgcttcttaaagtagaaactcatagcataatgtctcttttcagcctaccatttctatgtccatatgttagaggattttttttttttttggtattgtgcagtgttcatcgattttgttttataacaggttcagaagaagaacccagtcctgttttgaaaactttggaaaggagtgccgctaggaaaatgccttccaaaagtctagaagacatttcatcagattcatcaagtgagaataaagttcgcctcactgttcatgccccatctaagcttaaaaatgcctatgtgctctcctgtagcctcactgcgtgctgttgtgcactgcaccctctaatgggggcagttaacagatgaaaataacctctccaaagtgcgctgaagaggctcaacctaaagtggctggaactttgcttataaaataatatattacatttggttactaaaacactaggtttcctttaattgaagaatcccagtttgagtgtttctcaagtacagtgagtttcaaaggatagtggtagctagtagtattagtgaaaatagtcataactagcatttattgaatattatttgccaaaacgtgcctaacaattttacatgtattatctcatttaaccagcacaagcaaccctatgagaggtgaattattgttatccaaatttaaagatgaggaaaatgaagctcagaaatgtgaaatgacctttttagtattacacggaagatctgggactcaaaattaacaggctattatcaagaacatttatgaagggaccacattatatatgacagcgttggatgtccagtgaattttgcatgatacggagttgaattagtccctggcttcaaggactttcctttctcttttatcccttctattctgttcacacttttcttctagatactggaactataagcccaaaactacttaacatgaaagactttaggtacacgattccccactggcagctgctttaatggtgaaggatttcttgagtactagcagaaaacataatatataaagagagttgtgtgctagacaaatggactaagaaaccatgatttcttggggttttgttcttgctattttcaagctaaaatgcacccctgggattgcagatggtcataagaaaaattatcaagtgaaaagttaaccactgccaaactcatatgattgaaaattggccattgttatgtttagaatattttttgtgcatttgcaattaagaataaaaagtcagaatttaaaaatgaaaaaaagaaaagaaaaagccacttcaccaaacatttcctaaaattcacagattcccaggggtttgaagacagtattcccaatttggaatgtagtcctgactatcccaaggatcttggaatctcagggttagaagggatcttaaaaatcacccattttaacctcccctcaatgcaggaattctctctaaagcctcctcaacaggcggccaacccccatatccgcctgaatgcttccagagaaggcgagtcgaatcctttgttggacagccctgattgtttttcctgatgttggtgatgggccttgagaaaaagaaaaaaagaaaaaaaaaatctcagaacaattggcccatttagcaaacctcttgcctgtgaaacatggggctatttccatggtgcagctttaaagtactcaggaatgtatagggttaaaaaaaaatcaccatcagctgacgggtattcctgcacgctcccttccaaatactgatacccactctcacactagcctgccaagattccacttagcagctggtccccagttacatctcttcagttgacttcccaagcaagcctcccagaggcatatgtgaatgatgatgcacacacacaaatatttgttaatgaccatgggtttgggaaggtgttagtcatggctagcatcataccctttacagaagaatagagaggctgttgcagccccgtgctttctcctgctgctggccgattgcttgctctgaactaaccctctaacccttgggagtctgtgtgcagcagtgatgtgagctgcatccgggctgaaatgggagctcccgctatggcactggctcaaggagctaatctaaagagaaagtattttggggaagacatcttggttgcacccctcattgcatcttgactaattgcttccaactccgggggcttccagggacaatctcattgttcttttctctccaagggtcagccatgttaaccatttgttaatttcttctgaacagatcaagcaaaagtagataatcagccagaagaattagtgcgtagtgctgaagatggtaaatatctttatgtatttgcgtgtctgtctttgtattaacttctggggtgatttgggcagtctccgggacgcagctgttgggtaaacagaagaacgtcatttgccactatgtggtgaatagtgcctaagttactataaaacagttctgatttggtacatttaatatagtttgtattcttaaggcttcttctggtgatactgtcatgaggatctcatcagagacccttgtgaagcaagggtttctataaatagaaaattgtatttctttggatgtgagctgatttttgctactctgacttgcagaactctttgtaaaggcaggaagagtggagtgaattcctgggttaagttattcttctgtttgattctcaagtctcagcatttagatctctctgggcacaactggtaaaatcttaaattcaaaggaaagagtcccagaacaagggtgggaaatcgtgcctctgcttatataaataactaaatatagacagagggtgaagttgattctgaatataatggagccagaagatcttgaagcttgtcagtggatcaggtattacttggctctgttataagatgaatagtatagtggtgccttggttgagggagagacagaaatgagtctgatttttatattgcagaatttatgcaaatgtataatttgtatttgcatgctggattttatttacttgttgttaaatttgccttcactataatcataaaaatgtgtactcactgagctttcccatataaatgcagcaacagagctccttaaaggtcattctttacttttatgtaatcgttctgtctttcttattttatgtttacaacaacctcactgaagttgatggggcagggatttttatcttcattttgctgataagaaaaactcagagaaattaggtgacttttctaagatcctatagttagtcagtcactgggagggcaggaaatagaatctcagcttcattactcctagtccagtgctccttcccattttccatactgtggtctagtgaattacaggaaggatgctccgtatctcttttgtttgatcccagatttttagttgaacaggagaccttaaagaggctaatgaagaagagtcacagtgaggaatggatgaaagcaagatgaaaacctgtcagatgtattctgctgtctcagttgtgaaactgacatttgagctttactttcatgtctctttaatccttctgttaaaatggtatttattctcaatgttgccctcctgagtagatgagaaaccagatcagaagccagttacaaatgaatgcgtaccaagaagtgagtagcaggatctttctcacaaatgactaaacattccactttacatattaaatatactgaaataactaaccccattaataacacagtatttattattggcactaaactcctgcagcttgcaaagctatttcattacgataagggttttattgaaaacattttactattgtctgtgttgaaagaatgatttgtggttccactgagggagagttgtatattaaatatatatatatatgttattgctgatattattgtgcttttgtcagtctctatgctgtttgaatctctgcttaaaagcaagttggcaccttctgatttcatttggtttttatgttgcagtatgattttgagtattggatctcttgtggcctctgtacgaaactgtagatgtgaattcatttataacttatttggacctatgaaagaactgttagagtatgtgcttctctccatatccataaaagcaaatcttattatgcccagggtttaaactctgagtttcaaaactgccttgaatggtaaatgttctaagtataaaccaagtgaacaagtgaatctaagaagtaaatgtatacctgtggtgactaatgcccatctactaattaatgtctatcatcaagcaaagataatgtttgttcgatcttttctgttcaatcttaagattactctacttagctgtgactactatcttaaggacaaataacacatttaaaaagtactcagatggcctagtaaagcatgcagctctgtgtgtgtgtgtgtgtgtgtgtgtgtgtgtgtgtgtatgattttttagcttcttggtttcactctgtttcataaaccctaggcactgggggtatgaagataatgatacacatgtctaccctcagggccacaatattttaaataataatttcccaacagtctttggatatgctaatagggcttaatgaggaaagcagctaaacggaggagccattagatagaaaaccaatgtgctgatggctaaaagtcagtgacatgtagtgggaaacctgaaactttgcttatgaggtcctcctgccagcagtgaaggtgctgaactttggcacatgacttgacaaattcttaagaactgcctaggaaagaagagagtccaggcttcagctcttgtgagtatgtgctctctgtctgactactgcagatgaaacaagccttctgcccctaaggggtgttaggtaaaggggcttttccagttacttttgaactaggacatatttaattttgagcatcttataatatcttgctatgttttgttcaaaatttagtctgtggagtaaaagcaaaacacacatagacatatatgcctaaatatctgtatctttattcatgatctcctaattggcttagtttattggtcaaggcacatagactactcctgtgctgaactctgggtaaattaatttgtcccttttttgtgatattttccaaaatgactgttagtgccttttcactggtaaagagtatattcttaccacaaaaatcaaatacatgatccaaacacaaatgatgaaagcccataaatctaaaattgattacatttgagtagtgggtataattgaatttgaccttcatagcatcatccaacaatatactttgaaaatagtagggtgcaatgttataacaaaaaagtttttgcattctcattggaccatattgtgggacctaatcttacactgctaccagtataactctccctaatacacacacattgttgtttcatgggaagtgattaaagtaggtgtcattttagtgagacaccataaatgcattctgatgtgcatttacctatgggagcctaaggataggtgaaaattgttatgtgagcaaggatatctttagtacgtgtagctaaatttttagtttttccttcattagatttctttaaagatgaatttaatgtttaagcatgaatttgagtcttttgtgttatgtatataaatataatttgatttttacctattttcttaatatctcttataatgataaagtcaatgtatctgtttcattcacaatataatttaagattctttatcatatgatatttattagattagaaaatacttatatagagcttactctgtgctaggcactaagtgccttggaaaatattaacttattcattataagagctgtgattcaccataagaaaagcttagatgttgtgattcttagaaaaagaagaaaatagttttctaactaggtgtatgcaaattaggattataatttatcctcttcttgtaccttctacacatatactttctatatcagaaagaagacatatgctacattttcttattaaattcttagagtaccctaactttaaccattctaactttgccttgggatattgaaaattctgaatcagtgaggtatctaaataatttatattttcaaaaaataatgtttattttataattctgagtgtaaaacactatcagaaaagtaatcctcatgctcactaaacaaacctactctaagacactcaacaaccagaacagttttattattgagttgtgtacaaaaatcttgactgtccagatgaaatagtttttcagcctgcagtgtgttagtgatatatctcaaggagatgaaccaataaagtacagactttgtggtctgaagctctgttgtgaaaaaataagctaaaccaattcacactgacagtataatttgattcaagtgcagctccagttcaataaaaactaatgtttttaaaattaactttgttttgtatttggttcaactccttgctagttctctctctatataatttataaaaactgcatgttgctaatctcatgatcctgtgcatgtggactactctgcctttaacttttttacaaaaacatgtttgttcatagattaaataaaagtatgttttcaacttaatgtctaatgttttctgacaattgtaagaataattttgaaatggaaatgctgctgtttagtttccacagtgcctacacaacctgataatccattttctcaccctgacaaactcaaaaggatgagcaagtctgttccagcatttctccaagatgaggcaagtttgtcttttgtaccttcagaaaaatggagacagagggttggaattgctatgccaaggttggtgtgtttgtattccactgtggcagagatcaaagaggtcagaaggactggcccttgcctttcaagtcaatagaagtagtgttgttcatcctggaacagggaaaggcacatctcatttgactcaaacagtaactccttttggttagtgaagtcaaattgcatagatttgggaatgtgacttttgtttcaaagttagtacaaaataagaaatccaggaaggtatatgaactgattattcctctgtagtttggagtagacttgatttgtgaaaacttaatttaggcagcatgactagtttgaaagtgtttgttaataaagtaacaatgacacatcaagctttaaggagtatttactgggtgccaggcactttacatatatcatttaatccttcaacaaccctaggaggcaggcaccatcattatccccacacattacaggtgaggaaactgagactaagggagattaacctcactcagctagaagggggttcaaccaggactggagcacagatccaagttgcctgctgttaatgactatactatatactgtacggtcttaagaaagcacatgactataatttactattcattgagtacctaatatgtgccaggtacctaatactcattctgtcatctcactcttactaactatatgtggtaaggactattttcttcattttacaaatgaagaaagagccgcagagaggttaaataactttccccaaatccaatagctactgaagagtagatctaggactttaactcaggtcctttgacttaattaagattccatgttcttgcagtcaggtagttaggagcctaagctttggagccagatatccctagtcctggttatgatactaattttctgtgtgatcatggacacattcagtaccttctctgagtctggtttccttgcacctaccacgtgaggttgtggggtatcggtaggataatgcagggaaaacacatagcacagtgcttggcatataatgagtacctggtaaatgttagctgctactgtttgtagttttggtctgatttctaacggtgaaataaaaggcttcattatcaagaattctcttagtagatggaatgttgaggaaagctctgggcaacacataaattatattctgtcactggcctgggcatccttttgtccattcttgggcctttgatgaactgtatctgcaaatattcagcccttgcctatggttaagagcacatgttacagtttcctttggaaagaatcactcattctttggaagtaattcattagctagaagccaacagtaggcatgccatgcagttcaaccatataataatatgaggccgggcatggtagcttatgcctgtaatcctggcactttgggaaactgagacgggcagatcccttgaggcccaggagtttgagaccagcctggccaacatagcaaaaccctgtctctactaaaaattcaaaaaattagccgggcatggtggctcatgtctataatcccagctacttgagagggtaaggcaggggaattgcttgaacccgggaggcagaggctgtagtgagccgagattgtgccactgcactccagcctaggcgatagagtgagactctaattgaaaaaaaaagtgtgtgtgtgtgtgtgtgtgtgtgtgtgtatatgtattttcgaggcaaattatataagttcctggtttttaatttttctccttccttcagttttaacctgctgtctcatagctccacacagaagagagttcaaatcatctgggtttgtgtatcagagatgccagaattaagctctatcattttgcatggggtatagggttgaactaggtattaaagaaagtggaaatgcaatcaggccttgctcatctgttccctttgagacttatcatcagtcacatttgttgagtgccagttacatgtaaaacaccattccagatcaacaaggcagagtcctatccttccaataattcactaatgatctgatatactaggtagaatgcagtaggcgctaaaatagagggaaatgactatcagcatgtggggagagagtgtgacaacagagacatttaaaagatatgaatttttttaatccttgagaaaggattcttatccacgtaaagcattaattttgctttcctttaactcctttattaatctgcattacaattggcatccattatattgatgcataattgcatggtcctggaatatgctggcatgaactaactactccataaaggtgtcccttaacccctggtgccactgaactgttccataagctctctaaccctaaaaggagctcactctgaatcataaatttttaaagctactatttaataaactttagattcaaatataacaaaatttgttactgtcacttttctttcttgtcccaggtaaatacttcctcggacatatttaaaataaatacctgtattttacttctttttaaaaaatgtgttaaaatctaatgtgggtagaatgtataatttaatatacttaactctaggaacaaaaagataagcataataacacaggaatatgtaaggggaagtttaaaaattttaaacattaaaaaatatatatatatggccttgagttgaaacagatgagactagcatttcttttttcctagtttaatagtgtgtcaagtaaaagatttgatttttagagaagttaggggctgtgctaataagaggaattaaacatgatgttttggttttaacagtaaatctttttattatctgggtaaagttaatttctcatatataccaatagagttccccaggcaaataaatatataatattaaaagactggcaagaaagctcacaatagtgctgtcttctgcagcactttgggaaagactactttgtaggtgaaaagaaatcacttcgttattttggtagctaagcactgccttcctccttaggtgaggtcaaggcagaccacccactccatcctgaatcccataccctggcaattagcactagcatcctttgaccttgcgtaaatgtcagtggaataccaaaatctcatctttgcctaaacagagattctgatcttgactcattctgaatttaaatattgtgcatattatatgctgttttgtagagtgatgacagagaaacagatacagcatcagaaagcagttaccagctcagcagacacaagaagagcccgagctctttaaccaatcttagcagctcctctggcatgacgtccttgtcttctgtatgtaaacaaaggctccatattaatatctctccgcgtctctgaaccttgctctgacatgctcatgctcattgtaaaacagcctcctcctgtatttctcagggcacaaacagtttctctaatccataattagcttctggctagctacatctatctttttttttttagactaacggggttcatatccatcataaacaaatctttgtggggttttttgttgttgttgatgtaagtacttcacaaataaacttaaattgccaagaagatgaaccactaaatttttctgtgcaacaaatggggtaactatgataaaatctgcttgtatcagatatgcttttatatatgatttgcaggcatagaattgaacctctcttttagtaatcctgagcaatcaatatactggttgacatgaaagaatatgagaggtaattccttgccttttagaaggcatctgagcagcattttaaaaggaaatatccttaagtgtagttactcagatttgatttaagggaatctaactaatttgactttacatagaacttcttgcataaggtgaagttgtatgtgcatgtagtatgtatgtaaaaatatatgtaaatatatccacatacacttatctgagtatcagatgtgcatacacatacatatattcacccaagtatgctgaagaaatgataaaactgtgcttaaattcttgctagccttgtgtttctgaaaccttttttaaaaacctatttaaattgagtttctgctgataaaaatctaacatctgcctttgggaaggttttaaactcccttcatcaatcatccattttctacccttcctgacctctaaaagcgcatggctcagtaagcatttttctagattcagtggatgggtaacatggtaaaattcctttttagtgccttggaaattcgatacagcagtgtgtcactatgattagagtgtctgggttttctcacatcttctttcttttggattttaaatattaagcatgccagaaaatggatgcctttgaatgccacctagcataaaatcaccctgctttgaaatgagccagcatctaaataacattgcatttcacttttcatctatgtcttatagggaaaattatttaaaaacattagtcggctgggcgcggtggctcatgcctgtaattccagcactttgggaggccgaggtgggcagattacttgaggtcaggagtttgagaccagcctggctaacctggtgaaaccccatctctactaaaaatataaaaattagctgggcatggtggcgtgcgcctgtaatcccagctgcttgggaagctgagtcaggagaatcgcctgaacctgggaggtggaggttgcagtgagccgagatcaagccactgcactccatcctgggcaacagagtgagactctgtctcaaaaacaaaatgaaacaaaaaactctagtcatgtatatcatgtcaggttgtctttatagatatgtctttatgctatattgaattaactgcttttataagcaagctaaagaaataatgccagcagggattatatccatgatccttgtgctaggtttaagaatgagatagagacaaacactatgtatttctgatgctttcaggtgagtggcagtgtgatgagtgtttatagtggagactttggcaatctggaagttaaaggaaatattcagtttgcaattgaatatgtggagtcactgaaggagttgcatgtttttgtggcccagtgtaaggacttagcagcagcggatgtaaaaaaacagcgttcagacccgtaagtacattttagagtcacctaccttctcttagttctccaactgtcaatcttacaggaattggaaggaaataaagtaatcaagaggagggagggtatgtgttaagaggaatgtttgaaaagttggggggaaatgctgttttattctataaattcatatgtcaaacattaaattataaaaatcacagagaaaggccgggcacggtggctcacgcctgtaatcccagcactttgggaggccgaggcgggcggatcacaaggtcaggagatcgagaccatcctggctaacatggtgaaaccccatctctactaaaaatacaaaaaattagctgggcgtggtggcgggcgcctgtagtcccagctactcgggaggctgaggcaggagaatggcgaggaggcggagcttgcagtgagctgagatcgggccactgcactccagcctgggcgacagagtgagactccatctcaaaaaaaaaaaaaaaaaaaaaaaaaatcacagagaagcacaaaatgtttcaacttggaaagaacctttggggtcatcttgttcagttccttcattttacagataagaacgcaaggaccagagaagacaagtaacccatatatgtgaattcagatagaagcaaaatgaggaatgaggacctgaacccatctctttccaccacactctcaaactttttacaaaattagggatacatgggacacacttcataaagctcagtggtataaaaatagttaagactctagaatgagagaattttcatatttaaattatatcttacagaactttaggggaaattactaaaattattgttttaaatcacaggtttaattgcacttcagttttttttctttttttgcaaacgctgaatggtattccctacttatccctatacagaagtctgattcttaattattttgctgagacaagtgcaatccttttttcttttattcttattataaaaacaactgagctcaacatcctttatttttttaacattgaagataacttgactaggtatttactaagattaatttatttcaaaagacggtaacaaaaacttaaaaatactgcaagcaccaaagcgttttctcagaggggaacaaactaggggaacaaacagatttaagctctatgctgaaagtgtgttttctttttttcttttttttttttgaggtggagtttcactgttgttgcccaggctggcacgatctcagctcacagcaaccttcgcctcccgggttcaagcgattctcctgcctcagcctcctgactagctggaattacaggcatgcatcaccacacccagctaactttgtagctctgtgtgtgtgtgtgtgtgtgtgtgtggtttttttttttttttttttgagaccagcctggctcatggggtttttccatgttggtcaggctggtcttgaactcccgacctcaggtgatctgctcaccttggcctcccagagtgctgggattacaggtgtgagccaccgtgcctggcctggaagtgtgttttctgcccctttccacccctgcatattagttaaggccaaaggaaaaaaggaatgcaggaaatgcccgttaaaaatcttcaaaacaatataaaatgatcaattccactaaaaccctttacacatttaagtataaaggtattggtaggaaaatttgttattcactgcttttctcagtgtcatgaaataattatttctgctgtcagttttcaatgtatttaaaaaactagaggtggaaacataacttttattttctttgactttgtctgttcaattctccttttcagatatgtaaaggcctatttgctaccagacaaaggcaaaatgggcaagaagaaaacactcgtagtgaagaaaaccttgaatcctgtgtataacgaaatactgcgggtatctatgaactctctctataggaaaatcctagatggtgacctgtttaccatgtcttctttgggtagtagctctacaggataaagtcagtcaccaagagaggagaaggaagggaatacaaatgttctgagactgttttgtttgagacaaaacaacctgaatgttgtatacgttatttcattcactccccatatataaactgccaggctggtattggtatctgcatctcacagatgaggcaaatgaaacttggagaaatgaagtaacttatttaaaaacacacagcttggctgggtgaggtggttcacgcctgtaatcccagcaactttgggaggccgaggtgggtggatcccttgaggtcaggagttcaagaccagtctggccaacatggtgaaaccctgtctgtactaaaaatacaaaaatgagccagcatggtggcaggcacctgtaatcccagctacttgggaagctgaggcaggagaatgacttgaaccagggaggcggaggttgcagtgagccaagatcacaccactgcactccagcatgggtgacgagtgaaactctgtctcaaaaaacaaaacaacaaaacaaaacaaaaaacaaaaaaaacccacagctgataaagttgagcattgcaaccagaatgatcttataaaagcacaattctgattatgctatttttctgctttctataacccttagggtcaaagccatctttcttaacatgcacaccagtcccttcacaacctgaactccagcctcaactttcctctctcatagtctttgttccagtcaccctgaattcttttcattattttaaggaagtacattttctcacaattctgtgaatttctgttccttcaggctggaatattcttccacacattatttccctaactgcctcctgtactgtcttaaatacctcctcttatgaggggctgtgcttaacccctaagttctcctgctgtctgctgcctcagtaatcttgctttatagcaggatatgttaacagcagtttaactagtggttttattgtcttccttgccactaaattgtaagttccatgagggtagggaccaacttggtgttgtttgtaaactgtgtgtctttgggcacctcagatctgccaagtcgggttaatgctagttttcagatttgcaaaaggaagataataatagtacttacctacctaccttagcagtggagaacagtaaattagttaatttgtgtgaaagatcaacacacattaagcatttaataaatcttgatccttaatctgggataggtattcaaaatatgtttactggaaagataaatggacagatgaatagaaagtatacttggctcatattctttttcttcccaaaactacatcatgctgccttagtcatgactaacagatcatttaaaactaaaaataagtgttgttcattccctctttctgaaaactctgtccaagtatttgatcatcctctggaaaaataagcagttaaatcaacactcagtcatccatggtctgaattaaccacctgtagaatttttgtaccaagtttttaattacagtttgactatgatataccctagtaccctggctatttctgggtcagctacttcaaccctatactcaggaaaagccagataatttaaatgttaagctcagagaaaggcagacttactacaaccacagtggacattcaagtagtacatcatgaagccaaatggaaattatttttagattagaagtactattgtcctttccatgattatatgtaattaaagattgactacatttgagatgaaaaactgttaggatgccagaccttttctacttggccatatgcagcaggaaaagacaagtttatttatttatttattttaaatacctcatctgtgtgggatgttgatagtgggggaggtgtgtgtatgtggcagcatacatggcatatgggaactctgttctttctgctcagttttgctgtaaaccgaaaactgctctaaaaagactattttaaaaaagaccttgttcttaagtagaaaacagagaattcggttacatttgatttgtattttagactcaattttgtattacatctagtctaaaaatattcagcgaaaattgaaaaactggcttttattgttagagagctattaccaactatgatatctgagccttggtttgcttttccagagtggggaagcaaatcagcttttatgaaagatggattttagctctttgaaacaagatgcttagaataagatgactttgcaatatttttgggactcgaaacctaacagataagaaaatttgctatatacagatgaatttctcttcatctctgtgttataactttggcatcaagtaatgtttttcatcatttaattttcttctttgaacttcagtataaaattgaaaaacaaatcttaaagacacagaaattgaacctgtccatttggcatcgggatacatttaagcgcaatagtttcctaggggaggtggaacttgatttggaaacatgggactgggataacaaacagaataaacaattgagatggtaccctctgaagcggaaggtgagtccggaattttttgtttgtttatttggttggttgatgtggtacctagtgtataggaaaaagcttaattgcatttaattcagagtacagatctgtagtttgggagaattttaaactagaggaaaaaaaagaaaggtaaaaaaggttattgggaacatgtttaaatcatttaacacaaatgtttcagagacttcaggaaggtcttttaaataattcagtcctttgaaatttgatactgacttttagcctaatatttggctgaattttgataaatgttccatgtgttacttgagaccaaagtgtattcaatgattaaaggatgtaatgttctatatttatcaattaagtcaaaactagttcctgaaatcttttatatcctcatgggttttatgtctgtgtgtactgtgaattactaggagagttacaattgtgaatttgtctttttctccttttagttttattatttttgattcactatatttgagattgtcttattacatatacatacaactgtaattgttatattttcttgatgaattaaccattttatcattttgaaattccctttttatctctagtaatgcttattgccttaaaatctactttgcctgtatttatatagctctattagcttccttttgattagaagtttgtttctatcttttgattttcagccttttaaaattcttatagttcagatatatttttataagcaatagttttgatgtttttccagtcttaaaatatttgtctcttaattggattatctagtccatttgcacttaatataaatattgatgtatttgggtccaaatctagtatcttactatttgtcctgttttcttattttcgtaattgcctcctttgggattattattccattttttctctctcttaatatgtcagtcatagtttattttcatttttctttattagttcctgtagagattataatatgcacccttgaattcaaactgtaatataaattagaacttttgccactttcagaacagtggaaggaaccaagaacattttaactccatttacccattctctcatcctttgtgctatttttggtcatgttttaattgtatatatttttaagtcccataagacattaccgttattgttttatacggtctattaatttagatttaaccacatatttgcctttcccttgctctttatcctttcctggatttatccgtggagttgtttcttctgttcaagactctcctttagttttactcttagtgaatatctcctggcaacagattatttcagattttcttggtatcataacatctttttcaatcttggagggatatttttgctctgttgctaggttgacaattatttctttcagtgttttgaagatgtcatttcatagtatttggtcatttctgttgtgaagtcagctgttagtcttatttttgctcctttgaaggttatgtgttcttttccagattttaggatacttttctttgtctttgatttttagcaattgtactataatgagcctaggtgtagttttctttaatttatcctgaggtttggggttcagtgagctgcttgaatctatctatgttttggtatctttcatcactttgaaaatttctcagcaactatttcttcaaatattacttttgccccactattttctcctctccttctggaaactccaattacaagtatgttatacctttttattctgtccaacatgtctcttatggtcttttctgtatactttttttcttatatttcagtccatgttttgctaaccttttcacaattcaacaattttatctgctatgtctattctgttgttaaaaccatctacaatttaagccaatctataatataaagcttatattttcgaaagcatattttcttttgactattttgattccatttctctcctaaaattctctatcttaacattgtctttaaaaatatagcatgcaaagttatttaatgtatgtacttaaaaattccagtatcttaaacatttgtgagtcctgcttatctattttttaaaatcttagtttggacacttagttctttgtcttggtatgcccgttcattttttgatcatatgtggggtattgcatatgagaacgttctaggaataattggggaggatttacttttgcttctgatacagcaggcacagaccaccttcatttaatctgggaataaactgactttgaagcacaagcccagttttcatgtgatctggtctagtttttgtttgcttatattcctaggctaaggcccttcagaggttccaactgaaagccatgggaaatagttctcaaaatcagcatgcatctgattcacctgaaggacttattaaatcacagattctggggctgggtgcggtggctctcagctttaatcccagcactttgggaggctgaggtgtggattgcttgagtccaggagttggatggagacaagcctgaggaacgtggcaaaaccctgcctttgcaaagaaattaaccaggcttggtggcatgcacctatagccccagctactcaagaggctgaaatgggaggatcacttgaacccaggaggtggtggttgcaatgaactgagatcacgccattgcactccagtgtgggcaacaaagcgagaccctgtctcaaaaaaaaaaaaaaaatagacccactagattctgagccctattcccaaggtttacgggcccaagaatatacatttttaacaggttccctgtcaatgcagctgacctagaaacggtactttgaaaaccactggtctagagtgtttttccagtgccattccttcttgacaggccgtgggctccaagttttgtctccccagcctcatgaaactgctaaaagtcctgcttaccttttcagtctcattctgttaggctttttatgtgctcagtttggcactacttaaatgtctcaaagtgaaaagcagagaagaatgtcagactctaagatcttgttcatttgagtcctgtctgtgttaataattctttagcactttcaaactgatatttaaaatcccaccttttaaattgttattagtttaggggttgatgtgatccaagctagtccatcatagtaggaagtgataaatataaataactaatacaaaccataacttagtgtctacacaacagtggaactgttttagttccactaaagaaatggttctcaaatgttatatcaaaatcacttgaagcacttatttctagccctacccaagacctgaactcctcagaagatatcaaaagcatctcatttttaactggctaccattacgtttctgatacatacccatattttgaaaataaagctctaaagagccagaatttgaaagtaaaaaactatcttatgcaggtttcttatacaggtttagcatccctaattcaaaaatttcaaatccataatgctccaaaatctgaaactttttgagtgccgatatgatgccgtaagtggaaaattccacacctgcttcatgtgatgggttgcataaagttattaaaaatgttatataaaattaccttcaggctatgtgtagaagatgtatatgaaacataaatgaattttgtgtttagacttgggtcccatccctaagatatctcattacgtatatgcaaatattacgaatttcaaaaaacaaatccgaaatctgaaacttttctgatcccaagcatttcagataaggaatattcaacgtgtacttgaaaataacagatagaagtttaaaaaattattgttcagtctttgttatacttacagacttctatgcatttggcctaaaataatcagattagtgcagctttgaaaatgtaagatatggcctttccccccttactttcacacactatctcatactccttcaaataaagggaatacaaataaattgttttatatgctggctgaatagctaacaaaatatttgtgttttgatcaaaattaaagcattcaaagaaacctctcccatctccaagaaagccattctggtttcttcaccatctttgagactaaaggccttgaaatattttctgggtatcctgcaagatttttcaagatatacaacctagttttcccaggtattaaggcaacagtctagttctgatgcagagagaaattttaatccagagcactcatgagtgacacatggtcccagaaatgggacagatatggttctgtaatgagacctataccaacaaacaggatgaaaagtttgtctcccacctgctgacatttcttcacttttcagacagcaccagttgcccttgaagcagaaaacagaggtgaaatgaaactagctctccagtatgtcccagagccagtccctggtatgtaatgactttctattcagatttatgtcctttccttatccctcccttctcacagtatttactatgcgttttcaaaggtgaggccctaaagaaacttatcaagttagtaacgtatagaccaaatgagtctattcacagttgtaaataagaaaattctttttttgttattgtggcaaaaaaaaaaaaaaaagaaaacataaaatctaccatcttcaccatttttaactgtacagcttagtagtgctaagtatattcacactgttgggaaacagatctccagaaccttttcatcttgcaaatctgaacctgtttatctattaaccaacaatttccttttcctctactaccagcttctggtaatcatcattttactttctgtttctataagaaagttctcatttttttttttagtttagtttatagtcattaggtttcacctcactctccaaaaatttgtatctgcacaatgtgaatggcctgtattcagaatttgtgtattcctgtgtttggaatttggacttattgatagtgctataagaatagaacctgagtgttctttttcacaggtgggaattaagaggactccagagaacttaaagctcattcaccctccactctcagggtctcattaagagataaagcttttccctcaagattattaattgcctccttgtcaggtcttcagcccagttaaggagcaagagactagcaggaaatgaatgccagccagctccttgctccatttcccaagcaagttccccaagttagtctctttaagaatctgtatgaatgttatggctgaaatcagaggttgtaaactcaaatgctttcagtaaccaggcagtgaagctagtgagatggaagaaataattgatggtgaggatagtgactgaactaaagaaaagcattctgatgtagtttataccgccccccgccccccaaaaaagaaagaattagagggcaagtaaagcatattttcaggctggattgctgtcagactgccacctttgaacttctggattttcctaaaaggtagattcttttgcatataatttgtatcctatcatttaaagtcaacattcatagaaatcccatttccctttttccttctatcacttggtagtagagggcaggggtattgtgtgttgtgatgggtgccaccatgtctgaatttttgtccacgtagtttttcttctttgaaatggcttcctcttctcctcaacctaccaaagtcttagatgaagccccatctcctccataaagctttccctaactatattagatctcactgatcatatcatcttctagaacattacagtaataacttggagtttcactgtatattacatttttatcattttatttgaattattctctccaacataactataaacatttcccaagggcatagattatttcatgtattctctgtatatctaatgatgttcctagcatagcatagagatgagcttatgatagatcctcactaagtactgtttggttgactgattgagctaacccattcagaaaaatctggtggcattcctctgttcgtatgaacccagcctagacaacaatttcagactaagccaacttcttagtaactatctgcccataatattaactattacgtatgtacatacagtatccctataaaatgtttaaccactcttgactgggggtggtggctcacgcctgtaatcccaacactttaggaggctgaggctggtggatcccttgagcttaagagttcaagacaagcctgggcaacatgacgaaactctgtctctacaaaaatttaaaaattagccaagtgtggtggcacatgcctgtagttgcagctcctctgggagggctgaggtaggaggatcacttgagcccaggaggttgaggctgcagtgagccatgattgtgccactgaactccaacctgggtgacagagtgagaccctgtctcaaaaaaaaaagtataactactcttaaaaatgactataccttagccaatacctgttttggttactttatacccaaatatgttttaaatgtcttccactagcaccaactgatactggtattaatgtttgcaaggtatatgcatttcattgaaatgttttgaatataactgtaaatggatgattcacattcctggtgtttgattttgttgaatcaagcaaaaccccaaatgaatgatgtgctaatgatgtaatacttggtacttaaagccaatatgaattatttttatagagctatcgagttcagtaaaaccagattatgaagacttagttaagactgtatagatttaatcagttcagatgatatcatcaaatactagctagtatctccatgccagaacatttttaggctgacatctttggacgcagtattgccaagggagaactggcagtgaaaattttctcttctttttctattgtaggtaaaaagcttcctacaactggagaagtgcacatctgggtgaaggaatgccttgatctaccactgctaaggggaagtcatctaaattcttttgttaaatggtaatagtattgatgactctgtctgcaacagttctgtagcctggtctttgctggttagtttcggttctctatatctgtaatactgactcatcattcataatttaaatgaatttacttgggataatggagacatgaattggaggaatctatatcatgaactctcaaggcttcatttggctttaaaatcataaagtaagaggtcaaatgaaactagagacctcatactcaatgtgtaatgtgttctagggaaaacatctgttggtgagggcaataatcagttcaaaagagtttattaaatttctaatggtaagatgtcacaccccttgactcctttatggagcagggagaattccttctctcctttgtcccacctgttttgtggcctatttgcaaacggtcattgtatgagactgcagatatttggaaaatgatttgctaatcaacccttactaagagcttgagacagtttgggtttttaagtggcaaactcttctctctgttatacatataaagtgactggcatctagtaaataataactaaacagatattagtatgctctcctagtttctctaattttatttatatatagtctaccagaagaccaactgtagctttttaaatatatgtgacatatatctggtacagcgaggtgtctcacgcctataattccagcactttgggaggccaaggcggacggatcactggagcccaggagttcaagaccagcctggtcaacatagccaaaccccttctctattaaataaataaatatatatgtgacatatatctaagtagcatagatgatattatttatgattttccctacacattatctttatagatgtcagctggtaagatttttttggctcaagtcagcctcattctaagaccaagtcagtcagtcacattctgagaccattcacagaccttcttgccttgtgttgccacttgtattgtcttatattgccacttacaagaggcatggtaggttaaagttcatttaattgttatcataaatgaaatgtaagtgattgtaaaaaaaaaattacataatttatttccaaagtcaaatctagcaatttggagaggtttctcttctttttctattctgtataacacaaatgtcttaggctatcacagctaatcaggatagcctgtgcttgcaaattttaaaggaatcctcaaatgattactagcatattaagcacttactaaatgcaggcatggagctaagtgttttgcatatgttatttaattctaattttagccttatgaaatcagcatcaccattcccattttatagatgaagaagcaagtgtccgtaaggttgagtaactttccctaaaatgcatacccaggaggtagcagagtcaggattcaaaccaagtatagctgactctaggtccagagtcttttcagcatgatgtgttcctaccccctaccccactgtctgccaaaccaccaccaccactatctctccacatcttttcctccattgtcaatctttaatagctgtgttgttatgtattgaaagcatgaatgttcactatcttactaaaatgctcccacaatcatgcctctttttgtagtaccatccttccagatacaagtaggaaaagtcgccagaagacaagagctgtagggaaaaccaccaaccctatcttcaaccacactatggtgtatgatgggttcaggcctgaagatctgatggaagcctgtgtagagcttactgtctgggaccattacaaattaaccaaccaatttttgggaggtcttcgtattggctttggaacaggtactgtttgctacatttttaattctccatgagccaaatttttctagagatactagaggtttgtttgttgctttgcttcttcccagtgaaaaccgagatatcctgaaaacagatatctcttaagtatagtgaaataaatgagtaaagaaatgtcaggttgtatgccaagggctccagatatgaggattaacagggtgaagtgtctctgcatatagagtttaagttattgtggcagtggcagggacagaaaagccttcatcactagtctgccctgcaaaaacatttatggtccttcaaggctaaatatatgctttgagtaataacaataacatttttggagcaccagtcactgtattaaatgcttcatttacattatttcattgaatcctcacaagtctatgaggtagttactaatgttaccccaaaggaactgatagtccaagaaagtaagtaacatagctacaaagtggcagagccaagattcaaaattgagtctgttagacactaaagccttagtcacactaacctagagattatctagtgtcatctccaacccagtgcaggagtcctcccaactcccttattccctgatgaattttcatctggcctttacattaacttgaagaaaaatcattgctctaggaattatggtaatgattacaaacatgaagtcactcagacaattgaacagttcttccttatgttgagtctcacatctgccctcccagtgaagaaagctcctcctagcttccactggtggttataattagggaataactttccctctttcccctacccccaatgagctgtttctttctaaatgcaaagcttccttttttcaggtaaaagttatgggactgaagtggactggatggactctacttcagaggaagttgctctctgggagaagatggtaaactcccccaatacttggattgaagcaacactgcctctcagaatgcttttgattgccaagatttccaaatgagcccaaattccactggctcctccactgaaaactactaaaccggtggaatctgatcttgaaaatctgagtaggtggacaaatatcctcactttctatctattgcacctaaggaatactacacagcatgtaaaagtcaatctgcatgtgcttctttgattacaaggcccaagggatttaaatataacaaaatgtgtaatttgtgactctaatattaaataagatatttgaacaagctaggaaaattgaatttctgctgctgcttcaaagaaaaagctgccccagagcattaaacatggggtattgttaagaagcaaaatgttcttgtttgccatcatgtgtttcacaccacaattctgtgccacagttaagagggtctggtacccttgcaggacctttgtaggttgtgggaaaaagtcgcagaaagatactcaaagtggagcagggaatggagacagacatcagtgatgataaaaaaaaaaatggaccttaagaaactatttactctgtaatctctaataaaatatggaattccatattagggcaatgagactgaaactactggtgtttttctgccttgagaaaacaaacagttaaaacaagcctcaaatgtattttagtgccacccactggccataggtacaattcagttgttggcttgttttgacttaattctaaaataggtctcaagcctgtatttttatgagtttatttttttaaaaccctgcatatatatgattgtttttcttataactttactatatgaaagcagcataagagtagtcacaaacatgttttgcaacaaagttttaattagaatgtaagttgctcagttatactgttcttcttatgtatgtaaaattttcgtattttgtaaaaacccttagaataaattatcatttgatttaaattgtattagaaaattagcgtgacttctcattttaaataaaatattttaggaattctaaacatctaaa

SEQ ID NO: 145 - DNA, 71470 bp, Homo sapiens
gaggtgcgcgcgcccgcgccgatgtgtgtgagtgcgtgtcctgctcgctccatgttgccgcctctcccggtacctgctgctgctcccggggctgcgggaaatgcgagaggctgagccggggaggaggaacccgagcagcagcggcggcggcggcggccgcggcggcgggagccccccaggaggaggaccgggatccatgtgtctttcctggtgactaggatgtcgtcggaggaggacaagagcgtggagcagccgcagccgccgccaccaccccccgaggagcctggagccccggccccgagccccgcagccgcagacaaaagacctcggggccggcctcgcaaagatggcgcttcccctttccagagagccagaaagaagtaagttgagtgcgagggagccaggccgggagccagcggcggcgccgggccggagctgtcaccgggcgcccgccccgcggcctccgcgccccggcgccccccggcggggtgggggcggggcgggcccgcgggcggtggcggctcccggccccggccccgcgcccctcggtagccgcccgcgcccggcctcccccgctccgcgccgcccgcccgggctcccgccggcgcccggctccgcacactttacttttcagtcgggccttttcactgggtcttctccgcgactcttcttttggagaaatttctcgtagccgcgtcttggcctagctggatcattgagaaaacaagcccggagcgcgcccaggtagtccccggacggactccgggcgaaccgccgagccgtcggcgctcgggaaactctcggagctgtcaaaacgcccgggccaggtggtctcggggcgcgggctgggggcgagaagaaagcggccgggcgagtgcagcttttgtttgtcagcgacttgctcctggaacttttcctggtcccaaacctgtgttttcttcttttgatgatatattaggaagccatttgacttcttcctcccccctcccccaacacccagcaccgcactcccgggctccgaaagcacaagtcctgtgggatcccccagcttcggggaacggcctgcctaagttttggagacgtagccagcgtcccctcgtaaggcagaataccaagagcacttattcggagagagtgcagatgtaaatgtcgcttccctcgtaagtcttagctgtaaggggcttgggaatagggtcgcctgcctttgagcgtacagtagggctggaccccagcttattagaggaccagaaatgtcttcttacagaacggttatttgacggctttgcttgtaaattaagacaccgttttagtgccagcgaactgctcggcttctgtggctctcgcgtgtgccgtggaagaactgtgaatgtctctcgaagttgtagaatggcgtgtgtgcttactcatttcgtgagatgatattctcattgaactgtcgggagtggaagggtgcgctgggacgtgaaggaagccagcacgtttatggataggctgtttctttggttcgggtgcattcacttagtaatagtattgttgtttggtgatttgtagtaaaaatagtagcgtgaactgaggcatagcagagctgggttgtgggaacccattgagctcttgacttgaatgtgctcttttcttgccccgctgtccttttactatgaaaatgattcagggccttcaacttgcctccatattttattgccagctgttacctagctatgataatcgtgagggaagcaagtacaggatgtgtgtacattattacattagcttgttcgtgatacaaagttaggacttatttattatgccacttgcgttgtaatacagtggcaagtataaaatgcccttattctgtattaactgaaatttgtagaaggaagtggaggtttaagtaatttttagacatgtaagccacttttttttgcatcctttaaagcaactcaggacaagccatattggggttttaccttgattgcctcccatttcactatttgcaaagcatttcttcatctcttactgaacattaatttgcaagtattgttttaaatttgcatttgaattcttactccagaaagattagatctatgttgtcacaccccacaccccatactcctgtaagggcgtgcttgtgcacgcgcacacgcgcacactcacacgcacgcgcacactcgcacacaccctacttttgaaatgagctcatttgtattagtgcagctcctgagtgcactggacgattagggtattgccactttattattttaattctgaatctcatgaagaaataggcagcctttggagaagataaaaaatttctgctgaataacagtataatctaactatgaaaaatcaaaacttttggaaatatttagaacaaatgtaagtctgtagagagctttttcttttagatttgaaaactagtactgctttctttataggaaattaaagtctactggtaaatttgacgggtctaaactttttagagcgttttttttgaaattgtgtcttttgaagggaatggaatctccagttgtttttagcaacatgtaaatggaaactaacatatgaattggaaagcaaagaggtttttgaattgtgtatctctatactgtataagaatccatgcagaaaagaccctgtagttggacagtaaagaccctgaaagtgaaacttatgtgtaaccagtgtaaattaggtttgtaaccagtgaaattatgtgaaattgcaaataattcacctgagaaatgaaaattaatcttctttgctaaatctcatagagatattttaagttgctaatgttacttagatgttcattaacttagtgagttacattaagtagagaagatgccttttttttttttttctggacgaagtcttgctctgtagcccaggctgtagtgcagtggtatgatctcggctcaccgcaacctctgcctcgtgtattcaagcgattctccttcctcagcctccagagtagctgggattacaggtgtgcgccatcgcacctagctaattttttgtatttttagtagacacagggtttcaccatgttggccaggctggtcttgaacccccgacctcaggtaatccactctcctcagcctcccaaagtgccaggattacaggcgtgagccaccgcaccccgctgagaagatgccttttgacaatgaagtggatttatgtatttatctttggcttaaaaaaacatgcaccaccaattacactttcctcaagtttaaatttttaataattaggtaaataaagcattttcttgtcttatagtgttagctagattgtttttgtgtattttgtcatgaataaaaagcatagctatatagttactgcttttacattaactataaatatcttaaaattttactacctaaaatcaagaaacttgaactgaagctattaatcttagagttggaaaagtaaatacatagaggtttcctattgtacaaatgtcaagtggcacagtgaaatttacattcatttgaaagttttccttaactgtaaaaagtatcaaattatttgataatttggagtagttcatcatctttatcagaggcacaggtcttaaccattggcaggcctctgtcagaatatgcacatattaaagatctcattatttttgtgttaatgttaaaaaatttttctgaagcttttttcttattttttccatccttacactgtaaattcacattaccaagttgggaagccaaagaaacattctactctactatgtttcttaccagttcatgaaagttgatgttagaaatgggtgtgggtgtgggggatgggggtggttgtacagaagcagcaggtggtaggtataggatttctgaagcactatccttggccttttttgagtaaactctttataccctgaaccactttcttttcagagggcaattgctattattagagagccaccttaagcattattgttgtagaaaaattaggcacaaccagtgattgtcattacaaggaccagcaaaaatggctaggttgctactctgtatttgtaacgcccttcccccaacaaaatttctccttttcatagctgtgaatttgaaataagtgatagaaaactgtactgcattacaatatataccatttaataaaacaagtttatagttgagagacagcactattattcatgctttttgagataatgcaaatttgtaatttttatgacagcaattcttaataatttattgtccaagagatctgataaaatttttgatattattggtctctgggactcaataggcactgaaatgttttaattcagttgaaaagttgactcaggattgctaccctctcttacctgttaggaggttgttgtttaacctgacctgaaattcccatgaataagaacctgttttttttctttttttttttttttgacagagtcttgctctgccgcccaggctggagtgcagtggtgcgatcttggctcgctgcaacttccgcctcccaggttcaagtgattctcctgtctcagcctcccaagtagctggagtagctgggactgcaggcacgtactaccatgcctgactaatttttgtatttttagtagagacggggtttcaccctgttagccaggatggtctcaatctcttgacctcatgatctgcctgcctgggcctcccaaagtgctgggattacagacatgaaacaccgcacctggcccagggaatttctaatatttgagaagatgttatttttagtctattatacaaatttatatattgtttactaatatataaatttacatattagttactaatatgtaaacttaccaatttacatattggttactaatatgtaaacttgataaacatggatttccatggaaatataaaagtatcacaacaatttgttttcccattctgacacttgtgatttattacattttcgtactatttcagttaattccataatgccagaattgttgttaatctgccaagtgacaagccacactgcttcatctcattcctctgttccgcaaaactgcaaagtttcccagaccacagtcaggtttctctgggtagatagtggttgtccaactctgtaaacttaagtcactttaagtttatgatggaggggcttcgtgaaacttcattgaccttccaaggtgaaaattggtcagtttccagttataaaggacattaaggatgggtgtggtggctgatatatgtaatcccagcacttttgggagactgagtcaggaggatcacttaatcctcatttaaaaggagtttgagaccagcctgggcaacaaagtgaggccttgtctctacaaaaaaattagctgggtgtggtggtaggcacctgtagtcccaactactctggagactgagctgagagaagattgtgtgaggcttggaggttgaggctgcagtgaacggacatcacaccactacactctagtcaggtgacagagcaagactctctaaataaataggaacattagatggtctctctgcactcttgcctggtggggacgtgttagataccctcgttaggttgtgatttagtttttaatctgtgagatgtttgggccaaacaacttttagctgccatggaataaactttacagtcagcgtgtgagtttgtgtttgcctttacttttttttttctatattgttttggtccatttttatcttttaatttcagaaagctgattaatctcttccttttctctttaaaaattttctttatcatgtttgtgctacagtggttattttgagaacttgttggcaggataagtggcaaaagttacgaagtagaatagagatgatttctgtttttttttttttttcttttttttgagacagtctcactctcttgcctaggctggagtgcagtggcgtgatcctggctcactgtggctgccgccctccggattcaagcgattcgcctgactcagcctcccaaaaagctgggattacaggcgcatgccaccacacccagctaatttttgtgtttttagtagagatgggtgttcaccatgttggccaggctggtctcagactcctgacctcaggtgatctgcctgcctcggcactcccaaagtgctgggattacagacgtgagccaccacgcccggctgagattatttctttttttattatagctattgcttgtagatatatgctggtggttatctgtgaaaatgtaatagaaaggctgggcacggtggctcacacctgtaatcccagcactttgggaggctgaggtgggcggatcacaaggtcaggagtgggagaccagcctggccaatatggtgaaaccccgtctctaccaaaaatacaaaaattagctgggcgtggtggcaggcacctatagtcccagtgactcgggaggctgaggcaggagaatcgcttgaacccaggaggcagaggttgcagtgagctgagatcatgctattgcacaccagcctgggcgacagagtgagactctgtctcaaaaagaaaaaaaaaaaagtaatagaccaatcttggatttataattggaagtgttgatccctttatttgcagaatttgaaggacttaagagcacaagttgagagaaacaaatgacacagctctttttgcactttgtaatattctagaaaaagcctcaggtaaaaggaaaattgtttcactttgtttctgctgttaattttgtgatggcagtaactacatatgatctacaagtgtaaaattgtttaacaagtcttaagttttctatacttctatgtaactttttagatctttcatttggtacatgttatttaaagagctacaaagtgctaaatatgtcctgggatgaacagtcaaccctggaagatttattgtggcctagaggggtgctcaaagatttggaggaagtagtatttgaattagaccttgaaggattggtgggatttagccaagtagaatgacaagaaaatgagtgtgtgagggagcaatgtgaatgaaattattgagggaaggaggtgtaaaaggtggggtggcttctgactgtgtgactagaacagaggctgtgtgtagtggtgaggccaagctgtgatagttcttgaatgccagactcatgagtttgggctttatcctgtagtccaggagttataaactgtttacagggagcaggtaagcaatttaaatgaacagtaggctgcttctaagaatctgaatgacaactgacactttagaccttgggttggggagaaaatgggaaataataacagccttggggaagtctaggagtccttatgccctgcttaaggtgaaactgatacagaattctggctgatggttgctatttgagatgctgtttctagatttttcaagagggcggaaatttggatttttatgatttttttttttcttttttgagatggagttttactcttgttgcccaggctagagtgcaatggtgtgatctcggctcactgcaacctctgcctcccgggtacaagtgattctccttccttagcctcctgagtagccaggattacaggcacccaccaccatgcccggctagtttttttttttttttttttttttgtatttttagtagagacggggtttcaccatgttggccaggctggtctcgaactcctgacctcaggtgatccacctgcctcagcctcccaaaatgatgggattacaggcatgagccaccgcacccagccctttttatgatttttaaacttggattttaagtgtttttcattaattagaatctaaaacggtatttgcgcctatactttgtaggctaggtttaatctgcggaccaccaggggactacaggtctcaatctctgctttatgcccagttattttattttttaaatgaaagttttcaaagcaggtatttacagtattcttgaggataggaaccttactaaattactttgtattctgtttagcatttatgcatttgaatgtaggcactcaaatacttggtgatttaatgatgcctattattaaaaaaacactgtggtaataatatggagacaggagttacctggaggcagagataataggctgttacaatagttgtagtgtgagagatcaagccaaagcatagaatgttggtagtgcgaatggggaggaagattccagtcactgcaaaggaggaattcggcagtttctggcatagatgttgtagcaggcatccaaatagattggatgcctgctaagcattcggggaagtaggactggagttgaggaatcgattaggataagtatttaaagatgtgacttaacatgtaatcactgagaatatggcgtatgggaattagtaaaggattaggatgctttgttgcccttaggagataggggaccagttatacccggaaaaacaagaaaggaaatcagaatatattctcatgacaaatggacaacatatacatacaagatgctcatggcagcagtattagtagtagagaaaagttggcaacaacaaaatatgcatcaatggactaccatgcagttttaaatcaagacatagagatagatctgtgggccctgaagtgggagaatgtctatgatacattgttgaactagagaaaaacctttccaaaagttgtaaagcagtaagtttagcagtaactttattttgtgaaaagcacataaacccaaactgtgtgtatattttgtgcatataaaaagattgggaagaatacataataaatattaatactctgggggccgggcgcagtggctaacgcctgtaatcccagcactttgggaggccaggagggtgagtcacgaggtcaggagttcaagaccagcctggccaagatggtgaaaccccgtctctactaaaactacaaaaattagccagtcatggtggcaggcgcctgtaatcccagctactcgggaggctgaggcaggagaattgcttgaacctgggtggcagagtttgcagtgagctgaaatcgtgccattgcactccagcctgggcgacagagtgagactctgtctcaaaaacaaaacaaaacaaaacaaaaaaaaactctggggagtatattctttcagtatacatttatgcatttaaaaaaagaaaaaagcttaatacttcagaaatggtaaatcatttgacaaatgagaaaaccaaattctgggggcatcactgattatagagcctagaccttctggattcaagtctaggttgtactacatattagctgtttgaccttgggcaagttacttaaattttttgtgctatggttgcctcacctgtagagaggacgtaataatacacctaatttaggattgttatgaatttatatatatgtgtagaatttagaacagtttctggcatagactaagtcctattaagaggtgctgttgtaaggatttaactactgttgttactgtcattgccactaatcatcaattatcaatcagttgcctgttataaactatttagagacagaagtgattagaaaccaaactcactccaaaaatgccatgatataaggctgggtatgttggctcacacctgtaatcccagtgctttgggaagcaaaggtgggaggattgcttaagtctaggcgttagagaccagcctgggcaacatagtgagatccccatctctacaaaaaattaaaaatagctggatgcggtggtatgcacttgtagctccagttacttgggaggctgagatgggaggattgcttgagcccaggagttggaggctacagtgagctgtgatcatgccactgcactccagcctgggtgacagagcgagaccctatctcccaaaaaaaaaaaaaaaaaaaaaaactatgacataaaataatgcagttgttattggaggcggggatagtggggtggcaaagattttctttgtacgcagatgtccccaatatatagaagaaagatttttaaaaagctaggtcagcagaaatctctatgaaatgtttttcattatgagcaatacacgaaaaacagtcaaagcaattccctaggagttgtatatgtagtaatattattccaaagttttttattgctcaaacttttaaatgttgttagagtagatttttacatattataactctactggctagggttttattagtaggcctccctcagtgagacttgttttaggtggttttaaaatgatttcttacatcttttatccttggtcactttaaatctttacaccttattgtaatcgatttacattagaagcagcatacttgatggtctcagtgaagtctgtgtggtggtgttcttttagtggagcctagcaaaaaaagaatttccttgatttcctgatctttgggattctagtcatatggaccacatttggaataagcacatagttgaatataaaatgacaaaatgaaacataaccatattcttaaagttctcattgaattgttctaccatagttgaagtgtttggtcagtatggccaagtgtttgtttgtttttgagacggagtttcgctcttgtcaccctggctggagtgcagtggcacgatctcggcttactgcaacctatgcctccctggttccagcgattctccttcctcagaccccggagtagctgagagtacaggcgcccctccaccacgcctggctaatttttctatttttaatggagatggggtttcaccatgttggccaggctggtctcgaacttctgacctcaggtgatccacccaccttggccttccaaagtgcagggattactggtgtgagccactgtgcctggccctaagtgtttcttatattagactttcatacttatagagttgtagaatattagaactattaatagatgagaattcaagaagattgagtctaacccctcattttatagataactgagccccagagagattatggaatactagaagtcatatattaaggtgttacttttacagtaaataaaggagatggtagtctactgtattggtgtagacccatagtaaatcatgcctatgggtattcatgctattgtatagtcatctctctttgtatctcgcctagccctgtgactcactttaaccagtagaacatagcaaaaatgacactttgctatttttgggtacaagccttgagcatgtcaggcagcttctacttttgtactcttgggagctctgagttgctgccgtgcaagaagctgtcataccttgctggagagatgatgtggagaggaagagattccaggactatatggaaagagggaggcttaactatctcagtgtcctagctgccttcagcccttagttgacttgcctgttgaatacagacacaaaagtgattagtaagattagcgaaggggccggcgtgggggcttatgactgtgcagtcccagcactctgggaggccaaggcatgtggaacacttgagcccaggagttcaagaccagcccgggcaatatagcaagacactgtctctacaaaaaaatacagaaattagctgagtgtggtggcatgtctctgtagtcctagctacttaggaggctgaggtgggaggattggtcaagcccaggagggtgaggctgcagtgaaccattatcttgccattgcactcaagcctgggcgacagagtgaaaccttgtttctctctctcacacacaaaaaaaagattaacagaggaaccacctagctaagctcagtccaggttacgaaatcataaataagtaaaatgctggttgttttaatctgttttgctggaagcagatagttttctgaattaagggacgctaagaacaaagagtatttggagctgggtgtggtagtacatgcctttagtcccagctacttaggaggttgaggtgggaggatcacttgagcagaggagttggaggctgcagtgagctatgatcctgcaactgcaccccacccagcctgggtgacagaacaatacccggtctcagaaaaaaaaaatgcatttgggatacgagtgataaaaatcattattttccatcctcttttactgaaatagttaaatgaagtttctccttaaccttaccctttatttttctaaagtattttgaaatacagatttttattattgaggactttaaatagtatttaaaaatggaattgtcacagtgtagattgggctatagttaggtcatacagaatagaaagataaaacaattatgaatatcaaccctaaaaaggatatagtttatttatttatttatttttgttgacttgtacagagatctttatatatttgagcatcctggactcttgacagaagaactgatttctatttctgggccaattcttaacagccgggtatatcagtaaggactaggtttgtctttatgtgattgaaaaccccgtaataataatgacttgaacaggagtgtttatttctgtttcacttcaaaatctggagggtaggtactgaggctggtattgtccctctacactgcaaagtcatcaggagtgtctccctttatctaacttctcagacatttctaggttgtggcctttgccctaagattccttgatggctactaaagtcccaattacattacatgcatgtcccatgaagcaaaatacagaaaggagtccaagggcacacagcctcctcctttgaagaaatattgtatgttttctcttacatataattggctagaactatcacagagttcacatggctacctgtagctgcaagggaggctgggaatgtagtttgtttgttttctgagacagagtctcgctctgtcatgcaggctggagtgcaatgacatgattttggctcactgcaacctccgcctcccgagttcaagcgattctcctgccttagcctcccaagtagctgggattacaggcatgcaccaccaagcctggctaatttttgtatttttagtagagacagggtttcaccatgttggtcaggttggtacgaactcctgacctctggtgatccacctgctttggcctcccaaagttttggaattacaggcgtgagccaccgcacccggctgggaatgtagtttttttttctttttttctttttttttttttgagatgagagtctcgctctgttgcccaggctggagtgcattggtgtgatcttggctcactgtaagctccgcctcccgggttcatgccattctcctgcctccacctcctgagtagctgggactacaggccaccatgcctggctaattttttgtatttttattagagacggggtttcaccgtgttagccaggttgatcttgatctcctgacctcgtgatctgcctgccttggccttccaaagtgctgagattacaggcgtgagccactgcgcctggttgggaatgtagtttttttagatgagtaccttgctacttagaataggttcaaagtctggttactgatggtgggaataaatattacagaaatagctagtaaatagtctttaccactttgagcaattggtttatcaccataggcctaattttctcatgtgtgagaattatgatactgaagttcttgcgatggcagataatttcatgttgaggcccggttgattggtagtgactgctttcaacaatgctttgttgaatcctgagcccccagggttttctttttttttctttttgagacagagtcttgctctgtcgcgtggctggagtgcagtgatgcgatcttggctcactgcaacctccgcctcctgggttcaagcgattctcgtgcctcagcctccctagtagctgtgattacaggcatctgccaccacgcctggctaatttttttttttttttttttttagtagagactgggttttgccgtgttggccaggctggtctcgaaatactgacctcaggtgatccacttgccttgtcctcccaaagtgctgggattacaggtgtgagccactgcgcccagccctaagcctccagtttttgacctcagcatggtgaggaagtagtagaagtatgtattttgggtgaagaggagagtaaaagcatgctcccatttatatgctaacgctgtgctttttaaaaatgtggttacttcaacttttgtaatcttttcattgaaaacatttggttattctgctaacctttgactattctctttaaaaatgtcctacattcattccatattttaaagttttctaataaacctgagttcccacttgttttttttccttccagcttttattttaggttcaggggttacatgcacagatttgttaacatgggcacattgcgtgtcgctgaggcttagagcacaaatcattttgtcactcagatagtgagcatagtacccagtaggtagtttttggatcctcaacttcctcccagcctccaccctcgagtaagccttggtgtctcttggtcccctctgtgtccacatgtacttagtgtttagctcccacttggaagttagaacacacagtatttggctttctgttaattaattcgcttacgaataatggcctccaactgcatccatgctgttgcaaaggatcatttcattctttttttatggctgcacagtattctgtctcgtatatgtaccatgttttctttatccagtccgctgttgatgggcagttaggttgattccatgtctttgctgttgtgcaaagtcctgtgatgaacatatgtgtatgtgtgtctttatggtagaacgatttctattaatttgggtatatatccagtaatgggatacctggattgaatggtagttctcagttctttgagaaatccccaaagtgcttttgacagtggctgaactaattaacattcccactagcagtgtataagccttcccttttctctacaaccttgccaacatgttttttttgtgtgtgactttttaatcatagccattctgacttgtgtgagatggtatctcattgtggttttgatttgcatttctctaatgataagtgatgttgagcattttttcatatgcttgttggccacatatgtcttcttttgagaagtgtctgttcatgccctttgcccatttttaaatggggttgttttttgcttgttttttttttattataaactatttttttattatactttaaattctagggtacatgtgcacaacttgcaggtttgttacatatgtatacaaggtgccatgttggtgtgctgcacccattaacttgtcatttacattaagtatatctcctaatgctagttttttgcttgttgatttaagttccttacagattctgtatattaggcctttttttttttgagatggagtctctttctgttacagtctggagtgcagtggtgcgatctcagctcactgcaacctgtgcctcccgggttcaagcaattctcctgcctcagcttcccgagtagctgggactacaggcgtgcaccaccgcacccagctaatttttgtatttttagtagagatggggtttcaccatgttggccagaatggtctcgatctcctgaccttgtgatccacccacctcggcctcccaaagttctgggattacaggtgtgagccactgagccaggccaggcctttgttgaatgcatagtttgcagatattttctcccgttctgtaggttgtctgtttactctgttgataatctcttttgctgtgcagaagttcccgctttgtgcagaacattccaaacactggagatagggatgatgcagataaatactaaactcctttaatgtgtatatcagaatatacagaatatgttacggtgacaaaggatcccaattcttagtggcatcagtcacaaaggttcatttcttgctcatgctatgtgttcatcacagatcggtgtgggtgttagattataggtgacttaaaatctcttcctttcaaagtacatttctgaagcatggtttattcttagtcagatttgcttttcctatttgttctctgttaatcacccaaggaggatgttaggcaaaatcaaatactgagaatctgctgtgtattatacagtggagagaccaaaataaggcaagatccctaccttcaatttctggtaactcagtgcaaagtataatgcaaatgacacattttacaatagatttcagaaagtgctgaggaagcttagagaaggaagaacttatctcagaggaactgaagaaagaagacatctttgttgagtgtttaaaaatgaaaacagactttaccgaagagaaaaaggggagtgagaaactagtacctggctattatgtgttaggcactactagtgcttaccagaagttacctttttgataattactgatcacatggggttgaatcattagtacgttttacaaatgaaagatgaatttttatatagcttgtaagtgattgagtcaggatttgaatccaggtgtgtctgaccctgacctttgctttttaagagactacagtccaatatgggaggaaatgaggaagggaaagtaaattgggcattttgaatattaactgtaaacaatagggagccattgaagatgttaaacagaggtatgacattgtatctgtgttagaaaaataaccggcaacaactgtaaaactggaactaatgattttttgcatgtgattaagtatcaaatgaagtataatttctgatctcctttaatttgtttgtagtattttataattttcaatgcacaggtcttgtactttttttgttaaattgattcctaagtatttcattgtttttgatgttgttataaatgtaaatgttttctttcccccacttttttttttggagacagagtctcgctctgttgcccaggctggagcccagtggcatgatctcggctcactgcaatctccgcctcccgagttcaagtgattctcctgcctcagcctcctgagtagctgggattacaggcgtctgccaccatgcccggctaattttttgtatttttagtagagatgggcttccaccatgttggccaggctggtctcaaactcctgaccttgtgatccacctgccttggcctcccaaaatgctgggattacagacatgagccaccatgcccagtctattttttttcttttaaatgaaaaacaaatctttttatgtagggacagtcgtctcactatgtcacccaggctggtctcaaactcctaggctcaagtgatcctcccaccttggcctttcaaagtgccgaaattatagacatcagctaccacacccagcctgacctattctctttcaaacttttttcatatacacagtttttttttttttgtgatactacttatgtacatttagagttttgtaacctactttcccttgtaacatgtaaaagaaaatttccgtattgttaatcttttataacatttttgaagggtgcttaattttccattgagtaaaactgagggctgagtgctgtcgctcacgactgtaatcccagccctttgggaggctgaggcaggcatatcacaaggtcaggagttcgagaccagcctggccaacatagtgaaaccccctctgtactaaaaatacaaaaattagccaggtgtggtggcatgcgcctgtagtcttcagctgctcaggaggctgaggcaggagaatcgctggaatccgggaggtggaggttgcagtgagccaagaccacaccattgcactccagcctgggcgacagagcgagactctgtctcaaaacaacaacaaaaaactgagtaaccacactataatttatgtaaccatacagctgtctccccttttcctcttctcaccctactgccttttgttactatgtgtaatgctctggctgacctttttgtagataaagcctttttcatattttggttatttttataggacagattaccataggcaggataattaggttaaaaaataagcatttggccgggcatggtggctcacgcctgtaatcccagcactttgggaggctgaggtgggtggatcatctgaggtcaggagtttgacaccagcctggccaacatggtgaatccccatctctactaagatacaaaaattagctgggcgtggtggcgcacacctgtagtcccagctacttgggaagctaaggaaggagtatcgaggcaaaggttgcagtgagccgagattgtgccacttcactccagcctaggtgacagagtgagactccatctttttttttttttttttttttaaaagaaagagggtgggcgcggtggctcatgcctgtaatcccagcactttgggaggccgaggtgggtggatgacgaggtgaagagattgagaccatcctggctaacgtggtgaaaccccgtctctactaaaagatacaaaaaattagctgggtgtggtggcaggcgcctctagtcccagctactcaggaggttgaagcaggaggatggcgtgaacccaggaggcggagcttgcagtgagccgagatcatgccactacactccagcctgggcgacagagcaagactccgtctcaacaacaacaacaacaaaaaagcattttttgattcttcatagatattcagaagcatataggctctaatgtctatttgcttattgtcaaattctggtcttatcactttctagttgttggactttgtataagctgttcaatctgtatctgtttgttacctataaaatagggatgataataacatctttgtcacaggattattaaaagatttaaagagggtatatgtgttaagaaagccgctagaggccaggtgcagtggctcatgcctgtaattctagcactttgggaggccgaggtggatggatcacctgaggtcaggagttcgagaccagcctgaccaacatggtgaaacccatctctagtaaaaatacaaaaattagccagacatggtggtgggcacctgtaatcccagctacttgggaggctgtggcaggagagtcgcttgaacctgggaggaagtggttgcagtgagctgtgcctattacttagtaagttcttagtaaatacgaactttttaaaattttttccttcttatatttgatgccttagcaagcaataaatataaactctttttttgagataaatataaactcttttttttttttttttttttgagatgatgtctcactgtgtcacccaggctagagtgcagtggtgccatctcggctctccacaacctctgcctcccaggttcaagggattctcatgtgtcagcgccctgaatagctgggattacaggcgtgtgccaccatgcctggctaattttttgattttagtagagacaaggtttaccatgttggccaggctagtcttgaactcctgtctcaagtgacctgcctgctttagcctcccaaagtcctgggattacaggtgtgagccaccgtgcccggcttgatctcttatttttttaaattacattgaattttttttttttttttgatacagagtcttgttctgtcacccaggctggagtgcagtggcatgatctccgcttactgcaacctccgcctcctgagatcaagcggttctcctgtcttagcctcccaagtagctgggattacaggcgcgctaccatgcctggctaattttttgttgttgttgtttgtttttttttgagatgagtcttgctctgtcgcccaggctggagtgtaatggcgtgatctcggctcactgcaaactccgcctcctgggttcacgccattctcctgcctcagcctccctcccgagtagctgggactacaggtgcctgccaccatgcccggctaattttttgtagttttaatagagatggggtttcaccgtgttagctaggatggtctcgatctcctaacctcgtgatctgcccgcctcggcctcccaaagtgctgggattacaggtgtgagccatcgcgcctggcctacgcctgactaatttttgtatttttagtagaatactaaaaatacagggtttcgccatgttggccaggctggtcttgaactcctgacctcaagtgatctcccctgccttggcctcccagaatgcttggattacaggcataagccaccatgcccagccctgatctcttatttttattaaagttttgaaatgccactccctaaaaaggttgcatcaatttgtaatgtcattagcaatgtgtgataggtctagttttatcaaacctttgtcatgtatgatatattaaaatctttatcttaacaacagaaaaaaagtagttctaagcttttacttacttgattagtaggactaatgaatattttgaatttctttttcttttttctttgagacctgagtcttacactgttgcccaggctggagtgccgtggcacgatcttggcttactgcaaccttcgcgtcccaggttcaagcagttctcctgcctcagcctcccaagtagctgggattacaggcatccaccaccacgcccagctatttttttgtatttttagtagaaatgggttttcactatgttggccaggctggtctcgagcacctgatctcatgatccacccgcctcggcctcccaaagcgttgggattacaggcatgagccaccgcgtcagcctttttttgaattttattacttgtatttcttgcgaattgcccagtcgtgttttgtccatggtttattggggtgggggcattctaactgtttcgtatcattaatttaagcttgttgtatgacatatttgctctaagaatttcacctcatttcattgtataggtaattatcttttgtgtagtgaaaagtcccattatttcttttagttcatttaagattttattcaattatttatagaagtagtaagataaatatttgtagataggtaaacaaagcattagaatttttgacttttagaaagtaaaatcatttgatttaatgtctatttttgttcattcctatttcctatctaattaatagaacacagtactgggaggaggaacaaaattttaatcatgatattgctgtttttcataataatctaggactagtaataagtcctctctttcatccagaaaatattgaaggccggatgccatcacctgtaatcccagcacttgaggctgaggcaggctgatagcttgagctcaggatttcaaaatcagtctgggcaaaatggtgagatcctgtctctacaaaaaaataaaaaattagctgcatgtggtatgcacctgttgcctcagctgtttgggagactgaggagggaggatcgcttgagccttggagattgaggctgtagtgagctgtgatcatgccactgcactctagcctggtagcagagcaagaccctgtctcaaaaagaaaaaaaaaaagaaagaaagtattgagaagttaacttatttcattaccttaatgaaaaatagttaaggccaggtgcagtggctcacgcctgtaatcccagcactttgggatgctgaggtgggtggatcacctgaggtctagaatttgagatcggcctgaccaacatggtgaaacctcttccctactaaaaatacaaaaatgagccaggcatgatgccgggcgcctgtaatcccagctaaaaaaaaaaaaagattttttccaaatacagtatttttattaaatcttattgagtagttttcacattggcaactctgtgtgtttctttctttttttgagacagagtttcgtgcttgttgcccaggctggagtgtgatggcacaatctcggctcatggcaaccttcgcctcccaggttcaaacgatactcctgcctcagcctcctgagtagctgggattacatgcatgcgccaccatgcccggctaatttgtatttttagtagagatggggtttctccatgttggtcaggctggtctcgaactcctgacctcaggtgatccgcacccccttggcctcccaaaatgctgggattacaggtgtgagccagccaccacacccagctttttgtgtttcatatgcatttttttttttttttgaaacagagtctcactatgtcgcccaggctggagtgcagtggcacagtattagctcactgcaacctctgcctcctgggttcaagcaattctcctgcctcagtctcctgagtagctgggatcacaggcgtgcgacaccacgcccagctaaattttgtatttttagtagagacagggtttcaccatgttggtcaggctggtctcgaatttctgacctagtggtccgcccgccttggcctcccagagagttgggattacaggcatgagccatcgcgtctggcctcatacattttctaaatgacttttgtaaatttttttttttttttgagacggagttttgctcttgtcacccggactggagtgcagtggtgcgatctcggctcactgcaacctccgcctcctgggttcaagcgattttcctgcctcagcctcccaagtagctgggattacaggcgcccgccaccacacctggctaatttttgtatttttagtatagatggggttttgctatgttggctaggctggtctcgaactcctgacctcaggtgatccacctgcctcggcctcccaaagtgctgggattacaggcgtgagccaccatgcccggccagtttttgtaattttaaagagaacaaaaatcctgagatggaaacttatgtagaattttattcatagttgaagttagttacagtggaaataaaaactagaaagttgcattgtatcttctaaacatatgtatttaacataatttcacatttcattatagatggttctttggaatgatatttaaaaattttgtggctgggcgcagtggcttacacctgtaatcttagcactttaggaggctgaggcaggcggattgcttcagctcaggagctcaactagtctgggcagcataacaaaaccctgtctctacaaaaaatacgtaaattatccagctatggtggcccgcgttagtagtcccagctactcgggaggctgaggtgggaagatgacgtgaacccaggaggtcgaggctgcagtgaggtaaaatcgcaccactgcactccagcctggacaaagtgagaccctgtctccgaaaaaagaaattgttataatgaatgaatagatttacattgttagtttagttttgttttttttctcagaagtgtagagtttgttcttagtctgtccatctgtatacaagcatgaactgtacagtcaactgccttgtagaggggctggtttttggttatgtcttaaatcttaactccttttaattattctgaattttagtgggattcctatatcattgtagatttggaaagtattgagtaggagatgataatctataatcaggattctgagttggtaagattttatagatctgaaaaaagtaatttcttgaccttggcctcaataagaaagtcagaacttgacccttatttaccagcaccatcccccccaccacaatatttaaagtgtttaaatcatttattttgaaattcttatgtgatccaagaccactgtgcatttaagctagtttatttgtttattaaaacaaaagaagtagactgcagttacgttgtttctttttctgttgtttggtgtcaggagtagaatacatttggccagcttcatgagaggattagaaagttggagaaggaaaaatagaattgtttacggagccaggagaataattgtctataattatagatgcttgttttgaggtttggaaaaggtggtttaaaaaacttttaagaaaaaacatgataaacatctataaatatgaggaagaaaaattggttgcaacattaaaaaaatttttttttgagagggagtcttgctctgtcgcccaggctggagtgcagtggcaggatctcagctcactgcaacctccgcctcccgggttcaagccattctcctgcctcagcctcctgagtagctgggattacaggttcctgccacgatgcccggctaatttttggatttttagtagagatcgggtttcaccatgttggccagactggtctcaaactcttgcctcaagtgatcagcctgccttggcctcctaaactgctgggattacaggcatgagccaccgctcttggccaggttgcaacatcttcattagacttgtttaaatgagaattttcctttgttaaatggaagaaaataggctctgtttgggagagtgaggcccaagtaggacatccttgatacacattgaagatctatttatttatttatttaaattttttgctctgcaaaattgaccaaagaatgaagatcattttagttggttaatatttcagttttgacttcctggccagagatagtagattggaaaggatttagagatttactgagggagttaacccaagattttaacattgtgatgcaaaatgatgttaaaacgcgttcgtttcccttttattatttaaagaaatcctagatttctttaaataatacaaagtaattaaatggacctgttgggttatttgaaattaagcagtagacaggggaagttcttgtaagtggttactaaagcgttaacattagaggcattctccactggctggctgtagcagagtccctgatctgggctttggagaaatccatcccacctttttttaggtgcctgctttacgtcggatctactttctctactcgtgccttttcttccaccttcttccccctcctctttctcatagatggtgtggaggtgggagagagggagggagagggagatcaactgattattgtgtgttgagggggtggggggtcagagattctctgggccataaaagttgcacgaaataaaatgctcttttttttcttgtgtgggccctgccatgagatcaggttgtcggacttgattgggagccacggatcccgccctactgaaaacattgttgcaggatgggatgggatgaagctgaaagtcttatcaagtggtattatatctggcacaacaaaaggccagaaccccaaaatatcctaaggataaaaagtttttgtttcttttcataggatatttttgtatctggtttggaaggatgacttgacttggattgtactgttaaagacaaaatgaactattgtatttattatgtatttaaccttattaaagcattaagtatgacagcactagttatagagaattgtgtgtgtatgcacacatatacacacatatacatatatacacacaccatatatatattttttttgagacttggtctcgctctgtcatccaggctgaagtgcaggagtgagatcttggctcactgcagcctcgaccttccaaccccagtgatccttccacctcagcctcccaagtagctggggccgtggggatgtgccatcaccaccagctaatttttttatcttttattttttgtagagacggcgtctctcgatgttgcccaggctgacctcgagctcctgggttcaagtgatccacctacctcaacctcccaaaatgctgggattataggcgtgagtcactgggcccggctgagatgtatatattatatatacatctcatatacatatacatatatacataatctcatatataaaaattatacattatatataatatttataatataatatatataaattaaaacttaaaaaaaattttattttatttgagatggagtcttgctctgtcgcccaggctggagtgcagtggcgctgtctcggctcactgcagcctccacctcccaggttcaagcgattctgctgcctcagcctcctgagtagctgggattacaggggtgtgcttccacacctggctaatttttttttttttttttgagacagggtcttcctccgtcgcccaagctggagtgcgagggcgcgatcttgactcagtgcaagctccgcctcctgggttcacgccattcttctgcctcagcctcccgagtagctgggattacaggtgccagccactatgcccagctaatttttttgtgtttttagtagagacggggtttcaccatgttggtcaggctggtcttgaattgctgacctcgtgatctgtctaccttggcctcccaaagtgctaggattaccggcatgagccaccgtgcccggcctatatttttaataatgaaatcagaactaggtttgtaaacagggaaagaacaaataatcataaaagttttatattctggatttggaagttggttgatttaagagtaatgagaataaataatatcccctccccctttagttctcaaggttttccacttagtttaagtagttttattagctatagtagagtaactcagcattttgaaatatttgtataatttgaaaagtctctgaaagaacactgtgattcgggtatagcattgcaagtttgaggggtttcaacagatttcttcatgtgtgtttaattccatgatgatttaaaaaaaaacccaagaaataaaacctctggtcacttaaccagcattttattttatttatttttattttattttattttttttgagacggagtcttgctctgtcacccaggctggagtgcagtggcgtgatctcagctcactgcaagctccgcctcctgggttcaagcgattctcctgcctcagcctcccaagaagctgggactacaggcgcccgccaccacacctggctaattttttttttttttttttgtatttttagcagacatggggtttcactgtgtggtagccaggatggtctcgatctcctgacctcctgatgcacctgcctcggcctcccaaaatgctgggattacaggcgtgagccactgcacctggcccacttaaccagcattttaacatatttcttctgaaaatctgattaccagaatttaattacattagaagaaattttttaaaaagctcataactattacgtagcaaatatgttttcaaagaacttgttttaaggtgggtcttggtggctcacacctctaatcccagcactttgggaggctgaggcaggtggatcactcgaggtaaggcgttcaagaccagcctggacaacatagtgagaccctgaccctaaaaaaaatacaaaaattagccaggtgtgatggcacattcttgtgtgatcccagctaatcgggaggctgaggtggaaggatcaggttgagctccggaggtcaagactgcagtgagttgagatggcgccactgcacttaagcctgggtaacactaagcctgggtaacagagggaaactctgtctcaaaaaaaaaagagagagaaacccacccagtttgatgaattagatgcatgttaagtgaaacagttttttagatagtgtagaattaacttcattatgttcacagttaaattcatattagactgttacctattctaagatatttgatattaaccctcaagggacattggctacattttttttttttttttttttaacaaaaccttgtagtttatgttagtggtctccaaactttttggcaccagggactagttttgtggaagagagttttttccacagaccccagggggagcacggagtggatggttttcgggtgaaactcttccaccttagatcatcaggcattagttaggttagttagattctcataagaagcatgcagcctaggtcccttgcttgtgcagttcacaatagggtttgtgcttctatgagaatctaatgccgctgctgatctagaggaggccgagctcaggttaatgctggcttgcctgccgctcacctgctgtgtggcctggttcccaacaggctaccgagtggtattggtctgcagctataggtggggggaaccctgagtacgataaactatcttctagaataatttttttaatatattgaagcagtagtgcctagtttataagtagacatatgtatagtataaactatatagtttatattcagagtacaaaatccaccttggccactatttttttttttctttttttgagatggagtctcactctgtcacccaggctggagtgcagtggcacgattttggctcactgcaacctctacctccctggattcagcgattctcatgcctcagcctcccaggtggctgggattacaggcacacgtcaccacacccacctaatttttgtatttttagtagaaacggggtttcgccatattggccaggctggtctcgaactcctgaccttgtgatctgcccacctcggcctcccagagtgctgggattacaggcgtgagccaccccacccggccaccttggccactattacaaaagtaaagctaaataatactgaagtatatgttccatattttgtaaggactgttgatttggaaacagtgtattctaacaagataaattttaaatgtaactaatagtatatgtttctgaataaatagttgctgcttctaatataaagtgtcatatttgttttaaaatcattgctcaagttgtatagttgttttgggcacgtattttcaacttctagaccaatacaaaatgtaaaataagtaaaagacgtgatatagttgtatcctttctaaacactgacctattttttttttttcctttgctaccttttttttttttttgagacagagtctcgctgtgtcgcccaggctagagtgcagtggtgcgatgttggcttactgcagccttcgcccctcgggttcaagtgagtctccggcctcagcctcccaagtagctgggattacaggcgtgtgccaccatgcctggttaagtttttgtatttttagtagagaccggttttatcatgttggccaggctggtttcgaactcctgacctcaagtgatctgcctgtcttggcctcccaaagtgataggattacaggcgtgagcctccgtgcccggcccctttgctacattttaatgataatgaaaatgtaatccaagtgtcagattattcagtagcttcctgtcttttggtttgtgggaagtttgatacgttattttttaatgtttcttagtcctttgttatatttcatggatagtggggaagtgagtctgtgacttgattgaaatatattgtacaatgcattcatctgcatcataggcacttggcttttaatggtaaagtggaaactaaacttctccttaggaacaatttgcactaatttatttaactgatattgatgatgctccataaagataaaaatgtcattgcatggaggcttacttgtgatgtaatttgtactttggagaagtaaatcatagtatgattttagatgttttattaacatctaaaatgtttcagtttctgtagtagaatattgttaaataaaatggtaaacactgtaaaccttaatactccttcccaagaagaaaccattaccaccactacctcttctccctccaaaacagaaaccattaccacctccacctctaacaacagaaaaaaaaaaccaaaaaataaaaaaacccttttttggccccacaccttttttggctcacacctgtaatcccagcactttggaaggccaaggcgggatcctcttgagaccaggagttcgagcccagcctgggcaacatcaggagacctcatctctactaagaaaaaaaaatggctgtgtgtcgtgatacacctatagtcccagttatttgggaggctgaggcaggaggatcacttgagcctaggagttcaaggctgcagtgagccatgattgtactactgcactccagcttgggcagcccaggaagactgtgtctcaaaaaacaaacaagaacacctttttaatctgttaactcatggtttgtttaagattttcttttagccatttttgatgccttttttttttttgagacaggttctcactctgtctctcaggcgggagtacagtggtgtgatcatggctcattgcaccctggacttcccagaatcagatgattctcctacctcagcctcccaagtagctgggactacaggcacacaccaccatgtccagctaatttttgtattttttgtagagactgggttttgccatgttgcccagagtggtcttgaactcctgggctcaagtgatccacccaccttggcctgccagagtgctgggattataggcatacgccagctgcacccagcccatttttgatatctcaaatctttcatcatagtttagtcagccatatttttcctagaatttttttaaaaactattttgtcttgctatcaagctattactctgtagttttacatacattctttattttaactaaactgttatgagcaataatttgtgataacttttttttttttctgagacagagttttgcttttgttgcccaggttggagtgcaatggcgcacatgatcttgactcactgcaacctctgcctcccaggttcaagcgattctcctccctcggcctcccgagtagctggaattacagccatgcaccaccatgcctagctaattttttatttttagtagagactgggtttttccaagttggtcaggctggtctcaaactcccaaccttgggtgatctgcccacttcggcctcccaaagtgctgggattacaggcgtgagccaccgcaccctgccaatttgcgataactttttaatctttttgtatcgtgtatttaaacttttaagttcttttccctgtcaatttctgacagattgaaaaataataatctttatattatttaaaagcttcttctaaaaggtacaaaggaaaaaatagaatgcaaagtgaactaggcagcgtgtagtggctcctgcctgtaatcccagcactttgggaggccaaggtgggcagatcacatgagaccaggagtttgagaccagtctggctaacatggcgaaaccccatctctactaaaaatacaaaaattagccaagtgtggtggtgcatgtctataatcccagctacttgggaggctgaggcatgagaatcacttgaccctagaaggtggaggttgcagtgagcagagatcgagccactactccagcctgggcagaaaaaaaaaaaaaaaaaaaaaagtgaagttaaactaaatttagatctgttgagtttgaaatgatggttgtatatacctctaagatcagtaaaacctaaatcaatctagagaacaggtgttaaagatacatttttggtggggtgtggtgcctcatgcctgtaatcctgccattttgggaggccaaggcgggtggcttgcttgagctcaggagtttgagaccagctgggcaatatgaagaaaccccatctctacagaaaatacaaaaattagccaggcacagtgctacacgcttgtggtcccagctcctcagaaggctgaggtgggaggattgcttgagcgtgggaggcagaggttgcagtgagctgagattgtgccactgtactccaaactgggcaacagagggagaccctatctcaaaaaacaaaacaaaacaaaacaaaaaaacaaaaaagattttcatgctctggtaaaataagtattaaaattaggaaactatggatgaattgaatgttttggtctggtcgaagtactgtgcattaaatttttggttacattttactttgataagcagtgacggttcagtaattttgatgatagtctatacatcatgtaacttgacttatttagttgtcaacaaatatcttttttttttgagacctgagtcttgctctgttgcccaggctggagtgcagtgctgcgatcctggctcactgcaacctctgcctcccggattcagattttcctgcctccgccttctgagtagctggattacagatgtgcaccaccacgcctggctaatttttgtatttttagtagagacagggtttcagcatgttgaccaggctggtcttgaactcttgacctcagaagatctgcccacctcggcctcccaaagtgctgtgattacaggcgtcagccaccgcgcccggcctagagataccttttaaggtggttctaaagcctcagaaattatttatcctgaagagaaagattaaagttttattcattgcattatgagggaaagtttaggcagagtatcttatggttttgtttttcattaaaagatcaatgttctttcagattttaagtccatttaaaaactttgcatagtaatatatgtacatggttgaaaaaagtctaatagcccagaatgcttataataaggatcaagaattctgtttcactccttattgccactctccaaacaacttttttgtatcaatttaagggttacaggtgcagttttgttacatgaatacattgcatagtgctgcagtttgggcttttagtgcatccatcatccaaataatgtacgtgtacccattcagtaatttcttgttactcaccctcctcccagcctcccaaccttctgagtctccagtgtcgttattccacactgtgcccacatgtacacattattttgcttcaacttataagtgagaacatggcctccaggtccttccatccttccacgttgctacaaaagacatgatttcattcttcctttatggctgaatagtattcgtgtgtgtgtgtgtgtgtgtgtgtgtgtgtgtgtgtgtgtgtgtatgtgtcccagtttttctttatccagtcgtctgttgatggatatggagattgattccctatctttgctattgtgagtgttgctgtgataaaggtacgagtgcagttatctttttgatataatgatttattttcctttgggtggatacccaatagtgggattgctggattgaatagcagttttattttttatcatttttacttttttgagatggagtttcgctcttgttgcccaggttggagtgcaatgacatgatatcggctcagtgcaacctctgcccaccaggttcaagtgattctcctgcctcagcctcccgagtagctgggattacaggtgcacaccaccacgcccagcaaatttttgtatttttagtagagacagggttttaccatgttggccaggctggtcttgaactcctgacctcaggtgatgcacctgccttggcctcccaaagtgctgggcttacaggcgtgagccaccgtgcctggccagcagttttattttttagtcatttgagaactctttatatggttttccatacaggtggtactaatttacattcccgcccacagtgtgttaagtgttccccattgtctgcatcttccccaacatctgttattattattgtttctttaatagtggccattctgattggtgtaagatgatatgtcattgtggtttttatttgcatttcctcgatgattagtgatgagcatttttttcacatacctgttgactgtttgtatgtcttcttttgagaaatgtctattaatgtcctttgctaactttaaaattcttaaaaattttttattaaaattttttcttaagaccagttaagtgcagtagtgaaaggggagtaaagagtatagaacaaggaatttgatcggtaactgacagtgaaccatcaattgggataactcactaccagttatcagtagtgaggtattcagaacagccctttgcttactttttgatgggattatttgtgttccttgtaaattctggatgttagtaccctgtgagatacatagtttgaaacttttttctcctattctgtaggccatttgttcagtctgctgattcttttgctatgcagaagctttttagcttaagtctcatttgtctatttttgttttttttttttttgcttgtgcttttgaggtcttagtcatgaattctttaaattcatgaattcttagtcatgaattgtatagatcagtgtccaggagagtttttcctaggttttcttctaatggtttttatagtttcaggtctttggatgaagtctttaatccttcttgagttgatttttgtatatggtgaaagataggggtccaatttccaaaggaaactttcaaattatttcttcctgtggtattgtcgtgactatataatatacatatgttatgatttatgattgatttctgctctgataaaggaggatttggcttctttacatctgcttccccaatagattttttaaaaatcacttttaatttctctgctagttatctctgcagtttatatcagaactttccttcatgttatatagactgttgatcttgatgtaccaagcagtaacttttgtttgtttgtttgtttttttgagacggagtttcactcttgttgcccaggctggagtgcaatggcgcgatctcggcttgctgcaacctctgccgcccgggttcaagcgattctcctgtctcagcctcccgagtagctaggattacaggcaggcgccaccatgcctggctaattttgtatttttagtagagatgaggtttcaccgtgttggtcaggctggtcttgaactcccaacctcaggtgatccacctgcctcagcctcccagagtgctgggattataggtgtgagccaccacgcccggctgcaactcttctttttacctttccttttccctttatgtgcttacatctgtcatttctgacattgacattgtcaaggttgagaacagttatgcgctgtattgtactccttactactttgtttgtttatttatttatttttttgagacagtcttgctctgttgcccaggcttgagtgcagtggtgcgatcttggttcactgcaacctccgcttcctaggttcaagctattctcctacctcagccttccaagtagctgggactacaggtgcgtaccaccgtgcttggcaaatttttgtatttttagtagagacggggcttctccatgttggccaggctggtctttaactcctgacctcaactgatccacttgcctcggcctctcaaagtgctgggattacaggtgtgagccactgcacctggccggtatgactttaatacttgaaagttaatgggctggacgtggtggctcacacctgtaatcccagcacttcgggaggctgaggcgggctgatcacctgagggcgggaggccgagaccagtctggccaacatggtgaaaccccgtctctactaaaaatacaaaaattcgtggtggcgtatgcctgttatcccggctacttgggaggctgaggcagggagaattgcttgaaccccggaggcggaggttgcagtgagccgagatggtgccattgcactccagcctgggtgacagagtgaaaaaaaaaaaaaaaaagttaatgaatagtttctacattattatgatcatgtaatatttttcacagcagaggcaagtagtatgtaattacatttctttgtattgtttcttggtttttgaatctgtaactgcatttttcttgtcatattttcacgattcattttatcaatctttttctgtggtttgtcattattacttattttatgcatatcaagtccctcccaccctcccctgctttcccttagtcctatttccttcagtttgggctagaagtatttagacctgttgccttgtttttgtgctgaacttttccttactctttttgcacagtgctactactgttattagagctttatcatttcttgagttactaacttgttttaatgcagtacacccacataaatagctaagaaagaatatgtgagaaataaagttttgaatccttgcttatctgtaaaagtcctcattagcccttacagttgactggtattattttattcaagtgcaattaagctgaaaattgttttccctcagagttttgaagggattgctccagtgtcttctatgtccattgttgttggtgaggaaaagtcggatactgtgtgattcttcttcctttgtgggtgatgtgtttcatattttcatccatccctttagagccttcttttatcctcattaaactgaaatttctcaaagatgtccagatgtgttttcttctccattacaataagcaaaatactttatgtgcttcacttcttgaaagttttcatgttacggctttagtgatctttcttttttttatttttttgagacggagtcttgctctgttgcccaggctggagtgcagtggtaccatcttggcacattgcaacctctgcctcctgggttcaagctattcttcttcagcctcccaggtaactgggactacaggcacctgctaccacacctggctaagtttttgtatttttagtagagagggggtttcaccgtgtttgttagccaggatggttttgatctcctgacctcgtgatccgcccatctcggcctcccaaagtgctgggattacaggcgtgaacccccacgcccggcctctagtgatcttttctttgttttctctatagctgcttttagttggattattagacttactgaattaatcctccccaatatttttgtctgtttgtttgtttgtttttttttggtctggccatctcttctactttatttattcttggaccttttaattttatattggaagttatattttaaatgtttgagatttctccttcatttcctcccccgccaatatcttttctcattttatggattaataatcttcttgagtctctgaaaatgttaataaggtttattttttttttaaattttgttgccctccctcttacctgtcaactctattgtaatttttgttgttatcttagtctcatttatattgtaggcttttaaccaaatatctgctgaccttggatatcactcagctttaagatttagtagaagggttcacaatgagctcttggtgggaattaatggttggcaggcaggctttactttagggttaagctgttaattagtcttttgtattctgacattcaagagtccattgttttaccccaaagtgccaactcccatgctaggttcactagtttcctctctcccagactccagtttctttactttagaagagatctctttccattaattttactttgttttttaataataatttggctttaaatttttttaaactactgtttaaaatggtcttttgctgaagagagataaatgtatatgtttgatctgctatttgagccagagaatctctttcagttctcaaactggactagaccaaaaactaataattatttagatatttatttatccagtgtttcagaatgtgttaggttgtagaaatataatagcagctttaagtggtgtaggaggtgttttgcgtgtttataaaagcgagtactggctgggtgcggtggtgagcgcctgaaatcccagcactttgagaagccaaggtgggtggatcgcttgagctcaggagttggagaccagcctgggcaacatggtgaaaccctacccctaaaaaaatcccacaaaaattagctgggcttggtggtgcgaacctgtagtcctacctactcagaggctgaggtgggaggatcccttgagcccaggaggtggaggttgcattgagtcaagattgtgctgttgcactccagcctgggtgacagagctgaaaccctgtctccaaaacaaaactgagtactcattatgtgtgttaagccttttacagtatgtggaagattagaagatgtcacataaaaagttatgaatgtaatacattctggtaaaaataaagagcacaggagggcataacttaaaaagtaaaaggggctgggtgcagggggctcacgcttataatctcaatacttgggaaggccgaggtaggaggatcacttgaggccaggagtttgaggccagcctgggcaacatgtgtttcactgggtgacagagtgagcctcttatctaaaataaaaaacaaaaaatgtgaaagaccctcttttccctgttttgccccacatttcagagacaattactgtatccttgacttttgttatgggtatacctttgctatttctatgtatgtgtatgtacttatatccatttttatgataatgggatcatttaatttatatcgtgatttgattttgtcactttgtggttgatcttaggcatctttccattttagcttatacacatctatctcattcttttcaaaatttatccaaagatatgaatcacgtgcttaatttgccaaggagtgttttaggtgtaaggattcagtggtgaaccagagagaccaagctcctgcccttatggaacaatatttcaacggtgagaaacacaaaataaatgcatttctcgtaattagtctcaaatactgagaagtgctatgaagaaaataaaatgtggtactgtactgagtgtgtctgttaatggtatgagagagaacgcatgtggctaaggtggtcaggaaggtctgtatgaagtgatggcattgaaacacacgtgaatgatgtggaggcattttaggaagagcaggatttattgtgaagactcaaaacaagaatgagtgttgtattagtgcgtttactgctgataaagacatacccaaggctgggtaatttttaaagaaaaagaagtttaatagactcatagttccatgtgtttggggaggcctcacactcacagcagaaggcatgtcttacgtggtggcaggcaagagagagtgagtaccaagtgaaaggtgtttcctcttacaaaactatcatatctcgtgagatttattcactaccaggagaacagtatggggaaaccacccctatgattcaattctttcccactgtgtccattccacaacacgtgggaattatgggagctttaattcaagatgagatttgggtggggacactgccaaaccatatcaagtgtgttatactcaagggatcctcccatctcccaaaataaacgattggtgttactgtgcaatgaggggaacttaggagaccatatttgagaggcaagcaggagcccaagcagtgcccttcacaccgtggtaagaagctgggattttatccttagtgcagcaaaagcccttagaaggttataaaccagggcacccataaggctgtgaaagtaaccttgacagatatggcttagagtagagtgatggcagaggagaaaggcaatcagaagtgtttggaaagctcaggaggctgaggcaggagagaattgcttgtacctgggaggtggaggttgcagtgagctgacatcaagcccctgcactccaacctgggcaacagagtgagactccatctaaaaaaaaaaaaagcttggaaagttacagcggtaagatctgctaaaggatttgatgagatggatatgagataaagaagaattaaaattgtcttctagatttgtggcttcagtagttgagtggacagaaatgtcatttacttagattagagattgatcttagtggagaaacaggttttaaactagattgaaggccctctgattagttaaaccattcccctactgatggtcatttagttgatttccagttttattatctttgtaaggaatatccttgtacttgtgtatttgtacgtgtggacatattctggaagataaattcctagatgtaaagttctctcatcgaagaggacagtacatatgtttcaagttttgatggatattcattagttgccctccaaaagtgaggtgttggcttggattcccccaacagagtatgcctttttcctggcatcctcactaacaacatacctggtgggagagaaagtaggcagggcctacatttctgaaaatgggagtgggagttctaatagcattttttctttactaaatcactttggcactttgttcctagaatgaaaatcagcaattgtcgttttctttttggtatccctaaagtcataacatgtctctggccatagttttttccagttactaatcatatagctgttggtcagtccttctaggcttagtggtatttatggagcctttcataataattatgagaattacaatgaaaatgaaaactattaattggtttaatgtatgccaagcactatcctaagtgctttacacgtactatattaatttatttaatcctcacaacaacctaaaaagtaattactgttattatctcgatttcttgaagtgagacagaggatgtccaccaatctttgtcttttcatttatgtattttttaattaatttttttctgtcaaaatatcttttgggaagtttggcgctgttacttgaataccttttgtcagtagttgtgggtcagaatccaaacacagaataaatggcaggaaaaggcacattcagtttaggagaatgctctgcttatgggtgatagtgtttgtaatgctttgggttttggttttcagaactgcctatgttcaaatcccagcctcacacttagtagctgtttgatttggggctgatcattgatctatttttgtagctcagtcttctgagctttaaaatgggaaaacaaggttttgtaggttgtaggattgttgcgggcagtaagttacacatgtaaaagtggccagcacaagaggaagcactttatcagcatcaactaatatttttatataattggctaagagtgggcagtcctatctagcactcaaagtgtggggaaaatactggtgataggatatcacactcttactgagttatatatattaatatttaggtataaaacttagaaagtggggtggttcacgcctgaggctgaggcaggcagatcacttgaggtcaggagtttgagaccagcctggccaacatggtgaaaccctgtctctactaaaaatacaaaaattagcctggcatggtggtaggcacctgtaatcccagctactcaggaggctgaagcaggagaatcacttgaacccaggaggcggaggttgcagtgagccaagatggcgccactgcactccagcctgagtgacagagggagactgtctcaaaaacaaaacaaaacaaaacaaaacaaaacttaaaaatggttaggcactgtggctcatgcctataattctagtactttgggaggctaagacaggaggatcacttaagcacaggagttcgagaccagtctgctgggcaacatagtgagacactgtctctaactgggggggggaaagaaaagccaggtgtgcggccacgtgcctgtagtcccagctactcaggagtcgagatgggaggattacttgagcccaaaaggtcgagaatgcagtgagtcatggttgcgccactgcactccagccggtgcaacagagcaagaccctgtctcaacaaacaaaaaacccttaaaatttttttaatgctactattgttgtaatgagtcatattaagtgggattatacatgtaccaaacttttattttttcttgagtgagattatttcatggttattttaattggcatgccttacgattgagttaaattgattatatttgtcacttttttttgcaaactgcctaccagtaccctatttcgggtactttgcagcttcaaataagaaaaattttaattaaaaatgcattaaaccataaataaaatttacctcacatgactggaagtccaggtgtaattcagtggctcaattaaattatcacggacctagatggttttcattttcctgctgttttatactcagcttgttgtcgatagttgctaaattaattcacttaaataatcatttaccacctaaaatgtattaggcagtagtccataagcacgggaaatacagcagtgagcaaaacaaagttcattgccttccttcacgggcttatattttagtggggataagggagaagacagtcaaacaaataggtagaatttatagattgtcagaagatgttaagttttatggaaaaaaataaagccatggaagggacgggaagggctgggttggattgttttaagtggggccatcagagaaggcctcagtgagctgatgtttgaatagaatcttaaaagaaataagaatgcaaaggcagatatttggggaaagagcattgctgatgcggggaacagtgagtgcaaaagccccagaggcaggaatgtgcttagcatgttcatagaactgaaagggccagtgtggcaggagctgagttatggagaaaacatcataagagaagtagcgtggggagtcagattgtgcagggccttgtagaccattgtgagatcttttgacttttactctggattagatgagagtcctttgggggcttttaagtggaggactggctttatctgaccaagactctaaaactctcatgctggctgctgtgttgagactagaatgaaggagatcaaggaagaagcaggcatgttagataatattagcagggtaacagatgatttgaagcatgataggcatcagagaaatgttgaagtaattctgcatatgttgaggcagagccgaaaagatttgttgagggatgtggcatgtgagaaaaagaggattcgtagttcacaccaggttcaatgaccagtaaagatgaagtatatttgttcatgcacatctattttatttggaattaaaaacctttcctggaagcccttagcagattttttttttttttttttttttgagatggagttttgcttcttgttgcccaggctggagtgcaatggcacgatctcggctcactgcactgcatcctctgcctcctgggttcaagcgattctcctgcctcaacctccccagtagctgggattacaggcatgcaccaccatgcccggctaattttgtgtttttagtagagacagggtttctctctattggtcaggcaggtgatctgcctgcttcagcctcccaaagtgttgggattacaggcatgagccaccgcgctcggccaacagatttttttcttaaatcccatcagccgtgattggtatccatccatgtcctagatacaagtgagggtgagagagcaaggatgttccttgcagccatgataatgggaagtggactctgtaaggaacaggttgtgagtggggagtggctattggttaggtaactaatagtctgtttgtcattgcccatttttctgttaagtcgatcatcctttttaaatgatttgtaaataatttttgcatgctaagaaagtaagtatttgttatataattctagattctaaatattttggagctgtaaatgaggttttaaactctgagatcagttttctaattttgaaataaagtgaatctccattgaaatttacaagtaggggctggtgatcgcagagtccaatgcataatttatagtttttcctattctgggtgcagttgtcattttaacctgaatgccaggtagttatctttataaaactatcatgtgtgagttatagaggtagcattggggtggtggaaaaaaacaaaacaccacttttgaggtaggatctcactctgtcacccaggctggagtgcagtgatgcagtcatggctccttgcagcctcaacctccctggctcaagtaatcctccctctactcagcctccagagtagctgggactacaggtgcataccaccacacccggctaatgtttaaatttttagtagagacaagatatcactatgttgccctttcttccttcaaaaaaagctgataaactggcttattatataacaaggaattctcattttattttacttatattgtattattgttctttaatttcagtgatgtgaagcagtgttttttggaggttttgagtgtgagctttctcatcagatactgaagagtttttgagccttaactccattacttaattagctgtgtgacccagaccacttcattgtacagctccgttcttgttgtgctggggagggcattcacacaaaatacaatgaaattgtgcttcctggtggttctgatgtgactttaggcaagttcattaaacactgcgctttcaataagataatgcatgtggaatgctgagcacagtgcctttaagacactgaaggggatatgagaacagttccatagcccttcatttttacttttgattaagagttgtttactaataactaactaggtgagttataaatggggaagtagggtcattgtgaagtggctatgaaacagcatagaggatatattttaaaagctgtatttttactacctattttcaaactgcatatttcattttagtttggagaactttactgaaaaataaagaagtagtagtatgtgagtttggatcatttctgtggttaggtggtggctacactaaggcctttccaattcttggtcctgtgagaggtaggtagggttgtggggggtaggggagaacagataaatgagatacatttatatttttttgcatggtaacttataaggcattgccaagagagggaattcactgcaggcaaagaaaaatataaaacatagtgtatatagggctttgtagcatccgtggtttcaggcatttatgggagccaggcaggggtagggtatggggttgaaatgtatttcctatggataagcacaggactactttatatcacttaatccaagacccttttactggtgaggaatccagcatttaaatttatgtatgtatatgataaagctagaatttttccagatctgagactcaaagctctttgtgttttcgtttatactccagctcttttgaggagctttaaagtctagttacaaagacaggaaaaacaagaacggccacagtggctcacgcctgtaatcccagcactttgggaggctgaggccgagaccagcctggtgaatatagtgaaaccccgtatctactaaaaatacaaaaattagcccggtgtggtggtgtgtgcctgtaatcccagctactcaggaggctgaggtaggagaattgcttgaacctgggaggcagaggttgcagtgagctgtgccactgcactccagcctgtgtgccagagactctgtgtcaaaaaaaaaaaaaaaaaaaaaggccgggcatgcagtggctcatgtctgtaatcccattgctttgggaggccaaggcaggcagattacctaaggtcaggagttcaagaccagcctgttcaacatggcaaaaccctgtctctactaaaaatacaaaaactagctaggcgtggtggcaggcaccataatctcagctactcgggaggctgaggcgggagaatggcttgcacccgggaggcggaggttgcagtgagctgagatggaaccagtcagtgcacttcagcctgggtggcagagcaagactgtctcaaaaacaaaaaaacaaacaaaaaacaaacaacgacaaaaaacctaggaaaaacatacatgcaacagaatgttaaagaggagattttaaggctttttttttttttttttttttttttggagacagtctcactctgtcgcccaggctggagtgcagtggtgcaatctcggctcactgcagcctccgcctccctggttcaagcagttctctgcctcagcctcccaagtagctgggattacaggcgcctgccaccatgactggctaatttttgtagttttagtagagacggggtttcaccatcttagccaggctggtcttgaactcctgacctcgtgatccatctgcctcggcctcccaaagtgctgggattacaggcgtgagccgttgctcctggcagagattctaagttttttgagaatagtgactgtatttcttgggtcatggctctatcttatacatctggcacagtgtgtgtgtgtgtagcaggtgtctaatatttgttaaacacacatggtccttaatatcaaacggcatgggatttaagacatgaacttgggtttgagtctcagcactttcatttcttagttgtatgaccttgaccatttaatctgtttgatcttgaatgtccttatccgaaaaataggggacatactaattaacatctattgtgatgggttgtaatgagaattaaatgataatgtatacaaaatacctaacttgattggatttgtggtactcagtagctataatgaccattttaaccccaatatgagaaggattcactcatcacactgttgtatacttcgtagctattacttctttaatccccaaggacttgtttaacaaagtgttcttcagtttctacttcctagttcctttgtggaactggtaaaaatttaaaatatcttaacataatattttatttcaaatgataaacagtaaggtaaaatgtggtttttcttggacaacttatggtagaatgatgtctagaatatttagttatgtcatttaatactttttttctttacaatttaaaaaaaaatttattttattttagattcagggggtacacgtgcaggtttgttacatggctagattatgtaatgccgaggtttggcctgctagcgcagccatcatccaaagtgaccctagtacccaataggtagttttcaacctgtgtgcctcctcttctaccttctcttttggaatctctagtctattacttccatctttatgttcacatgtactcattgtttagctcccacttacaaatgagaccatgtggtatttgattttctggttctgagttacttcttttaggatagaggatgaaaaagagtgtagcctccagctccatccatgttgctgcgaaggacatgattccattcttttttatggctgtatatttttacctttttttgcgagggggagaggatttaaatatggaccagcataatgaagaaaatgtctgtaatcccactattcacataacccctgctagtttaaaaaaagttcgtgtaggccgagcatggtggctcacacctgtaatcccagcactttgggagtccaaggctggaggatcacttgagcttaagagtttaagaccagcctgagtaacatagtgaaacctcatgtctacaaaaaaataaaacttagccaggtatggtggtgcatgcctgtagtcccagctacttgggaggattgcttgaggccaagagttcgaggctgcagtaagctgtgattgtgccactgcactccaccaggtatttaaaaaaaaaaaaagtaaataattagaaaatttaaatagtgtaaactagaggcctctcctatcagtttgctagagctaccataacaaaataccacaaactgagtgacgtaagtgacagtattttttttttttttttttttgagacggagtctcactctgtcaccaggctgcacgatctctgctcactgcagtctcggcctcccaggttcaagtgattctcctacctcagcctcccgagtagctgggacttccagtctccagaattgagaaatttaatttcttttaatttaaaaaaattaagagtgacagttggctgggcgcagtggctcatgcctgtaatcccagcactttgggaggctgaggcgggcagatcacgaggccaggaggtcgagactatccttgctaacacggtgaaaccccatctctactaaaaatacaaaaagttggtcgggcgcggtggctcatgcctataatcccagcactttgggagtccgaggtaggcggataacctgaggttgggagtttgagaccagtatgaccaacacggagaaaccctgtctctactaaaaatacaaaattagctgtgcatggtggtgcatgcctgtaatcccagctacttgggaggctgaggcaggagaatcgcttgaacccgggaggcagagattgcagtaacccaagatcacgccattgcactccagcctgagcaacaggagcaaaactccatcccaggaaaaaaaaaaaagtctaagtagtccccaaaacataaaatttgagcctaaaataagaactgttttaaaattttaatatattgtgttttttcgccatacaatcccaggtattcttcaggttagaactcagtttcacaaaaaagggtgtgcttgaaaagcttaccaaaatctcctgattagatacttttttcgtttgtttctgtttttttgagacagtctcgctctgtcgcccaggctggagtgcggtgccacaatctcggcttacgcaacctccgcctcccgggttcaagcgattcttctgcctcagcctcccgagtagctgggactactggcacacaccaccatgcccggctaatttttgtatttttagtagagacggggtttcaccatgtcgacaagtctggtcttgaactcctgacctcaggaggtccacccacctcggcattccaaagtgttgggattacaggcgtgatccaccacgcctggccagagcatacttatttatttagcaggtgtggatatgtgtatttaaacagacttacttgtaaatagatgtataaatgtatacccataatgaatgaaattaatgaaattatatatatttatatattcattataagaggttacaatttttttattttatttttatttatttattttttttttttgaagaggttacattttttccccccagcctagaaagcttcactgcataacatgattatgtgggaatttcagagttggatcactttgcattactgtaaatgatagagctttaaagtattttttattctaaaggtatatgtgcttttcataaattcaaattctaagaaaaggtatacatcacaagttcagttttactccccagaggttatcactggaagctttttttgtatatttttctagatgtttttggtttgtagataagacgtgtatgtatgtagaaaaaaatacagacataggcatatatattctttgaaaacaaatggaattaggccgggcgcggtggctcacgcctgtaatcccagcactttgggaggccgaggcgggcggatcacgaggtcaggagatcgagaccatcctggctaacacggtgaaacccggtctctactaaaaaatacaaaaaattagccgggtatggtggtgggcgcctgtagtcccagctacttgggaggctgaggcaggagaatggcgtgaacccgggaggcagagcttgcagcgagccgagatggcaccactgcactccagcctgggccacagagcgagactccgtctcaaaaaaaaaaaaaaaaaaatggaattatactataaatactgttttgtcacttttttttttggcatactagtatatgttatacatcttttcataggtatattgtgattaatgtaggtgcagttcagtaatgattgaaatgaagttttttcattatattctatttttgaaaaattaccaataactacatatataactgaaatcacatcatgtaactgtcagtataaaggaatggctcagataaaaccaaatagaagttgtatatttaatatttttaataattttaatatttaattaaaaagttaaaacttgtactacatggctgtttattagggtaaggaagtatgatctctttaatgtacatggtatttaaaaaatatcttattctggtgtgtcttcttgattgtaaaaccccacttaacattttgggctcctatttatatctttttactttaaagtaacactattctgtggttattcttatggcatattaaagtgatattttaaggaatacttaacaaaattctatataaaatgtatctactctaagttagaaatcttggtgcccttactggtcttgtgatcttggaagtcacttaagatcccgagctctgtattaagacagtgctggttcaagttctggatctaccattgagtaattgaccatgactttctttatacttcagtttcctcaactgttgaataggaataatggttgttgtgatgagtccataaaaaatacagtcttactgactttatggtggccgaaatttcaagagtaacacagtaacagttaagtcatactgggactcaggctaatcttttctccgttgccctaggcattgatgtccacctggcaaatgagggtgagaagcggtgagggattgcatgggaggtttggggacaaggcctgggagtagtacagaggcatctttcacttttgcccacatttcattgtccagaccagtcatgtgaaagggaagctgggaaatgtagtttagccatatgccaggaggaaaaggaaacgctttggtaaatagccagtttttgccaccagtgctaagcacagttcctggaagatggttttcaagtcattaagcaagtcacttttcacctctccaggtccgtgtttctttctgtaaagtgggaagggggatgataatgaaaacttctatgaagcactgttttgggagaactatatgttataaccatcttaactcacttaattcttacaaaagtcctctgaagtaaagactactattgtccctttttttttttttttcttttttaacagctgaggaagctaaggctcagagtgagtcatggacacaggatttgaacccaggcagtcttttctgtagggtctgtgcttttatttatttttatttttattaattttttttttttgacggagtctcattctgtcactcgggctggagtgcagtggtatgatctcagctcactgcaacctcgcctctcaggttcaagcacttctcctgcctcagcctcccaagtagctggtattataggtgagtgctaccacgccaggctaatttttgtatttttagtagagtcggggtttcactgtgtttgccaggctggtcttgaactcctgacctcaggtgattcacccgcctcagcctcccaaagtgctgggattacaggcatgagccactgcacctggcctcaggcataatgtgatatcgtttataaatattagagaatgtagttctaaaaagtgaaggcttaagaaaaacctaataccaccatcatacttaaaaaaaaattgacagttaaatccataatatcatcatattctatgttcaggtaaacacgtctcaattttttttttttttttttttttttttttttttttttttgagacggagtctcgctctgtcgcccaggctggagtgcagtggcgggatctcggctcactgcaagctccgcctcccgggttcacgccattctcctgcctcagcctcccaaggagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaacacgtctcaatttttaaaagtatttgaataaggcttacttattgcgattaagtgtcttaatctgtaggataccaccttcctttttattctcacaatttatttgttaaagaaatgggttatttgccctgtagagttcctgtagtcaggattttgctgattcctgagattcaataccaggtttatccccgatgtttctctattttctgtatttccaaatgagtagttagaaccagaggcttggtcagagtcaggttcagtcttattttataagactgcttcttatattgtggtgcattctttcatcaggaggcacaaaatatggttgtctctttttgtgacattagcaactgttggtgactaatgcctagatctgttgattcattaagagttgtaaaatgataatgttctagttgtgttactccttcattttattatctggaatactgttttataaaaagaaaagtttccatcacctcttacttggttgcccagtgtaactgttcatatgggaaaggcagaataaatgtttgcttgtttacctttctttaccagtttccagtgtaatcagtaggttcactgtattttccagctgtgattaataaatttttaaaattattatttttaatgtatctgttactgtataggacagtatctggaaatacccaaagacaagatctctaaaggagtcatcggctagtggtggatcagtgcagcgtggtggtggtggtggtggtggtggtggtggtggtggtggtggtggtggtggtggtggtggtggtgttatgcacatgggggataatatagcagaggcatttagcttgaaatcaggaaagagctctggagttatccttgagctgcattttgaaggttgagtagcagtttgctattggaggaggtagaggttacttttcaggcagagggagcagcatgtgcaaaggctctgagatgtgagagtttgttactgaagaaattcagtagggctggaagctcagtgagcttggtgcgagagagtcaagagatgaggctttagaggtagtatgggttttaagtcattccaaggaatagttttgatttaactctgaaggccatggagagacattgaaaggttttatccaagtgaatgatgtaaggaacaaactgtggaactcttggggcagcactgaggagagtgactcatgatgccccttttctgaactgcttatacagatttctcattcttggcattactcctgattcctccttcatctacatgcacacgcgcctacacacacgcacacacacacagacacacatgtctgcctctcggatctccttctagagtcttagttcttgttttttttttcagaatttgggcaactaacaaggctagaaaggaggccatctaaaaaagtgattggtgttgaaaagttgctgctcctgtcctagcagcacaactcttcacgtcatagtaataggagtaatgacgatgatgagtgtggacaactaatgagcacttaactgtagtaccaggcactattctcagaattcattagtgtgacaaccctctaaggtagggtctgttatccccattatacagatggggcagaaacggcagggagaagttaagtgacttgcttaaggtaataaatgtagtaagaagcagaggtgggattgaacctaaacagtctgcatctagagttcatgctcataacattctatttattgcctttctggttttatgacccccttcttatctaagtgtatgctctgtgccccgcatatacaaactagttcccataacatgtgtaatataatccctcctttcccagggtttcccggcttcctgtccttccccttagctttctatcatcagtttttcctaggatttctggttcagcctatgtcaaagtgagagtcaccaacatagttgatgataaatactgtttgattacaggaatgtaggaagatgtgcaagcattctactaaaaatgcttttcccacagataatgtaaactaaggttgcttaggttttgtaagactgccattcaactataaataggccttatgtatgtttactaaatcagaaaaaatttaatgtagctaaattttaaataatcaacaacagaaaataaaaatattttgccccaccatcttaaggttacaagacttagaggtatattttatttacatgcatgcatacacacacacacacacaaattatatatagatgtgtggaaaatatagaaaagtagaaaaatgtatacaaatatttgaaatacattatgtggaatcatgtttgtatttttcttagcttaggaaagaaagccattaaaagagttacatgtcaataaccatgatactataggattttagtagttgcagagtattacattacttaaataaatgattcatggaatagtctttttttattggacaaggaattttcccctccacctcaatctttgagagttagaaacaatgcagagatgagtgtctttatagttaaacctttgtacattttataatttactcatgataaattttcaagttgaattcctaggccaaagagtatacagattttaaagactttcaatgttggcagatatcactttaggataattataccaatttatactcttaccagtaatatatgagtgtatatatttacctattccttgccagttctggaaattgtgaatttaacagaatcttccaaaaagcattgaaaattggcctgggaatgtaaatatccttttcttccccattcagcttactaatgaatctatcataatctcagctgtctgaatctaaaagagaaccagtaaaattgagatgacaagtttattgcaaaataaatgacctgaaagccacaggcattgggtggggtgggggaagggcaggtaatggtgactgaggtgactctgtgtttgggtttttgaaaagatggtagatttgaaggataaggagttcagagaagtagaaaggcaaataggggccgttataaataaggacagtggcatgagccaacagggttatctctcatgtttatagaacatggctagatctggtttccctataagttgatttcttactgttattctgagttgaatgcgtatcttttgtctcaatgaagcctgaatggcttttgatgtctctgatctggaaaggttgtttatgtatctcagaataagtcattttgctaaaaaaggctactcctgagggagagcagtggaaaaaagagttggaaaagtggattgtagctagttgaaaaaaggatttgaatgtcaagctttaggaattaggttcttatttggtatgttacgggcaaccatatggacttttgagcaggtgaaaaatacagtattaatgggtagggatagcttgggagggaaggagacatggacattgagcttcagaaaaaccagttagtaaaatatttcagatgatacattggtaatagaaaaggatccgttgaaatgtgaggcattcacttggaaagaactggcagaatgtggtaattaactgctataaggaccccaaaataaaaggaataatcaaacatcactcaaagcttttagcacagtttttgataacagtcagtgtcagaaggagaagacaactttgttcctaaaagttatattgtaaaataaatgtagcttatacatttttgaaagtgaaatctcaggattcatggtatctttacttctacttgccaaattattaaaatggtgttatatttcttaagatattttaaagcctctattgtagaacagaaatagtagaaaatggaactaatgtttattaacaattactatggaagagggaatagaaatgtgttgctcttgaacagatttattcagctttggcactgttgacattttggactagctaattccttgtcatgggcagtatctcctgtgtgtaggatgttaagcagcattcctggcctccacccgctagatatagtagcacacccgcacccctccccccctccctgcccccgtgacaaccaaaaatgtctttagacattgccagatgtcccttggggagcaaaaattactccctctccccagttaagaaccattgttctagagtacagaatcaatcccactaaataaatgttattggcgtgtttagaacagtgcctagcacatagctggcactcaaatatttgttgaataaatgagtagtcagattttcattgtgaattaaaaacagaacaaaacttgatgactgaccactcaagttgcttttacaaaagaaatgggatgtccattgaacatctgttttagatctgatttcccaatctggattattaaaatgaggaggctattttttcccagtatataaatgattctaatactttttgctgtaaaacttttggagtctctctgctaaattatgttccagtttcgtagcttgggattcaagtcataaatatactaggtctgtcttacctttcggtgcttttatttgttcccttttgaacatggctgaattttacttttctgtccacctgcccgccattcgtgctacccctccttcctttttccactctcatctttttcccattttccagtctgtaaatcctacctatccttttattttttaaattacaagatctcattctgttacttaggcaggagtgcggtggcacaatcatagttgactgcagcttcgaatttctgggcccaaatgaccctcccatctcagcctcccaagtagctgggaatacaggtgcgcaatactgtgcccggctagtttttttttttttttcttttgagacagagtttcgctcttgttgcccaggctggagtgcaatggtgcgatctcggctcactgcaacctctgcctcccgggttcaagcgactctcctgtctccgcctctcgagtagctgtgactatagtcgcatgcccccatgctcagctaatttttgtgtttttagtagaggtggggtttcatcatagtggtcaggttggccttgaactcctgacctcaggtgatctgcctgcctcggcctcccaaagtgctgggattataggtgtgagccactgtgcccagcctagttttttttgttttgttttttgttttgttttgtttttttttttggagatggagtctcgctctgttgcccatcctggagtgaagtagtgtagtggtgtgatctcagctcactgcaacttctgcctcctgggttcaagtgattctcctgcctcagcctcccaagtagctgggactacaggcacatgctgccacccctggctaagtttttatattttagtagagatggggtttcaccatgttacccagctggtctcgaattcctgagctcaggcaatccgcctgcctcggcctcccaaagtgttaggattacaggtgtgagccaccatgcccagccattcccggctagtttttgtagatactggggtctcgctgtgttgcctaggctggtctcgaacccatgggctcaagtgatcctcccattacagcctcctaaagtgctgggattacaggcatgggccactgtgccctgccctgtcctcctttttgaagtctctctctctctgtcttttatacttattttttctctcttgtcatgtctttgtccttgtcttttttgatggagtcttactctgtcacacaggctggattgcagtggcacagttctagctcactgcagccttgaactcctggggtcaagtgatcctctagctcaagtgatcctcctacttcagcctctgagtagctggggctctatgtgtgcaccaccacgcctggctcctttgtccatttttgtttgtttgttttttggagacagagtcttactctgtcgcctaggctggagtgcagtggcatgatctcggctcactgcaacctccaccttctgggttcaggcgattctcctgcctcagcctcctgagtagctgggattacaggtgcccaccaccacgcctggcttatttttgtatatttagtagagatggggtttcaccatgttgaccaggctggtcttgaactccagacctgtgttctgcctgccttggactcccgaagtgctgggaatacaggcatgagccactgcaccctggccttaactacgtattttttatatctgcacagtgttttggaaaaagtggttcaactgaaagaatgaaaagatgggggcagaatttgctttttaaaaaaataataataatttaaaaaaagggcattgaaaaaagtttcagtggtgttgggagggccttggaacaaggaatgaatggaagatgagggagtggagggaggccatgtatggactctttctacagaccaggctgttgaaggagagagggctaacaggaaatgaagtgcgggggaagttttttgaagatgggagaaagaggacaacttttatatatttcatttcatttgattccttataaatttgtaaggaagatagagcttgtattatttcagtgaagttgaaaatagagtacagaaaaattaagatacagcacccccaaaactgagaacttctgacataatacactgttggaaatacttacttcagagtgaagaaaatattggaagttaggcttgttaattgctctgcatggttcataattactctttcttattaactatttaaggaacatgagaccaggaagttaaatacctgggtatatgcagatatatatctagaattggtaccaaagtaaatacaggcataccttggagatactgtaggttccattatagactaccacaataaagtgagtatcaccataaagcaaggcacacaaatattttggtttaccagtgcatgtaaatattatgtttatattctactgcagtctattaaatgttcagtagcgttatatttaaaaaaccaatgtgcatactttaatttaaaaatactttattgctaaaaaatgctactgatcatctgagctttcagtaaattgtaagattttttgctgatagaggatgttggtggctgctgactgatcccagcagtgattgctgaaggttggggtgcctctggtagtttcttacaataagacaacaatgaagtttgctacattgattgcctgtttctttcatgaaagatttctctgtagcacgtgatgctgtttgatagcattttttacccaaaagtagaacttttttcaaaattggagtcagctcaaacactgctttaacaactaaggttatatagtattctgaatcctttgttgttattcaacaatttcacagcctcttcaccaggagtagattccatctttaagaaaccactttcttggctcatctgtaaggaacaactcctaatctgttcaagttttatcatgagattgcagcaatccagtcacatcttcaggctccacttctaattctcttgctgtttccactacatctgcaatgacttcctccacttgagtcttgaacccctcaaagttatccatgagagttggaatcaacttcttccagacacctgttcatgttgatattttgacttcctctcatgaattatgaatgttcttaatgacatctacggtggtgaatcctttccagaaggttttcagtttactttgcccaaatctactacaggaatcacttttttttttttttttttttgagacggagtctcgctttgtcgccctggctggagtgcagtggtgcgatcttggtttagtgcaacctctgcctcctggttcaagcgattctcctgactcagctcccccgagtatctgggactacaggtgtgtgccaccacgcccggcttatttttgtatttttagtagaaatagggttttgccatgttggccagggtcttcttgaactcctggcttcaagtgatccgcctgccttggcatcccagagtgctgggattacaggcatgagccaccgtacctggccgaaatgtatttcttaaacagtaagacttaaaaattgaaattactcattgatacgtgggctgcaggatagatgtatcgtactggcaggcatgaaagtaacattcttctttctgaacatatccatcaaagccctcgaatgacctggtccattgttagtgagtgctaatattttgaaaggaatgttttttccttagcagtaggtcttgacagtggactgaaaatattcagtaagccaacctctaaacagatgtgctgtcatccaggagactgttgttccatatgtagacagcaagcagattagatatagcataattcttaagagctctaggactttttgagtggcaaatgagcattagcttcaacgtcaagttaccagctgcattagcccctaacaagagagtcagtttttatttatttatttattatttttaaaagagacaagagtctcgccttgttgcccaggctggccttgaactcctgggctcaagcgattctcctaccttggcctctcaaagtgctgggataacaggtgtggccccagcctgacctttgaagcaaggcattgattttccctctctagctgtgaaagtcctagatggcatcttcttctaatggaaggctcttttgtctacataaaacaccttgtttagtatagccacctccagcaatgatcttagttagatattctagataacttgctacagcttccatgtcagcacttgctgcttcactttccacttttatgttatgacgagagcatttttcctcatgaaccaatctctacttgcttccagtttttcttctgcagttttctcacctctctcagccttcatagaattgaagaaggttagagccttgctgtggattaggctttttgcttaagggaatgttatggctggtttaatcttccatatggaccactaaaactttcttcatattagcaacaagattgtttcatgttcactgacatagtgcttttaattttattcaagaatttttcatttacattcacaattggctgagtggtacaagaggtctagccttaggcctttctcactttttgatatgccttccccactaagattaatcatttgtagcttttcagttaaagtgagaggcacatgacttttcctttccctgaattgtttgaggccattgtaggattagggttaactaattggcctaatttcaatatggttgtgtgttggggaaacgggaggtctgaaaagagggagaaagagagatagggaatggctaattggtggagcagtcagaacacacattatatgttagccatcttatgtgggcgtggttcatggtgttccaaaacaattacaatagtaacatcaaagatagcatggtagctcactcctggaatcccagcactttgggaggccaaggcaggaggatcgcttgagtttgagactagcctgagcaacatggtgacaccccatctctataaaaaataaatcagccaggtgtggtggtacatgcctgttgtcccacctaccgatgaggctgagcacttgagtccggaaggttgaggctgcagtgagctgtgattgtgccactgcactccagcctgggtgacagaacaagaccctttctcaaccaaaggaaaaaatatatatatatcactgatcgtagatcactatcacagatataataataatgaaaaagttcaaaatactttgaggattactaaaacgtaacacagagacacaaagtgagtgcatgctgctggaaaatggtgtcagtagatttgttcaggctgggtactatggctcacacctgtaatcccagcacttgggaggctgaggcgggtggatcacctgaggtcaggagtttgagaccagcctggccagcatggtgaaaccctgtctctactaaaaatacaaaaattagctgggcgtggttgtgggcgcctgtaatcccagctacttgggagactgaggcagaagaattgcttgaacctgggagatagaggtttcattgagccaagatcatcccactgcaccccagcctgggcgacagagcaagactccgtctcaaaaaaaaaaagacttgttcagtgcaaggttgacaaaagcctttgctattttaaaaaaaactcgctgggtgtggtggcttacgcctgtaatcccagcactttgggaggccgaggtgggcagatcacctgaggtcaggagtttgagaccagcctggccagcatggtgaaaccctgtctctactaaaaataaaaaatcagctgggtgtggtggcacgtgcctgtagtctcagctactcatgaggctgaggcaggagaaccacttgaacctgggaggcggaggttgcagtaagccgagattgtgccactgcagtccagtttgggcagcagagtgagactgtgtccccaaacaaacaaacaacttattatctgtgacgtgaaataaaatgaggtatgtctgtaagcaaaatggatattcctcttaatgtttgacattattttttaatcgaggagttctgaaaaattgattttgcatggatttttttccttgtgtttttctcttcaatttttttttttttttttgagagacagagtctccctgtgtcactaaggctagagtacaatgctgcgatctcggctcactgcaagctccgcctctcgggttcaagccaccccaagtagctgggattacaggagtgtgccaccatgcctggctaatttttgtatttttagtagggacagagtttcaccatattggccaggctggtctggaactcctgaccttaagtgatccacccaccttggcttcccaaagtgctgggattacaggcatgagccagcacacccggcctgattgttcagtttacactcctactagtgtcgattttcccataacctgactagcagagtgtgttatcactctttgctaatttggtatctgaaatgatactccttgctttcatttccatttctaaaattgtttagttgaatatctcatgtgttcagagactttcactctttcagttgttggactgtatttgttatttttctattgagaatttgtttttctcattcactcattttaaaaattattatttttaaaatttcttttcaatttttattaattattattattattattactattttttgagacagagtcttgctctcttgcccagtctggagtgcaatggtgcaatctcgggtcactgcaacctccacctgccaggttcaagtgattcttgtgcctcagcctcctgagtagctggtactacaggcatgtgccaccatgcctggctaatttttgtatttttagtagagatctcggggtttcaccatattggtcaggctggtcttgaactcctggcctcaagtgatctgcccgctttggcctcccaaagtgctgggattataggcttgagctaccaggcctgaccagtagttttcatttttcatatcattgttcgatttccctgattacttggtaaagttgagcactttatcatattctataggttgattaattgtgtctgaatttcttattcaaaaatgaatttgttgttcatatcctttgtccctttttaaaaaaaattaggtttgtgtctcaggatactttattcttcctttatgttcataagtagagttttatattacttattaaagttattcctagtaactttgttgttgatatctctttctattacagtagaataattatttctactgtatgctgtatagaaaagttattgatgtttatatgttactgtgttgatctgacaatcttaaagaactcttttaacatttcagttgataaacttgtattttctaagtagacattagtgatattttctgctaattatgacactttagcctgttcctttatggtattaaagtgtcttatttcttatcacttagcttaatgacacaacatccagtattaagtggctttgttttaaagtttgattccctgtgaaattttattattttgttcagtgggagacagaactgtaacttgcttttcagaattgttaggctgttatctcaatatttgttattgaatccatatttttgtcctgagttatagaaccatctactctttcaacaaaacatatattgagtgcttatgtttcatctggtgctgttaggtgttgggggtgcagcagtgaatagaacaaatttctagtcttcatggagtatacagctaaagagacagtaataaacaaataatatttttttgatccatagtcatttggatttacagatgcggaacccgtggacatagaagtcttactgcatttatatctgttttttttctgcatttgttgagatgatcatttttccttgatttgtaaatatgacaaccatattaacagattttcccttttgatttctttatgaattttctagctttcttcctatgtcattgatttctagtttcatacaattgttgttagaaagatacttgaaatgatttcattcttcttgaatttgttaaaacttgttttgtggcctaacatatgatctatcctggagaatattctgtgtctgcttaagaagaatgtatattcagctgctgttggctagaatgttctgtatgtgtctgttaggtccatttagtctgtaatgttcaagtctgtgtttccttattaatttttgtctggattatttatccgttgtcgaaagtggggtatttaagttccccactattacggtattgctatttccccctttagttctattgatagtgctttatatatttaggtgctccaaattggggcatgtatatatatttataaatgttacattctcctgatgaattgacctctgatctcttttaacactttttgactcaaagtctattttattttatgtaaggatcctctgctctctttggttaacatgtgtgtggaatatctttttccatctcttcactttcagcctcagtcctttaaagctaaagagagtctcttgtaggcagcatataggtggatcttgtttttaaaaatccgcttggctgggtgcagtggctcacgcttgtattcctagcactttgggaggctgaggtgggtagatcacctgaggtcaggagtttgagaccagcctgaccaacatggtgaaaccccatctttactaaaaatacaaaaattagctgggtgtggtggtgggcgcctgtaatcccagttactcaggaggctgaggcaggtgaatcgcttgaacccaggaggtggaggttgcggtgagctgagatcacaccatcgcagtccagtctgggcgacagagtgagactccgtcttaaacaatcaaaaatccattcaatctgtgtcttattggagagcttaattcttttcatttaaaataattattgataggtaaggagttactactgccattttgtcagtttttctgactcttgtagtttctttgttccagtcttcctctctagccgtcttcctttgtgatttgacgattttttggtagtgatatgcttttgattttctgtttcatgtatcttgtaggcagcatatcattggatcttgtttttaaaaatccactcggccaggcacggtggctcacacctgtaataccagcacttagggaggccaaggcaggtggatcacctgaggtcaggaattcgagaccagcatggccaatatggtgaaattccatgtctactaaaaatacaaaaattagccaggtgtggtggcatgtgtctgtaatcctagctactcaggtggctgaggtgggagaactgcttgaacctgggaggtggggtttccagtgagctgagatcatgccactgcactccagcctgggtgacagagcgagactccatctcaaaaaaaataaaatgaaatgaaaaaattaaaaaaaaaatcactcagccaatctgtgtcttctggagtattaaatttatttccatttaaaataattattgataggcaaggagatgctatcgccattttgtcaatttttctgactcttgtaagtttgtttgtttcagtcttcctctcttgctgtcttcctttgtgatttgatgatttttttgatagtgatatgcgttggttcttttctggtttatgtatctactacagccttttttttgtggttaccatgaagcttacataaaacatcttatagtgttaatagtctattttaagctgacaacctcaacagtataccacaactttacatttaacgtctcctttcacattttgtattattgatttcataatgtatatcttttatatatcatgtatccattaccaaattgttgtatgtatagttaatatttaatacttttgtctctttacatttatactagacttaaatctgatttaggtaccaccattacagtattggagtattctgaatttgaatatattgttatctttatagtgagttttattctttaatatgtttttatgtttttagagttcttttgtttcaatttgaagaactttctttagcatttcttgtaaggcaggtctaatggtggtgacctcccacatttttttctgtaaggggtcacatagtaaatattttaggctttgctggcaatatgctgtctgttgtaactgctgatatctgctattgtagcatgaaagcagatgtagactgtatgtaaacaaatatacatggctatgttccgataaaattattacaaagaccaagtacaggactggatttggcctctggaccgtagtttgctgaccagtgatttagacttctaacatggtagattacattgattgattttttgaatattgaacaagtgtagcattcctgggataaaccctacatggtgtggtatattactcttcttatgttcctgagtttgatttgctaatatattcttgatgatttttgtgtttatgttcacttaggaaattggtctttagttttgcttctttgtactgtctttgcctgattttggctttaggataatgctgacctcattaaatgagtggagaaatgttgttccctcctttttctggaagggattctgtagagttggtgttacatcatcttaaagtgttggttagaaattagttagtgaaagcacctgggcctggagattgttatttcagaaaatttcatactataaattcaatttctttaatagttacagagctgttcaggttacatatttcatcttgggtgagttttggtagtttgtcatttcctatgaattggtccatttcatttaaagatatcaaacttatgtgtgtggagttgttcatactgctcttttattgtcttctttttttttttttgagacggagtctccctccgttgtccaggctggagtgcagttgtgtgatctcggctcactgcaagctctgcctccagggttcacgccattctcctgcctcagcctcctgagtagctgagactacaggtgcccactaccacgcccagctaatttttttgtatttttagtagagacggggtttcaccgtgttagccaggatggtctcgatctcctgacctcatgatctgcccgctgggattacaggcatgagccaccgcacccaaccttattgtcattttaatgtctgtggagtctatagtgaaatcccctttcattcctgttttagttcattttctattgctatagcaaaatacccgagagttggtagtttataaaggaaaaagatttatttggtttatggttctggaggctgagaaatctaagatgggttgccgcatgtggtgagggctttgtgctgtgtcataacatggcagagaagtgcaaggggaagcacatgtttgcaaagagaggccaaacatgagaggcatcctcactttataacaacctactcttgtgggttcacttctccaagagtgagaactcctttcagaacgacattaatccctcttaacaacctaatcacctcttaaaggtaccacctctcaacactgctacattgcagaccaagcttcaacatgagatttggtgaggacaaatgatattcaaaccatagtagtcatttttttgtgtgtgttagttttgctggaatcttgtcaattttattgatctttacaaacagtcagattttgatttgagtttttaaaaagttgtggtagaatatacacaaaatataatttgccatcttgtttttttttttgtttttgtttttttttgagacagggcctcactctgttgcccaggctggagtgtggtggcgtgatcttggttcactgcagtctctgcttcccaggttcaagtgattctcctgcctcagcctcccaagtaactgggattacaggcacgtgccaccatgcccggccaacttttgtatttttagtggagacaggattttgccatgttggccaggctggtctcgaactcctgacctcaagtgatctgcctgccttggccttccaaagtgctgggattacaggtgtgagccactgctcctggcccttaactattttttttttttaaccttccacagtccttttattttggaataggctgtaaacaatcaaaccacgagaacatgattgtacaacagtaaaatgttctcctgtattaaactgaagatatctgtttaataaaaaaaagaaaaagaaaatgtaggaaaggtacttagagctgttactttctaagtacacaacaccctagacaattcaaggcatcttaatctccatcaagaaaaacaagaaaaaataatttttgtcacgctgttaaatccatcattatggatgaaactggtgcatattggtcaaacggatccaacaaacactgatgtccaagctggcatattggcaactaatacgtaactggtggtcaatagagagtttaaaagatcttccctttcttcttgttcttttccaaggttctcgaagagttctgttctaaaatatgttgttgagcttcccagtttgccttctcatcctcaaactgacgacgtttttcctctaattctttgtgctgtgcttccaaattctttttcattagctcacggcgccactggagctcagcttcagagtcctttagtttttgaactttttatttgaccttcatctctaacacctgctccatctccatctctatcttcttcattttagctgcatactcccttctttcttcttccatttgtgccagagggctcttagtcagctgccctttattcttgttgttatcaactccattataagtcacagctgccagttttctgcttctgtagttctcatagtggacattattagtaacatctttcaagtcctgagtgtgtgtttttatcagcatatttcttagaattgtaaaatcacaatgttcaccattttcaacttcagcagcaccccaaggatactgccttcctttgacccttttgccattaacttcaatgatagtattactagcttaccacagcaagaggtaaacagtcctttacctttttagcaagtttattttcttcttcatcatctatttctggaaaatcatatatcttaattttatgttcttggatttctttcattatctgttttttaaactgttggcattcctctggtataagtgtgtctgctttggcaataagttggatgataatcactttttcatgcgaacgcttcataaactcaatatccaatggtttaagttcatgtcctgaaggagcaatgaagtataaacaacactgcaccctgctattaggcatctgacgtctgttcactcgtgattctgcatttaggtagtcctcagatttactatcaatgtaatcgataagaggctgccagcaattactattatccactacatctccaaatcctggggtgtcagctattgtgagcagcaactgaacaccaccttctttgattaaaactttggattgtccacctgtatagtctttttaattctatgagaaggacctggatactctggagcatacaaatctgtaaggaataatgagttgattaatgtcgactttcccaatccaggttcgcctctctgggtaaggtggctcacacctgtaatcccagaactttgggaggccgaggtgggtagattgtttgagctcaggagttccagaccagcctgcgaaataaggcgagaccctgtctcactttgtatgctggtgccagccgggggtgcccctggtaggtgctccctggggtgtctgcttcagggcttctgcgaaggtgcaggtcagggctcctccagctgggaaacttggaatagttggcagctgctttgaatgttggttccttcttctctgatgaccgtgctgtcaacatcaaaacacactgcatctgctgagtagaaaagcttcctcagctctgagtgggagaccatccttggaagaattttcctcgtttctccagtgctagatttctaggagaccacactcttctcttcctgttccttctctggataaaaatgcagcacagagttctgactacagatttcttcaagaaagacctgtggattccgcaagagcaagagcccaggctcaggtgaggcaagggtgcggccggggctgcaactggcgctggccattgaggagcttctgcgcgaccttgcgatcgtgcccgccaggcgccggcccgttggctcgcagcgccagctcgcgccgcgtctggcccttgctgcgcccggctctgcaggccgggaagttgtaaagctcctccatagctgatgggcggcggcggccgggccgaagcctgcggacacggaagggctgcagctcagcggctggttacatcccgcccggccgtctgtggccacccaaccccttaactatttttaagtgtacattttagtgatgtgagatacattcataatgtagacactatccattttcatagctttttaaaaaatcttgttaaactcatactttatagccattaaacaataactcccagtttctcccttctctcagcctctggcaaccaccgttccactttccgtctctgattttagctactcttagtaccttatataagtggaatcatccactatttttttttctttgtgactggtttaattcacttaggagattgttgtcaaggttcatttatgttgtagtatcgcatatgtcagaaattccttcctttttaaggctgcatagtattccaccatagacatactgccaatgtggtatgtctgtaccacattttacttaactgttaattatgttttatttattgtgaataatgctgctgtgaacatgggtgtataaatatctctttggagactctgcttctgattctttttggtgtatacccagaggtggaatttgtggatcatatggcaattctatttttaactgcttgagaaactgccgtactgttttccagggcccatatcattttatgttccctacacctgtgcactagtgtttcagtttctccacgtccttgccaacatttgttattcttttttttatttttcacagtagccatcctaatgggtgtgaggtggtatatcttagttttgatttttcatttttctaatagtcatcgtgagcatcttttcatgtttttttggtcatttgtataacttctttggaaaatgtctgtggaagttctttgctcatttttgagttgggttgtttttgtcaggtgttcgtcccacctcatcctcctgagtacccaggactacaggcacatgccactatgccccactaatagaatctattttagacctaattatattctgtctacctgaaagacaattgaaataaaatgacataaagagaaagataaaacatgccaacactaatcaaattaagctggagtggctatgttaatatcagacaaagcacacttcaaaacaaaacactgggccgggaggctaatgcctgtaatcccagccctatgggaagccaaggtgggaggatcgcttgagaccaggaattcaagacctgcctgagcaatatagcgagactccatctcaaaagaagaaaagaaaaaaggaggaagtttttagttaactgtttgtttgtttgtttgtttgtttgagacagggtctcactctgccgcccaggctggagtgcagcggtgcgatttctgctcactgcaacctccacctccctagttggagcaattctgcctcagcctccagagtagctgggattacaggcgcctgctaccattcctggctgatttttgtatttttagcagagacagggtttcaccatcttggccaggctggtctcgaactcgacctcaggtgatccgcctgcctcggcttcccaaagtgctgggattataggcgtgagccactgcacccagcctactgttgcttttgaaggatacttttttttgctgcatgttttgttcagtgtttagaagggtttttcctttaattttctccttagtactttaaatatgttttttactgtcttctggcttacatagtttcagacaagaagcctgcagtcatttttactttattccccctttaagcaatgtgtattttcttttgctgcttttaatattttctctttattaatctttttcagcaatttgactataaagtaccttactggtacgtgtgtgtgtgtgtgtgtgtgtgtgtgtgtgtgtgtctgtctgtttcagattttgttgtgcttggatctgtgggcttataataatacagcttttaaaatttacagctaattatttcactaaacaatttttttgtccctatccctttaaccccaacctcacacatattagttaggtaggttgctattattccacagggcactgtagctgtgttgtcatttttcatactgttctttattttgaatagatttttttttgttatgtctttagggataatgatcttcttttgtcatttctaatcacatgttaacttttcaatgtgaaatttgcatttttttctttttttcttttctttttttttttggagacggagtctcgctctgtcacccaggctggagtgcagtggtgtaatctcggctcactgcagtctccacctc

SEQ ID NO: 146 - DNA, 17710 bp, Homo sapiens
tagctaggcaggaagtcggcgcgggcggcgcggacagtatctgtgggtacccggagcacggagatctcgccggctttacgttcacctcggtgtctgcagcaccctccgcttcctctcctaggcgacgagacccagtggctaggtaatgattggggaagggctgagcaacgggcaggcggcgcagggcttttctgggcttgtggggctcttttccctccgagggaggcggcgcgcccgcaggcccagcgtggcggggtcgggggcacgtgcaagccgcctccctgggtgggaactggcgcccccgctcaccccgaggcccggggcgggggcgcaatgccaggcgcacgtgctgggcccccgatttctttggaggggaaagtgcagatcaacacgtgattaccgactgcggggccgagtcactgtcagggaaggtcgggagctgcacacgcgagctgcttagcacagcgggagttgggagtggaagttgcttttccatcgtagccaagtgtaaggtttttgggatagacgcagacttagcggcggtggccactcaggccaggcccttcctaaaatggaggagggcggcgatagtggagatggccacgaggctgcggccccctcccccaccggtagcccccgcctctcgcccgcgctcgcggcccgcgcttctgcctagtaagcggtgactcatttaactccgagaaggcacctcttgaggaacctacagcagagccgttagatcattggcaagtcctccaggcgacctcgcccaagttgggcaagagcggctccccggctggccaccaaaaatcgggcctgatctgatttggtttttttttttttttgagttttgctattgttgcccaggctggagtgcaattgcgcgatctcggatctcggttcaccgcaacctcggcctcctgggttcaagcgattctcctacctcagcctcccgagtagctgggattacaggcatgcgccaccacgcccggctaattttgttttttttttgttgttgttgttgttttagtagaggcggtgtttcaccatgttggccaggctggtcttgagctcccgacctcaggtgatccgcccgcctcggcctcccaaagtgctgggattacaggcgtgagccaccgcgctaggccaagaaggatgtattttaagaaagcttcctgttcaatgttcccctgctctgtgcgcttctctgggcggtagggtccattgcttcacttgcctttcaggcccacccgggccctgactgctccattcatttaccgtgtccctaattcggggttccatccaggcagctaaaaaagctgtgaatggtccgggcgcggtggctcacgcctgtaatccgagcactttgggatgccgaggtgggcctcctcaggatcacctgaggtcgggagttagagaccagcctgaccaacgtggtgaaaccccgtctctactgaaaatacaaaaatcgaccaggcgcggtggctcacgcctgtaatcctagcactttgggaggccgaggtgggtggctcacgaggtcaggagatcgagaccatcctactctactaaaccccatctctactaaaaatacaaaaaattagccgggtgtggtggtgggcgcctgtagtcccagctactctggaggcggagcctgcagtgagtcgagatcgtgtcactgcactctagcctgggcgaaagagcgcgactccgtctcaaaaaaaaaaaaaaatcacctgggcgtaatggcaggcgcctgtaatcccacctactcgggaggctgagacaggaggctgaggttgcagtgagccaaaatggcgccattgcactccagtctgggcgacaacagcgaaactccgtctcaaaaaataaaaaaaaaatcacactttattttcacatcctaagacgtttgtctttttttttttttctgagacggagtctctctgtcgcccaggctggagtgtagtggcgcgatctcgactcactgcaagctccacctcccgggttcacaccattcttctgcctcagcctcctctcctgacctcgtgatccaccctcctcggcctcccaaagtgctgggattacaggcgtgagccaccgcgcccggccaagactttctttcgtcttaagtcactaaaatgaaaacaaaagtactgaggcaccctaataaaattgcctttaaaagtatgactgaaatactcaaagtataccacagtggtggcctggagatggggcagggggatattgactggaaatggcctgagataactttttgcagtgatggaaatgttactcgggtatataatttgccaaaacgcaaaattaaatctaaaaatatgtttaaacaaatttgcctttttggaacctagtaaaaagtaagtacctttttttggctaatgaataaaactccattgttacatagacaacaaagccacagaagtgacttcagtaaataattttgaaagttaaaaacctgccacttgccacctcaggacattccagagaagatgttggaggggagcccaggtagataatggctttaaacactaagttcctctcacccacctcagttctataagttgttcagttagtttctttggagagcgccaaggaaaaaagtaagaatgggtttttctttgaggaattggtatttgttgttcattgctggaaattcttgtatttttttttttaaggtggtgttaaaggaagccccttcccttgaagtatcctggtgttcaaagaatctttcctctatttacaaattataaaaccccgttgggaagaaataattagatgtcattattggctggtcctggtggcttacccctataatcatcctagcatgctttgggaggccaaggcaggggaggatcgcttgagcccaggagtttgagagcagcctgggcagcatagtgagaccgccatctcttaaaaaagtaactaaaataaaataaagatgttatcattaatgacataacaacactgaagacccaagtactgtgaaattggaaagtcccaggaagtggcagtagccaagatcacacggtccaaggacttcattgttcctgacttccaaactcagaatttctgatcaaatacctactaagtgaatattaatctgaagaattatgtccaaacttcattcactattttgttttaattctgctacaagcaaggttttcccctggtcccgccaccctctttttggccctaggtggttttgcttgtgaccttcatgtctgttcttggttcctttccattcccatgccagccctcattgttcactcatgacaatagccagtttcagacagctcctgggccactctgcgtcgagcaacacattcatctttctatttggatttgattctccctgggcacacacgtttgtgggctttttctctctctttttttttttttcttttttcttacagaacaagacctcaattgctagggtttaacccatttatgccagaggttgcaaatctttttttgtgaaaaatcagaccttggcaatgacttgagcagtcggataaaagtaactcccacgcccttagcgttccagtaatggaatactaggcataaaaaggttaaggccttccgcagctaggccctaactacttaattaggagaattctcactgctttccagcaggcttttccccccaccctagccagctttcctacatccagtatttagtccagtgctgattctctctagtccacgaacctcggaagtgattccttgaatgagtgaggaaatgcagcattatggcttatggaaaacatgaactgtgtgtttcttctacagaagttcaccatgtctattctcaagatccatgccagggagatctttgactctcgcgggaatcccactgttgaggttgatctcttcacctcaaaaggtatgtgccacctccttggtttccatggttccttccaccgtgcttcattttaaaaattttctacaaatgctggagccttaggaaaaaaaaaatctgttaaagcttttctttctgtctgcacatgctagtaggttgtgattcctgactgtgagggttggggaatttttaggcatggagccagtgtcttgctgtttctcggcttatttttttctttttctttttctttttttttttttttttttttttgagatggagtcttgctctgtcacccaggctggagtgcagtggcatgatttcagcttactgcaacctctgcctcccaggttcaagcaattcttctgtctcagcctcccaagtagctgggactacaggtgtgcaccaccacacctggctaatttttgcatttttgggagagacgggggtttcaccatattggtcaggctggtctcgaactcctgacctcactcaggtgatctgcccgcctctgcctcccaaagtgccggcattataggtgtgagccaccccgcctgatcctgccagctccttggcttaaaaccacataagttggctcctaagtcagtgaagtaaggaagtaaggtgataccacaagaccttgtccctaaaggggcccatcactagttgttggctgacagcttgctgtgaccaaatgcaggatacagtgtgataggatggtatctcttgataaggggagggatagcaggtgtgaatatagcacctttatctctgtgactagaaatcagtcttcagcaaggatcaaggacagtttttacctgtaggctttggaatagtctggaggctctcatttttacctggctgtcaatccctataggaggagttttcttatgaaaaattagagaattgtgaaactccttcctttaagaagaaaatccagtgcctttgtagctctgtgttacctccagcacatggcgcgatggacagagtgggtgaggttggcaaaggagcttcaggcagaatcactcagcggtgctaaactcacagagaactgccagtcggagctgagtcaccatctgtgagtcacaggcctagcagtggaaccccagcccttcccttccccttgcacctcccctccccctcaggaagaaaggatccttgaggcctgacttcgttgggcaaaagaatgcctgagttggctgcttgctgtgtgggctctcaagcactgtggggtttctcactggctttatggggaaccctgagggttctcacaggatgccaagaattcccttcatccagtaagagtggtttgcttagtcaatgggtggaactttctacttggatattaatgaactttaagcaacaaaagaccccagatgctagaagattgttgggagttggacattttgaaattgaaatgaatggaactttctcttgtgtgtcttaatccttttcaaaaaacatgaaatgatggacttgctcagaacctttcatctctctctctccctgtctcatcaacttttttagagcagttttaggttcacagcagaagcaggcggaaggtgcagaggtacataaacccatgagtacccactgcctctgcacatgcgcagcccccccattgtcagcatccccactagagtggtcaacatgcgtgaacacgttatcatcaccaaaagtctgtagactccaagcctcttgttttcatcttgtctttgcctgatccagtgtagggtggatatgtagggagccagggcagctttcaagaaggaagtatgacctgttgatagcgcacactgcagtgcagcagggaacactgctgggtcctttgctagaaatatcttgttggtttctctgcaacatcttccttgacaccatctgttcttttgcctccaccaaagattgcccttgttacaggtataggtttcaccagatggctggtttcagtatctgcaagattacttggttcagttcttacatttattaaactgcgcattttattatctttattccttccccccacatccatcctgtttgccagtttccagttgggcatagaacccctaaaatagcatttagcattgtccaaactgaaacaaatgagctagatactcctcctgagccagttaaattaccctaattttatgcttaacatcaatatagtacctgtctgggcatggtggctcatgcctgtaatcccagcattttgggaggccgaggtgggcagatcacctgagatcaggagttcaagaccagcctggccaacatggtgaaaccccatctttactaaaaataaaaaaactagccgggcgtggtggcaggctgctgtagtcccagttgctggggagcctgatgcaggagaatcgcttgaacccaggaggtggagattgcagtgagccaagatcacgccatacactctagcctgggggatagagcgagattctgtctcaaaagaaaaaaaaagtaccagaacgtcttcaatgccctgtgtggctcgcattggatttctcttgggcagtgctgctggagtaatccacagggcaccaatgcgagcttgtgagggatgcatatttgcctgggtcagaatctacattttaacaagacctccaggtggcatgtaggctctgctgtagaacactttctttctgctagaggaattagtcatctttgcagtaagttctgcagtacaggatcataaacatgtgaaaggcatgaagaacagcccagagcgtttaattcacacagctggtaggaggaagaaacagctccctaatgacaaatgcatctgtgggcgggaggggacttgggattgtgctggaactggatttctgaattgctactacatcttttttcctctcatccaggtctcttcagagctgctgtgcccagtggtgcttcaactggtatctatgaggccctagagctccgggacaatgataagactcgctatatggggaagggtaagccttagaacccacagcccatggcctccctgcttccagccccattcctggccttgcccagtcctgtcctctctgggtggcacttgcacttgcaggtttatggcaggtaaacctgctgtgacccatgatgttgatggaagcagtgcaccaccttgtggacaggaaagttggtgtgtggattccggggttcccgagcctgcatgctctgggtcgagagttccaatgcttgcttctattgcagtttgttcccaatctgcgaaatactccttcacggttaggacaggaacccaagcatgagaacagggcctgttaactaaagaaaagtttccccatctcccaggagggttctgtgggccctccagagatcatcagcctcttcacgggctagaaaggatccagggaaggtctaaccaatgacctgccctgaatggtgagctgcaggtgtgtcatttagtgtgattttcctgttgactgactcataggagccctgctctgtggcagagctagcctctggctgtattcaaattgacttagtgtgtgtgcaacattgacctttctagagatagaacatgtggccaaattacagaaaagcacatagggctagatcacgcattctcagtggggcacccggaaaactccaaaaaggctgcagggaggggacaatgatgaaatcaggttgtgaaacactgggctggtgtcgcagtggtggtgctgggtgttcagtcccgctttaatgctgtaagaagcactctacacacacgaacatgttaccatttgaccgttgtttaatggcgtacgtggggacttagccggagcaggatgatgctgtgccttgatggtaatgagtgctcagtaagtaagcatttgtggaagattgaacgcatggcccctgaaatgctctcctctgctttcctgccccctcactgtctctcactcgcagtccttaatcaccggttctcttctgagtctctctcatttttccttcttcatcctctgctgggcaggcgtctccagacccattaagtatattaatgagttcctggcaccagccctgtgcactcaggtaactgattgaacagcctttagtctgcagttggcgtttccagtgcatggtcttgcaaactaacctccagtcagatcgttctgagccagctgctgttttgtgtggctctaaccctctggggtcctaggtaggagcactcagactgggccggaaagtcctccgattctggggggaaaggggagagggggaagaggtcccacagaaggtcccttggtgggcttccgcgtcggcctcaacagtggttctctctaacaatgctgctcaagcctgttttaaagttaatgtcagtaatttgatttgattgttccttccaggtgtctcaaaggctgttgagcacatcaataaaactattgcgcctgccctggttagcaaggtaggacctgcctcctgataactaatgtgtctaatgccaccagagcgtctcccaggcccaggggctttcctgtttatggaagagcttattctgagagctgtagaagcctattggattccctgtcacgcacgagaacaatccatgcatgacataattctaacctgcccgctgcctcaccccacttttgggagcagatggaattgcatcagaagaatgagacacttcgagccctgaggtttcttcccccctgcaactctctggacctttgaagaaattaagatccagattttaagagtggctctcaggggtgtttgtggtagtgtccatggtgactaatttctcatgaactttggaattatttactataattctactgactttaacagtggagttcctgttaagtaaaatctggaaatctcagtatgtcaaacataaaagagctgctggaggtgaagtagggctggggacccagcaacccacccgactctgcaggttttatctcatttaccctcccttcggcccgtccctccgtaattcctgtggcgctcatcagatgggactggtttgaaaacccctgtctaaaaacactccgggccaggtgcagtggctcacacctgtaatcccagcactttgggaagctgaggtgtgtggatcacttgaggtcaggagttggagaccagtctagccaacatggtgaaaccctatctctactaaaagtacaaaaattggccgggcatggtggtgcacgcctgtagtcccagctacttgggagtctgagacatgagaatcgcttgaagctgggaggcagaggttgcagtgagcagagattgtgccactgcactccagcctgggcaacagagtgagactctgtctcaaaaaataaaaataacaaagctctctaggcccagtccaagcccagccacagcctccgtctattcttgaatctagtccctctcctccatgaattcattctgtacacgagggaaaaggaggagttcctttgttgtctctgtccctgactcgttggtttaggcctggcttttgtggcactctgtaattactccctgcccgaccagcccccagacaaaatgtcttgttaccgttctgtctgcaccaccccctgccagtctcccggacacctccacacataccttgttctctgtcccttcatacccctgcatagtgtgactcacacgatgagcaggatcccctgacttttttttaaccccctagagaaacataccaaactgttagtgagaattgacctctgaagctgtgtgcttgggtaactgcctgcctgttgcagtgatgccttgacaaagctgtgaaagacaccaaattgctcatacagcatgatgggatcagagttgattttctttgcatatttttttatatcaagcacatcatagataaaaataatgccttgttattaatatattagtttaaaatggaatgctgatttttggctgggtgcagtggctaacgcctgtaattccaacactttaggaggactttaggaggctgaggtgggcagatcccttgaggccaggagtttgagaccagcctgggcaacatggcaaagcccatctctataaaaaaaaaatataaaaattagccaggcatgatggtgcatgcctatagtcccagctgagtttggaggatcatttgagcccacgaggtggaggttgcagtgagctgagatcgtgacactgcattcctgccttggcaacagaatgagactctgtcttaaaaaataaaaattaaaaaattaaaaagtaatactgatttttattggattactttgagccagttctcagtacgtcagttttgttactttatagtctcatcaaaaattcattttgatccatcattagacgctttgctaaatgatttcggactacctgcagaaatcatgcctcccatcagaggatgaagatttgccatctttgcagttagccaagagtgagcagcagagcctgcctttcaagggctcagcctgcttgagtgaacagtgagctttgcttatttattgcctatgaaagccatgttcctgggtagcagtggtctacatagcacatacctgacagttctcttgggtgtaaagtcactttgggctccctgggtagactattaaccttttgttacaaaagcattgtctgagagtgccatctctgttgcattgttgggtgaatgcctgataaccatcaaagcaagcagaaggcagttttttgtctccccactgatttttgtcctccactttttttgcttataaaacaaacatcacagaattgattttgatattacacagttccaaagtcagattccatggtaggggagcaaaggctatgcagataagagtggccccaacccctcattctcccctctccctcgtagaaactgaacgtcacagaacaagagaagattgacaaactgatgatcgagatggatggaacagaaaataaatgtgagtggcctgaggtggcgtctttactggggaagatcatgaagtctcctgaagattttaaaacctttcaggaagaggcccatgatcttagtgatgagctacatgagcctgtggtctcttcccatttctttgctttactcttaagaaatcacacttttggccaggtgcggtggctcacgcctgtaatcccaacactttaggaggctgaggcaggtggatcacgaggtcaggagatcgagaccatcctggccaacgtggtgaaaccccgtctccactaaaaaatacaaaaaattagccaggcctggtggtgggcgcctgtagtcccagcaggagaatggtcccgggcggagcttgcagtaagccaagatcctgccgctgcactgcagcctgggcaatagagtgagactctgtctcaaaaaaaaagaaaaaaaaaaattttttttgaatatcaggtgcaaaaccaggtgacaatagcctgtcagtttggttactcagaagagctttgctccttataatgaattcagcaattcctactgttggctggagttgggctctgtcttagaggggaaaagcagtggtgagtccacatagaatgctatttgtatttctagtaacagtgaaatggaggtgtgatgggggaggagatggtgcagaatacaaccctcagggcagtacagcaggagaaaagctggtgaatcagaaatgacttcattccactcggttctcttctgttctagctaagtttggtgcgaacgccattctgggggtgtcccttgccgtctgcaaagctggtgccgttgagaagggggtccccctgtaccgccacatcgctgacttggctggcaactctgaagtcatcctgccagtcccggtgagtggtttattggaacttcccaagcaaggagttgggggtttcagcttgctgttggggacccgagacctcctatgccttgatatcctaacacatgtgactctcccagcacagctctgccccttgttaagtgtgaccttgagcaggtaactcaacttgcctgtgccccaggtcctttatctgcaatggaggctcggggaggaaatgacagcagtactttccttgctaggctgtgagcattacctgacatagtcacaagtgtttctcctggtgatgatgaatttgcagttatcaaaatagacctggcgtgaactggttgcagtagcgcacacctgtagtcccagctaatcaagaggctgaggcaggaggatcacttaaacccaagagtttgagaccagcctctaggcaagaccagtatagtgaaaccctgtctctaaaaacatgagtcagagacctggtgagcatttcacagcaccctggcccctctggtgctcctcaagaagcaagtcttgggctcatctgtgagctagattgggatggtaggaccagaggggcttactgccctgtggggctctctggacccagtgccatgcttctctgctctgctctccccaggcgttcaatgtcatcaatggcggttctcatgctggcaacaagctggccatgcaggagttcatgatcctcccagtcggtgcagcaaacttcagggaagccatgcgcattggagcagaggtttaccacaacctgaagaatgtcatcaaggagaaatatgggaaagatgccaccaatgtgggggatgaaggcgggtttgctcccaacatcctggagaataaagaaggtaaaggcgctagggaaccgcccccccacccagccctgcagcgccagctccctctgttggggggtcgtccacacctgccactgtggaaatctattctttccacctgtagtttgtaaagatcaagacccttcaaacggttttaaggaggaaaaggggagcttcattttattttacttatttttttctttttttttttttttttgagatggagtctctgtcgcccaggctggagtgcagtggcgcaatctcggctcactacaacttccgcctcctgggctcaagtgatacctactagtttggggagccaagtgtctgtccgtctgtcctgctggcagggcagcttagccatggacagcagaccctgagcctgagctctcaacggcacagcctggcgggaggatcctgccatcccgggctgcctccactgggctttctcttggaccccgcttctgctctatttaaggcctgtgccttgggacagctgatctcagctgcttactgtaactgtatcttggccaggacagctgttcctgggcactaaatttgggagcatttgtcagtgagaagggctgctttcttggaaagagagctgaatttcccattttgtatgcaccaagaactctgacccatggtttcttgccccaaagcagaaaaaaagtaactgatgtcagaactactggttggggcctgaacacctgttgatctttgtgttacagtccctgtgtagcagctgttgaagggaagttttctctgtacctacctgttttccaaacctgttgtcaccatctcttcccaggcctggagctgctgaagactgctattgggaaagctggctacactgataaggtggtcatcggcatggacgtagcggcctccgagttcttcaggtctgggaagtatgacctggacttcaagtctcccgatgaccccagcaggtacatctcgcctgaccagctggctgacctgtacaagtccttcatcaaggactacccaggtgagtgttccccgagtgccatctccctttcctgccactgacctgcagcagggcagctggagcatctggctggctggtgatggctgcaaggaggggatggggagggagtgtctgaacttccagctcccgtaggggattcaccactgggtttgcccccagttgtgcatacacagggcttcacagaggttcttgtgtagctaaggagctcgggtgccagcagcgacattgcataataagttgttcacagtcaggagcagaggcagtctgtgctccattagacaggtgagggaaccaagccttcagaatcagaacagccacttggtactgagatgtatcatgcttcctgtgagctgggaatattcattttaggctgtgtgtgtgcacaggatagagactgtgaccacctttctacaggagaggaagctgatggctggctgaataatctgcccgagagcacacagcaaatggtggggcaagaattcagaccaggaaatctgactccagagtctgtgtgtttaaccactaccctaaataacttggtcaaggttgagccaagacccaaactcaggtcttctcacttctgagtctgtggctccattctgattttcagtggcactaaactcaaacaaccctagacaaaaagtgtcctcttcttacaggtcttaaacaaaatttttgaggctgggcatatggtggctcacgcctggaatcctagcacttggagaggctgaaacggcatcacttgagcccaggagtttgagatcagcctagggaacatagcaagactccattgctacaaaaaaataaaataaaataagtagctgggtaggttggcatacccctatagtcccagcgactcaggaagctgaggtgggaggatcatttgatcccaggatttcacagctgcacttagctatgattgcacccctgcactcaagcctgggtgacagagtgagattttttttgttttagatctatagatacccaggattgtgggtgacttttgtcccctgctgcaggagtaggctggggcacattgtttcaaggatcagttggggagctgtccccatcctatgcttttgggcattgtgaggccaggcgagcagcaagtcaagggggaagcaaggctgggcattgcggtggagcacactgggaggatcacactgatgaagcgtgtccctcctttccttagtggtgtctatcgaagatccctttgaccaggatgactggggagcttggcagaagttcacagccagtgcaggaatccaggtagtgggggatgatctcacagtgaccaacccaaagaggatcgccaaggccgtgaacgagaagtcctgcaactgcctcctgctcaaagtcaaccagattggctccgtgaccgagtctcttcaggcgtaagtgtcttcccaggcgagcagctttcccgcagctacggcttgtgaatcagaaaagggcccttttgttctggtgatggggaatcctgctggccagaatgtaggactcgctggaattttaacaggttttgtgtttgaactcaggagccttttaaattaaacaattggggcctgtaatcccaacattttgggaggccaaggcaggaggatcacttgagctcgggagctcaagaccagcctgggcaacatagcaagtagttgtattctgtgaagagctctgtcagagaacactaatctttctcccatcaagggaggctgaacccagtgtttcaactatgacaggagggctaagaaggtcctgggggtggaagagttcaggggagggtgagggttctcctctgtgctcttgacaaagcccaggcatggagggctttagccattaacagcccctccactgctttcctgctggcaccgaggggtaatggcattgggggttatggaaccagaaaatgggatcatgccatctgggttgttccttggcttccaggtgcaagctggcccaggccaatggttggggcgtcatggtgtctcatcgttcgggggagactgaagataccttcatcgctgacctggttgtggggctgtgcactgggcaggtaagaatgagcgtctcctcctttcttctctgacctcaacttcctaggaagacccaaaaccagtgaggctccatgtctgtccccgttttgctcatgtcccctgagtcagtgctcttgtttctgaggctgaacagaatgggggcatgagcgccctgcctgtatgttgtggcccccactttcctagcatcagatcctctagaaattctctctctgacaccacaccctctccctgccagaaatgcctgcaaagcttgtccgctgtaagcaaatggcctttcttttctcctagatcaagactggtgccccttgccgatctgagcgcttggccaagtacaaccagctcctcaggtaaggagggctcctgagaacaaggggcctgtggttcactaggtgggggcctgcactcagtgtaggcactgccctcccccaggagctcctggctctgggaacatgtacaggtgcaggtgcacagtgcagacagccaggccctgagcaggcttaggtcaggacagagttaggcctagactccccctacccacccactgcagcgccaccagaggcaggagcctgttccacacagtgctgccctcttctggtgagaaagaatgggaccccctttgacagctgatgcatgactttcttagagctttcagagagctccttcatatgatctgtttcagcgcatttaacccctgtttgtggatgtggagccagggctgggagggaggaagaaaaggccgaagggcacatggctgggtttccacttgtgagcgctgtggggctgttctggtctccctttcctgtctgtgtccttgggaagcccctgaacaccaggagacttgtccccccgcccgccaccccgctaagttctcccatattaccccttcattcaaactgtatcctggaaattttcaaacatatacaaaaaagcaggtgaacagtagacgcagggcttttttgttgttttgtttgtttgagacagggtcttgccatgtcactcaggctggagtgcagtggggcagtcatagctcactgcagcctcaaactcccattctttttttgctggggaattttatttttatttttttgagagggatctcactctgtcgcccaggctggagtgcagtggctcagtcttggctcactgcaacctctgcctcccagattcaagcaattctcctgtctgagcctcccgagtagctgggattacaggtgcccaccaccatgcctggctaattgttttgtatttttaatagagacggggtttcaccatattggtcaagctgacctcgggtgatcctcccactgtgcctggccccaaaatgtgttggcctttttttttttttttttttttaacatcaagatccaaacagctcacacattttgtcttttaataaggtcactctccttttctccccatgccatttatttgttgtcccttcaatattttttaaaaaacaaaagcattagaatttttatattccaagaaatggcaatgctgacattttactttgctcctctgcaacactgacggggagaggagaggaagagaaggggcggtgggtggagggcacctagcatggtgagttgggatgaggagaactaaatacttttctatatctggcttctcagagaagcacaagtttagagggtttaaagaaggtggacaaactggagagttctgtgttctcaacttcccaggagtggggctgtgtctttgaccacatctaggatgggaaaacttaaaacttgaggtctgacttttcttttttcctccccatctctttacctttctccttcccaagaattgaagaggagctgggcagcaaggctaagtttgccggcaggaacttcagaaaccccttggccaagtaagctgtgggcaggcaagcccttcggtcacctgttggctacacagacccctcccctcgtgtcagctcaggcagctcgaggcccccgaccaacacttgcaggggtccctgctagttagcgccccaccgccgtggagttcgtaccgcttccttagaacttctacagaagccaagctccctggagccctgttggcagctctagctttgcagtcgtgtaattggcccaagtcattgtttttctcgcctcactttccaccaagtgtctagagtcatgtgagcctcgtgtcatctccggggtggccacaggctagatccccggtggttttgtgctcaaaataaaaagcctcagtga

SEQ ID NO: 147 - DNA, 7890 bp, Homo sapiens
attcctgagagctctcctcaccaagaagcagcttctccgctccttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtgagggtcccccctgcgtggctgactgtgcccgcagcccctttctcctggtagtcccggtccctatgcacatctccagcccccagctggcgtcctgctgggcctcacccgccctggcgacactctcccttccatcctccgactcacccctcccgtgcaccttggtttgggctgggtgagggtggggagagggtctggacagccgggatgaatcctggggcttccttcttcccttttaaactggagggtcttggaagagagagacaacttaagggtacagcctagttcccaccacccctctctacaaatcccgttcttcctcaggtcattctgtccccaaattataaaaaataatagcggttattgttctcaccccaacccgagttctgaccgtcttttaagctatcgccctgcggcagtcccagctgttcggggactaccctcctccaggttcgcctcttcgccagcactaccccaagggctccccagtggtgcctttgtgattttttttctttcttttcttttttttacataggggtttggtgtgattctagcattctaggagaaggaagtgggtgtctcggttcaaacgggcaaatattgattgaggcctttggcgcccggaggcctgagtgcgggggtcacagaatgagtcataccccggcccctgcgccggcagcgtgggcggggccgagggcggggtgaggggctgcgggcagcagtctcgggacgctctcctccacctggcggagctcggcgtcgggggcggtgtgggtggggtggggtggggtggggtgggctggggtggggtggaggaggcgccagggcctggcctcggaaagcccatgcaggattcaaagtctgcgggcgtgggacgccccgcccggggtttacgtcctgttaagtttatggcttcagataacgcggtcgcccaccaacgcccctcgcccattcagcccgtgtccctttctcgcgtcctgtccctgctccgccccagcggcctggctccactttcacacagcaggagccaggccgggttttgcagccctgggactccgctgcctgaggggccccgggcccccggcggccccgaggattgggcccttcacgctgactggctcctgggaggcattgtgggaacgggaggagggaaatcctggggcagagtaagccgggaggaaccggagccccaggaacccagtggtcgggggcccttggcgctccaagcgcctggacttgacttgttgactgcgttttgctagccctggggtccttatagagagcagctaagcataggctttggaatctgaattcttggttcgcactgctctgccggttcctggttatggactcccttgccaagtcttatttcctcatctataaaatgaatatgagagcccctaaatccatataggcaaaagtttttgcctattcaaacttacatatgtaaagagttcagcagtgcttggcccacattccattaggataagatgttataatcacttttttttaaaaaataattttggggcagaatgacctggggaagaaagcgatttgcagagagtggtggagggaactaggctgtacccttaaaagatttctgtcccctccagtttagaaggagttacaagtttttttgtttgtttgagacagagtctcactctgtcgcccaggctggagtgcagtggtgtgatctcagctcactgcaacctccgcttcctgggttcaagcgattctcctgcctcagcctcccgagtagctgggactacaagtgcgtgccaccatgcccggttaatttttgtattatttgtagggacagggtttcaatatgttggccaggctggtctcgaactcctgacttcaagaaatccgcctgccttggccacccaaagtgctgggattacaagcgtgagcctccacgcccggcctctttttcaatcttaacatctttagaaaggttggctatttttggccgggcgcggtggcttacgcctataatcccagcactttgggaggccaaggcgggccaatcacaaggtcaggagttcgagaccatcctgcctaagacggtgaaaccctgtctctactaaaaatacaaaaaaattagtggggcgtggtggcaggcaggtgcctgtagccccagctactcgggaggctgaggcaggggcaggagaatggcatgaacttgggaggcggagcttgcagtgagctgagatcttgccactgcactccagcctgggcgccggagactcccaaagaaagcttggctatttttattgatgtgtaatatacaacctatgtaaatgaagttaggcctattggtttgcaaatgcagctttaacataattaccttacctgtctccttcccctacccaatgctgagggacattgctccccacctcaccatcatgccatgctttctccccctggtcataggtgatctttccagaacagctaaccaggtgcctggggtctggagaccttactgcttgaggagtgaattaagagaaaagactgcttgctttcctccagactttgagccctggcctgatgtagacctttttgctctctcctccttcgtataggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtgagcaactcccaccctccacccaactgaagtcaccgtgctctcctccaccccttgggaccttgggactaagtccccatggccctctgttgtgggaagtgcagtcctatctaattagggtgaccacctgatgaggtttgctcggaacagtctgtgtttatgcccaggttcctagcacaattgttgatagtacccaccccctttcaatctcaactgtctggatttgaagaacaaattatgtgtcaatgttgacatggtaaacctgagacgggagagataggcagcctgtgggcctcacttttgtacttaacattctggcccctctttagtcttgacccttgacctctagcaaactctagaaagttctgtctgaggtctcatgtcaggccctgctgttaacactctcaaggtgtccaatccgatgtgtattcatggatttggagagagatttcctgcttcccacgggctaagggaggggtgagggtggagagggcagctggggaaggcagaaggaccagccttctcatatcctgcatctctgtgaactgaattttcctgattttcacaacgcccctgtctcccaaaagaccaagggcaacctcccttttgccttcatcctctaattgtaagtcttttcctcacaggtatgaggatgagatcaataagcgtacagagatggagaacgaatttgtcctcatcaagaaggtgagggagtctcccttctcctatctggacactggaggctggggctcagagactcagaccaagaagctttctgggttttgtccctaaatattcctaagtagtgggacaaactcatttatgtaaacatttgggtgcacagaaaggtagacaaggatggagtggtaggtgcatttggacagaactcttgacatcggtgttgggacatggttcagaaaacagagcagtagaactggagatctggctctagaaggctccctagagaaggaggtggaagagggtgtgttgcaggaagcagaggtgaaggtgtgtgggctgagaatgcacatgtgatgggcagaggctgggctggaagatcaatccacaaagtgggcaactagaaagtcctgtgaccaggccattgggtggaccttgggagccccttggttggggttgggtgtggaaacccagctcaggctcccctctcctcatcccccaggatgtggatgaagcttacatgaacaaggtagagctggagtctcgcctggaagggctgaccgacgagatcaacttcctcaggcagctatatgaagaggtatgttcctggtcgcaggagagtgagggtcccccagccttgtcagcgcctccaccctgagactcaaccagaggctcctcccagcccccagcacactaataagacaaaggcccactgctgactaattacagccaccaatatttgctcggctagtatttattgggtctatatgttctgtccctcgcatgagggatgagtcattaccccatttcacagacgagaaagtgggctcagagaagtgaaataacgtatccaaggtcatcatagggtgtggtgattcagcagcaactctgtccccaaagcccttgttcctaatctttgagctgcattggatccctctgtgcacctagtattggtgcacccagttcctttttcaggaactttgccctctccctgaccctgactcccacctgctcctctcctctgctgcccctgtcttataccctaagaaaggctgttgtggaaaagggggctccctgtgtgcagagacagggcctcaccacttgccctcttcccccacaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccaggtatgggccgggttgggggtgggaggggttccttggacacatcctggtgagaggagataatgtaggaagagtgaagtttctgggagtcggggaaggaatcctagaccagggttcaggagttggaggggcagccacagttcagcttctcagtctgcttctgagaagcaaagggatgcagggaaggtcccttgggccaggacagaggtgaaaggggactggggcaggtatgttggggctcgtgatacatgctcccaagcctgctttaatcagtcatatgcatcagggtaaggttgagctctgctgctttaaggaaagtctagaacccagggatctagtccagttagggtagggggaccttacagtgtcgcaggtgagaagggtgtggaggggaagcacctggaaactgctcatgtctccctgatctgcttccttagtctcgtttatttatttatttatttttgagacagagtcttgctctgtcgcccaggctggagtgcagtggcgtgatctcggctcactgcaagctccgcctcctgggttcacactattctcctgactcagcctcctgagtagctgggactacaggcgcccgccaccaggctggctaattttttttgtatttttactagagacggggtttcactgtgttagccaggatggcctcgatctcctgaccttgtgatctgcccgcctcggcctcccaaagtgctgggattacaggcatgagccactgtgcccggcccttagtctcatttaatttgagctggggggagtcagcctaggtggtggtggggaggaccctgagggagggtgggagcacgggagaagagaaggcatacccaacctgacctacttacctgtcccctaccccacagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggtgggtgtgggtacctctgaccggacctgcttccctatccctgggacctggggtggggacggtgggagccccctgaagccccttgggacttggggtcctgttgttctgggccaagaagggctaggagttggtcctgacaccccatttgtctgggtacaggctggagtctgggatgcagaacatgagtattcatacgaagaccaccagcggctatgcaggtgggtgtcccagggccctgggatgagggcgggaggcagggcccagggaggcctcagctccagggagggggctgtgctcagtcgctcacagtgacctcagcctgagcactcatgttcttgggagaatcctagggtggggaggcacatattcaggaccccagtaataactttattacttagtaactttactattagaaagcacccaaataaaccatagctgtgtgccaggcactgtgctaagtatcctacaggttttatgtgatttattttatttattaatttaatttaatttttttgagacgaagtctcgctctgtcacccaagctggagtgcagtggcgtgatctcagctcactgtaacctccacctcctgggttcaagagattctcctgcctcaggcctcccaagtagctgggactacaggcgcataccaccatgcccagctaatttttgtatttttagtagagacggggtttcactgtgttgggcaggctggtctcgaactcctgaccttgtgatcagtgctgggattacaggcatgagacactgggcctggctgtaatttattttttatatgacacctgtaaacgtcttcagttgaggaagctgaggtgcagctaaatgtccaaggtcacacagctatatatatggcagctgttttccaccctgctcctggttttccctgacagttctggagtagtgaaccatgcaatcactgatcaggcagagctgggttaacctcccatccctggggctatgttgggaatgagcagggagaaggggcatggagcctgccatggggtgggcttctgtactcatgtggctacctctgtccctcaccaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaatgtc

SEQ ID NO: 148 - DNA, 7019 bp, Homo sapiens
gcgatggcgatgatgcctctagtcctgcatcatccagagcggcaggcggagctggggtccggactgcgagatggaggaggggcggcgctgcggccacccggcaggtgagaggccgcgggcccctggaggaggacaaccccacgatgccggagacggctcccggaggctggcgggatagcgaggagcgcggctgcgctgggccaggcccggctccgcgtacctgtcttcctggtgcggcctgcagggtagccttctcgcccgtccctgccggttcccaggctctgctcggccgtggaaccccccccacccacccacccaccgcccctaccctggctgagccctcctaacccaccacccctctgcggcattcttttgcaagcttacctggcccggcctaggccctccttaccgtcacctcacccttctccgggaagcccctacccaccgccagcccctcacgggggggtcgaccttccctgcccgcagtttcccactctgtcctcaggctgggggctccctggcctcttcatccctcccatcaaatgactcaggtcttcccatcccattagctgctccgggttcaatgtagttctactggatagaaagagcaagggctttgaaatcagataatgaccttggggaagttatctaacctccctgaggttttcctgatcgatagaaatacaatgggaatcacaataatacagaaccttgctctctgtgaggattaggctttgaaaatgctaacctaagacattttggggcgcgcggggaatggggttggaagaattcaggtcgtgagttgatttatgaaagcccctatagcatgttttaatgttcactaaaaatttaaaacagcacactagatatatcagaggctgttcacatatcttaatgaaaaatcattgccactcaaattatacaataaattttcatccatattctttgcttgctagttacttcaggatgtctcatttgtaagaatatgcatgtgaattcattcttactgcagctaatatgcatgcttaagactggtgttccagcttaaaatctttctgattttgtgactttaatcacatcttctataacctattctccgtcccagagatgaagagtagcttgtatgtttgcattgcaaataacatgggtaatctttattgaatatttatgagtagcaaagcagtattaatttattccccttccaaaaccacttttattttctgccgtcatcatgtcattccaaattatggtcacagcctcctttttcttaaagtctcaggagttactactaagacctgagtttactttccctccattttcttgatttctgttatactaaagtttttctgcaaaccttttcgtcttttctgtcctctgctttttctcccttttctcttcccagcccatgattcctttttttctaattatctcaataggagtgatttatgattactttatatgtgaactacagttagatacatagaagaatgtgtgtgtgtgtgtgtgtgtgtgtgtgtgtgtgtgtgtgtctatctgtatctacatagatgtagatatagctatataggtgtatcagaatttcggattccagaaagtttcagtggggaagggattgcaatacctattcataggattattgtgagaatgaaataaagcttgataatttatgtaaagcctctagaataggtgcctggtgtgtaataaccacttaatacttctgacctggggatgcctcccaaaaaggtttttttgttgttcgggttagcatggtggtgaagagtgtggaagagcaactgcttagattcaaatccatgttccaccactttagataacctctctttgacttggtttcctcatctgcaaaatggagatgttatatcaagtatttcagggttgttatgaggactcaataagctaatagtgtggaacattgagaaaagtacctggcacatcataagcacttgataaaattaatatactaataatgatgctgataattatactgccattgttatttcctgacctggaattcttattttttttaatttactgaaggctgggtacagtggctcacacctgtaatctcagcactttgggaggccaaagcaggcagattgcttgagcccagaagttggagaccagtgagggcaacatagtgagactccatctctattaaaaatatatatattgaaaaatttaaaatttgttgaaaaaatgtaactgtacaaaacgtgaaagttgcctctcctctaccccaaatcaccttttttcctcctgcctcctattcttgactaatgttagtgcttcatcatctcatttttctcctaatccctttttccaaatatctcttagcctgaggtcttcataacttccatcatcccgcttcattattacctagttacttttcatttgtcttagcatcctaattccagactcctcattcttctaatttccccaggccaaattcctgcatccctcttcacccctcttcatctctctacctccaaagaggaaacccttggagataagggggttagagacaccagtatcacctccctgctcttcctgcctcctcaaattgttttctcttctacttcccttttcataaattagctgtaatactcctgttagcaacttttaaaaacagtaaaaaattgtctttctcggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaaaaattagccgggcacggtggcgggcgcctgtagtcccagctactcgggaggctgaggcaggagaatggcgtgaacccgggaagcggagcttgcagtgagccgagattgcgccactgcagtccgcagtcccgcctgggcgacagagcgagactccgtctcaaaaaaaaaaaaaaaaaaaaaaaaaaaattgtctttctcattatataggtatcaaaagtgttcagaaacaaatatacagcctttaagtggaaatagagctatctggtactatttttaaaaaattctaaccatcaagaaacaaaagttcaggattttcttctcttatggaacttttatttgaaaggaaagtatagaaaagttggtctcactttccagtggacaaattcaccatatcgtcctgatctgtaccatatgaatgttaagaatatagattaagttatctttttccttgattaaggacaccagtcaattatatggatttcccaggactggtatatgtctgatagtcactggcatggctgtatctgttgttaaatgtggagagacttctgtattgggtagtccatagctgctaattggagccccaggtaatccctgactgacctggttcattccgctgtacccccttgatctggcaactaaagggttaacagctggaggcttctgggatccagcttgagctggtggttaagtacactgaacatcagccctggacctctgcagtgccacttattgttcctaaaattctagattaaggcaaaccctttttggttgtcaagaacatagtgctgtctccaaggaacagcttagtcggtcccaccagaagcatctgttgggagcaggttgggcaccaacccttgcaggactttgggatttgggacaatgtagatttgtgtgagtgcacattaagtctcattgcaaaatagaaaaaaaaaagttaggaaaaaggagcaagaagttattcttttaaagtagagactgccttactcatcgtagcacctagcacctggcgtaatgctggcatatggtatgcacataattaatataaattgagcgaacgaatgcaggaatgggtgcatgcctcctgcttcaccatcaggatattcttgttgggataatggtaactcacatttatatagcagtttagactttacaatgtggtgctttgcaccttgtaaatttctaatataattccaacatccttggttacttccagttttccgtctcacatgtagtcctacacaaggtttttttccaaaggagaatatgtagttaattggccaagaaattgcaagctgggggaaaaattataaatactgggaaataaaggattcttcatagggaacgaaacagggtttgttaatgatttatgggaattatgtgaagggccacattatgcatcaacaataccctccagcctatatttcaagcacatgcagttttttgccgcagtgcttctgctgcaaagacctacccccacttctcttagcctgtctgtccccactccatacccccgacctttcatccagctggcctgtgcttgctaaagctccctttatcctttcccagctccctttccatgttggagtaggttccccccttccatgctctcatagcaccctgcaaccttattaggctgtaattattacatagttagattgatctccaactagattgtcatctctttggtggagagattacgttcttgtgtatcttcagtgcctgacacagaagtgtttctaaaagtaacatctgcacacccctcaaacagaatcacaaggggcgaggccaagaaatctgctctccaagtgataacttaaactttttaacatgctcttcaggtgacacttaaacttgtttgaaaacctctgtgtcataaaactaaatattagctggatgaatgtatttgtatctttttctgtgttggcctttgtgaggagaaatgctgtctatgcaccaaatcagagctgaaaaattctagtgttttgttaaaaaaaaaaaagagagagagagagctgggtttggtggtgcatgcctgtagtcccagctacttgggaagctaagccaggaggactgcttgagcacaggagttcaagtccagcctgggcaacatggtaagaccccattgctaataaatgaataaatttttctctcaaggtgagagatactagtactaatactactactaataatgagatcactgtatgaattcctttctgtttctacattaatccctttctgtttctgggtgtgcatttttgtgtgtaggcttatctgtcttgggcctcttttgtcacatattgctcatctgtgagctgaggccctgactcactgagtatttttggggagcagaagaaggagacatttctctccgaaaatgaactcaacaggccaccttcaggatgcccccaatgccacctcgctccatgtgcctcactcacaggaaggaaacagcacctctctccaggagggtcttcaggatctcatccacacagccaccttggtgacctgtacttttctactggcggtcatcttctgcctgggttcctatggcaacttcattgtcttcttgtccttcttcgatccagccttcaggaaattcagaaccaactttgatttcatgatcctgaacctgtccttctgtgacctcttcatttgtggagtgacagcccccatgttcacctttgtgttattcttcagctcagccagtagtatcccggatgctttctgcttcactttccatctcaccagttcaggcttcatcatcatgtctctgaagacagtggcagtgatcgccctgcaccggctccggatggtgttggggaaacagcctaatcgcacggcctcctttccctgcaccgtactcctcaccctgcttctctgggccaccagtttcacccttgccaccttggctaccttgaaaaccagcaagtcccacctctgtcttcccatgtccagtctgattgctggaaaagggaaagccattttgtctctctatgtggtcgacttcaccttctgtgttgctgtggtctctgtctcttacatcatgattgctcagaccctgcggaagaacgctcaagtcagaaagtgcccccctgtaatcacagtcgatgcttccagaccacagcctttcatgggggtccctgtgcagggaggtggagatcccatccagtgtgccatgccggctctgtataggaaccagaattacaacaaactgcagcacgttcagacccgtggatataccaagagtcccaaccaactggtcacccctgcagcaagccgactccagctcgtatcagccatcaacctctccactgccaaggattccaaagccgtggtcacctgtgtgatcattgtgctgtcagtcctggtgtgctgtcttccactggggatttccttggtacaggtggttctctccagcaatgggagcttcattctttaccagtttgaattgtttggatttactcttatatttttcaagtcaggattaaacccttttatatattctcggaacagtgcagggctgagaaggaaagtgctctggtgcctccaatacataggcctgggttttttctgctgcaaacaaaagactcgacttcgagccatgggaaaagggaacctcgaagtcaacagaaacaaatcctcccatcatgaaacaaactctgcctacatgttatctccaaagccacagaagaaatttgtggaccaggcttgtggcccaagtcattcaaaagaaagtatggtgagtcccaagatctctgctggacatcaacactgtggtcagagcagctcgacccccatcaacactcggattgaaccttactacagcatctataacagcagcccttcccaggaggagagcagcccatgtaacttacagccagtaaactcttttggatttgccaattcatatattgccatgcattatcacaccactaatgacttagtgcaggaatatgacagcacttcagccaagcagattccagtcccctccgtttaaagtcatggaggctataggatcttatgtaaacagtttttgtttctgatagtaatggactttattctaacttgagatcagtggcggatcaaaacctacaagattcaactgaaaagttggcagttatggttttctttcatctgatgtgtcagtatctgttgatttgctttgtagtttgttgacatcttaagatttgatgtgaaagttttagattttttaccctg

SEQ ID NO: 149 - DNA, 14456 bp, Homo sapiens
ttcctcccaccgccgacatctccgggaacccagcccaggccctgcctcccggacacaccgacgctcacgtagtcgcgcttgccacaaccctgcgggctctccgatgcggcgagcgagctggggagggggcttctccgcggcccaaaaggtgggtgcggcgcgaggccaaggaggcttgtagggaggttgggggcggagtgcagccctggtcaaactggacggaggggacagagtcggagagtaacttgtgggatcctccagcctggagagcactggcctgctcctgcgtctctttggaatccagaaaaaggggtgtggaaggcacagtagctgcaaaagagggagtgggggccggtaatgacttactggaagatttggggcctgtcagagcactgttttctgaaaaagaggagaaaacagaggaaagactggacttgggaacttggagacttggaaggtgttggaacctgtggtctgagtggcgggggcctgcctgggagacccagggtgcagcagaagagacaattagagctttggtctgggaggaagaggaggagaggaggaaatgtttccttgggcagagttgtccaggagccaaaactaaagtgaagacagctggaggacttacacaaaagtacagttgaggtatttaggaaaaaaagttagtgggaagagaagcggcaccaggggtgggtcgcaacatacaatgtcagggccagcagggaccttggaggggacctcaagcccagagcagctgagtgactcgctcaagtagcaaagcaaggtgcgggcattcttagcctagtactctgttttccctcgtacgtttttagacggcaggggctgtgtcatttgaacttgcctctttcctagaatatgcaactgtattcacaaatgtcagtctccaagatgctttggatgatggggacaggatcaaggggtacaaggagcctttaaggctgtgaataggcccccatggtctgagtacaaaggggaaagacatgcactctcttcatgctggatcagtgaaaccttttggaagggaacacagaattgttggagggaggtagatggccatgtctttaaaaatgaaaattataacctggttgtgaatgtttactgaatgcagttcggcagctttcagtgttcctggtgggttgcttgtgcatctgatttttttgtttgtttggttttgtttgtttgttttgagacggagtgtcgctctgtcgcccaggctggagtgcagtggcgccatctctggctcattgtaagctccgcctcccgggttcacgccattctcctgcctcggcctcctgagtagctgggactacaggcgcccgccaccacgcccagctaatttttatttgtatttttagtagagacggggtttcaccgtgttagccaggatggtgtcgatctcctgacctcgtgatctgcccgcctcggcctcccaaagtgctgggattacaggcgtgagccaccacgcccggcctttttttgccttttttttttttttttgagacgtagtttcgctctgtcgcccaggctggactgcagtggcgccatctcggctcactgcaagctccgcctcccgggttcgcgccattctcctgcctcggcctcctgagtagctgggactacaggcgcccgccgccacgcccggctaattttttttttttgtatttttagtagagacggggtttcaccgtgttcgccaggatggtctcgatctcctgatctcgtgatccgcccgcctcggcctcccaaagtgctgggattacaggcgtgagccaccacgcccggcctttttgtcttttcttaccagaagaaagagagagagagaataagagaatggaggggataatgtcgtggccctgatacaaaaaagatttcctccctatgaaaggtacagccagaaagtcagtagttcagctgcctgaaaccgtgaaggtcatagggttattttctgtgcaggtctatagttatcaccatggccgtctaaccttggccagctgtcttgagaaggtgtgttatgagtggaacagataaagcatttatgcaaaactatctccatgatctgttagggtttgccctgtcttagccatgaacactgtaatctaccctcaagcatggcccagtctctcaccagagaaactgatccctgagctctgaggcatctctatggaagcaagtgtttgagaattcatacctacctgggagcagcactcatacactcattcctatcctgcaactggtatcagatcctgagtcctgctctcatggttcaaatgtatgtccataacttctggttctttttttttcccccttggccaactttggtgactcatattccctggcctgggaaaaggacagagctggagcagccagagagtctgtcaggagaggaggctgggctgcagcctggtgcttcctgtgttggaaccgatcattttcatgtcatttgtaaaagaagcacctgtccaggtgccttcttttcaggaacttaatattaccttgcacatctcagttgctaggagtacttctgcatggcggcagccatccctgtcacagtccgctggggagttcctgagcagttcaggaaagcctacaccaaaccagcactttggtgtgctgattcttggagaatgacctggtaaataaaatctggaagctatctgtgggacaggcaaggtgactgacagtcgagtcataccccagattgaggccacacaggttaatgtcctcacctgcagttatggtgacacacaaagtgaagggattctagactggggttgcttgtgcaatgtccctggggtagtagtcctgcgggtaactcttgagccatcataaccttacttttgcctttcatggaagaatcttgtaatagcagtttggctccttcaagtgccagcagcattgtttaattagctctggctctgactagagcctggcctctccaagccggacttctgcttgttcttacagcttggtgataaaaagggatctcagggacaaatttatgccactggggtgaaacagtgaaactctaccaaggtcttcagctaagtctcttcagcctgcgggattagaacttgggacattggctctagtgggctgtgtgtagattctttgattgatccttttgctttggctgtttccacaatatcttgagagtttccaaggcttttcctaacatgcagaaaaagcacgtaggaggctggtttgcaggcttcttggaagtgcaaagagaacttgcagataacctgtgctgactcagttgaggaggaagctgtgaagaggaacccttcctccctcagttcacacccagatttttcaggatgggtagagtggggggcactgggatgccagatatagcctcttgtttggttttcgtacttgtttaaaaacaaggctgggcacggtggctcatgcctataatcccagcactgtgggaggctgaggggagcagatcatgaggtcaggagttcgagaccagcctgacatggtgaaaccccgtctctactaaaaatacaaaaattagctgggggtggtggtgcacgcctgtaatcccaggggtggtggcacgagtagtcccagctacttgggaggctgaggcaggagaatcgcttgaacccggatggcagaggttgcagtgagctgagattgcgccacggcactccagcctgggcaacagagcaagactccatctcgaaaaaaaaaaaattaaaaataagacaaaacaaaaacactacctgtgttacagttagagctgagggtataattccagcacagttttgcaaaggacaagagtaactaaaatttagatattttgtaagtataggattttttttttacattgaacctgttagtcaatccgtggaacctctgcaaacctaccttgcctaattcagtcagaactttcctttccagaacagttacgtggctataagaacagatcattgaaagcaaatttgcccttaaaattttcactagattgattttcttaaaggggaaacagtgagacagatatcctttaaaatgaatgtttaagcacctgcattctggccataagttattgttttatttgtttccgaatatgtgtatttctctgactggccatctgtaagggtttcttgcatcccagggaagttctgtacttttggaaaaatggggtcaaatctgatatgtgttcgtccgttcaccttttttctttacatgtttggttaatcacaatcagaaggtgaaaatgagaggttatttatagaactgaaccagtggtcccagctctttacagaagacacttggcatgttgcctgtcacttctcaggggtggccatggctgcttgagagtgagctccccaacacgtcatcacacacctacacctgtgccataaggaggggtaagataggttgaggggagataggtttggggactcatccagatcctgtgttctgtgattctcagacttgagattttaatcctagtttcggcactcatttccttaatttagtccattgaaactgtcaaatcaaaatataaatttgccatggtaattagaatgataaaaagtgctcagattttgggaggctgaagcgggaggattgcttgagctcaggagtttgagaccaacctgggcaacatggtgaaaccctgcctctataaaaattgaaaaattagctgggcatggaggtgcacacctgtagttccagctactttggaggctgaggcgggaggattgcttgggcccaggagtttgaggttccagtgagctatgattgcaccactgcactccagcctgggcaacacagcaagatcctgtcttataaaaaaaaagtgctcagctttagtgaggcagtagtgatgggatgggtttttggcatatcataaaatatttgaggattttttttaggttcattttgttctgatgatagaagcaatattattttagaagatataatacaaaccaggataccagaaattcctgaaatcttgtcacctaggtattctgattttaaatatatatctctagtcttttttctctgcatttacataatacagttgatccttggacaacatggagtctaggggagcctagcccccacacagtcaaaaatccacatataacttttgactccccaaaaccttcacttctaacagcttactgttgaccagagtcttaccaataacatcaacagtcgattaacacatattttgtattttatttgtaacatataccgtattcttatagtaaagtaaactaaaggaaagaaaatgttaagaaaatcataggaaagagaaaatatatttactattcattaagtggatgcgggtcatcataaaggtcttcattctcatcctcttcacgttgagtaggctgaggaggaggaagaggaggagaaggggttggtcttgctgtctcagggcggcagaggcagaagagaatctgagcatacgtggacctacaaagttcaaactcatgtcgttgaagtgacaacagcatttttccccacaagtctagtttctatgtacaattttatcttctctctctctatatatatatacatatgtagacataaatataaatatataatatttttttttcatttcatttgaatcttttttaaaataatggctttaatgatgatataaaattacatcacatgggctggccatgatggctccccgcctgcaatcccagcactttgggaggccgaggcgggtggatcacctgaggtcaggagtttgagaccagcttggccaacatggtgaaaccctgtctctactaaaaatacaaaaattagctgggcgtggtggcagactcctgtaatcccagctactcgaaaggctaaggcaggagaatcacttgaacctgggaggtggaggttgcagtgaaccgagattgtgccattgcactccagcctgggtgacacgagtgaaactctgtctcaaaaaaggaaaaaataacaacagtaaaaataaaagtacatcacatggatgtggtacatttaatttaaccaggtacctgttaatggtcacctaggttattttgtcatctttttccccctataatgtggcattgaacattttagtaccttaatctctgtgtgtttttaattctttacctaggataaatgtctctatgtgatattaggataaaaaatgattaaaaaattagaaagtttgtaccaattttaactaatgaaaatgtttgcattggctgggcacagtggctcatacctataaatcccagcattttgggaggctgaggtgggaggattgcttgagtccaggaattcaagactggtctgagcaacatagtgagacctcgtctctacaaaaaaatattttttaaaaattagccggacatggtggctcatgcctgtggtcctagctactcgggaggctgaggtgggaggaccgcttgagcccaggaggtggaggctgccataagccatgttcataccacttcactccagcctaggtgacagagtaagacccagtctcaaacaaaaaaaaaaaaaaaagaaaaacttgtattatcttttcaatttttttcctaattcaataaataaaaaacagacattgtttttcatctaaatttcttaaattaataataaggttgaacattttgcatatttataggccactttaaaattttttttcatgaattttctattcatgttctttgcttatttttctatgtggaatatttgactttattattgctttgtaagaacactttacatattaaggtattagctctgctgctatgcttattgtaaaatattttcacagtttgtctgtagtctttttttgttttacttatcgtttttacttaaagaaaatatagtttttgttaactcagatttatcctctttcagcatgattctctttgctttttattcttatagagccaattttttacttgtggaaaaaacaaatattcacctatgttaaaggcttaagaatacgaaattgctggttgtttttattttatttatttttattttttttgagacagagtcttgctctgtggcccaggctggagtgtgtgatctctgcacactgcaacctccgcctcccaggttcaagcaattctgctgtctcagcctacagagcagctgggactacaggtgcatgccaccatgcccagctaatttttgtaattttagtagagatggggtttcaccatattggtcaggctggtctcaaactcctgacctcagatgaaccacctgcccagcctcccaaagtgttgggattacaggcgtgagccaccgcccaggcctgctggttctttttaaaagaatggtatcctgacatttaaaaacctaccataaacttaatgaaagcaggtttgtgtctatcttcactattgaatcccagtatcttgcttgatgcctgccatataggaaacacccaatccctatttgtgggatgaatccatttctttttatcagattatagcaaatataaagccacaatgagatgtcacgtcacacccgttaggatggctattttcaagaagaccaaagaaaataagtattggcaaagacgtggagaaaagggaacccttgtctcctgctggtgggaatgtaaattagtacagccattatggaaaatagtagggaggctcctcaaaaaaccacaactagaactactatatgacccggcaatcccactgcaggacatatatccaaaggaattgaagtcagtgtatcggagagttatctgtactcttatgttcattgcagcgttattcactaagccaagatacggaatcaacctaagtgcccatcattggatgagtgaataaagaaaacatggtatataaacacagtggaataccattctacctgaagaaagaaggaaatcctgtcatttgtgccaacggggatgaacctggaggatgttaagtgaataagtcaggcacagagtgacaaatatagcatgatctcacttatatgtggaatctgaaaaagtcaaactcatagaaacagagagtacaggggtggctaccagaaagtgagggtagagggactggagaggtatcctttggccaaaggatacaaaatttcaggtagacgggaggaataaattcaagagatctgatgtacaatatggtgcctatacttggtaatgatatgttatatatttgaaaattgctgagagtggattttaagtgttctcactgcaaaaaaagtgtgatataatgcatgttaaatagctcgatttagccattccacaatgtatacatatatggaaacctgttgtacaccataagaatatacaatttttacttctcaattaataaagagaggcagagaggctcacacctgtaatcctagcaccttgggaggtcaaggcaggaggatggattgagccaggagtgtgagaccagcctgggcaacatagcgagtcctgtctctacaaaaattttttaaaattagccaagcatggtgacttgcgcctgtggtcccactttcttgggaggctgaggtgggaggatcatttgagcctgggaggtcgaggctgcagtgagctgtgctcacgccactgcgctccagcctgggcacagagcaacaccctatctctaaaaatacgtaaataaatagtgtccctcaggacagctatctgtggaagacacccttttagtcaaatagatttgggaaattttaaaacagtatatatgcccttttgattatcctctgtggcacatttgccaacggaaggccccaagaaatgctgaccaaaaaacctgtgcatttagttttaaaactagtgggtttcatactcttttgtttgttttaaccttgaagcaccccccaccccccaccgcatctcgtccccccacaacataatcttctctcaaacgcatgttgtgctggaccacaccagagttaatcctgacctgtagccaggtgggcatagataaaaggaaatattgtttgccagtccctgctggaatgatgcctttacacatctgtctgatctgattgctccactgttttctttcttctcttccctttccacggttctagcctgttcatctagccccatgatggctgtggacatcgagtacagatacaactgcatggctccttccttgcgccaagagaggtttgcctttaagatctcaccaaagcccagcaaaccactgaggccttgtattcagctgagcagcaagaatgaagccagtggaatggtggccccggctgtccaggagaagaaggtgaaaaagcgggtgtccttcgcagacaaccaggggctggccctgacaatggtcaaagtgttctcggaattcgatgacccgctagatatgccattcaacatcaccgagctcctagacaacattgtgagcttgacgacagcagagagcgagagctttgttctggatttttcccagccctctgcagattacttagactttagaaatcgacttcaggccgaccacgtctgccttgagaactgtgtgctcaaggacaaggccattgcaggcactgtgaaggttcagaacctcgcatttgagaagaccgtgaaaataaggatgacgttcgacacctggaagagctacacagactttccttgtcagtacgtgaaggacacttatgccggttcagacagggacacgttctccttcgacatcagcttgcccgagaagattcagtcttatgaaagaatggagtttgctgtgtactacgagtgcaatggacagacgtactgggacagcaacagaggcaagaactataggatcatccgggctgagttaaaatctacccagggaatgaccaagccccacagtggaccggatttgggaatatcctttgaccagttcggaagccctcggtgttcctatggtctgtttccagagtggccaagttacttaggatatgaaaagctagggccctactactagtgactgcaggtgacagggcgtggcggagctgccacagacaagcctagctctgctcactgtgcagtggagatggaaggccagggaggagcaacgtggaacttccatgaggccccgtttgggaaaataaaaggatcctcttcacttctttcttaaacagcaaatccagccaggttcagattacacaaccagtgtctcactcaaaggagcagtggtggctggcgcgctttcgcactgtggcagccacgagagtctgtgcacgtctgtgctggaaagggtatggatgggaatcaagcctatgccagtgctgatgaagctggaggagtctctcctctgctctccactcagatgtgggacatcagtcgccaaaagccactcagccccagccacctcgcgtgagaccctcactgttcattgtgttcatctttgggtgctctctgccagccaggcctttcctgcaagctgctgtgcttccccgtccacgtgtatctctgctgtgacacactgagctgacgcacatttccagtgcagctgcagaagagaaatgggattggctcttgttttctgcaagttcatgttttgcattttatgttcttccacaattgatctgatgttcaggaaaagataataaaggcaaattagttagtggttgagacaggcatttcctcctcccgcttcttgaccccacagatgtattccagcagagagcaacacaccagtcatcaaaacccactggctcctgtgcggtgtcacagattgcagggttctgacaaggcaggacagtcaagagtggggacactttcagcttctacttttgccttctagggggagctttctaagtccccacatttaccccgagtcaccggaaaaatctgatttttcccccgaaagctcaatgactttaacgtgcttggctggtttgtctcattctttatgaaagaattttggggccgggcgcggtggcttatgcctgtaatcccagcactttgggaggccgaggcaggtggatcacgaggtcaggagatcgagaccatcctggctaacacggtgaaaccctgtctctactaaaaatacaaaaaaattagccaggcgtggtggcgggcgcctgtagtcccagctacttgggaggctgaggcaggagaatggcgggaacctgggaggcggagcttacagtgaaccgagatcacaccactgcattcccgcctgggcagcagagcgagactccgtctcaaacagaaaaaaaaagagaattttgaatctcctttcccaaagagtcatcttttctgctgtgtttaggacatttgatttgcatatccaatatctcctcgaaaccttcagaaaatggttttatcgtgactgtgattcacactatctagaacactttaccagcacccagggacatggacttgggtgttcttatttatggtgtgtatgtaaagagataggggagaaaaacctcacccaagttcttatacgttattttaaacgtttgccaactctgaaatttcagagattcattgttcttaaccatattggactaaagtctgttggttagtgctgttgtaaaagagacctctggggccgagtgtggtggcttatgcctgtaatccctgcactttgggaagccaaggcgggcagctcacctgaggtcaggcgttcaagaccagcctggccaacatggtgaaacctcgtctgtactaaaaatacaaaatttagctgagtgtggtggcaggcgcctgtaatccagctactcgggaggctgaggcaggagaatcacttgaacccaggaggtggaggttgcagtgagccgagatcacgtcactgcatttcagcctgagcgacagagtgaaactgtctcaaaaaagagagacttccgggacagtcattatcagataggccccaaacctgtgatttttcttgggcaagattggtgtttacttaggggtgctttaaaaatatatttttacaagtatacttgtaggaagttggttttttattttctatttttgtttgtttttggagtttggttaaacgactcttttattttctgttttgccttatcttactaaagtgaagttttcctaaggcaagcaagaagaggagtggaagcacagttgcctggatttggaggcagagttgtcaggcttttcaagctaagagtcttgtgcttggattttccagattaatttgaaaagacctcccatttgtggctttgtacataaccaacaggcagatactgagtgccttggctcctagagttttgtggttgggttaggttgtttttgttgttgttttgttttggttttgttttcatttctgaagtttaagatgccttgactttttaaatgctcttaaggctattcgatgtaattcttactcctaaaactggctgttcttagcctgaaatctaatgctttgttttttgtacctctcccaggtgggtaacactctaggatgacatgatgttataattttaggggaaatcacatttttaccttatgctgttactgggcagaaccacgttttatgtaaacataccagacatcgggtaacagacagtactttaaatgttataaatttggtgatcagaactattaatagcataaatcgaactcaaatggaagcaaaactgatttcatgcaggtcctgaattttactttgccttaagaagtgccctccccacaatgcaggagaggcacagagtgcactgtcattgacatgttacccgactaaggatcactctgttcataagaaaaaggcctgaagtgactctgtttaataaagtcagtttaattttatctaataatgatcttaagacattcccatgtcaaaatttgaaatatggtaattcagtgataactatctcttctaaagcagccgtaaaccctccccactacccgtctttctcccagctcaccctggctttttttgctgggggtgctggatgcaagcccccagccagcacacctgggatgctcaccctgccgcacagttcagaaggcaagtcctcacctgctcgcaaagacccttcttctccaataaaagactctacttgcctgagtttcctcatcagggctgtcattcagtgatgtatgggggtctgaagaatactgccttctatctgtcttctgtttaccacttgctcctctgctaccctcctgccgcaaacagtcttcttccttttggcccagttctgtcccgtgaaattctcagaaggcctcgggagctgcgctgatgtattctctccttgtttgatagctcatcatcagtagataagcctacacacttcagagggtgacaggtttcttacttggagacttcactgcaccttgacttgtagatttgccttcagacagctcttggttatggttacaagtggcccccgagtcccagaatctttcccaggttgccccagaaagaccagccacctgtcacaggtgcagttgtccggcaatagggaagcaacttcatttttgttttatatttattccctcaagtgccctgaggagcatttgcaaactgggtacaataaataagctggattatacaaagatatttaataaataagctttcagtatctattggaagacatgaagcatttgagtgggtttctttatttaaaaaattattctactggagctggtgagaaataatgaagctgtacagttctccagaaattaaaacaatgtcagagtcaatgggagaatttaatttacctttaagatttcattttaatggtggcaaaattatacattcttagaagatgtaaatttggaactgttaggagattgctctgtggttttgatcttttcaaaccattttctttttgaaaaaaggcattagttgtagtcatggacattaaatgggccatatatgcttatcaatcaaaaaagtgttccttttttggaactgcccattttctggatcttccctctcaatggataggggatgaaaaccttggttgccttttatttgtttcctcttctaaaatttctcacctgaatgtagtcctgggagagtcccgatcacgtctctcctgacatgttcactgaaatcggagacaagaagttacatggatgatgggatcttatagggtcacacaaagacaatttggcagcttatcttaatttcctgcagtgagacaacacatgtggaactgggaaggacagctgttgttacgagcagtttttcctggtcatggttgtaaagctctgtaacccacattgtaaagccgtgaatgtttttagtcttgttgacgagtttttagagactgctggacctctgagggctttgagagtgcagctgtgatgatgtttcactattacttcagtgtgaatgtagaaccaaggactcatcttcattttatacctaaaagtgccttgtcaagaaatttttgcatgttttaaaagataaatatttttgtacacagagttcaaggggaaatgcactttaaaaatcccaagaatggatgttctttgtgtggtatgagaggttggtttgtatctcaaaagcaaaaatgtaataaaggaagacaaaacaaaa

SEQ ID NO: 150 - DNA, 5371 bp, Homo sapiens
gttgccagaagccaggatcatagagacgctcggcctccgccgcacgcgctggcggactaagagtggctggcgaagcgagcggccggcgcgggcccctggcgggcgggcggtacagccccaagcctgagacccggacctgagcatcgcaggttcgagtcccgccccgcctggggcgaagccgggggtggcggcgacctcgcggcgttgcaccggctctgtgagcacctcccctctgagcacttcccttgtgacaggccacttcccttgtgacaggcccaggacgaggtggccaggcggcccccatggcgtccctggtctaggcggagaaccgcctgggcgatgagtgagaacctcgacaacgaggtagagtgcggggagacgctgggtagagacggggatggggtgggaggaggcggggtgggtcaggaaacctgccagagaataggtggggacgaggcaggtgcgataggggaggaaaggagacgggaatggggtcgggagggtagactgggggaggggcagggctgagtgcagagtgcaccgacggaggtctgggtgtcccataaggaagcttggggggccaggcccccagggcctagtcctcaccctagcaccccatctgtccccacacagggcccgaagcccatggagagctgtggccaggagagcagcagtgccctgagctgccctaccgtctcggtgccccctgcagccccggcagccctggaggaggtggagaaagagggcgctggggcggctacagggccggggcctcagcccgggctctacagctacatcagggatgacttgtttacctctgagatctttaaactggagctgcagaacgtgcctcgccacgccagcttcagcgacgtccggcgcttcctgggccgctttggtctgcagccccacaaaaccaaactctttgggcaaccaccctgcgcctttgtgacattccgcagcgctgcagagagggacaaggccctgcgcgttttgcatggtgccctctggaaaggccgcccactcagtgtgcgcctggcccggcccaaggccgaccccatggccaggaggaggcgacaggagggtgagagtgagccaccagtaacacgagtggccgacgtggtgacccctctatggacagtgccctatgctgagcagcttgagcggaagcagctggagtgcgagcaggtgctgcagaaacttgccaagtgagtgtgggcgcaagacgcccctcttggccagggctctgcccggcctgtgcttcctcagcctgtccatgcaccagttgggaggcccagcacaggatctggcggcccctttgggagctagccagcaagacacccacgtcacagtgggcacaatgacatcccaaaggaggggtcaggagcctggacatttggggagtggcctggcatgggtcgggggcagtaggtggagtccaaccaccgatctgctcctcttacagggaaatcgggagcaccaaccgtgccttgctgccctggctgctcgagcagaggcacaagcacaacaaggcctgctgcccgctggagggggtcaggccatcaccccagcaggtcagactagacttcggtggccacaaacccctatcctgggttttgaaaaactttgcttttgctcacccttcctgttgatctccctgctttgtgttttcttctggtaacatcacatagttgtcagctgttcctcttgtttgactgccagcccctgtggggaaatcagggtttccaggcccaagcgctgggcagccagggtaaggtgcagctctctctccctgcagactgagtatcgtaataagtgtgagtttctggttggcgtcggggtggatggggaggataacaccgtgggctgtcggctcggcaagtacaagggcgggacgtgtgctgtggcagccccgtttgacaccgtgcacatccccgaagccaccaagcaggtggtgaaggccttccaggagttcatccggtgaggacctgtgacggggctcccgggaagtcctatgcggtgtgggagcagagggtggtgatcctgccccgggaattctggagtgcctgccatttcagccagatgaaggaaggtgtggccagaggagagagcagggggactgcttgcccagttgtgggcacttgggccagctcgtgattcccacaggtccactccatactcggcatacgacccagagacgtacacaggccactggaagcagctgactgtgcgcaccagccgccgccaccaggccatggccattgcctacttccacccccaggtctcaacgggggccctgctgggggagggtgcctagcctaggtgggcctcagcacagcctgatgggaacttttcaccacttactccagaagctgagccctgaggagctggcagagctgaagacctccctagcgcagcacttcacagcagggccaggcagggccagtggagtgacctgcctctacttcgtggaggagggacagcggtaaggagcccgagtggggcggggcaggtccctgcagggactgtgacactgaaggacctgcaccttcgcccacagaaagactcctagccaggagggcctgcccctggagcatgtggctggggaccggtgcatccacgaggacctgctagggctgaccttccggatctctccacacgccttcttccaggtagccatgagtccctggtgggcatggggacatgttgagggaggcctgacgcaccatcaggacgtgatgggaacagtgggctcaggcggtgagatttgggggagtatccaggcaggtgagccacaggggagggtgaagtaagaaagaggttggtcatcactgatttgactcgggataacctagaggtacacacggcagtggcccttgtcacagggaggatgaggagtggccctcagtgcattaccacagggcactgctctgggctcggcaggagggaggccatggtggcctctgggctgggaaatactgtttcactgtttgctcactgctgcaggaaggctgtggggacctggagcggccgtttttggagacaggcctggcaggacctcctggagggctaggtgtgggggtgggagctgcagttgggtgattccaggggccccggtgtgagttgtgggaggcaaagcccccttgctggggcagggaaggtacagcctattggcctgcggggcctcatgagccctcaaccaagtggggcaaggaggaggctgtgcttagcacgggcttggcttttaaagccaggggctggatgagggcatcagcaaggctggtccaaggtggggtcagggaagacgttgggcaccaaggtggggagtgggcgccggaggtcccggcaggatggagggaccaggaatgtgggcgtcggggcaccagtggcaccacaggagaggagccactgacatcctgggcaccgcctgcccccaggtgaacacacccgcagccgaggtgctctacacagtcatccaggactgggcccaattggatgcggggagcatggtgctggacgtgtgctgtggcaccggcaccattggcctggccctggcccgggtgagccctcctgccctgctgagggcaccctctccccaccccaagacccccattgaccccagctcaaagtcaccacagctgactccatcatgccccaggcccagctcctctttgctgcccacagggccccatgtactcccctccctgggtggggcgacaccacgctttcctgtttcagaaggtaaagagggtcattggggtcgagctatgcccagaggctgtggaggacgcccgggtgaacgcccaggacaatggtgagtggcaaggccgtgggtgggggtggggatgggggcagccgccacccctgctgcaagcctcagccacagccagggcttgggggctgcccgacaggtagagcaagtgagcaagctctttggctaggggttccccagggctggccctgctgggagggcatgtggccctctgacaggccacggtgccatctcttcagagttgagtaatgtggagttccactgcgggagggccgaggacctggtgcccaccctggtgagcagactggcctcccagcacctcgtggccatcctggacccaccccgtgctggcttgcgtgagtggcttttgcttaaggaggtggcacgggaacgaggacacatggggtggctcaccatgttatgcactctctggctgtggggacccagctggtgtttgcctcctcagattccaaggtgatcctggccatccggagagctaagaacctcaggcggctgctgtacgtctcatgcaacccccgggcagccatgggcaactttgtggagtgagtgtctgcaggggcctgggtgggggctaggcctgctaccaagcccccagctcccacaggagcccctgattagcctatcggctgaccttagcgccccccttttccccccacagcctctgcagagccccatctaaccgggtgaagggcattcccttccggccggtcaaggctgtggcagtggacctgttcccgcagaccccgcactgtgagatgctcatcctgtttgagagggtggagcaccccaatggcacaggggtcttggggccccacagccctccagctcaacccacaccaggacccccagataacaccctacaagaaactgggaccttcccctcatcctaggcccaggacccattatggggacaggagctgaagggctcccagggccccaggggcggggaaggcatggcttgctggccaggatattcagaggtaggcagccaaagggcacagaaccctgtgccccaccaggattggcctgctgctaggggccaggggccctgaccaggaagacaggtgggttcctgtagcctgttgcccatccccagggcctttgtggactagccaaggctgtgagggccagaataaacaactgctcaacaaagggtgtttctgtgatgagagccaggggtctgaacacagggcctgggtgccagggaaagggccaaactaggcctaggcagctctgcaagcctctctgcatggctgggggagtcagggcagagcttactttaaaaaagaatgttcgatttgatacttaaacttgaggagaggcagagagaggtctgggaactgcaccagctgggggcatggggtggagaacactgggcagagttggcccctctgtggccagcctggccctcagcccagcagagagggcatcaaccaaggaaggggccatgctggggtgctgctcagctgttacaaaggcagggtccagcctgcagggaggccccaggaggggatctggccagtcaagggtccacagggtgccagcctctcaccctcagaataaagacatcagccattc

SEQ ID NO: 151 - DNA, 71540 bp, Homo sapiens
cccgggcctcctcccgctttctctctccgcttcccctggagcctccgaggagtccgcagccgctgggcgcccgggaagatggcggcggcggcgggagacggcggcggcgaggggggcgcgggcctgggcagcgcggcggggctggggccggggccggggctgcgcgggcagggcccctcagccgaagcgcacgagggcgccccggacccgatgcccgccgcgctgcaccctgaggaggtcgccgcgcgactgcagcggatgcagcgggagctgagcaaccgcaggaaaatcctggtgaaaaacctgccccaggacagcaactgccaggtactgggacggtgataggggcgacgcgtcccgaggggcggcggggcggcgctccgtgtccaggctgggatcgggggcgcctcagagcggtcctggggagtgggtcggcgccgagtggtgagagcggcccctcggtttgactgagttcttggggtttctagcctgcagacgccctgccagggaggggggcagattgggaaactgaggctctgagtggcgaagcggcttctccaaggtcacgggaatcaggggctgctgcctccaagttcggcccggtctttccttcccctacggccgtagaggagtaggaggtgaaggagagtggaggtgagttgtggagcacacattttgcgggggggagcgggggtagagggggccgaagcttcgggagcaccttggcaggggcgagggctccaacgtatagtccccggtgctcgggagtgccatagggggcaggggcacgagagagctgggagtgagtttcgctgttgttgcagaagcacttgcccaagtttctatgaaacaactctgtcttctcagtttgctaaggccccagaatagagttattgctgcgctccttggagccttgcagccgcctcctgctacgccaagtacagtactggagggtttgttctcagtgacttggatgaggtttaaagatagctactctgtgtatttaatccagattaactgttgcttttaagattagaaactctgcatctatttaactttttttttcccctgatttcaaaagctgcatgctcattgtaggagagctaggaaagacagagaagcacaaaggggacacagaaattacccatatttctgatacctgaagataaccattgttatcctgggatgttgttcttttctcttttcctatgcatatatatttttgttttatcaaaagcttgaaatcatttctttgattcttcaggatttcttagctgtctggatgttcacacatgtttcacatataacctgaatttatatactgctccgagtgtggtgggctgtcctggtagttgcggatttgtagttcctcctgtaaccggatgcatgaaattgcaagagggctggctattgacaattgcatggcagttcttccatgtgacttataaaataatgagaccaatgccccattactatgtaatgagaccttacatagccattcacaataaatatgaacatataaccttataacccgtaggcatggggggctattttgtttcaaaatgcagtgtctgtcagtattgtttatctcatctgtctttcaactctttccattccgccatggtccacttcccatctgtcaggtaatgttttgtgatactacctgttaaggacacctgcaatggactgatttcttggaagcagcctcccctgcccatacaaatagaggactgtaagggagctcaggaaggaggaggcttggaagaagcagatggcattttttaaaaaaacaaatttaaaaaatagcagctctttgtatagacagtctaggaggagagaaatagagaagtatctcaatgtctttgtagaatgtcagctgtttttgttatcacaattccttgcattaattctaaatatatttagaccccaaattgaagacgttctgtctattcttgctttgctgttggtatctttctcatttcccttcgcaatagacatgaaaaatatatcaaagggtctaataaaaggagcagttttaattagtgatagaagctttctcagaattacactgggatttgtatttttgagatttcatctacttaaactaatattttcatatgttctgcatgaatttttttgtattttttgttttaacaatttcccttaattataatgtctgctttttcttagtgactatattttactgtcaacttactgatgaaagtttcactttattttattttgtgtctttttgctagtaaggcctacataaaatcacctgtgctaaaactacatatttacccttatgaaatggttaatatggcttttgttcaattattaagtaatcagatatttttgaaatactaagttcttgttcttttccagaagagactgtgtttattcattcatttctttctttctttttttttttttctgagacagagtctcgctctgtcatccaggctggagtgcagtggcgcgacctcagctcactgcaacctctgcctcccaggtccaagtgattctccctgcctcagcctcccaagtagctgggattacataagcctgccaccatgcctggctaatttttgtattttttagtagagatgtggttttgccatgttgaccaggccggtcttgaactcctgacctcaggtgatcccacacgcctcggcctcccaaagtgctgagattacaggtgtgagccactgtgcctggcctcatttctttattttagaatatcactttaaggatcaaagacattcataactctagttctcaaactgtgtatttatgtctctagaaaatactgatcaataacttactagtagaaacccaataattttttcttaacatttgaaatatatgagtgttttctttattaaatgtagttttcataaatctcaaattttgttttatttttggtatagcagatttataatagcatcccacaactttatagttcctataattaaaaggcatactgaaagtatttttaactggaagcttttagaggtatgtttatcaaataccttatagaagtaccggctctaaaaaaaagtgaacacctttatattaagttctcaaaagctttctcactgaataattactgtgcattcagtcaagccctgtctggtctgcctaagctttctggaatcttcctggccctctttgttttcacagcctcagctctggttcaagtccttttcgtctcttgttcactgttaacaacttttcggtttgtcacctaccttcattactgtcctgtttcttacattttagctccttctgcatgctacttcccttgagggatactcctgaagcacaaatctgatcatgtcactctcctgctcataaaaaaccagcctttggctgcacgtcctctcaaacttttcctcaaattgtccttaacagtaaagaacagtgaatctgaattagactgttgcaagactgaaattgctttgaagttttgtgttctgtctgagaattttatattaattttatattctattagtaacattggatttaacacaaaaatagcatttaactcccaattttttttcataaacttgacacttatggaaaatgtactatatttgacttttgattctctgtatttctgtattaccatggagtacacagatatgagtttgaaaagcatgaaatgataggacagcagtctaagattcttaggctttttgtgtgttggcccctgcctacgtttccagtctcattcctttttagtttttatttattgttttgagacagggacttgctctgtcacctggactggagtgcggtggaacgatcactgctcactgcagccttgaccttccaggctgaagcgattctctcaccctctaaagtagctgggactacaggcataagccaccatgccaggctaatttttttttttttaattttttgtagagacatcgtatctctatgttgcctaggctggtcttgacctcctggactcaagcaatcctcctgcatttgcctcccaaagtgctgggaccacagtgtgagccactgcacccagccatcagtctcatttctgattagtcccgcattggattctgttcatttctgattagtcttgcattggattttttgtttgtttgtttgttttttgagacggattctcactctgtcgcccaggctgcagtgcagtggtgtgacctcggctcactgcaacctccacctcctgggttcaagcgattcttctgcctcagcctcccgagtagctgggattacaggcatgtgccaccacgctcggctaatttttgtgtttttagtagagacagggtttcaccatgttggccaggctgctctcgaatgcctgacctcaggtgatctgcccgcctcggcctcccaaagtgctgggattacaggcgtgagccaccgtgcccggccagtcctgcattggattctattccacatttatcaaactacctagatccccaagtacctcatgccactgtgaattgaatatttatagttatatctttgttttggaatgtatttatagtgagtactttatagtgaataatatttataattatttttaatgaataatttatagtcaatagtaatgttgcaaatgctggttcctattcatagccattgtatatgtgtgtgtctggtcttttgcaactgaatttagaattttgattggttgaggtaatgttttaatattttttctaatatatgtgttattgtatttctataaattgtattacggttaacctggttctgtttcaatattgttgtcattggggtttcaaaatggagaaaacaggggcatttgcttcttagattatttgtgttcacttaggttttttttcttacaggtcttatgtgtgtgcatgtgttttgtttttgtcatcttgtttaccctaaaatcttgaagagagtctcttgtgaaattagaagacaatgtgaagtgcttagggccaacattcaggatcagtaatagaggaaacaaaacattctattgtcactttggatattataaacttacatttcaaagtactctaatatgatagttaatttgagaagcttgatggtttatttacagagacccatttgaaaccataatattaccaagtaagcactttttagaatcacaaacaaccaaatgtaagaaactctagttaatcttttttcgtaattaaatttttttctgctctttctcttttctttttcttttcttttttttttttttaaagagacagagcaagatttctctgtctcccaggctggagtgcagtggtgtgatcatagcttactgcagccttaactcctgggctcaagtgatctttccatctcagccatctgagaagttgggaccataggcatgcaccactgtgtccagctaatattttttaattttttgtagagacacggtctctctatgttgcccaggctggtcataatcttatttataaaagctacgtattcctgtttatacatcagtataaaaaagaattatcttacatattttatgtcctttaactgtgggatttaaaaatgtactttgttttctctaacaatatatttggtaattattgcctctttttaaaatagggctattattctctacttttttcctgacaatattggggtgttttctctttttgaaattatcctttctttaaaatcaaaatgccattgcttacctccaaaagttacttttcttagtgtatgctgtgcaaaaattatctattaaattttcttttctaatgcaattaaacagaattgaattatgggttctacttctttttcatgtgttttgttatcctattctcaatgtaacaagaacactgaaagctgctagggaaatgtacttctagatttctgggacaccactgtctccttaagtttctagttttggaagaaattcttgaaaagtgtttgagaaatgcagttctctgctatgaaaacacattcaagaagaggaggaatactttgtggttagcatcaaaatgctgtgttaacagccattccaaagaaatctcatgtaatctatagcccatttcccagttaatgactgggttatgcttagaaattcttttttgaacttgtgacatgttttcacatagaaagaatatagtagatggtatttagttttcaggttagcattttagcctctatttaagttatgattgtttattaagtgtaagattacactaagtagtacgacaacatctaacaaagctccagctttgtgcaggagcagaaactctcccagcttcaaatcatcagtaggtactcctgcatcttatggcaaaagctcaggaagaagggaatttaaggaaattgctccttgaattaacaagactcagatcagggaagcattaaatgaagtcaactctgatcaaaggctgttactgcaaaaggggttcctattactaactacctgagttttgtctcttgattcttctatttgcacttattcttctttccttatggacaaaaagtttttgtttttcatttttagatacgggatgttgctatgttgcccaggctggagtgcagtggctattcacacattcacaggcataatcatagtgcactgcactgtggcctcaagctcctggcctcagatcctgtgctaccaagcccagccttgatttttttaaaatctttactttattttgtaaatttatttttaatttttaatttaatttttttaaaaaaagctttatgcttaactttcctcgctcagctaaaacaggcaaaccaaggaatattaaaatgtaaataaaattatttatatatttttaaatcctaaaattgcttatcatgtgtctcggctgtttgtattttgtttgcctaattacacaattgcctgactctaaggagatagtatgaactgagaggggtaataagtgagaagtcggaagatcagatcacctagaacatttggctatacagtactgtatattttttggctgatgattatgggcaggatagcccttggtggttgtgctgaatagcttccatttgctcttccagatctattctcgacccttctcacccactccttatccagggaggctaacctgtactgtggattgcaccaacaaggctctctcttatcctctgttttatggttgcacttggccagagccactagtgggggatcagagggttgaggagaggagcatttattcacccagcatttattcacaggtgactgtgggttggctgcttcctctttaaaagtcggtttctatccagtggctccctccataccacccagctctcctggttatcataaccattcttcttgtctctttgggtccaggaggagtacaggaatgttgctagcctaggatttcttcaaatctttgtagatagtctcttttaaaagttctccccagttagtttctgagtgtgccttctgttacttgctggggccctgattctgttgcctactcagttgcctttcttcctcttgcctgtcctaattacacccagatttccccttgaagacctacctcttttttagcaactgtatgatttgggtggatttcatctctatccccatctgtaggggtgacataaaccaaagaacacagttcttccctttttcgagagggattggttaaagacgggcaataacctggaccaaagcccatcaatacatgatagccccttggtcatagtgattatttcagcctggcttagcagacaaacttaggacttgtgtttggttgttaaagtaagtgaatctctttctctctgctggatatgaatgcagagacatatggctctggctgcagctgacagtcattaagggagcagacatgcaaaggaggactgaccttggaggggaaatgtagagaagctgagctggagccctgatcgaactatatctgaagcttaacctgcctctggacttcatatatatgcaagccactaaatcccttttattgtttcacttatttcaagttggatcttttgttactaccaaccaatagtatcccagattaacaggttggagtacagtggcacaatcatgcctcactgcagcctcgaccttcctcgctcaagcaatccttctacctcagtctcctgagtatctgggaccacagatgcatataaccatgctggctaatattttgaatttttttctagagaggggattttgccatgttgctcaggctggtcccaaactcctaggctcaaccaatctgccctgcttggcctcccaaactgttgggattataggtgtaagccaccatgtctggctttttttaaaaaaaatatttttgtttcaaagaaatccccacaaataaggtatcctattccatcttcagacagctttctttgttataaaggtcttatttatgtgtaatatatacaatgtattcacttgaagtcttgatccaacgtctaccctctggcaatgtatagaattctttttttttttttttttttttggaaacggagtctcactctgttgcccaggctggagtgatctcggctcactgcaactgtaacctccgcctcccagtttcaagtgattctcatgcctcagcctcccgagtagctgggattacaggcgcccgccaccacacctggctaatttttgtatttttagtagagacagggtttcaccatgttggtcaggctggtctcaaactcctgaccttgtgatctgcccacctcggcctcccaaagtgctgggattacaggcgtgagccaccgtgcccggcctctcatttttaacttataacttaaattccttcaaatgactagtttttaggacatgattccaagtttcctcgccatctcatttatttttctctgaatacacatcattaccactttgtcattgtatcttttaaaatatggtacccaaaattgagtatggtagtctagttgagatctccctgtaatccccagccagaacaaatttctctttcctctggatgtctataataataataacctttgttttttgggggcctaccattgccaggcaccatacttagagttgtttaatattatatttaatcctcattttaagactataagattggaatttcttattcccatttgattgctagagaaacaaagatgcaaaattaatgtcaaacaatttgcccaagatcattcagctaattggtggtagagtggagaaccaattctgtttgattccaaagcttatatccttatctcccattgtattataattcctctctatgcagctatattgttagtgtttcaaagggcaaggatcatgttgtgtttacctttgtatcctcaacctgtaacctagaaactgacacattgtttgaagagaaatgtaaaagaagcggactacccacctaccttgttctaaaatgctatatttccattgagacgtctgacccccggcacactctcaggattgatttgttaataaattttgcaatgtaccactctgttagcttttttggcagggaactctctccattcacttataattattcaatcagtcaactgtttatggcttaagagtctgttgaaagctgtaaaccctccaagaaagtgctaatattcataagcacacaaaatttgcatattatttcaagggggtatggatctcttatagcttatccctgatttcattaggggattgtagaccctaggttgaaaagtgctgttgcaggtcaacaaaattttagtcatgtctttgggactttacctgagtagggaccatttgggcagatccaaagctgttgcttcagtagagttttcatcagaaacttctgtaggccacgtttatgcatgagggtttgggtagtgatcctttatctgggcaagaatataaatcaggctcaataattttctttttaaacaaatcaaccatgcgacttcatgtttgatgcaaaagcttattgctctctagtcactcagcagcccacaactgacattttaggttctgtgcctggcccagagtggatgctcaacaaagtaaatttttaaagaggttttcaagaagttacaatgtaatatttcctccttaacatttattaaaagtcaaacattgatacaaagaatgtttttctttaaaacaaatcaagaatattatccattctgtttaatgtcttcacaataagtatcctgatttcttagtaagaaaataagtttctcttttgttagattttaggggtgcaactcattgtgagcccctaaacttgtcttctaggtatttggagcttaattttatgtttatttactactgttatctttaggtttgtaaacttatttcccacttccctatgttaaggcattttctttgtgtgtttgagacttactgtttaacttttatttccatatgaatgccaaaaatagcattagattcattgaaatttgtttgactctgtatttgtacatgctttcattgtctctcttcctgctactctctcctgcccctaccgtaccccaccctatctgctctacccttagacaattgctttttatatctttcctcaacccactgcagtgattatctgctcttagttcctggcttgcctttatttcctggactttggatattctattaccctaccagtttaactacttgctttcgattccaaagtaatctccatttctctgactttatgcttcatagtttttttttttttttttttttttttttttgtagccagaactagagtagaaagtgatggcaataagcaagaacatgtgaatctgggaagttttacactttgaaataatctcagacttacagaaatgttttaagtatagcgtaaagaatgttttccccctgaactgttggagagtgctgacccaatgcccaaccaccctgaatactttattatgtatgtcctacaaactaggacaacttccaacataactgcaatgctaccctcaaagtcacactactgcctcccagtcctcagatgcatttaagctttggcagttgtcccatcaatgtcctttacagtgaaagaattcagttcagatcatatattgcactttttgtagaatgtctttcaattttggttcgtatggtgttccttcatgattagagtcaagttttatgtctttagcaggaacatcacaaggtggtacatgttttacatttgtcctattgttgataaagttcactttgatcactttgattccctttgattaaagtggtatctgccaggcatctccatgtaaagttttctgcttgtaatctataaggattttgaggggaaattctttgagactgtttaaatatcctattccccttcaagcattcagtttattcatttatttatggcaatataggctcatggtttcctatttagttcaatgggttatgctgcattcctactaccattacttatttcgatgctttgttttagatttggagagtgggagcttcaaattggcccctgtgtcttcttattgaataagctttttattttggggtgattttagattagcagaaaaagttgcaaagataacacatagagttcccatgtatcccttacccagtttcccctgatgttacatcttatacaaccaatgtacatcagtcaaaacttagaaatcaacactggcatattattttaactaaattacagactctattttagatttcattagttttttcacttaagttccatgattcagtctgagatacataattgcatttagttatcctatctccttagtctccattctgttacagtttctcagtcttttcttgttgtctatgaccctgatggttttgtttgggtatcttttagaatgtctcttaatttgggtttgtaggaggtttttcctcaagataagattggggttataggttttggggaagaataccacagaggtgaagtagcttctgatgacatcatatcagggggtacatgacattaacatgacttaccactggtgatgttaaccttgatcatttgcttaaggggatgtctgctaagtcactcctctgtaaagatactatttttcccattcactattctttggaaataatacattaattccagcatacacttaagggaagggtcctatgtccttttgacgtgtccccagcattcactgagtatgtcctttgttttcaacacaacaggacattgcagcttattttgtagtttctgtgctccagccctagaatcagccatttcatgaaggtgcctattttagactgaatgtttgtgtctctctccaaattgatatgttgaagccccaacccccagtgttactatatttggagatggggccactaaggaagtaattaagatgaaatgaggtcataagggtgggttcctgatctgataggattagtgtccttataagaagagatagcagagaacttggtctctccactcatacaccaaggaaaggccatgtgaggacatagtgataacgtggctgcctgcaagccagccagaaattgaatcagctggaaccttgacttggacttctggcttccagaaatgtgaggaaataaatttctgttgtttaagccactcagtctgtggtagtgtgttagggtagcctgagctgactattacagtgcttagtttcttttagggggaaaatgctacctagaaaccaagatctggaaactagctatactcattgccattgggtgtcagtgctctcaggtcctcttagtagacaaagctagagaatatataaatgtgtgtatatgcacacacacaaacacttatatttctattgaaagtaatgtgttcataccaatacattaaattttaatcattccagttttctcccattctgtatttgtgactctttcatctgaagtgaaaagtttggtgttcattatccttattttatttacttatttgatcaaccccatttacataggcatctcccatcaccgctgcagatgcttgccccattccccccacagatacccacttcacccaattcaggctccatcctcctgcactgggtttctctagtagctggaaggcaccatcaccttgcctgggttctgacactctgctggcttccttcatgtacagtgccctcctcaccatgtttgagctttgaaacctaagatactaagttaagatattttgtgtgaagtacatgtaagtgtacagtaaatgctatctattatttgtgcaattgtgatagccacagttctaaaaatggtcccccatattttctaccataatccatgggactttgactataatgaggtatcacactgtgattatgttaaatggcaaaaagggacttttttgcaggtgtaattaaggttactaatcagttgatttagggttacacaaaacagagattatctaggtgggcccaatctaatcacatgtgccctttaaaagcagagcattttcttgggctggaagccttaggggaaattcgaggattgaagcacaagaaagacgtgattcgctgtttgttgctgggtctgaagatggagtgggcatgggcaaggatgttaaagcagtttctaggagctgagagggtcttcagctgacagccagcaagaaaatagggacttcagtcctaataccacaaagaactaaattctgctaactaccttagtgagtggaaatgtattcttccttagggtctccatataagagcctagcttgcctgacaccttgatttggccttgggagaccctaaacagaaaacccaatggggcctgcctggacttatgatctacagaactatgagagaataataggtattgttttaagcaacttaatttggagtcatttgttgcacaataatagataactaatacagtatatccaggtgatatttgaaagaaaaatatttaaatatttaatatttacatattaaatatttaaatattggaggagagattgtgatttatgtatggttattctttggatggatgactatctaaatctatctcttgaagattaaagccctctttcttgggatgtctgcaagcaaaaactgctcaaggagaaccttttatagttagatatgtaatgttaattaatttgagctatgtaagtattttcttttgaagaagtgagttacaaattaggttagtgtacagtaagtatattttcaggtgtaagtatattttcaggttttttattttttatttttatttttatttattttatttttatttttatttttggagacggagtcttgctgttttgcccaggctggagtgcagtggcgcgatcttggctaagtgcaacctccgcctcccgggttcatggcattctcctgcctcagcctctggagtagctggaactacaaggcgcccgccaccacgcccggctaatttttgtatttttagtagagatggggtttcaccgtgttagccagaatggtttcgatctcctgcccttgtgatccgcccgcctcggcctcccaaagtgctgggattacagacgtgagccaccgcgcccggcctatttattatttttttgagacggagcttcgctctaacgcccaggctggagtgcagtggcgcgatttcggctcactgcaagctttgcctcccgggttcacgccatcttcctgcctcagcctcccgagtagctgggactacaggcgcccgccaccacgcccggctaatgttttatatttttagtagagactgggtttcactgtgttagccaggatggtctcgatctcctgaccgcatgatccacccgccttggcctcgcaaagtgcagggattagaggtgtaagccaccgtgcccggcctattttcaggttttttgagcactctaaacatattggtttatgttaatgtcgtaaaataatctcagaaaaaaagatgcagcattagagttgataaaggtaatctatggaaacaaaatgtcatatatttaacaaatatcaaaggtctactttctgctagatattgtgctggatgttggagatctgtttatgcatgaggcagatatgtgatacttgcctacaatcttatgaaaattataagcatataagcagttaaaatatggatgatagctgctgtaagggttgtgatgtggaaaaaaaaaaaaaaaagcctgtggaaacacagatatctaatccagacttgagaggttcagtggctggagtcacatggccacagcctaagtcacatgctgggaagctacttgttgggaaggctgagaaatatagttgttattgggcagccctgtgttcagctatatgttctctcacgttagaaagagagcagtctgtgcctttctttccaaacccttctcccaagggagacaaccccagatcaacttcagagtccagaatctctgggtgatgtatgtttcaggaacctttagtttaagacagagaaagtcacctgagtcctggggagagagatggtagctaacggaaagaaggggaagaaagggatgtagaacatccatggcattagtaacaagatgtaccaagacctaaagacaaggaaaagcgtggccaaaattagttcactgtggctgaggcatagagtttgatagggttagtggtaaaatatagggctggcacatttagcattactagatgattgaaagtgtatagggcatgttagggaatttggattttatttaatgggatatatttaaacaagggagtgatgcaatgagatttctacctgtcagaaagtaaaattatattgtttttgcttttacctccaaggaatttgcatggtagacatcccaaatgttgttcttggccccaattcccattctaagattaggaggccagtgatgcagtgagctttaggaatgtgatgggaatgaatattttatagattttgtttttgtaatggcaattcttaaggtacaccactgtatagttgtgtttgctgtagagtctgtcaactgggtttgaatcacagctgtgtcacaaactgtctgtacaagtcacttagtttttctaggcctcaatgttctcatctttaaaatctggatgataaaatccagctttaaaatcaaattcttaaggttgttaggattaaatgagataatgtctataaagtgcctgggataaagtaaataatcagtaaatgattgttttttatactgccaataaaaagctgaaagtttattaatttattttaggccaagtcaaaatgtgctcctggcaaaaagttggtattgaaacgaactttccagccaaaaccctgcattgaaagcagttaaaaatttagccaagataaaattgataccacatccactcagccaacatcatatatgataggactgcgttgggccccccccaaaattcattgtctggtgtgggacatccaaatgcagtttcaaaagagggagaagggaatatataggcttggagcttgggagagaagtttgaaatggaagtaagagtttggagattaactatcatgaagatgagatttaactcatctcaatgggtgcagaaaaagcactttataaaatttaacactcatacatcgtaatacttacagcaggcaggaatagagaagaatttcttcagacataaagattatctagaaaagccaaaagcaatcatattcaatggtgaaatgttgacagctttctttctgagattaggaacaatacagggatcactgctattcaagactgtattggaattcctagctaacacaatacacctagataaataaagtttaaagatataaaaaaagatgtaaaactgtctatttgcagataacatgattgtgtatatagaaaataaaaaagaatctataaataagctattagaaataagtgggccaggcacggtggtttacgcctgtaatccccggacttggggaggccgaggcaggtgtattgcttgagcccaggagtttgagaccagcctgggcaacataaccaaaaccctgtctctaccaaaaaaaaaaaaaattagctgggcctagtggtggcacatgcctgtagtcccagctactcaggaggctgaggtgggaagatcacttgagcctaggaggttgataataattaaatgaatttactaagattgatacttgtaaggtcaatgtacaagtataaatgatatttctgtatactagcaattgctagaaaattaaatgtcaaattttaaaaatagacttcaaataacatcaaaaatgtcaaatgcaatttaaaaaatctgataaaaatatgcgaaatctctacactgaagactataaatatttcagagaagaatttaagaagacctaaataaatggaagaacattccacatttgtggattggaagactcagtatcatttagatgtcagttgttcccaaactgatctatagtgtcaatggaatccactcaaaatcctagtaggttttttttttaatgaaaactgattctaaaatttgtacagaaatgcaagtgacctggaatagccaagatacttttgaaaaaaaaaaaacttggaagacttacactaccagatttcaaagcttactataaagctcaaataatttgttcagtgtgatattggtacagtgactagacaagtacactagtgggacagaatagagtccagaaattaacccacagaatatagcaactcagtagtagaaagaatagtcttttcaacagatgatgctagggcagtttgatattcaaatcaaaaaaattgaaccttgacccctacctaataccacttagaaatattctattaagatggcttatagtctaaatgtaaatgttaagacaataaacattccagaagaaaagatagatcagtgtcttcatgaccttgggtaggtaaagatttcttaaagaggtcacaaaaggcattaaccagaaaagaagatattatatgatagatgggactttggcaaaattaatgtcttcttatcaaaaagacattactaataaatcagtaggcaaaccacaggctagatgaggatatttgcaataccaatatttgacaaaggagactgatatccagaatttataaattctgcaagttgactgggcacagtgggtcacgcctgtaatcccagcactttgggaggccaaggcgggcagatcatgaggtcaggcgatcgagaccatcctggctaacacggtgaaactccgtctctactaaatatacgggtgaggtggctggcgcctgtagtcccagctactcaggaggctgaggcaggagaatggtgtgaaccagggaggtggagcttgcagtgagccgagatcatgccactgcactccagcctgggcgacagagcgagactccatctcaaaaaaaagaaaaattctacgagttaataaaaaagataacccagttaaaaatagatgaaagattacaacaggcatttcacaaaaaaggaatatccaaatggcatattaaaaggtcagtaatatcattataagtcaaagaaatacaaattaaggccatagttggatacaccattcccaccagaatggccaaaattaaaagacaggcaagaccaggtgttggctagaaagtagagcaattggcactcatattctgccaataagtgtgcaaattggttacagatttttggaaaactgggtgtgtctcttaaggataaacatataccagccggacatggtggctcacgcctgtaatcccagcactttgggcggctgagacgggcggatcacctgaggtcaggagttcaggaccagcctggccaacatggagaaaccctgtctctactaaaaaaaacaaaaattagctgggcatggtgatgggcacctgtaatcccagctactccagaggctgaggctggagaatcacttgaacccaggaggtggaggttgcggtgagccgagatcacaccattgcactccagcctggacgacaagagtgaaactccatctcaaaaaaacaaaaatacacacacacacacacacacacacacacacacacacacccctaccatgtaatttagcaattctactccttagtatattctactcagcaattatactcccagcttcattcttgatagccccaaactagaaacagttcaaattcccatcaacaggagatgagttacattgttgtatattccaaaatgaatattgtacagcaataaaaaagaggatttgttttgtcagatatcaatgtttataaagctttatttaggacagtataatattagcacagaataggcaaaatgtccaatagaaccagaagcaagagacaaaaatatccatgtatatcttggaagttgatatatgagagagacagccctgcagatcattgaggaaaagatggacaatacaattatggtgtcctaatagttgattacccatataggaaaaaaaaaaactattttcccatatgggaaaagggaaaaaaaaacagcacacaaaaatgaactccaaactcactaaaaactgaaatgtaaatggaaaaaatttagaatgattgaaagatgaaataagatccctttatgaccttgtttaggaaaggacttcttaagccacaaaaagcctacattttaaggaaaaagattgataaatttgatattattaaaatgaaaaacttctcttcacccaaaatcccacaaataaacacaatgactcatcacactgtaggagaatacactcataatacagttaacaacaaaaggtgagaatccagaatatattattttaaggatttggttcacaagactgtggaggctggcaagtccaaaatgtgtagggcatgccagcaggctggaaactcaggcagctgttaatgctgtagtcttgaggcagaacttctacaggaaacttcacttcttgctcataaggccttcaactgattggatgaagtcctcctctccccaacattatataagataatctccattactcaagtcaactgattatagatattaaccacatgtacaaaataccttcatagcaacacctatattagtgtttgattaaataactggacactgtagctaaattgacacataaaactaataatcacaatgccctacattgtttattaatcatgtaatggaaattaaggccacaatgagacacaattttatatccattaaattgacacaacttaagtctgataacaccaagcattgaaaggagtggatcagcaggacttttatctactgttgatgggactgtacactggtacatcattctggcaaacaagttggcacttcctcataaagttgatcatatgcatacgtacaccacaggaatttctctccttgaggagctcttgcacatgaatgcaaggggataagtgaaatttacaagaatgttatggtagttttttaaaaattcaaacagtgaacaacaacctggaaacaaaccaaataatcagtcatagtaaaatggatacataaattatactatagtcacagaatggcatagcaaacagcagtgaataaatgaatgacagccaggtggaatgagtgaattttagaaacataatattgagtctaagaatcaaggcacagaagtttaaaaatagcataataccaattttataaaactcacaaatgagtaatacaaaacaatataatgtttggggccacatgcctacatacagatacagacctacatgtgaggaggaaggtggaggaatgggatagtgaaggaatgcagaggtggatgcaaatgtcagtgttctcgtcaagtttggtagtgagtttctgggtatttattttgtttattactactcataatatatgtttggtgtttggtgtttcatcttttcattttatcaagttacataaaattttaaaagaaaatgaacaaaaacgtgcttccatttccagtccaaagcactgaaatttaaaagtagtgttttttaatctatgaaaacatttcttaaaacatttttttaaaaactgaaactaagtctgtgaagagcttagaagacaatgtaattcaggtttataactaaggccatgcttcatcaaggaggtctagatcagctggaacaatggttaacttttttgttgagggtggggtgatgacgtcattgactgactgctttgccatggaagctattgatcgtctctccagaaagcatttcatatgtgcaaaacttgtcacttcagcaggtgacactgaatctggtatggaaatagtttactaaagctatctaataccaatttttattaacttaacttgacattggcagtcagatgacaaagtgttttcatcaaaggtgctactttattccttaaaatcagtaagttagtggaaatgttataaagctaagttagtatagggaggctctaattttagtccttttagttctgtgtgatggagcatagaattattttggcaaatggttattgggactctctttcaggttttaagtttttaatttggccaacttaccaaggctcaaattgagggatgacccacttttgcctgggtcaaagcaaccagggcatggagaaaaataattgggtttttctttgtaggaagctttgtaaggtttcgcagttggcaaactctgtatcccacatctgatacatagaagagctatgagtagagatatgggtgttttcaacataacatttctaagttgcaaaatgcacctttgaatacttaagctctcttaggtaattctcttagctgaatgagtaacataacatgtcatttgtttacagatacttgataatgtgaagagcagtatcatgttttctttatctagcatttgatggctgttaaccagtgaaatgagagattagattctatgcaactaaaagcacacactggatcccttcaaaaaaaccgtgtcaccttctatataaagtattaaattcgttgattggcaagatgcatatgttatgctgctgagacagtgatgttttcttattgaagagtacagtagatgtttttgtaagttcaagaaaatgttgaagcttacaagataaaaattaccatagtaatatgtaaactaatctttataattgagcatagtaccatatgattcaccaaatgctattttacaaaattggtaagtgtatgtattttaaaaaatttctaatactggttggtaataaagaatactaaattatcaactttatctttcatatcatagaggattaccttttttcactcagctttgttttcatgctttgcctattatatcactcttttctccctcttgggttggattaaaagggagaatatttttcaacttctgtcttcttatttattatccatttctatattactcatatgattacttattagggcactcgtggtattgtttttataactgttaatgatagtgtactgtttttaaagttaatgctggaatgaataagtcaatatggcatagaggttgagtgtcatccttggagccagacagatagagtgaatctcctctcagcaagtgactagctatatgtccttggcaactttactctgtttttcctgatttttaataaaagtgaattcagtgcctgataccttgtgataactataataatagcaataataagattattattgaattcagcattttaggttacatacttaacataatagcacctgtgtatatttagcatattcatttgcagtatagaacaggttggctgtaactctctaatctggagtcagaatgtctacctgtgtgagagtctagttcctttgaatatattgtaactgcatctgttatgtattatgagtaaaatttttcagggccacatattgatttaacaacgaaacaattatattcactctaatgtatgtttgagtgcctacgatatgcaaagcaatgcaagtagtatataaatatgtaaaatgcagtttctgtttctaagtaccatcagtctaacagaaaggattagggaaatagaggaaatctactcttttgggcacccaagtggatagaggttgtgctatcagaaaaaaaaagtttaggctatgttaataatagaagcagaatgaaccataaaccagtttaaacatcttggggagccaaggggaaataaatggaactgcatgctatgccttagtagttagtttttttcatatccagggatctctaagctcaggtttacaatctattttatttttatttttttacaatttattttttctacgtttgtgctctaagcatctacaggtgtattacttgttaaaagctctatagcatgcagaaatagaaataagtataatacttatttccacaagagaggcataaataaagttatgaccattgttagcataaaggtgggagaggtcacattctgtggaaaattatgagaagcaacttcatgaaagaacatttgagctgagatttcataaagatgcatgtgatttcaggcaaagtttgggaaatttagtgatatgtttgcctcctgctacgtcaaggaataagtgtgagtagaaagagaacagtgcatggtatacttgtgagatagtgaatcttccatttgagcaggaatgtgggctttgtgtaggatgtctggggaatctggaagacctttaatttaagtaagtaatggggatccatgaaataattttttttttttacatgggacatggtggtggtaatggtggtggtggtggtaggctaatagagctagattatctagtaactgcatttgtatgtttactgaattcgtgtttttttctctttcaggaagttcatgatttgttaaaagactatgacttaaaatattgttatgtggacagaaataaacgaacaggtaagatttctattctaagtgtctaatttcattttgattctccctgtactcgttatagaacaaaaaagctcagtgtcttttcatgcttaagctaatcatggaatttttaagccttaaatcattcgaatgtaacccacactgtctattttctgaaggtaatattggtatcctaaatattaattgcataaatgaatatagtgttactagagacttatgaatttttataatgaatgttctgttacagtgaatgttcttcataggctcagagttcctcgattttaattgtatgttactggacttagtgaatagactgtatgacttgacctttagctggggaaattgagaaactcatttaggttttctgggtattagttttatatctgtgagattaaaaaactagattatttcctttttgtgcatgtaatatgcagctgtttaaaagcatccttttgagactaaaaataaattatggaggataatgtaattactatgtacacatccactcccaaattatcaaatggtaatattttgtctttacaaagtatgtacatagctagagccctcatgtagatctgttgaatttcttcagattcaaaaaaaatggtaaaaaggaacattacagataaagatgaaattcactttctactactctgattccattccctcccagcctccttgtctaggggcaggcactgatgaatttggtgcatattttccaatttatgcaattacattttgatagccattaaagctgttcacaaattcttgttctttttcttctgagcacaaggtaagatagtacttacctgtgcctctttgaagttgagagtggacttgtgatttgcttgttgatgaatgaagtgagagtgaaaatgacatgtatcccttccaggtgaaagatttcagagccagcatgtgatttcctgctcacacttccctgtgctaaagtaattggggaagtaacagaacctctttcaacctaggtctcagagtgactataatgagcaaaacgtccttccttccttaccttcagcatgggatatgcagcatgaatcagaagaaagccttttgttttgttatgccattgagattgtgcagaagtttgttaccacagtatcttgactaacctataattttaccatatgtgcctatatataattaatggtagtctctgttttaaacttttcataaatggcattctaatgtatatttcatttagcaacttgctttttttgggttaacgcaacattgtttttcagatctttccacattgatatatataactcaggttcattgatttaagctactacatgtaattatcatgtgaatttattacgattaatgtatttgttactgactggcattcaggaagctttacctttcccagtatttcaaacagtgatgcaatgaatagccttttagttgattactaatatacatttcaactgtttctccataactgaagctctgagtcataggtgtgcacaatttcaatgttacagatattgacaacgggattagaggtaacagccttcacagctcacatagagccaggaatagtgctattcccactagtcaggatgataaacctcataattcatggggcattagaagtaataatcagaaagtttttgctcaggaatggggaaaagtaactcaagaccaatgatgctcttgtcctacctaacaaaacttaaaaacaagaccagaacggatcaaagtgcttcctcataacttaaccacatcctggaacaaaactcaagaatatttgtatgcatccaaaacatctgacacccaacaaagtgaaatttatgatgtcagacatccaataaaaaagtagcagacatgatgaagaagcaggaaaacctaatgtataacgaggacaaaaatcaatcacaactggcctagaattgacacagatgaattaataaaaatggacattaaaccagtttttataatagtgttccatatatatagtaagttatagtaaagattgaacatggtaaatagagacttggaagatataaaatatccaaatcaaacatctggagatgaaaattacaacatctgacatgaaatacactggataggattaatggcagaatagacactgtggaagaaaaaattagtgaacttgaaaacaatgatgtaagtgatccaaaatgaaacacagagagaaaaaagactgtaaaacatgaacagagtatcagtgaactgtgggacagcttcaagagcaattagagtccctgggggtaggaatagttaaaaaaaaattaaagaattagtagctgaaaagttttaaaattttgatgaaaattctaatcccagaaatccacagagctcaaccaacttcaagtacaaaagcatgaggaaaactacagtgtacgttgtaatcaaattgcttacagttagtgatagaatgtcttaaaagcagccagaaaaaaagtatacatcattaatacatttagcgggacaaagattaagatgaccatagatcttggaaacaacacaattgaaaagactgtagggtaacatcttttcattctttaccaaaataaacaaaaacacaacaggtccacatagaattcttaacctattgaaaatatctttcaaaaacagtgatgaaatagagatgtttttcagtcatacaaaagttaaaagaatcatcaccattagacttgcactataagaaatacttaaggaagtcctacaagcaggaagaaaattatagatggaaatctggacctacccaacaaaatgatgaatacgtgatatggtcattacgtgggtaaagacttttttcttaatattgaaatcttttaaaagtataattgactgttaaaagcaaaaataatgacattacattgtgagatttgtaacacatgtagaaataaaatgtgtaacagcaataatacaaaggctgggagaggagaaatgggattgcactgtttgaagtctcttatacagtacatgaagtggtgtgataccgtttgacaattgactgtgataagttaaagatgtatactgtaaaccttaaatcacctgttaaaatcacacaacacagaaatcattaattgtattaaatgattttgccttggattttggaacctatagtggtgttcgtggaaacagatataattaataactcagttgataaaagatgcaattcttaactataaccttgcaaccagagcttcctatggtagatatgaggaaattattatagtaaaataggatacattaggggaaaaagttttggcacatgcttgccttcaaattagacccaataataaactaaatagtagaccatgcaatgacttttaaaagaattgggatcaattgtgggatatttaaatttcacaaggaaaatggtaatgtaattaatcccaaattcccttacagccttttctctgtagagtgacatctaccatttctatgagaactagtatgtgaatttttttattttttattattttagagaattcgtggccttggaaaaacatggaagaagctatagaacagaaaatgtgacctcctttccctactgtctgaacttttaaatttgtttcattatgttatttaaattcttccataaaacctaagttgagcaaatgcagatacctaagaaaaggacaaagagattttcagtttttaaattattagttgatttatatatgcatttatttattcattcatctaacacaaagcttctaccatatgtcatgcaccatgatagttggtggaattagggagctcacagtttagtagggtagcaggcatctaagcaaatagattacgatgtgatgtgatctatgcaataatccgagcaatgttcaagatagagaggtataaaaaaataaagaatggttaactctaagagaggatcagggaagcttcctggagatcatgatggagtaatgcatggacgaatttgaaaatcagctaaaaggttctaggtatcctaaggtatggggagtgatcttataggcaagggaattaaatgtgtaatatatggatacctgaaataactggatctctacagggagctacaaatatttcagtgttcttggagaataaagagctgttggggaagggaggaagtatggcagttaacaaggctggagttagatatagcaggcattgtagagcatgattaccaatctggcacttggctttttttgtgagtaatagcaaacctttgcatttaaggcagtaaacaggcacaattaaacttctgttttttagagatcactttattgtcactgtggagaaaggattaaaaaaagaaaaagctagaggactgaagaaagggggatggattcaagacctattagacgggtggaatttgaggattccttttatatgggaaatgagggagacagagtctaggttaattcccaggtttccaatttctgggtgttgtgtgaccagctaaaatagggaataaaggaagatgagaagtattaggatttttttttaatatacttaaagttctggggtaaatgtgcagaacgtgcaggtttgttacatagatatacatgtgccatggtggtttgctgcacccatcaacccgtcatctacattaggtatttctcctaatgctatccctcccccgctacaccccccgacaggccccagtgtgtgatgttcccctccctgtgtccatttgttctcattgttcagctcccacttatcagtgagaacatgtggtgtttggttttctattcttgtgtttgctgagaatgatggtttccagcttcatccatgtccctgcaaaggacatgaactcatccttttttatggctgcatagtattccatggtgtatatgtgccacattttcttaatccagtctatcattgttggacatttgggttggatccaagtctttgctattgtaaatagtgctgcaataaacatacgtgcacatgtgtctttatagtagaatgatttataatcctttgggtatatacccagtaatgggatagctaggttaaatgatattactagttctagatccttgaggaatcgccacactgtattccacagtggttgaactaatttacactcccaccaacagtgtaaaagcattcttatttctccacattctctccagcatctgttgtttcctgactttttaatgatcgccattctaactggtgtgagatggtatctcattgtggttttgatttgcatttctctgatgaccagtgatgatgagcattttttcatgtgtctgttggctgcataaatgtcttcttttgagaagtgtctgttcataccctttgcccactttttgatggggttgtttttttcttgtaaatttgtttgagttttttgtagattctggatatattagccctttgtcagatggatagattgcaaaaattttctcccgttctgtacgttgcctattcactctgctgataatcttttgctgtgcagaagctctttagtttaattagaccccatttgtcaattttggcttttgttgccattgcttttggtgttttagtcatgaagtctttgcccatgcctatgtcctgaatggtattgcctaggttttcttctagggtttttatggttttaggtcttacgtttaagtctttaatccaccttgagttaatttttgtataaggtgtaagaaagggatccagtttcagctttctgcttatggctagccagttttcccaatccctttcttaaatagggaatcctttccccatcgcttgttttggcaggtttgtcaaagatcagatggttgtagatgtgtggtgttatttctgaggcctctgttctgttccattggtctgtgtatctgttttggtaccagtaccatgctgttttggctactgtggccttgtagtgtagtttgaagtcaggtagcctgatgcctccagctttgttctctttgcttaggattgtcttggctgtgttggctcttttttggttccatatgaaatttaaagtagttttttccaattctgtgaagaaagtcattggtagtttgatggggatagcattgaatctataaattactttgggcagtatggccatttttacgatattgattcttcctatccatgagcatggaatgtttttccatttgtttgtgtcctctcttatttcattgagcagtggtttgtagttttccttgaaggggtccttcacatcccttgtaaattgtattcctaggtattttattctctttgtaggaattgtgaatgggagtttcctcatgatttggctctctgtttgtctgttattggtgtataggaacgcttgtgattttcccacattgattttgtatcctgagacgttgctgaagttgcttatcagcttaaggagattgtgggctgagatgatggggttttctaaatatacaatcatgtcatctgcaaacagagagaatttgacttcctcttttcctaatcgttttgttttttggcagagataggatgaaaatcgtgagttatgtttgggagtcaatatgaagatatatgtggcactaaaggttagaaagatagattggggagtataatggtatgggaggccttttgcaagtcctcagatgagattattttgctcattgctttcatagcccctcatacttcccctttggggacaccacatttgtaactctttgttaaatgtctagcttcccctattagattgtgagctctgtgttgaaagggatcttacctgttctgttcaccaaaacatttccagtgccaaacttggaatctggcacatgatacggaatacatgggaatgggtgtgattgcccccagaggaagagggtgtagagtgcgaaaaaagatattcagcggccacacattgagtaacacatgtggccacacaggtgttactgtgtgtgactctgccaggaaggcaccccaaggagtactaccttacagctgtgagtggaggagaaagagctagcaaaggaaatagaagaaagagcttggacagttatgaagcaaatcaagaaagagtacatcaagaaagttaagaaaggcctggtgcagtggctcaggcctataatcccagcactttgggaggttgaggttggtggatcacttgaggtcaggagttcgagaccagcttgaccaacatggcgcaaccccatctctactaaaaatacaaaaattagccaggcgtggtggcaggccctgtagtcccagctacttgagaggctgaagcaagagaattgcttgaacctgggaggcagaggttgtgatgagctgagatcggcaccactgcactccagcctgggcaacagagtcagactcttgtctcaaaaaaaaaaaaaaaaaaggaaagaaagttaagaaagggaatgattaacaggttcaaatgccctgagaattcaagttaaatatgacctgagattttatgggctgatacgagaatataaccagtatttacaaactgttgttggctcgtttgttttagggaaacagaattaaattgtattttatgtcagcataaggaaaaaagacatagaatcaaaatcaagccttttaaaaaagattgttagaaactaagagatagccttttaataagggcagtaaagccattttttctcattttttggaagagatgttggaacagttagctgttcctttggcaatagttttcttgcgtgtgggacatgtgttaaatgaaaaatgtgtttctttaaatgttagcatcacacttagtgtggtgagatgctcttactctgagagccgcatggcactaagaccaattgagggcagagaagtttagtgaaatgacaggcagaattgcccatgctacttaaattacttctctgtctcttgctatatccatatttgctgtatacaacatattgtcatgcagttctaattgaatttgggtaaattaaatgttcatatggagtaacttcactatatatttcagagggagagggagaggaacttgtagagagcaatttatttgtaatttgtggattgctatgtattttttaatgggggctttaaacttttcctataaaattgctcaaaaccttttatattcttttattgcaaaaggtaaacaaattgatatggttaaaatgtaattttaccagatatgaatgtacataatatttcattgatttagaatgttatatttgtattatgtttccagttatataagccgtcatatgcatttgttgcttgatgctggaacaacttcattagctagacagggcagactatttttattgttttatgaatattcaagatcttgtcttaagatcagaatcctgtaaccttttcatttgatattattcatcaaaagtgtaccaaattaaaagtgtctgtgtgttatgtcaatctaatctgatattaaggaaatatatacatgaattggagaaagaaatggcctcctttatgcattttgatgtttttgctgtaccttcattttttcaggtccttgctgtcaaataggctcttttagaactctttctaggaagaaagaaagattttgtaacttcatttttatttcagttaagttttatataaagtcttcataaaattttatatcacaggtttttgggtgggaggaaatcaaatatgtgtgtgattggaaaagactaccaaaaaccccccagaatatcataggattttacagtgaaactcctaatataatccctgtactttctattttgggttactgttgatgaaattagtttaatggaggtgtcagcattaaaaaacgcactgaaatagaataaaaaatgtcacaatgcattgcatatagtaggggtattaacttataattttgtttcagaaaaaaggtgtatgtttatgtgtaccaagtcacagaagtaagatatatttcttactgtgttttcaaacaatttgaaaactctttaattcatttcgttatcttccagcttttgttaccttattgaatggggaacaagcccagaacgcaattcagatgtttcatcaatattcttttagaggaaaagacttaatagtccagcttcagccaacagatgctttgttgtgtattaccaacgtgcccatttcttttacatcagaagagtttgaagaacttgttcgtgcttatggaaatattgagagatgttttctggtctatagtgaagttactggccattccaaaggctatggatttgtggaatacatgaaaaaggactttgctgcaaaggctagactggagctattgggtagacagttgggagcatcagcactctttgcacaatggatggatgttaatctattggcttcagagctcattcattctaagtgcctttgtattgataaactccccagtgactacagggattcagaagagctgttgcaaattttttccagtgtccataaacctgtgttttgccaggtatgtatttttaagagattattgaaatattttaaaatatatacatatgtatctaatctacatacactcacaaatttatcatacctgtgtgattaacacaatggaaatttaattctgcatcattctgtagggaagactttgatctcatgggaaattttaaatcagttcctctgtttatgggccaaagtatgttgttatgtagttaagtatgccttagcaaatccattgcttactcattcacctcattccatccattcgtcccaccatttttccatcaatccatttatctatccaacttttatttaccatcttctgtgtaccagacactatgccaagtgtcagaaaggcagagaatggaaagatactctatctcaatacctcacaattttgtagaagagacggacaagtaagcaaataattgcaaatcctatatgaagagtgatataatggaggatagaaaagtactatgaagtttaaaaggaatgtgtagttctatcttaatgtggtcacggtaggtgagacatctagagaagatcctgaaaactgataacactggcgagacttttcaagcactttatcatagtaaaattaaatacattctaataaatatatatatatatactatatataacacttttccttacagagttttgatagcaactgatcaattatttctctcttgtttctctccatttcttccttctccgttttcctttttaccgcactcccttcccatccacgctccttttcctcttacctctgttgtttcctctcctcctttgcatcttttctttaatcatacatttgttgatttcctagtattgcagtagaaattttggagttggagtacatatctatatatgtatataaataaatatattatttaatattaaatatatattaaaatatatattatttaagttgacagttaaaattgtatttatcatgtataacatgttttgaagtatatatacattgtagaatggctaaatcaagctatttaacatatgtattacctcacatagttatcatttttgtggtaagaacacttaacatccactctcgtagcatttttcaagaatacaatatgttgttattaactgtagtcatcatgttgtccaaaagatcttttgaacctatttctcttatctaactgaaatgttgcatcttttgaccatatctccacaagctcccacacaaatcaccccagcccctagtatccactatacttctttgagatcacctttttaagcttccgcacatgggtgaaattttgcagtaatatatatttttaacattttttttttgagacagggtctttctctattgcccaggctggaatcatggcccacagtagtcccacactcctaggttcaagcgatcttcttgtctcagcctcccaagtagctaggactacaagtccacattactatgcccaactactttttaatttttttttttttttggtagagactgggtcctgctatattgccaggctgctctcaaacacctgggctcaagtgatcctcctgccttggcctcccaaagctctaggattggcttattgatatgttcttcttgaatactaagaattatattatgttgtcatcctgtggcctttatttgaggcctttgaagcagatgcgaagagaaaagccatttatcataaattgtatttgaattgtgaacccccccgagttggaagagcccttagagattatctagtatagctttacatgtcatagaaaatatttgctaccatatttttgagtgaccatttagcttctgccaaaatacttcaaaagagtggaaaattaactacatcacaagtcagaccattgtgtttttgaatggctctcatattgaactgaaatagccctctctgaaactactgatgccgtggacttaaaatgattttgttttttgaaagacttaaaatattataatttatacaggcatgaagatcattataatgaaatagaatagtaaaaaaaaatttttaagttttcaaaagattaataaagcagctttgggatggctctttatcagtgggtctgttaacctcaggctcttttgcatggtagattggcatagactgtattaaagacacagcctcttaacttgtggtcaagagaccaaaatgattaattagtggcttttacaaacctgattttaagaactggtttggattataagaggaatagggttgttggagacatgtttagaagaggtagatgtttttccttttcctgtgtgactggaaaaagctttgtggaggaaaagatatttgttgacagtttttaaaggaagaagtaatgtgaaggaaaagatagaaatttgatctaaatatacaaggaagtagaagaaagttaagcttcaaaaacaagagaaaagaaactgagaaggactaagaagtgatttagttgtaatatcagcttatgagatgccacacccaaatagaagtattggaaatgtgtcttctcaaagatatactaagctgaattttgtgtcatttatcactttatagcatgaatgtatttaagataattcagacgtgttcaaaacctagaaaggttttagtgtcttatcttgttcttatttttgctctttgtaccagtcttttcagatccaggactttagtatcttccattacactcttacaggtgggtgactggaaataaatcaagttctacatggcaggagtttatttagggcacattcagaaataaaagttgtgtgttgcttataataaacctgggacacagttttcctaaataaggtttgcctgggtatacttgactaaattcctgggatctgcctaaaatagtgaaataaaaatgaaatattcctcctaccttctcttgataatactaactttattttccattgatgtgtggtcaaataatttgttcagtatgtttcactgtccatgtacctggtgattttcttttaaggaaagctataattattgtgtcctcatgttttcctataaattaccagtttatatatttcttaatatatagagactattaccatctgggcttttactgttaaaataaattagaaaattaaagaattgaatagaaacttgacagactcctatcttcctgtcttcaagaagaactacatctaagcaattagtaaacattttcataaagaaagaatatgttatttccaccagtatcatgctccaatgcacttgttcttgaatttgaaaattatatatcgtaaataaatgtttctaagtaaagatcggaattactgtttaatagaatgtattgtatcagcttgcacaggatgaaggtagttacgttggtggctttgcagtggttgaatatagcactgcggagcaggctgaagaggtccagcaggcagcagacggtatgaccatcaagggcagcaaagtccaggtttccttctgtgctcctggagcgccagggcgaagtacattagcagcattgatagcggctcaacgtgtggtaagttttttctctttctgtctctttttttagagtatagaaaattctaatactattttaatctatccagtctagccaaagtaattgattgtcgattgcaccatcattgcatttccatcacactgaagacttttccttttttttaaaaaaggttagctaaatggtttccttgttaagtcaagccagaagtcattaccaaaaaaagaaattgtgtttagtaaagtgtatttatcttgagaaatttttgaaggaatttcatttattcagcaaatattgagttcctcttgtgttataaattttgagtgtaacatgcctcctttttctttttcttttctttttttttaaattttgaaatggagtttcactctttcacccaggctggagtgcagtggcacaatctcagctcactgcagcctctgcctcctgggttcaagcaattctcctgcctcagtctcccgagtagctgagactacaggcacatgccaccatgcctggctaattgttgtatttttagtagagacagggtgttgccatgttggccaggctgatctcgaactcctgacctcaggtgatctgcccgcctcagcctcccaaagtgctgtgattacaggcgtgagccaccgcacccagccgcctctttattcaagaagttttcacaagtagaggaaaatacgtgcctttttgcttatgtggcacattgtacttccttctttatagtaactgtctactcattcttctctacttctttagcctggaggatccttggagatggagactataccttcttcacagtttttaccctagtacttagcatagtaaatatttgttaattgaatgaaggaatacatttttgaaggaattgggaaagactttatgctgaaggtgacatttgagtgtgacaacgaatggatgagatattgacttgtgttgatgagaagtgaataggattgccacagaaatacagatttttgcatgagatacttgtactaaaatatcattcattgtttatccgaacttaaaatttaactgcacattctgtgtttttacttgctgcatctggcaaccccaaagagggaaagtgagtagtcactctaggtggaacagaaactactcatacagtgcttgaggagtggtaagtggtctggttgcagagtgaatatgaggatgcttggatgtaggctaatgccaaagcaaggaagactattgagtactcagccaattacataggtatacatgtgccatgttggtttgctgcacccatcaactcgtcattacactgggcatttctcccaatgctatcaatcccccagccccctaccccgcgacaggccctggtgtgtgatgttccccatcctgtgtccatgtgttctcattgttcagttcccacctatgagtgagaacatgcggtgtttggttttctgtccttgtaatagttttctgagaatgatggtttccagcttcatgcatgtccctgcaaaggacatgaactcatccttttttatggctgcgtagtattccatggtgtatatgtgccacattttcttaatccagtctatcattgatggacatttgggttggttccaagtctttgctattgtgaatagtgccgcaataaatatatgtgtgcatgtgtctttataatagcatgattgataatcctttgggtatatatccagtaatggaatagctgggtcaaatggtatttctaggttctagatccttgaggaatcgccacactgtcttccacaatggttgaactaatttacactcccaccaacagtgtaaaagcgttcctatttctccacatcctctctagcatctgttgtttcctgactttttaatgatcgccattctaactggtgtgaaatgatatctcactgtggttttgatttgcatttctctgatgaccagtgatgatgagcattttttcatgtgtctgttgactgcataaatgtcttcttttgagaagaagacatttgttgtctgttcataccctttgcccactttttgatggggttgtttttttcttgtaaatttgtttaagttctttgtagattctggatatattagccctttgtcacatgggtagactgcaaaaattttctcccattctgtaggttgtctattcactctgatggtagtttcttttaatgccctagaagaaaacctaggcaataccattcaggacataggcatgggcaaagacttcatgactaaaacaccaaaagcaatggcaacaaaagcaaaatagacaaatgggatctaattaaactaaagagcttctgcacagcaaaagatactgggctttataaccatgcaaccggttgcctgaagaattaggcctcacttattgtcaccatttcttaattttccatttccctctcaagtctaatgcaatgtagtttctcctccactgttcaagtgaatctgttctcattaagttaacaggggtttttaaatattcagatctagtgactacatttcaatcttttattggttggtcccttcgcaacatttaaaaccttctactggctgggcacagtggctcacgccagtaatccaagcactttgggaggccaaggtgggaggattgtttgagcccaggaactcgagactagtctgggaaacatggtgaagccctgtctctacaaaaagttagctagacttagtcgtgtgcacctgttagtctcagctacttggggggctgaggtgggagaataacccgagcccaggagtttgaggctgcagtgagccatgattataccactgcactccagcctgggtgacaaagtaagaccttgtctcaaaaacaaagcaaaacaaaacaaaacaaagctctctactaccttgaattctgccacaccattcattttcctatctgcctatgtgttctttccctaacttattttttccccctaagagctgatatcagtagatttccatatttggccttctcattttcttcctgttatatatgcctattagtgattacttccaagcatataatttcagaccaaactgctctcagtactaaattatgtttccaagggattcttagacattcccacttcatgctatataaatagttcaatttcagcatttcaaagaagactttttttctgggactgcttttctatgttctataatatctatatatggcatcagttcatccaaactaaaactatgtgaatcaaaaactcagttaatcgtgattggtctccctcacccactttctaatgtaaatgtcagaaatactatcacatcctttcaatttcacctcctaagatctctcaaatccttgggaccttgtcagcatcttgattacttcactcaggatctcatcttttctcatctctctgattagaataattccctgcgtggtcccatgtcattagtctttccccttctaatccatcttgcacagtgcacaggagagctctttctcatcctcaaatcagcttatgtcattctcttgcttaatattctttaatgcctgcataagttcaccttccttagcatggcatgcaggccctttacagtcagatagtagtgacagtgagaaatctcagtcttaaaaataaggtattctagataatgttttctataggtttttggtacatatcctttggtaatatcaagttttctgagttttttaatgtcataaataggtgctgacctttatcagaatatttctacaactattgagataatcatgatttctccttaatttctttagcgtcgtttgagagttacacattctatctctatcctgctggtgattgtgcctgtccctaacttttttttttttttttttttgaaatagagtcttgctctgtcgttcaggctggagtgcagtggcacgatcttggctcactgcaacctccgcctgccgggttcaagcgactctcgtgcctcagcctcctgagtagcagaattacaggcatgcaccaccacgtccagctaatttttgtatttttagtagagacggggtttcaccatgttggccagactggtcttgaactcctgacctcaagtgatctgccagcctcagcctcccaaagtgctgggattacaggagtgagccaccatgcccggccaattgtccctaactttttaacatgcataggtttatcagaacttctgtctactcacttattctcacctccatctgcttcctccttcctaccatacctatcatcatattggtgtctgcctttttgcattaggatagtcttaaatgtttttggggtgtttttatggttgtggctttgcatacaagattaaaattatgatattgtgtacctcaatttcaacatattatataataacatcttgcatttatttcttttcttgctggattacttccttctagggcattttgaaagatagtattcttgtggtaaaaacttttgagaacttatatagttgagaatatttttatttctttgtgatactaaataacttagatgaatctaaaaatctaggctcagagttcttttcttacaatactttgaaaatattaattcattgtcttcttgaatctaatgttgatgctttgagaaagaagattatagtaatttgtttcttgttcctttagagatatgttctttttaaatggaagtttttagaaggttttttgttgttcttattggctttgatgttcttaaatgtcacacaaatgtgactaggtgtgttttttctttagaaatcatatttggaagactgtgaaccctttcattctatgctcttcaattgttctttaataatgggaaatttctcagccattatttcttcaaagatcttattttcttctccttcagagacttctaatattacaagtgttgatgcttctacctccgttttcttcgtcaccctgctttttcttgtttgttggaattttcagtttctttaattggatctttaagatcactactttgggccaggtgcggtggctcttgcctgtaattccagcacttcgggtggccgaggcaggtggatcacctgaggtcaggagtttgagaccagcctggccaacatggcgaaacccggtctctactaaaaatgcaaaaaacttagccaggtgcggtggcaagcacctataatcccaactacttgggaggctgagacaggagaattgcttgaacccaggaagcagagattgcagtgaaccgagatcacaccattgccctccagcctgggtgacacagcgagactctgtctcaagaaaaaaaaaaaatactattttgttttttagtcacatatattctactatttaacctatctgttaaagcacagggtaaatgttaataataatgcttcacgaattccttcagtttctttatctatagaatggagataatactaagcttatagaattggttttttgaggattaaatgatctgattcatgtaaagtgtttagaacaatgccaagtctatagtaagtgagggctgctattatttttcctcaatacttatgtttttcataatctagcatttctcattggttattctttaaaaactgcttgtccttcatgttatgagtaaaaatccattttatttttgtaatgtctattacatttatttgacattcttattatttcctattcataattctgctttctgtcttataggtggttcagtttgttgcttttattttttagtgactgcattctccaaatgtctagctatttttcttttgaatgtatgaatatacatttcctgtgggggctatcacctttctgtatgtcactgtttagaggttgtggggaaggggatgggcagagggaagctaaagcctggtcttagctagggtttagggaagggcaggcaaggacctcagggcagagaagttctgccttcaccatctaggcttgagcccagcccttttcccaccccagccaggcagccctgcaccttagagagcctctcttcatttccacccctgctcttttccaagttctgccttcctctgctgtaactcttctatcctgcagagtgggtgtgggaggacctgagaaggtcggggaggtgggaaggttttcagtgaccagctggtctgcccgcctagtgttatcttgtccccattgtctctgcacttgtgtgccatcctgctgttcgttggtcctatggctgtcactggggtgatgctgctgttttcccacctcactgtcctggccaagaaagccatgctctctgaaggcaaagtagttacacaactcaaaagtccttccctgaattatcctgtgtgtggacccatgcactctcatgctctctgctgatgtttaccttcacatcttctatctccccaggggtttctcacaggctttatgtcagtttcttggatgcatcaccttctccctctcaatttcgcagtatgtgggttgggagaaggttccagttgtccttgtccgttctccattttctcatagctgaaagtttttaatttatcttttatgtaattatatatattcatatcaccatccatcaagctggtttttaaaactgaaaattatttcatgtttttaggaagctactcgattgcatgtatgtaaggccagctcattttaatctcatattaagttaatcaagtaaagacctttataaaaaagaagattttgggctgggcacggtggcttatgcctgtaatcccagtactttgggaggccgaggtgggtggatcacgaggtcaggagatcaagaccatcctggctaacatggtgaaaccctgtctctactaaaaatacaaaaaattagccaggtgtggtggcgggcacctgtagtcccagctacttgggaggctgaggcaggagaatggcgtgaacccaggaggcaaagcttgcagtgagccgagatcgcgccactgcactccagcctgggcaacagagtgagactccgtctcaaaaaataaaaataaaaaaacaataataaagaagattttgggtcagtcgcggtggctcacacctataatcctagcagtttgggaggccgaggtggtggatcacaaggtcaggagattgagaccatcctggctaacatggtgaaaccccgtctccactaaaaatacaaaaaattagccaggcgttgtggcgggtgcctatagtcccagctgctcgggtggctgaggcaagagaatgtcatgaacccgggaggcggagcttgcagtgagtcgagatcacgccactgcactccagactgggtgacagagcgagactccgtctcaaaaaaaaaaaaaaaagaagattttgaattgtaaggcaacccacattgttaaacttcgttttattttatttttatttgaagtttttatttgtaaaaatatagaaacagggtttcaatatgtcacccaggctgatcttgacctcctgagctcaagtgatcctcctgcctcagcctcccaaagtgtcacgattacaggtgtgaggcactttgcctggccaattaaactttaaatcaacattataagaaggctcttctgtagtatcaaagtatccatattgtgtcaacaagttattaataacttcagattcccttgtcatccttctatttgtatgatatgatgagactcattgtgctaaattgtcagtcctcttaaagccagttggtatttacctgagacgttctatgaggattttatgccatatgtataattgagaactgcagtagagagtataaaatagatatataatataaatcaaattatgtttatcataaaatagatcttgtcagatgaatgaggatttctagaagaaagcctttgaaattgtgtctttgtacttatgctgttctaatgtttcttatttctatattcattgcagatgcacagtaatcaaaagggcttacttccagagccaaatccagtacaaattatgaaaagtttaaacaaccctgccatgttgcaagttcttctacagccccagttatgtggacgagctgttaaaccaggtatggaccatgtatgtatactgattaattaaagaatgctagcatgaagttaattttttcacatgtgaaatatggaaaaatacattgatttgtgaaaaatatatttaaattagtataaaatatttaatttttctaggacctgttaatgaattttaacaataatctgaggtgatatattttgactatttttgacatatacaacctgcttatgtggtattttttactattaataaatgctaaatatcaaaccttctgtttagctcttagttgacatgaatttatagaccaaggtaaaggttaacacactacattgttataacctatattaacaaagaattaatactcttctatgtaatatttttagcagaattattttgttgaaaagtgccaagtgtttgtttcctctttgttcttcccctttttgttgtaaaattgtttcactttgtagcaaatgatgaaaacattattattttctaagtgttatgcaaatctttataatatcagtatacattaaatatctacctatttagtattctttctctagtaagagcttaccttctgtgcattctgaaatgtacaactttttatgtacaaaaatgtctgttttagcattatgaggaaatgaatgcctatacagtggtctccccttatctatgttcttgtgttccacagtttagttacctgcagtctgaaaatattaagtggaaaattccaaaaataaactacttataggttttaaactgcatgctatcctgagtagtgtgatgaaatgttttgccattctgcttctcctgccttggctatgaattacccctctgtccagtgtacctactctgtatacattacccacccattaatcacttagtagccttcttggttatcacatcacctgtcatggtattgtagtgcttatgttcgagtaacccttattttccttaataatggccccaaagcgcaagagtagtgatgctggcagtttggatatgccaaagagaagctgcaaagtgcatcctttcagtgaaaaggttaaaacatttccaacttaatagggaaaaacaaactgtgtgctgaaattgctaagatctacagtaagaatgtattttctatccatgaaattatgaagaaggaaaatgaagtttgaacatagcgtatataaattttggtactatttatggtttcaggcatccactggggttcttggaacatatcgctcgctgataagggggaactaatgtattcaacatttaagtttacagcaaatatgtatagagcaaatatattaaatacatttattatgtttcagtcccaactggtctaacaccagctcacctactgcaattcaattctagcactaactacctggagttagcacagaccccacaagttaagagctcaatcttccatatggctgcccccactttagacctagacacaagttcgggggattctccaggccatgtgcacttctgaccaactaactacaaatttgggagttcccacagtgccctcaggttcaatagttcaatagaatgactcacagaacttaggaaagcactatgcttatgaatacagttttattataaagagcacaggcaagggaagatacacttagggaaaagtcttggagggtcttgaatgcagagcttctgtgtcctctacccatcaaatcaggccatgtcaccctcccaacacatcaatatgttttccaactggggatctctactgaacttcgatgtccagagtttttattggagtttcactatgtcagtgtgattgatgggccccatgattgaactcagtctctagtttgcttccattccctggaagttagaaggtcaggctgatatcacatgatgcaaagctccacctctccttatagagttggtctttctgcacagccagccctcatcctgaagctatctatgtgtccataatgagttacctcagtagcatatcaaagacactcctgtaactcaagaaaatacaaggatttagagtctccctcaggaaccagggacaaaggccagtcaaattctttattatacaacaatattcatattcagtacttcatataattatttgtgtgtaagaagcagctttggtagttttctggctcaggctattatgcaattagatatctcttttacaattttaatagtatagagatactcttttttgtcttgacaacatgaaggattagaagctcattacttcccaaggcagcctattccctggtttgacagtttcagttactggaaagtttttatattactaatataagtaatttttagccacttattctggttccacctctgaagaaatacaggataaatgtattccttcttgcataataaaagcctcctaatatttgaagacaactaccatgaaacctcagtcattttttattttacctgtcttcttttctccagaccagttcttttttttacaatgcaactttatcagtaaaataaattttgagcagagccccagtatataccatatatgtaaaagatgtcagttaaacagatggaccattgacaatccatatatttagaaatgatcaaacctaatgttttccttttttaagatgaaagtaaacataaatagagatggtatttttttctgcaattctctttttatacatcttatatctctttgcagattacagttctatatttgacttcccataacatgtcacaggacatgtgctttaaatcccccacaagttgttctcttgtggatatagtctaggtcttctgggttgtcccaaaatatgatgtgcacagacacaaacatattctgtatattggttttgattaacacagaatgcagtgggatttccttcctattatcattatatttcccttaatgcagtccaagattatgtattagtgtctaaagaagtataccacattcttaggtcttttagaaagtatcatctgcctctttggactctgggctatctttactaattcatctcaagtattatttttgtctcttcttttcatctaagactaaatattctccactctgctgttctactcagattaatgtatggccatatggcagtagacttctttatacttagtgctttctcaattttaagatgtttgaatattacactgatgcagaagttatttcataagcatagctttttcttgtgtggggtggaaagggaagaggattaaatcactgcctcacttgagcacatacatagctggaaaatgtgtggaaagtttcttgatgttgagaaaaaaagacagtgtcttgttaatcaataaattccgtttatttttcttttactatgtcctttactatatcataactgtagccttgctatatcctgaactcctcacaaaggccttctctgagccaactaaattaatgataaagaattgtaattcttggctgggtgctgtagttcacgcctgtaatcccagcactttgggtcactgaggtgggcagatcacctgaggtcaggagttcaagaccagcctggccaacatggcgaaaccccatctctactaaaagtacaaacattagctgggcatggtggcatgcacttgtagtcccagctactcgggaggctaaggcaggagaatgacttgaaccctggaggcggaggttgcagtgagccaagattgcaccactgcactccagcctgggcaacagagcgagactccatctcaagaaaagaaaaaaaaaattgtaattcttatacccttgctctgcttctttatcattgtgtaattttaaaaacaactgacatatattatacaggtacttgtttattgtctatttctaccactaaaatggaagctccaactgctattagattaatttccctcccaggtccaattttgattatgttactctgaccaagctgatcttttctcttcaatctagaccttttaactaccttcaaaaatacaataaatataattattctagacttctttatgtatgtgtgtgttcctaatttaactgttgtgtaatcacttgatagtataaactgtatttttttaggataaactatttttaaacagctttattgaggaatagtttatgtacattaaactgtaggtatttgaagtgtatgaattgatatgttttgatgttatgtatatactcatgaaatcattaccacaatcaaataatagacgtataaattaccccctaaagcttctttttgtccatttgtaatccatcccctatcctgtccccaggaaaccactgatctgctttctgtcactacagtttgtattttctagaaattggtataagaggaatcgcacagtctgtactgtttggcttcatttacttagcttactgttttgaggttcattcacgttgttacatggcttagtagtatttttttctttttattactgagtggtatttcattctataatttgcttattcattgatttgttgatgggcatctggattatttccagttcgaggtcattacaaataaaatctctatggacatttgtgtactagtctttatgcttttatttcttatgcttttattctctttgataattaactatctgtggaatggctgagtcatatggtagatatatgtttaagtggtaagaaactgcccagctgggccaggcgcagtggctcatgcctgtaatcccagcactttgggaggtcgaggcgagcggatcacgaggtcaagagattgagaccacggtgaaaccccgtttctactaaaaatacaaaaaattagccgggcgtggtggtgggcgcctgtagtcccagctactcgggaggctgaggcaggagaatggcgtgaacctgggaggcggagcttgcagtgagccgagatcgtgccactgcactccagcctgggtgacaaatggggactccgtctcaaaaaaaaaaaaaaaaaaaactgcccagctgttttccaatgtggttgagccattttacatactcaccatcagtttctagggctccagtttgcttagtatccccaccagtacttgatctgttggtctttttaattttagcctttctattggatgtatagtgctctcttactgtggttttaatttgaatatttcttttgactaatgattttgagcttcttttattgtgcttatttgtcatctttatatcttctttggtgatatgtcttttcaaatattttgcacgtgttaaaaactgagttgtttgtcttcttatcaagttgtaagagtgtttttttattttacatacaagtactctgttggatatatggtttgcaaatatttttttaacagtgtcttttgaggagcaaaattttttattttgacaaaatccaatttattattttttcttttataatttgtacttcctgtgtcatatttgagaaatctttgccaaattcaggttttctaagattttcttgtatgttttcttggagaaagttttataatttttatccctatatttaggtctatgatctattttgagttaattttagtttgtagtatgaggtaagagtccagattttttttttacatatagttatacaattattctggcatcatttgtttagaaagataatgtttcattgaatattttgacatttcccaaaaatcagttcaccatatatgcatgaggctataactaaactgtgttcattgacctaaatgtctgtcttttaccagtactgtctttatatcaatactgtctctataccaaaatatatgtgttataaatcctgaaatcagttagtgtaagtccttcaactttattcttctttttcaaagttgtttggccattccaggttctttgcattgacttataaattttagaatcagagtgccaatttctatgaaaaatgtcggctgggattttgattgagattgtgttgatttgtatgctaatttaggcagaattcacaacaattctgaggcttctgatccataagtatggtatatcttttcaattattttgaggtcatatttaatttctcccagcaatgttttattttttcagatacaaatcttatacatctttggtcagatttattcacagtatttcatattttttgatgttattttagatggtactgctgtcttaatttcaatgtcctgttgcttgttgttagcatatagaagtatgactgattaaatatttatttatcttatatcctacagtcttgctaaactcacttattatttctagtaggtttttgctgggattttctatgtagatgattatgttatctacaaataaacataattttacttcttcctttccaacatgtatggcttctatttttttccttgcttttttgcattagatagaaattccaattgtgcatagaactggtgagagcagacatccttgcctcatttctgatctcatggagaaagtattcattctttaattattaagtattatcttagctagagttttttttcacagatttcttttattaagctgcggaatttaccatctatttctaattgccgaattttagcatgatggttgctggaacttgttgaatgcttttctccatctattgagatgatcatatatttttcctatctgttaacatgatacattacattgatgatttttgaatgttataccaaccttttattcttagggtaaacctcacttagtcatgttatattataatcttttttatatattgttgaatttgatttaataaaatttagtttgaaatttttgcatctatgtttatgaggtatattggtctgtagttttcttcccttgtaatatattttctggttttattatgctgccctcatggaatgatttggaaaatattccctctcttcagtcatcaggagagtttatgttcagtgctattatttcttcttcatatgtttgatagaattcgctagtgaaatcagctgtgtcaaattttttaaggaagatttctgactacacatttaatttctttaatatgtaagagctatttcaggatcttgttcttcttaagtgagctttgctagtttgtatctttcaaggaaattgtctattttgtgtaagttatcaaatttattggcataacattgttcatagtattcccttattattctttaatctctgcaggatctatagtgatggcctctttcacattcctgatatttttgtcttctctcttttttcctgataagtctggcaaaaggtttatcagtattattgatttttccaaagagctagcttttgttttcattgactttctctggttgttgtctgttttttatttcattgatttccgctttaattatgtctttctgcttaccttgaacatattttgttcttccttttctggttttttaaagtaaaactagattattcacttgagacctttcttcttttaatgtgtttagtattacaaatttccttctaagcactgtatctcacaaattttgatatgttattttcattcatttcaaaatactttttggtttccattttgatttatttggtcagttggttatttgtgtcacttaagttccaaaatttggagattttctagatttttttggttataatttaattcacttatagacagagatgatactttgtacaatttaaatttataaattagaatttagacttgtttcatggttcagaatacaggctatatttgcaaatagtccatggacacttgagaagaatatatgttccgctcttactggatgtggagtgttctatacacgtcagttagatcaacatggttgatagtgttcatgtctcctatatccttactgatttttcatcaacttattctatcagttatactgaggagaaggatggggcatagtgggagtcctagccatagctaagggtaagagcaggtaggcatgatgctatggacattttcagactgtttttattctgattgttgtttctgttgttgttataaactggaaggtactgtgttcagtaaaaagctgtgaagaaaaattatttcagttttttataataaaatacagtgatgatatgaaaaagagaagaagagttgttgaaatttttaatcataattttgggtttgtctacttttcctttcagttctgtgaattttgcttcatatattttgaagctttgttatttggtgcacaaacatttaagattgttgcatcctcttgattaattggcccatttatcattacaaaatggtgatctttatccctggtaatatcttttgatctggatttttttgatattaaagtagccaccagcttttaaaaattaatatcaccgtatctatctatatctatatgtttatatgtttaacaaaatatattttaagttgccaagtgggtttgtattttctattatcttggaaaatccttttctgatatttgcagtattactactggctactccatcaataatgtgtgactttaaagtaatgtagtttttttttttctttttttttttattatactttaagttttagggtacatgtgcacattgtgcaggttagttacatatgtatacatgtgccacgctggtgtgctgcagccactaactcgtcatctagcattaggtatatctcccaatgctatccctcccccctccccccaccccaccacagtccccagcgtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacaatgtaaaagtgtagttttaaaagtgttttgatatctgttatttgtggtttccataatagttttttgagggaagagacttctattaatctttcataggtaatacatctagggctttgtaatttagatgtatttccccaggtggtcattaatttaacaagaagggatgtgtcttaaaaactctattttttgtacttcaactacagaatttgaaaaaaattaactcctccactcaagtttttttccattaagaaaatttttaattgacatgtaataattatacatatttatggggtacagactgatggtccaatacatgtatataatctgtaataatcaaatgaaggtaattagcatattaaccacctcaaacatccatcatatcattgtgttgggagcatttaaagtcctctcttctagctatttcaaaatatacaataaatgtttgttaacttagtcaccctacagtactatagaacatgaaaacttaatcagcctatctagctatagttttgtaaccattaaccaacctctccctatcatccccttctcccttctcttcccagactctaataaccatgattgtaccttcaacttctatgagctcaacttttttagctcctgtatatgagggagaacatgcagtatttatctttatgtgcctgacttgtttcacttaatataatgtcctccaggttgctgcaaatgaccagctttccttttttcttatggctgaatagtattccattgtgtatatgtaccacattttctttatccattcatctgttggtggacacttagtctatatcttggctactgtgaataatgctgcaataaacattaggatgcagatatctcttcaagatatggatttccttttctttggtttgttgttgtttttgttgttatttgtttgtttttttgagctagtcccaccctgttgctcaggctggagtgcagtggcatgatctcagctcactgcaacctctgcctcctgagttcaagcgattctcatgcctcagcctcccgagtagctaggattactggcatgcaccactacaccctgctatttttgtattttttagtagagacggtttcgccatgttggccaggctgatctcgagctcctgacctccagtgatcaactcacctcagcctcccaaagtgctgggattacaggtgtgagccactgcacctggccgtgatttccttttctttggataaatattcattagtggattgctggatccatatggtagttctatatttgtttttttgagaaaccatcgtactgttttccataatggctgtactaatttgcattccctccagcagtgtaagagagttcccttttttccgcatcctcactagcatttattatttgtttgtctttttgataattagaattagctgttctaattggggtgagatggtatcttattgtggttttgacttacatttccctgatgattactgatgttgaacattttttcatatacttgttggtcatttatatgccttctgagaaatgtctgttcagatcctttgcccatttttaaattggattatttggggtgtttttttgttttttgttttttttttttgctgttgaattgctagagttctgtgtatattctggatattaatcctgtgtcacatgaataatttgcagatattttctcccattctacaagttgtacgtgttcaccctattgattgtttccctcattgtgcagaagctgtttagtttgataaaatcccatttgtctatttttgattttgttgcctgtgcttgtgaagtgtgacccataacatctttgcccagatcagtgtcctcaagtgtttcccccatgttttcttccagtagttgtgcaatttttagtcttacatttaagtttttaatagattttgagttggtttttatatatggtgagagataagggtctggcttcattcttttgcatatgaatattccgttttcccagcataatttattgaaggggctgtactgaagttatttgtctaagtcaagtaatattttccctaattttctacatttaattccctatcacttgcagaggagttcttttccgtgtaccagttttccactcaaaaatgcctttttcctcattgaagtagataatagaattctaagtgagtcatcttccatatatcctcacattatcataactttcctaaaattatgctagaattaaacattccctccaatcctgtgtactctgggcacttcctcctttgctagagagaatattgaaaactgttgaattaaatagtttcctgtgattatctcactgatatcattctactcctgaaaccaagaagttggatcattcttgtcttctgaggtggtcccaatgtagacttagatggatactaaaaaatttggttacaatgaggatttatttcatttatttatttattttacctttcatagtacagtgtttttttattttgctacatatatattacaagaagatgttgccagaaccttttctggacactgtttgtatattttatatatatatatataattttgtatattattattattattttgaaatggagtctcactctgtcagccaggctggagtgtaatggcgtgatctcagctcactgcaacctccgcctcccagcctcaagcagttctcctgcctctgcctcccaagtagctgggattacaggcatgtgccaccatgcctggctaatttttgtatttttggtagagatggggtttcaccatgttgaccaggctggtctcgaactcctgacctcaaacaatccgcccaccttggccttccaaagtgctgggattacaggcgtgagccactgcacccagcctaattttgtatattatgattattccagttattttacaataattagattaaatttctaaatatattttctatctcatggtcctctttgtgtctctatattatctattctaaaaacatcctcccttttttttttttttaaagtcagagcaagtttattaagaaagggaagcaataaagaatggctgctccaggccgggcgcggtggctcacgcctgtaatcctagcactttgggaggccaaggcaggtggatctcaaggtcaggagttcaagaccagcctggccaacatggtgaaaccccatctctactaaaatacaaaaattagctgagcatggttgtgagcgcctgtaatcccagctacttgggaggctgaggcaggagaatctcttgaacccaggaggccggaggttgcagtgagctgagatcgtgccattgcactccagcctgggcaatagagtgtgactctgtctcaaaaacaaacaaacaaaaaagaatggctgctccataggcagaacagtggcatgggccactggttgcccatttttatggttatttctttattatcttgattatgtgctaaacaagaggtggattattcatgaattttccaggaaaatggtgggcaattcccagaactgagggttcctgccctttttagaccatatagggtaactttcacacgttgccgtggcatttgtaaactgtcatggtactggtgggagtgtagcaatgaggacggccagagatcactcttgtcaccatcttggttttggtaggttttagccggcttctttattgcaccttgttttattagcaagggctttataacctgtatcttgtgctgacctcctgtctcatcctatgacttagaatgcctaaattactgggaatgcagctcagcaggtctcagccttattttacctaacttctattcaagatggaggcactctggttcaaacatctctgacaccccccacctgctcccttttgtaagttttccattctaaaaacatcccttttgaaatgtactctggtatttagactcttagacgcgattatgagtattgttaccatttattctttttatgtctgtgtacagttttgcagtttcttttgattttattatgtaaatatttttgtgtacatatattgtcttctcaattggattttatgtaagcttttcaaggacaaggattgtatcttgtcccctactcctaccctctgccaaaatccctgaaataccaaaaaaacactgaataaataacatgggttcaatgagtattgtgcttattaaaggtggatgtgttttgttgcactaaattctagagaaaattaagcctaggtttggagttttacaattatggcagaaggcttttgaattttaaagcaaattccagggttgaatctcagggaaaggtacctatcacttttgaccaatgacaaggtcactatatcattgaactttcagtggatttgttaatagtttaaagaaatattcatttacccttttcgaagcttggtttttaaaaatttttaattccatatataaattaaagtttttacttttattttctcaaagccgttcttggaacacctcacagcttgccacatctgatgaatccatccatctctcctgcatttttacatttgaataaagcacatcaggtacataaataacattgagtactgaagcattaaatattcggagtgaatattttgtttgttcttaacacttaaagttctcaagaaattaaatgagtattttgcttttaaagaaaatctttaataataagtataggtatgtaaaatcataacttattgagtatatcagattcaattaagctagccaaagcagtagttatgtaccatgataaatattattgattccaatttgtatggcattaagaaggaaagtggtatatttttttctagataataaataagttgttcaagacacggcttcttatgtggtcttaactcaaaaaagtatttctagaaagaaaatataaatgaacagtaacttaatttttaaaatttaatgactattataaaaaataactcatgtatatgagaatagagtatgtttcctaccttttttagataaatattttaaatgtgtgtttatagatttaaatgtctgtaatattagagataagcattactcattaatttcaggtactgtttaagaacatagaattctaattacaaatcaaacaatatataatcgaattttaatataagttgaatgaatgaatatctggtcctaaatccagcttttatttttcatccttagaatctaacacaggacttggtgatacattatagagtttttattcattcatttactcaatgtattttattgagtatctgacatatatgtattagacattgtgctaatcattgaggctactgtgtggaatgtaacatttaaagtctatgttattatagaatttcaaccagtagggaaaacacattaaacagttaattacaataaggagtggagagtaatatgagaggggaagttcagagtattgataatattccctgtgttttaagagaaacaccaaaatgcattacctttaaggcccatacatttgagctggcccctcctgcctctcaactcactgcagatcgctgtcccactacaacagcctggttttggtcctcaaaggaccttgttttttcctcctttggtcttttctcctgctggtccttcttcctggaacgcttcccaccccaacatcacctaattccctcccagacttcaactacagccttcagattgcagtacaataattagttcctccaagaaaccttccttgaatcttccaggctaaatagcattcctccactatttgttcttatagccccctgtatttttccttcatgtgattaccatgtgtaatcctgtgttttttttattaattaatggctcccttccttaggggattgtaagatctatgagggcagatcttattgtacttctcactaagtagcacagtgcctagaacatagaaagtgctcaataaacctttgttgaatgattaaatgaataaataaatgaatgaatagaatgtcactgtcattgaaaccaaaaagggttgagaggagggaacgaaggatgaaataatgtagaattatttcatgactgcatggccccctcttgtgtattattaaaataattaattagctttgtctgataagttggagagtgaaatatgtttagaagcagttacttttactcagatcgactggagaattgaacttcaaaatgaattgggttatacaacatgtagcttttcaaaattaaactgacaacgttttgtcattttcacagagctcagttatgggtaatacttctaatttattccttcagaatctttctcatataccactggcacaacaacaattaatgaagtttgagaatattcatactaataatgtaagtatggtatcattttttcttttaaaatcagttcatttcttttctagaatcaggctgtggatcaggttgtttatgaattttcacgtgtgtagctttttttaggttatatcttatggccatgggtcttacctttttttcttcttttgtagaaacccggcttacttggagagcccccagctgtggtacttcagactgcactagggatagggtcagtgcttccattgaaaaaggagttgggacatcatcatggagaagcacataaaagtaaatgatgtgtatttactgagaagtcagtaaacagtcaggtttgagatttaaagatagtttacctatgttctaattttatttacagggaggtcaaatttgagttttatttagtcatttaaaattttgagaaccctcttggcttttcgattttcaatattggtaagttactgatggacttgcttccatgccaagataagacttcccctattggatatgctttaatattttatgcaggttcacagcagtacaaggtaaagacacagatccatttgagactgacatgctgcccactgggctgacagcacatatggatccatgtaattattgctgggataagaaaccattcacttttattttttaaaatctagtatttataaatttaaagtttgattatttatttgtattatttaaaaaaatttaacctctaaatcagtagtcaaaactaatgtgtgtactatgtgcttctaaaaacatggcaaacaaaatagcttttttggcaggaaaacagaagcatggtgttatactaagacttcttatttgaatgtgattttgaagggcattttcagcttgaagcttaattgaaatttgcttagaagtgagcatgctgagtaaaaacagaagggccaccaataatttaaaaaaaagtcaattaaatatgcgtagcttacttaaccttttgtccagtgatcaaataacttagttctgactgttgaaattgactggacaaaagttaagccagtgaagaaattttgtgatatcatggggtctgtatttccaaaaaattaaattttttatgtctaaaagcttatgcaaatatgtattatttgtgttggattaactaataaattatttgctttagtatatgccgctttaagaacactgaaaagtcagtgtccaaataactatattctaaacgttaggggaaccaaagtatccatctctaaatgattattactaaaaataattgaagaaatttgtttagtaaatttataaaatggtaaatctgacttagttgtcaaaattagctttttccatttaattttgacctatagattttttaaaaagtggaacggttcagaattttcctattaaaacttttatttgccagcctgggcaacatgacaaaaccctgactttactaaaatgcaaaaaattagccaggcatgctggcacacgcctgtggtcccagctactcaggaggctggggtgggagaatcacctaagcccaggaagtcgaggctgcagtgagccatgattgtgccactgcactccagccttggcgatgggaatgagaccctgactcaaaaaacaaacaaaaaaacccttttatttcttccagaatttcttgttattttctgtaaataaaaacataaaactttcatgtatttagtgcttatctattaacaaatactgatttaaaaaaagaaaccagtgatatgctgataagtgtttaacaaccagctctctaggttgaaaaaaagggcttgatttgtagcatttgtgcatttctgtttgtgaatactccagctgtgactgatttcaagttaccaatatgaagacacttaacttgatagctgggaagagatgtgtattaatagctctcatgagctgatggaagccagctaaccaaatttattattggagtcaatcaaacttcattaaattttaatttcagataactttttaaacttaaaacttaattatttccttcagttatggaaacagtcaagttgcaatgactgggcataaaaaaaagcactaatacagcttaaatgccaaaaagtacataaactttgccctcaactttaacaatatataattaacaattatatatagaatttaaaaacttaaaaattccttatcattgaggttaccctgaaagttgctgaaaataagagcattattactattgtaggtttttgtttttttcataaaggaacccactaattaacaacctctaaccttaccttttgctgttatctaacaggtacaaaattggtttctctgcattttgctcataacttaacaaaattaaaaggactattgtgaataaatattttctaactaaaagctttttgcatttatggtttgctacagcatctagcctgattccaactcaaacaacgataacagctggaatgggcatgttaccattctttccaaatcagcacattgctggacaggctgggccagggcacagtaatactcaggagaaacagccagccacggtgggaatggcagaaggaaatttctcagggtcgcagccttatcttcagagctttccaaaccttgctgctggaagcttgctggtgggacaccataagcagcagcaaagccagccaaaaggcacagagataagttcaggggtaagaaaactgtgggtgcacacagatgtatatatacatgtatatgtatatatattccttttaaattatgtcttaaattgtcgtgtcaatgaaatgatgactttttcatagtttacatttacttttcaaaattgaagaaaacattgcattcttttaaaaaatctgttataaataaagcaaacaaaaaatccattttttgataagttatgctagctggcatttgggactatcttaattatttgccagtttgtaagtaaagtaattttaatttgtgtaaaatgagttacgtctcttataaataatttaaatgtggattctttattccttataagagaataaggaatttccaaaaagtttgtgatatacatggttttcaaaaatacttgctattttaaatataagatataaactagtttaagttcagaattttgtagtttgaaaaagcttaggagtatcaatgcttattcgcttacgtagtaatgttatttgtaaggctttctaagtacatagtaatgctgttctttcaaatatacttttttctatcttaaatatatatttggtagctaattaaagtattttaatatttaaaggcagaaccaattttatccggaaaatatcaaaaccagctattaaactctggtctgttcaaactaatctggtctctcttttaattctggaagattttaccgaatcattttattggctaaaataccactgatatttataaatgttgtaataagtaggtagactaaagtacatctaatttttattatatttgtaccctaaaatacactgtggtttgtaagtggtataaaacttaggcttaagcagtttgtaaggaaaaaaaatctatgtagtttcttgtattcaagtgtcaaaataataatactgaatttgtaagaggttttagtgttacctagccatagcaagaggtatgactagaatgccctgcaattgtatattgagaaagctaatgcagtcctttttttttttttttttttttttgagaccaagtcttgctctgttgcccaggctggaatgcagcgacacaacctcggctcactgcaacctctgcctcctgggttcaagtggctcccctgcctcagccttccaagtagctgggattacatgcacacaccgccatacctggctgatttttgtatttttagtagagatggggtttcaccatgttggccagactggtctcgaactcctgagctcaggtgatcttcccgcctcggcttcccaatgtgctggtattacaggtgtgagccactgcacctggccgtcaattctttatagaatgaattttaaaaatttatctgcagtgttcattgcttgggttattgagggaaattacacaaataaaacttgtatatgaatacttcatgtctctttgcaatctttaattcactgaaagcctcagagtctttagaagaactgtggattttaggtgattcacataatgggcaaatgagtctatctacaagaggacagccaaaatgggggcaggttctggaaaataagtcctgtgaagaagaattcaggagaaatggatatatggaacctggaaagggacaaccaaacatatacattgttaaagctatttaaagagtagtcatacagtattgtgtgtacctccagtgggcagaactggctattaagtacaacatacaataaagcagatttaggtttaatataaggaagaacaattcaagcttttaagcaaagagaaagtttatttcacaaagatgtgaatgtcatatcaccaaaagcaattaagcagagcccaggcaagcatctgtaaaggatgttgtattaatagaaatgatccctctttctgtcagtaggggttgtaccaggtaacctcagtgttttctaattgtgagattttagacttggctgaaatgattggtttaactttgcttcagatgtttagacctgcatctttaatattgtgttggccagtaagtcttgagtctacctttttgtttccagaatcacctctagtgcaaaaataaataaataaataaataaataaataaataaaagagatttggaccccaactccaacctttgagaattttattcagggagacagggatgataaccagtttctgtttattgtggtaaaatatacataacatacaatttaccattttaaccattttaagtgatgtggcattaagtacattcacattgttgtgcagcatcattactctccatctccaaaactttttcatcatctcatactgaaacctgtacctgttaaataataactctccattttcttctcccactagcccaggtaaccaccgtttctacttttgtctttatgaatttgactattctaggtacctaggtgacacaatatttgtccttctgtgtgtagcttagttcacttagcataatgttttctagattcatccatgttgtagcatgtatccaaatttccttcttttctaaggccgaataatattccattgtacgtatataccatgttttaattcagccatccatggacatgtgggttgtttctaccttttgtttattgtaaataatgctgctgtgaacattggtatctgagtccctgctttcaattctttggggtatgtacccagaaatggaattgctggatcataccataatgcatgtttaatttttgttggaactgtcatccttttttccacagcagctgcaccattttacattcctgctagcagtgcacagggattctaattttccaacatccttgccaacgcttgttttctgttttagctgtctgtaacaaaaataccatagactgggtggtttaaacaacaaacatttatttctcacagtttgagaggctgggaattctaagagaaggtgcaaggtgccagcaaatccagtgtgtgatgaggatactgttcctgctttacagatgaccatctttccattccattttcacatggtaaaaggctggagcaagacctttcatgtctcttcttataagagcactaatcccactcttgagggctctactttaatgacctcattacctcccaaaggccccaccttctaagaccatcatattgaggcttagcatttcaacatatgaattctggggagacttaaacattcagttcgtagtgatagccatcccaatgggtgtgaagtggtgtctcattgtggttttgatttgcatttccctaatgattagtgatgttgagcatttttgtgtgtgcttactggtcatctgtatattttctttggagaaatgtctattaaagtttctgcccattttaaatcaggttcatttttgttgtcattgctcagtttttaggagttttctacatacagttgaccctagaacaacacgggttttaactgcacaggtccacttatacttggatattttccaagaaatatagtgggaaattttttggaaatttgaaaaagtttgaaaaaactcacaaatgaaccccatagcctagaaatattgaaaaaattaagaaaaagttatatatgtcatgaatgcataaaatatatgtagatattagtctagtttgtaatttactaccataacatgtatacaaacctattattaaaaagttaaaatttagcaaaactaacatacatacttacagaccgtacatggcaccattcacagtcaaaagaaacgtaaaccaaaataaagatgcagtattaaatcataactgcataaaattaactgtagtgtgtaccgtactactgtgataattttgtagctacttcctgttgctattgcggtgagctcaagtgttgagaggatccacttaaaatgctgtatgttgctaatcatctccatgtgagccattcatctctccagtaaattgcttattgcagtaaaaagtgatgtctcgtcatgcttgcatatttttcatcatgtttagtgcaataccataaaccttgaataacatcctacaatccataaaaatgccactagcgatactagaagtgctctcaagaaacaatgtcatgacattgtaagaaaaattcgaattgcttgatgtgtaccacagattgaggtttgtagctgctgttgtccaccatttcagacagatccatattgtaaacaaatgatgtaatttatggtattgataaatactacagtactgtaaatgtgttttccttatggttttcttaatattttcttttctccactttattgtaaaaatacagtatataatacatgtaacatacaacatatgtgttaattgttggctgttggtaaggcttctagttaacagtaggctattagtagttaagtttttgggtagacaagggttatacatagattttccactgtgtagggggttggcacccctaacccccatgttgtttcaagggtcaactgtgctagaatccttacacctaactaatacataaaaatatactgatatacattttcaagaaatgtgtatttctagcatcatctaaatgtggagttggagtttattaaactcatttattttgtttgacattatttttagtaccagaggtaaataagctttgcttttgttatttggtcataaaatataaaaatctcagtaaaaatattgataacaggccaggcgcggtgggtcacgcctgtaatctcaacactttggtgttgagccaacactttggccaaggcgggggcatcacgaaggtcaggagttcaagatcagcctggccaacatggtgaagccccatctctactaaaaatataaaaaaattagccaggcatggaggtgcgggcctgtaatcccagctactcaggaggcggaagcaggagaatcgcttgaacctgggaggcggaggtttcagtgagctgagattgcaccattgcactccagcctgggcaatagagtgagattccatctccaaaaaaaaaaaaaaaaaaaaataggtagatagatagatagacagacagacagacagatagataacagtgtttctggaaaagagatatggaatttggtttttcttgtgaagatgaattctttcctggttcaaatgagaaggttgtataagatgtcctttcattctcttttagttctaaagttctatggctctacaatagttttttaaaaacctaattgaacaactaataacaggtgaaatgtgataattttagtgaacatccataaatatttcataagtacactagatgtattgaaaaataagtatttctctattctttatttttattttcgtgtacctctcattaagtactccctcctttgtttttgttaaataggctgcctctaagaatcaaacttcactcttgggagaaccaccaaaagaaattcggctcagtaaaaatccatacttgaatttggcaagtgtgttgcccagtgtgtgcttatcatgtaagtaggggctcagtattcttgttgtggagttttactgaatacttttcataataagttttactttaatttttgacttcatggaagcaaataatacctattgaccaaattaaggcctaaattattctttaaattgaaagaataattaaaactaagacactcaaaatgcgtgctattttatttaaggaaaacattacaactcatagagagtcatttttcttaaccagaagtttaaacctataagtaatcttatatatcttgagtatttgaatactcccagaatgtatgagctaccaataattggtggaagtggaattctcatttacattttggaggaaaccctcaagccttcaattactataaatcaactattcattcaaatatcgttttaagagaaaatcacaaatgtgatgtgctccaggcacaaggatgttcactgcaacattggttgtaaatagtgggaaaactggaaaatacttaatatttgtcaataggggaatgcttaaatagttcatcataaaattgaatactgtgcaactttttttttaataattgagggatatctacatatactgatatgagatgaactctaaagcatattttggcaaatatatgcataaaatgattccatttatgtttatttaaagttatatatccttacatgtatatacttgagagtgcaaatgcatgaagtaaatccaaaaaagtaaattctaaactattacctctgggaagaagaataggattaaatgaaaagagatgaaagatgaatttcatttttaatatacatcctctgtattttatgaaatatccttgaatccaaacattaatttgtaattttttttgagctggaaaaaaatgtaaaggcacttctagtatacctgttatatattgatctggtctaaaaattgatggtgacaattattacatttataagaatggttagtttacattttatatgccttgttttagagactagacacacacacacacacacacacacacacacacacacacacacacacgttttgttttgggttatttatttatttatttttttattatactttaagttttagggttttgcttttttgagacaaggtctccctctgtcacccaggctggagtgctgtggtgtgatcttggctactgcagcctacacctcctgggctcaagtgatcctcctaactcagcctcccgagtaggtgggactacaggcatgtgccaccatgcccagctaattttgtgtgtgtgtgtgtttgtgagacagagtcttgctctgtcacccagtctggagtgcagtggcatcatctcggctcactgcaacctccacttcctgggttcaagcaattcttatgtctcagcctcccaagtagctgggattacagtcatgcaccaccattcctggcaaatttttatatttttagtatttttatagagatggggtttcaccatgtcacctaagccaatctcgaactcctgggctcaagtgatcctcccaccttggcctctcaaagtgctggaattacaggcatgagcaaccgtgctcagccagacatatatgtttttgaacctttccaccaaaattatttacccatgagacaggtgtccattttaagttgttccaaatgaataagacagtattatatacttctcaggggaaaattatttagttatatattggcaaactaaaattttgttctatttgataatgtgctgagttacaatttataataaaatataatttgtttataatataacttataataaaataatttatttaaaataacctaaataaaataaatttataataaaataacctaaataaaataaacttgttgattctgcctttagcccctgcaagtaaaaccactcttcataagactggaattgcaagcagcattctggatgcaatctctcagggaagtgaatcacaacacgcattggaaaagtgcattgcttattctccaccttttggtgattatgcacaggtaaataattcccaggttctgatgatactcagaaaaattggttcaactatatattgagttcactgaatatgaaattgtgatttctatattattaacgtaggcaaatcaaattgcactgatctatgtatttcttactcatcatttgaaatttgggaatgtgttcaagacattatttagtatcattttgcactagatatttacctctcactgtttacctagtggttggcaaactacagcccatagaacaaatctagcccaccacctggttttgtaaataaatttgtattgtaatacagccatgtccattcattaacatattgtctatggtgctgtcatgctataataaaagagttgagtgatgacagtagagactatgtggcctgcaagattaaatatttactatctggttctttatagaaaaatgctgctaacctctggtttgcactagtgtagacctaagaaacccaagggaatgcctctgttcttctccactgattgtagatggagaaagatgatcatatttacagacactactgtgctaacttctaaaccagccaatcaataacataaaaatattatgttcataagatgtcctgtgtcattacttaaatatttcagttttgctttggcccttcttcagcttactcttagtggtgtaagctgaatatatatcatgttagccctgtgtgattatggaatcataagagtccacaagagtcttataattatcagttctgactcttactttcctagaacagccagcttcttctcagatctatcctgttcgttggagtcttgtctccactttgatttccctggagcagctttgtgtttgcctgacccatccctaataaacttagaaaagaaaaccacttagaacaattgacgcctgattataagagtactagaaacagcccaagttctgtaaaaatggtgcagctggatattagtgaaatatttgccatctcttatatacctgggacaagacggaaaaatatgggttgggtagatgatgtaattaggtgacagtatatctatatttagagaacagtgatcacaaattgctgcagtctgaaggcattctcttatattgattcataagagtcatcttcagtcctttattagataacatttgaagtaatgacttagataaagacattaattgtaaaatttacaagatatagtcctgtacaattccaatttgtttcttttcaagaaacaaactttttataaacaggagaagcacaataaattttttaaaaattcattaaatacatatttaagctttaaaaattttttgaacttttatttctttttaaatttgcctttttcttagcagttttgcttattagattactgtgatttattgtatacttatatccatggaaagactttctcattcacacatggagaaattctgtgataatgatgccttttgcattactgtatgtcttctgcctccacacttgcttgcccagagatatggtggggaaatgaatcctccctgcactgttcagtgtctcctttgacagtccctgcttctagcgcacgcttgttcataaaatgggatttgttctctctctcgtgttctttcttccttataaacttaattaaatgttactaatggaacattaaagtacatggaattaaactaatggaatactaaaataaccattatagaaaaaggtggtcgtgtattaggaattccttttactatttccactgctgggatgaaggaagaggtctaagggaaaggaaccaaaagtgtttgttttctttttaacacttgctata

SEQ ID NO: 152 - DNA, 7667 bp, Homo sapiens
aagtccgggcagcggttggcccctgggcacgcggggtcggggccgcccctggtccaccgctgctgctcggtggctgggccgtccgcctccacccctctcgcagtcatgtgcctggcagggtgaggggcgggggccggcgatgcccgcgaggctgccccccagactcctgggctggaaggagcgattggccgccgaggtgggaaagcaggcctgcgccttggggtctcctcgaggtaaggagccctggctgcccctgcgggtcgggcacacaagcggcacattgtgtgggccccccacgtgtgcacacacacgaacacacacacacacaatgggccactctgttcctctccctgccctcccctcccctcgcagccctcccgctcctcccctctggcccggggctggaacactgggtacctgagccaggcttgggaagcctgtggcctggcccgcctggcgccgccactggaaacactgcatgcacgtcccatgcccgcccgcctgtctgggcccagcttagcaagagcgatgggcacgcgtgtgtcctgtgactacaaaacagcactggggtttctggaagccgaagtgacccagtgatgggtgggaaacagaggtccagagcaaaggcctttgcccaaagttaggagaaggatgctgggacctggagtcaggcaagttgcagccaagctcggcctctgagtagtggagcgagcccagccagggcaagggtaggaggcccagagaggagaagggggtagtggcacccagctctccctgcccttttgccacccccaccccagcctgctggccagggcctgtgccatgccctgcctatctcctgtagagcctgactccctgggcttgctaaggccggcctggcccctcttcccgcacctgtatccctctgtccttgcacgtggccatcccaccagcaggggactgtgacccacccgccctctgccttggacctcacacttgcaggcaagcgtccaagtgcaggacagtcgcgctccctgcctttggatgagcccctcaggcctgatcacccagccttggcgcacatgcacacacgcacatgccctcactgtgctgcctgaaacagggaattgcggcactagggacaggctgcgtgtctgagcgtgcgtgtcctccatggccatcaccccaagtgaccgtgggggtggaagccctgtgggcctagcgcctctctgccacccagggaataggacttcaatggcccaggggctactgtagcacctcttcaacacactgaacccagcccctcaagaccctacgtggggcccgagtcagtggccacccctacactgactcacccagtgggaagttgtgatggggcctttggagtctgggctggcccgctgggcctgggcagcctggctgggggccaccctgagtccaccctgtgcctccacccccaggtgtgttccttattccctgcatcctgatagccctggtcggaggaatccccattttcttcttggagatctcgctgggccagttcatgaaggccggcagcatcaatgtctggaacatctgtcccttgttcaaaggtgagcagcccttggccagcctcagggactgcccccttttcccagctggctcccacttgagaaatcttttcctgtcctgagcaccaggcctggggccacgtgatggcatcccagtctcgaggggggagcctggaggagatgttcaggccgcacagtgaatttggggaagcagggactagagggggcataggcagctccacaaggcaaggacaggccaggcatagccgggctggggatgggacctgcccagcacacttggctctctaggtaggtcctactattactgtccccaaggacgctggggcacagacaggtggagcgacgtactgaggttgcccactacgggggcaactgtctccaacactacctcaggctactagaaactccccccctccccaccaccaccaccaccagctgctgaggactggagctactgggtggccaggtggaggcttggacctcctggaaccgccatggtggcagtgggacccacagaaggggccaggtgtgtaaggctggagactcaacagcacttggtcagatggggacaggaggagaggggctcgctctgccttgggtctagggggcggctggaggagaggagagaggctggggagtcagcccagtgttggggctcacacaagggggagtccaggggagtcaggagcaccacaaacaaggctccagaaggacagacggtgggagcactgccagcctgggtggggagataaaggggtggcaggggaggtggccaggaaagaatctacatggcaaggacttcccggccccaggcctgggctatgcctccatggtgatcgtcttctactgcaacacctactacatcatggtgctggcctggggcttctattacctggtcaagtcctttagcaccacgctgccctgggccacatgtggccacacctggaacactcccgactgtgtggagatcttccgccatgaagactgtgccagtgccagcctggccaacctcacttgtgaccagcttgctgaccgccagtcccctgtcatcgagttctgggagtgagtccagcacctctgggccaagcccatcccatcccccaggtctccctcatgttgcctggctccaggggaatggccctgagaggggaccagggtgtttcttggcagtccctcctggaccctgcctgcccttgtctgccctcggagagtcctggggccagccccaggggctgcgccaggtcagccttgctcctgggttcggcagcctatcactgtcctggtcactcccgcctgatgggggagctggggctgcatgtggggtgggatgggagtggcctcccaaaggccaggggctcgtgggctccaggcccagcccagatggacaagagggcccactgaaccctgggctgtgggagagaagggagccacgactcctgggggtggaccctgtggctccatcctctgctggcacaggcctcatgggacctccctccctcccctaggaacaaagtcttgaggctgtctgggggactggaggtgccaggggccctcaactgggaggtgaccctttgtctgctggcctgctgggtgctggtctacttctgtgtctgaaagggggtcaaatccatgggaaaggtaccactagaggcatgcaggggggagggtggctcagccctgggagctggatgtctgtgccaggcacacccgtagcaacgggaggtgaccagacagagtctagccctaaggaagggggaggtactgaaagccaagcaacactccccaccctgcaaatccagggcccagcagcctttgctcctgtggggagaggccccagcaggcactgtcccttccctgtgcccatcacccccaccggtgccctcctgccagtctctgactcttgtgacagtctgctggacctggtctggccatctgttacctgcctatcttgccttggggacacagagcagagtctggccacatcccttgggggctcctggtcaggctggggagtcacctgaacaaagaagacaatgtccagagctgtgggacatggccagctccctgggggacaaggtccccagagcagcatgtgggaagagggggcagacagtgtggcagccgcatcttgcctgcctctgcctggcccagttccactcttcacctgctcagccccgacctctctccagaagaggaggggggcccggccctgatccaatatcccgctccctgcctgggcctcccatgcgtgcactgcccacacactcacacagctctcactccccacatgctccatgcctcctgtccccactgaggagagctcctagaggctcgcccgctccccactgacatgcatccctgcagacaaacgaggcgcccagagagcttccccactgcacttgccagggctgccggggcccagccttgcccctagcttcctctggcgggagctatggctcggaggagaatggggacctctgaacatacctgcccgcaagggggaccggaggtgctcggagtgggcttgtgagggaggtggtgccgcagtccccgctgagcagcctggccccccagatcgtgtacttcactgctacattcccctacgtggtcctggtcgtgctgcttgtgcttggagtgctgctgcctggcgccctggacagcatcatttactatctcaagcctgactggtcaaagctggggtcccctcaggtgaggtggaggtggggaggctgcagcagggtgttgtgggggagccctgcaggcccctcatgcctgcactctccagccctcctctaggtatggatagatgtggggacccagattttcttttcttatgccattggcctgggggccctcacagccctgggcagctacaaccgcttcaacaacaactgctacaagtaagcactgctgccctgccacccgtgccctgtcccgccctgccctgcccagcagcctaacccatccactctggcccctccacccctccaggacgccatcatcctggctgtcatcaacagtgggaccagcttctttgctggcttcgtggtcttctccatcctgggcttcatggctgcagagcagggcatgcacatctccaaggtggcagagtcaggtagggccctacccccagccccgcctccagagcagcaactgccacccagatgcatgatgtacaagaacacgcaatagaaatgctgaaaagtgatgaggattcaaacagaacttctcagattgtgggcctgtgggggcaggtcctgggatttttcaatgttgacagagacaggacctcccagcccctgctgcatgacccagggttgacagcacctcagaggcaggcgtgggcatgggcgtgagtgttgcaggcagggctcagggtgcgcgcagggcacgacatcggctgcaaggtctagagcctgcacctttcccacagggccgggcctggccttcatcgcctacccacaggctgtcacactgatgccagtggccccactctgggctgccctgttcttcttcatgctgttgctgcttggtctcgacaaccagatttgcatggggctctgggacagggagccaggagaggggcggagtgagggctgcgggcaaggaaaggggtggagggtggtgcggggctcggcctgagctagcctggccacagtttgtaggtgtggagggcttcatcaccggcctcctcaacctcctcccagcctcctactacttctgtttccaaagggagatctctgtggccctctgttgtgccctccgctttgtcattgatctctccatggtgactgatgtgagtggggtggggggtctgcctgtgacctctggtggccgtctgccatcctccctgactgggctctgtcccccagggtgggatgtatgtcttccagctgtttgactactactcagccagtggcaccaccctgctctggcaggccttttgggagtgcgtggtggtggtctgggtgtatggtaggtcatggctgagggctgggctggggcatggtggcggggaaggcaggtctccagcttggccctcccgcctcgccttgccacaggagctgaccgcttcacggacgacattgcctgtatgatcgggtaccgaccttgcccctggatgaaatggtgctggtccttcttcaccccgctggtttgcatggtaagggctgggggaggtggggcggggtggggggggcggggcggggtgggggccccattaaccacggcattctggtctgtagggcatcttcatcttcaacgttgtgtactacaagccgctggtctacaaaaacaccaacgtgtacccgtggtggggtgaggccatgggctgggccttcgtgctgtcctccatgctgtgcatgccactgcacctcctgggctgcctcctcagggccaagggcaccatggctgaggtaaggctccctcccggcctgccctcccctcccctgctatgaacattcaacccagcctgcttcctagccaaggagtggccctgactagggtggcaggcagcaggagctggagagaggcagaggaagtcaccgtggggatgagcaggtgactctgggggcttcaacatgtcctctcctgcagtgctggaagcacctgacccagcccatctggggcctccaccacttggagtaccgagctcaggatgcagatgtcaggggcctgaccaccctgaccccagtgtccgagagcagcaaggtcgtcgtggtggagagtgtcatgggacagctcagctcacatcaccagctcacctctggtagccatagcagcccctgcttcatccccaccccacccctccagggggcctgcctttccctgacgcttttggggtctgcctgggagaggaggggagaaagcaccatgagtgctcactaaaacaactttttccatttttaataaaacgccaaaaatatcacaacccaccaaaaatagatgcctctccccctccagtcctagcccagctggtcctaggccccgcctagtgccccacccccacccacagtgctgcactcctcctgcccctgccacgcccaccccctgcccacctctccaggttctgctctgtagcacacccttgggtgacccctcaccccagaagcagcagtggcagcttgggaaatgtgaggaagggaaggagggagagacgggagggaggagagagaggagaagggaggcaagggaggggcagcagaaccaagacaaatatttcagctgggctatacccctctccccatccctgttatagaagcttagagagccagccagcagtggaaccttctggttcctgcgccaatcaccaccaatatcaattgtgtgagcttgggtgcgagtgcacgcgtgcgtgagcacgtagagtatatatagatctctatctcttagcaaaggtgaataccagatgtaaatggtgcctctgggcaaaggaggcttgtattttgcacattttataacaacttgagagaatgagatttctgcttgtatatttctaaaaagaggaaggagcccaaaccatcctctccttaccactcccattcctgtgagccctaccttacccctctgcccctagcctaggagtgtgaatttatagatctaactttcagaggcaaaacaaaagcttcgagctgttgcatgtgcgagtctgttgtgtggatgtgtgtgtgtggtccccagacccagaatggattggaaaagtgcatggtgggggcctcggggctgtccccacgctgtccctttgcccacaggtctgtggggcaagaggctgcaatattccatcctgggtgtctgggctgctaacctggcctgctcaggcttcccaccctgtgccctgggctgggcacacccccgggaagggaccccggacacggctcccacatccaggctcaaggcggatgcacttcctgcacctccagtcttctgtgtagcggctttaacccacgtatgtctgtcacgtccagtcccgagacggctgagtgaccccaagaaaggcttccctgacacccggacagaggctggagggctggggctgggtgagggtggtgggcctgcggggacattcttactgtgctaaaaagccactgcaaacatagcaataaaaacctgtcattttcc

SEQ ID NO: 153 - DNA, 63426 bp, Homo sapiens
agaggtgccctcggtgatagaggaaacatggccgagtatacgcggctgcacaacgccttggcgctaatccgcctccgaaacccgccggtcaacgcgatcaggtaacgggctcggtcgcctccagcccggggaccgtgcgggccttagccgccctctggctccggaggctttgactctcccccgtcggtttaaaccgagaaggacactcaagagttgagcaactggtacatgccaggaactttttttttcttttctttctttctttttcttttctttttttttttttttaacctagattagcttggttaatcttcgcagggaactctcgtccccgttttactgataaggaaactgaggctgaggctgagacagatcaacacttagggagttggcctcgacctgtccttcatgcggagccctcctgcttacttgcaactttggctttgcaggccgactttttatttttcttttttttttttaattatactttaagttttagggtacatgtgcacaacgtgcaggttagttacatatgtatacatgtgccatgttggtgtgctgcacccattaactcgtcatttaatattaggtatatctcctaatgctatccctcccccctccccccaccccacaacaggtcccagtgtgcaggccgactttctaatccaaaggtcttaacttagtttgatgttggactttgatccagcctcactccccttctttgagtccaggctgtccttacaatgtttggctaaaggctttaggaatagggcaatcactggcattagtgggactttttttttttttttttttaatgttaaaagtcccactaatgccagctcagtgattaaagcagaattttgccctggcccggaaacgcaaaattatttctcctgatttgtttaaacctcaggactttggtgcttccaaggaagactcacatcagactaagcctatgcaatagcattttctgaaaaattgcaccttatcttctttttctcactggggagtatttgccttgtgtggtgcactttaaacattaaaaagtgagatcaatgttgcctttttgaaaagtaatgattatttggtttggtccttctacatctcttaaaaaaataattatatgtcagccttgaaaaagaattacctatccacagggaataagattagtggaaattataatttatcaagaatatataaagcatagagagaaaggtctttggtcaaaattcttataacatgctgctgaagcaaagagactgaaatgagaagacctgctaattttaatagaatttaaaaatcctactgtcattggatttgatttatcattagtattaatattaattcattatgaattattgcatttaataatgtcaaaaaatgcaggactaaaatcacataaggatgacatgtctactaacttgccattcccagaataaaaagcaaaatatctgttatattggttttgacaaagaaaaatgtaagtaatatgattacatgtcaattttggactggtctatatactgattagaattgctagatattaggaccttagggggaaaagttccatactctaatacccatgactaggaatattttctgacaactgttttttttttttcttttttttttaagctcatttgcttgttttgagacggagtcttgctctgtcgccaggctggagtgcagtggcgtgatctcagctcactgcaacctctgcctcccgggttcaagtgattcccctgcctcagcctcccgagtagctgggactacaggtgcgtgccaccacgcccagctaattttttgtattttagtagagacggggtttcaccatgttggccaggatggtctcaatctcctgacctcgtgatccacctgcctcggcctcccaaagtgctgggattacaggcatgagccacgtgcccagcctctgacaattgcttttaatatttctggaatttaacctgctctccttgcccacccatgcaaccacctgtgccacccccatcctctttgcaggagaaatgttagggcctacctcataaagttgtgaagtttaaatcagctggaaattatgaagtggcatttaatagatgttagttattcctattagtcagaagacctgttcaagccccaaaaacaggccctgctactcaggacccacttcagtttcatcaagaagatattctccacttgggaataagtacttctctgcccttttttgtctgtcttctgaacttttttaggtagaaatggacatcctaggagttcctcaagtttaacagattcctcaatttttttcttacactttttctttcctccctttcttccttttccccttcctatttctaattttatatgggaagtcgtctcctcctagctgattgagagattcttacttgagtgtaatacacacacacacacacacacacacacacacatataaattttttccccaaaacaaatagtttaaatccttcattgctagtttagccagccatgtttgcttccattcagataaacaccagccctctttataagtataggacatgcctgattaataggcctgtctcccagaacaatggctttcacacgattgctttactgtaatccacagagtaagaaagctcacgtttttacgtagcaattcaagacacacttacatacaaacacgtaaccgaaagcagtttcctaaaacaaaacctatccttacttggtatattgtttgatatagtctattttctcatctcttctttttctttgaaaaaatcctggtcacaagccacaaacttgatttgatgacttttggtttaaaaaaaaaaactgtctaaaaaaaaaaggaaagaccttctatagtcaaagaagctgaagagttttggtcagtagtcatgaaatgctgtctctactccagactctatttcttcatgcctgacagtattaacaggagaaaataatttcataacttctgcggcctttacattgctatgactctctctgtcagcttgaatctagtaaagtgcgtatctgttatagctattttcatttttttcctgtttttgatatttgcaaaattatgaacataaaaaaggaagataggttgaaatgggaaaagctggtttcttctcctcagtggcactgattgagctaattttggctagttttgtaagcattgtttattcagaaggaaatgtgtgccttttggactttttgatgttatataatggttctgaatttgcttttcatggtcagatttggcttctaattaaccagctgaagccaagaggttttgtctgatttcatctaggttaagaggtgaaaagtaattaggtgtaagggaatcattataaataagggcaagtatcctttttatttcttggggttttaactaatagttgttggtcttaacaatatggcctttacagaagtttgttgttgtttgttttgttttaaaatttatttttaaccctgtgtactaaagaacagagattttactcagaatacttggaattccaaggcaaaactgattggaatctggttctgtggtttttccttttaagcagttcctcaccacttgccctagattctcttattgcttggtacttattaatcccctccttcttcacaaattttctctcttggtctttgtgactttgagctcacttgctgaatcactctgctgagcttgtcccacttcttaaatgaagatatatccagaggatctgccctcagctctcttttcctttggtagactcattcagtcttggttttagctatctcttctgcagatgacttcctcatatattaaaacttggcaaaatctgctacatgccctatctttccactatcttgcctttatatcttatcttagttaagattacgcttggctgtcactgacagaatagtgaagataatagtgaattagacaataaaaagctaatttctctcacagcagtgccctggaatgatacagctgctccacaatcaacaggggcctcaattattttctctgtctatctcttgctctaccatcctcaatacatagcttctacctcctgatccaaggtggctgctcctgatctaaccatcactggtgccaggaatagggaggaaagaaaaagggaaaagcatacccaaatctttaagaactcttccccaaagttgcatataccaaatatgcttccatcccattggctagaacttagttccttgtgcagaccttactgtaaagcaggctggaaaatatagtctttattttgggcaaccatatttttgtgttagtccattttcacactgctataaagacatatccgagactgggtaatttataaaggaaggaggcttaattgatcacagttccacatggctggggaagcctggggaaacttacaatcatggtggaaggcaaaggagaagcaagtaccttcttcacaaggtggcaggagagaggcatgagtgcaggggaaactgcaacttataaaccactagatctcctgagaattccctcacagaacagcagcagggggaaaccactggcatgatccaatcaactcccgctaggtccctccctgacgtggggatcacagtttgaaatgaagttttggtggggataaagagccaaaccaggctgggcgcggtggctcacacctgtaatcccagcactttgggaggccgaggtgggtggatcacgagctcaagagatcgagaacatcctggttaacacggtgaaaccccgtctctactaaaaatacaaaaaattagccggacgtggtggcgggcgcctgtagtcccagctactcaggaggctgagtcaggagaatggcgtgaacccgggaggcagagcttgcagtgagcccagatcgcgccactgcactccagcctgggtgacagagcaagactccatttcaaaaaaaaaagagccaaaccatatcacatatattcaagtaaaaaccaagtgttttaatactatgaagacgatggagaggaatggatatttgaggtaactcacagcccccgccacagctcctagactgtttctcatttaattttcttatattttaacaatatgaaaaactgaaagtaatttcacccttctctgaacttcaacatcactttttctttgtacctttattacagcactcagatatcttagtgtgccttacatgataaattatgtacaagtattggataactccttgtacaatatatagaagacatgtaataatatttttaaattggttggtgtcaattttaagcggtcaaagtgaaagcacagtgcaggaaaattacatttttaaaaagtggattaatttaatctggtcagtgcttaattaatcataggcatatatattatttgtagaagaaatttaatagtcatagtagacatattatttgttggaagctttattgagaagtatctacagtttttatccattatgtgtgtgtttaatttttcatttttaggaaaggaaaacactctgaatggtaggaatttaattctgactgatttacttcatgtattttgttttcttttagtacgactttactccgtgacataaaagaaggactacagaaagctgtaatagaccatacaataaaagccattgtgatttgtggagcagagggcaaattttctgcaggtaactcaagtctaaccctctcccaccatctctggaatccagccacagactgagaccaatactgcattagctgtgcttgttggtaataacttagtgtaggtaatggatatggcagacttgagtgagaatgagtaacactgtggagaaagggacaggaattacaagagagacccagagaagggcttagtctcttttattgtggattgggcttttagagtatatttagttccagacttgatggctgttatacacctgctgatatatacctgcattgcatgtatctccaccatatgtgggcttgggcaaatctctttaacttcctgaacctcaatttctctatctataaagtgggaacaataatatctattttaaggggtttttgtgacattaagcgagataacatatctgaaagcctctactacagtacctacacaaagaagatggtcaataaatgttattgtttaattcacacagagtcttataatagaattcatttttcttccgatagtcacccatctcagtgaccatggcactgctttattgggttattgtgtgaagatgcaaaattattgacaaaatatggcaaaagtatgctgaaatggtgatttattcaatggcatatatggcgtcttttccttaatattcatacattataccctttgacaaaagtcacatggatatgggggcctattcaaccttactgtagccagagaaatttaatatgtgttaatggtagtctgaaaagacacagatgttagaatcatggcaataaataaatataaaaatgtgaatcattataatattaccatttatcttgcctgttatatgccagtaccatgtaggttatttattaaataataataataaaaataatagtatttttaaacatgttatatgttaattctcagttagtcctacaatcctcatttacaggtaagaagagattttgagcctgggagagattaatataatgtcccaaaccttaaccagttattaaatggcttactcactgtttggaaatttaaggtttgtcacccaagatgatgacgatgatgcatgggaagagtgctcagaatgataaagaacttgatatttctttgtaagaaagaaggtagatgagagaatgtaattagagtttggaggcagaaaaaattattcttctaaaaaagtattagggattatgaaacttgacttaatacatttacatagaacaatgcaccccaaaatgggagaatatacattcttctgaaatacatctggaacatttacaaaaattgaccagatactgaattataaaatcttatctaaataaatttcattaagaatacattatctgacaacaatgcaattaagctagaaatcaataacaaaaatataactagtaattctcatatgtttggaagttaatttccaatatcctctgagtaaaaacagaaataatggaatttagaaaaaatttggaactgaatggcaatgaaaacataatataaaacttgagggatgcagctaaagtaaaacttatcagaaaatttatagctttaaaaatatatattagaaaagaaaaatggctgaaatataatgagttaagtatttatgtaaaggaactgacaaactaaccgtaaaatacaccctaatcaagtagaagaaaggaaataataaagaggagaaattaatgaaatagaaaacatttgaatcaagaggaacaacaatgttagttttttgagactaatacaattgacaaactctggagagattgaaggagaagagaaggcaccaagcaatgcatataaagaatgatgaaagggatatcattgcagatactgtagcctttaagaaagataatggccctttggctgatgcaagagcctagtgcggtggtgggagaggtatcagcaggagcagcgctgccacggggcctgggggctgacctgtctgacttcccatccatgcggagcccactggaatcgcatccatatctggagatgagatgatttttgatcctactgtgagcaagaagaaaagaagaagaagaagccttttatgttagatgaggaaggggatactcaaacaggaaacgcagccctcagaaacaaaagtctggagccagagccaactgaggacaaagatttggaagctgacaatgaggacagtaggaaaaacgatgcttctgatgatctagatgacttgaacttctttaatcaaaagaaaaagaaaaaaaaacaaaaaagatatttgatattgatgaagctgaagaagttgtaaaggatcttaagattgaaagtgatgttcaagaaccagctgaaccagaggatgaccttgacattatgcttggaataaaaagaagaaaaagaagaatgtcaagttcccagatgaggatgaactactagagaaagatgaagctctagaagatgaagatagcaaaaaagatgatggtatctcattcagtaatcagacaggccctgcttgggcaggctcagaaggagactacacataagaggagctgctgaattgtgtgttcaacatcatgagggaaaagaatccagatatggttgctggggagaaaaagaaattcgttatgcaacctccacaggtcgtctgagtaggaaccaagaaaacttcttctgtcaactttacagatatctgtaaactattatattgtcagcacacttgcatttttgttggttgaattgggtacaagtggttctatagatggtaataaccaacttgtaaaggaagattccaacaaaaacagatagaaaatgtcttaagatttatcaaggagtatgtcacttgtcacacatgctgatcactggacacaatcctgcagaaggacatgcaactcttatttcctacagtgtgaaacttgtcattctagatgttctgttgccagtatcaaaactggcttccagactgtcatgggcaagcgagcacagccctgtgccaaagctaactaatttgctaatcactgatttttcaaagcgtgttgtggatatgtggctaaaccagtttgccatcagagtggatataccattgtattaaaagcaagataaaaaagctgccaagttctttggctagtggctggttggtgtgaaatccttgcaagatgctgatgctcaagctgttgacatatgtatagactactttaacaactgtcagagaaacatgatatggggtaaagaggtgcttttttaaaatcgttcatagacttctgtaaaatacaagataaattaaagttattgtaacagtgaaaaaagaaagataatgaaaatattatgaacatgtaaaaaaaatagcttctcaaaattaactcaagaagaaatagaaaacccaaatagttctgtaatcattaaagaaattcaatcagtaatcagaaatctcaccaagtaaatacttgaccctgaagactccactggcaaggtctactgtaaagtcaaggaaaatattccaattttacataaacatttcagagaatcaaaaaagtggggccactttctctattagtttcttagagcaccataacaaattgccacaaaccaagtggcttaaaacaacagaaatctattctctcattgctctggaggatagaagtttgtaatcaagatatcagcagggtcattcttcttctgttttctttagggaagaatccttccttgcctcttctagcttcttatggtttctagcaatccttggcctatggatgcatcactccagtctcactttaatcacatggctttctttcctccatgtctaaattttcctgatcttctataggcccaccctaactcagcatgacctcatcttaatttgataacatctgcgaagaccttctttccaaatgtcacactcacagcttctgggtaaacactattcaactcagtacacttcccaactcattttttgaggcagcatacccttgatactaacacctgacaaggacagtatggaaaagaaaaattacaggctaatttcatttataaatgtagatataaaaatcgtagtgtaaattgagacaacaaagcaactaggtaacaatattatgacggaaacaaaccctcatatatcaatattaaccctgaacataaatggcctaaatcctccacttaaacatatagacaggcaaattggattaaaaaacaaaacctgatcgttttctgcccacaagtgacaccctttggtaaaaacacccacaaactcaatggagtggaaaaagatacactgtgcaaacacaaaacaaaaatgagcagtagtagctatatttacatcagataaagcagattttaaatcaacaacagtaaaaagacaaagaatgtattatataataataaagggttcaatacaaggagaagatatagctgtcttaaatatatatgcatcccaaaatggacaactcagatttataaaacaaatactactcaacctaataaaagagatagacagctatacaataataagggaggacttcaaaaccccgctgacagcactagacagatgattaaggcagaaaatcaacaaagaaactatggacttaaactagactttagaccaaatggacctaatagacacacttatagaacattctatgcaataaccgcaaaatacacatttttctatttgtgcatgggacattctgtgcatggaacgttctccaaaataaatcatatgcttggccataaatcaaatctcaacaaattcaaaaaaatctaaatcatatcaagtatcgtttcatattatagtggaataaaagtagaaatcagtagcaagaggaactctcaaaactctacaaatacatgggaactaaacaacttgctcctgaatgttcattaggtaaatgaggaaatcaaggcagaaatttttttaaaatatagaaagatcttaaagtcacaacctaatgttgcacctcaaggaactagaaaaacaagaaaaaaaccaaacccagagctagcagaagaaaagaaataacaaagatctgagcagaactaaatgagattaagacaaaaaaataataatgaggattaaggatcatcatggtggacgggacacagactagattgcagctctgacttggatggacagagcagcatgcagaggctcatgtcgtgaattttagctccagaatgactactggaataaatcaggaatcccaagaggacccacagaccctctgaaggaagcagactgctcctgcaggacacaggagacatcccaaatactgtgagtgcccaaactgcggaaatgggagagggagatcctccattctggaacacacacccccactggggaaactggaggtctagtttgtgggagaagattctgaccttacctggagatgagtcaatttagagagccatgtgaaatacatgggtggaggaagcagcaggaaaggccctgggagcttgctgggtccccaggcaggccattcctgcctagcatcacagagatccttcgagagggtggccagaggcatggggaaaacaccacagggagacgaaagtctgcagctgaactttgtaacaatttgaaccagtctagaagcctcctggccagaactcgggggagggtgggaatctggagtgcagacttcacaggcaggggaagaactaaagcccttatgcagctgggaggtgggtagcctggggcaagttcttagccctgcttgcccactgcctggaaacagactcagtgctgttagatggggagtgagaccagccctttggattgtgtgggagctgggtgaggcctgagtctgccagctttcccccactttccttacaacctgcatgactcggcagaggcagccataatccttttaggtacatgactccagtgaaagttgaaaagagtgtcctttccccactttgtttttgtttgctttgtcaaagatcagttggctgtaggtatttgggtttattttttgggttctctcttctgttccattggtctatgtgcctatttttatactagtaccatgctgttttggtgactatggccttatagtatagtttgaaatcaggtagtgtgatgcctccagatttgttctttttgcttagtcttgctttggctatgcaggctctttttttggttccatatgaattttagaattctttttctaattctgtgaagaataatggtggtattttgatgggggttgcattgaatttgtagattgcttttggcagcgtggtcattttcacaatattgattctacccatccatgagcatgggatgtgtttccatttgttaacatcatctaaggtttctttcagcagtgttttgttgttttccttgtagagatcttttgcttcctaaatagtttattttatttttttgcagctattttaaaaggggatgagttattgatttgattctctgcttggacacagctgggataattggttagccacatgtaggagaatgaaattggatcctcatctctcactttatacaaaaataactcaagatggatcaaggacttaaatataaaacctgaaactataaaaattctagaagacaacattggaaaaacccttctagacattggcttaggcaagcatttcatgaccaagaacccaaaagcaaatgcaataaaaacaaagataaatagttgggagttaattaaactaaagagcttttgcacagcaaaaggaacagtcagcagagtaaacagacaacccacagagtgggggaaaatcttcaccatctatacatctaacaaaggactaatacccagactctacaacaaactcaaacatatcaacaagaaaaaaaaatcccattaaaaagtgggctaaggacatgaatagacaattctcaaaagaatatacacaattggccaacaagcatatgaaaaaatgctcaacatcactaatgatcagggaaatgcaaatcaaaaccacaatgcgataccaccttactcccgcaagaatggtcataatcaaaaaatcaaaaaacagtagatgttgatgtggatgcgatgaaaaggaaacacttgtacattgctggtgggaatgtaaactagtacaactactatggaaaacagtgtggagattccttaaagagctaaaagtagaactaccatttgatccagcaatcctactacttggtatctatgcagaggaaaaaagtcatacgaaaaagatacttgcacacacatttacagcaacacaatttgcagttgcaaaattgtggaaccaacccaaatgcccatcaatcaacgagtggataaacaaactgtggtatttttatacgatggaatactactcagccataaaaaggaatgaattaacagcattcgcagcaatctggatgagattggagactattattctaagtaaagtaactcaggaatggaaaaccaaatattgtacgttctcactgatatgtgggagctaagctatgaggatgcaaaggcataagaatgatacaatggactttggggatttgggggggaagggtgggagtggggcaagggataaaagactacaaatacagtgcagtatatactgcttgggtgatgggtgcaccaaaatctcacagatcaccactaaagaagttacttatgtaaccaaacaccacctgtaccccaataacctatggaaaaataaaaataaaaacagaaaaaagaaatatacttatgaaaatattacaaatataagttcgtaatatagtataagaagatacaaaggataaatgagatgaaaagttggttctttgaaaagagaaaaatttatatactgctagctaaactaatcaaaaagagagaagtttcaaataaacacaattagaaattataaaggtgacagtacagctgattccacaaaaagacaaaagatgctcagagactactgtgcacatctctacatgcataaactagaatacctaaaaaaaaaaatggataaattcctgtaaacatacaacctcccaagactgaatcaggaagaaatagaaatcctgaacagaccaatactgagttatgagattgaatcagtaataaaaaattttttgaccaaaaaaaacccaagaccagatagattcacagccaaattttaccagatgtgcaaagaagagctggtaccaatcttcctgaaactattctgaaaaatcaaggaggaaagattcctccctaaatcattctatgaaagcagtaccaccttgataccaaaatcaggcaaggacacaagaaaaaaaaaaaacaaaaactaaaggccaatataactgatgaacataaatgctaaaatcatcagcaaaatactgtcaaactaaatccaatagcacttcaaaaagatattacatcaatattagatgggctttattgcagggtttctaggatgcttcagtaactgtgattcaccagataaacagaattaaaaaacaaaatccatgatcacctcaatagatgcagaaaaagcatttggtaaaatccaacatcccttcatgataaaacccctcaacaaactagacatcaaaaaatacctcaaaataataaaagctatatacaacaaaaccacagccaacatcatactgaatgaggaacaggtgaaaacattactcctgaaaactggaacaagacaaggatgcccactctcaccactcctagtcaacatagtactggaagtcctagccagagcaatcaggcaacagaaagaaataaaaggcatccaaattggaaaagaggaagtcagatttcctgtgttcattgataacatggtcttatacttagaaaatcctaacgactcttccaaaagactcttacacttgataaatgacttcagtaagtttcaggatacaaaatgaatgtacaaaaatcagtagcattctatacaccaataacgttcaagctgagaaccaaatcaaaaactcagtcccatttacaatagccacaaaaaaataaaatacctaggaatacatttaaccaatgaggtgaaagatctctacaaggggtactacaaaacactgatgaaataaatgatagatgacacagacaaatggaaaaacatccatgctcatgcattgaaagaatcaatattgttaaaatggacatactgcccaaaacaatatacagattcaatgcaattcctatcaaattaccaatgtcatttttcatggaattagaaaaaacaatcctaaaattaatatggaaacaaaaaagagctcaaatagccaaagcaatcctaagaaaaagaacaaagctgggggcaacacattacctgacttcatattatattataaggctatggtaaccaaaccagcatggtactgatacaaaaatagacacatagaccagtggaacagaatagagaacccagaaataaaaccgcatacctacaccaactgatcttcaataaagtcaacaaaaatatgcaatgggaaaggatatgctgttcaataaatggtgctgggaaaattggagagccatatgcagaagaatgaagctggacccctatctttcaccatatacaaaaattaattgaggatggattaaagacttatgtgtaagatctaaaatcataaaaattcctggatgaatatttaggaaatctcttttggacgttggcctaggcaaataacttttgactaagacctcaaatgcaacaaaaacaaaaatagatgaatgggacttaattaagagcttctgcacagcaaaagaaataatcagcagagtaaacagacaacctacagaatgggagaaaatatttgcaaactgtgcatccgacaaaggactaatatctggaatctataaggaactcaaacaactcaacaaggaaaaaccaattaactccattaaaaagtggacattgtcttttggttatatatacttaaaaattttttttgaagtacacataggacatatacatttgccaaaaggagacatacaagtggccaataaacatatgaaaaaattctcaacatcactaatcatcagagaaatgtaaatcaaaactgcaatgagatatctcacaccacttagagtgactattattaaaaagtaaaacaacaatatgttggcaaggatgcagagaaaagggaatgcttatacactgttatttggaatggaaattagtacaacctttatggaaaaacagtatggagatttctcaaagaattaaaaacagagctatcatttgacccagcaatccaactactggggatccgtccaaaggaaaatatattattatatcaaaagatacctgtactcatatgtttatcacagcactgttaatgatagcaaagtcatggaatcaacctaagggtctatcaatggttgattagataaagaaaaccatagtatactacacaaccataaaaaagaatgaaattacgtctttccttaggccattatcctaagtaaaataactcagaaatagaaaatcaaataccgcatattctcacttataagtgggagctattatgaaggaataattgtcagggaaaaaaagggggagctaaacaatgggaacacatggacatacagagggaagtaatagacatagggaccttcaaaagggcaaggaggttggggtgagggttgaaaagttaccaagtggtacaatgttcaccgtttgggtgataggcacaccaaaaacccagacttcaccattatgcaatatatctgtgtaacaaacctgtacatgtaccccccgaatctataaaaataattttaaataatcttagtgtactgtgaagctgaatctaacaacatataaaaagcataatatatcacttttgtcctaggaatatcagattggttgaacactagattaatgaaattcatcccattaaaagattaaaaagaaaaattatatgattatgtcgagatgtagaaaaagcattctataacatttgacgtgcattaagaagaaacattcttagtaaatgaggtacaaaaagaaaatgccttaatcaggcaaaaggtatccattttgaaaaatctacaggaaacaaacaaaatggcgaattgaaagctttccttatgagaaaggaacaagacaaagctgactgctctcactatttcttttgacattgtattcaaggttcttgataaaccagtaaagctagtaaaagaaacaaaagatataaggaatgaaaaagaagaaacaaaacttcattattcagaagatacaataatgtttgtagaaaaatcaaaataatctattaaaaaattgttagaattaataagaaaatttagcagttttgctgggtataaaaatcaatatcccaatattaattagattttgatgtgctggaaataattaaaaagtgaaatcactacactgtttgtgctttggtttttcagaaactgggataataatcatactaaccttatgctgtaagtagaagaatatagtatagcttttaagaatgtggggtttgtagtcaaattgcctaagtttaaatccctattctaccagttattagtcatatgtctgaagtagtcacttgtctcaaagcattaacttccttacctgtaaaatgggaattgttatgctgcttaacttaggtgttatgaaaattaaatgacacagtatatgaaactgcttagcacagtgcttgatgcatttatccaataattgttcatttctgttattatctaaaaaactatctcaatctaaagctacaggaatgataggcttgagacttggattgaaattgatcttgtttctctagaaccaaaaggaattgaaaacacgaaacaaaacactggactagagagtgaaatataatgaattggtgagaaaaaagcttaactcctggattgatgctagatgaggaacaggtagcaaaaagggaaaaaaagatgaataggctagatataaaataattaatttttaaaacttgtaccaagcttagtgttttcaaagaatagataatgctgtaggaaaaagcttactatgtataatgttatatgaaaacaggaaaatataaaaatgattttatggtatgctctaaatcagctgtcctcaacctttttggtaccagggactggtttcatggaagacagtttttccatggacaggggtagtgggtgggggtgcaggcctgggagggtgggggggcagggattgttttgggatgaaactgttccacctcagatcatcaggcattagattctcataaggagagcgcaacctagatccctcacttgtgcagttcacaatagggttcacgctcctgtgagaatctaatgccgctactgatctgacagaaggcagagctcaggttgtaatgctcgctcacacatgtggaaaaaaactaagaactcctcaaaatattaaattatggctatatagtgatatttagggtgatcttcatgttctttttaattttgcgtggttttcaaattttccataatacatgttatttttataatcaggaaaagcaataaatattatttttattgaagataaaaatctattacaaaaacataattctaagctgcttgattaacatataactcataaatatgtatacatgttaccctgatattttatattgtgatgactcatgcccttaacaaagatatggagctaagttgctgtgaatagacttgattaacagtatcacacatacaaaaatgagaggggctgactcaatctcagaataatgatctttggaggagagtccctattccccttttctgagatttttaatttttttaaatatagacttactacttattatatggaaagatagattttagaaaattacagaattcctggtaaagattcaaggattttctctcatagcattctacattctccaatatacttgttttcagccaaggatgaagtgtaagggcccaaagaggtctgagactttagtcatcaggaactctaaaaaaaattaagaaataaataaaacaaattaattttttaaagagtatcaggtaacttactgttatataacaatgcccatgtatttctcaactctgttttctccttgtctttgtgcccttaggtgctgatattcgtggcttcagtgctcctaggacatttggccttacactgggacatgtagtagatgaaatacagagaaatgagaagcccgtggtggcagcaatccaaggcatggctttcggagggggactagagctggccctgggctgtcactataggattgcccacgcagaggtaacaaccaaggctctatatagtggctggtgtgtggggcttttctttagggcaaactctaaatgtagtcataagtatcagcggtgattattttatttatttgtttttttgagatggagtctcactctgtcttccaggctggagtgcagtggtgtgatctcggctcactgcaacctccacctcccgagttcaagcaattctccttcctcagcctcccaagaagctgggactacaggcatgctaccatgcccagcaaatttttgtatttttagtagagacggggtttcaccatgttggccaggctggtctcaaactcctgacctcaggtgaccacccaccttggcttcccaaagtgctgggattacaggcatgagccactgcacccggcccagaggtgataattttgaatggttagcttactggttaacgacttcagctgttacgtgccagtacagtggtactaattgttaaaatgttcaaatacttcacttccattctggtaagtaaacacctgctactctgagccctagtttcccttgtttcccttaaccttagccctagggcctctctatgatccatcaactacaggggaactccttgtttcccttaaccttagccctagggcctctctatgatcttgtttcccttaaccttagccctagggcctctctctgatccatcagctacaggggaactccttgtttcccttaaccttagccctagggcctctctatgatcttgtttcccttaaccttagccctagggcctctctctgatccatcagctacaggggaactcctgagtcaatagagagccccgagactctacctccagtactatgacccatatcaggtttcactgatgcagtgctcatgcagtatgagtattaaatatgttggctgtcacttctaagtatacatttaaatacttctttgataactcaaagatttctgtttcatggtcccttataattatcagtacctaataagacaaatttctattggaaaatagcacaaaactagtaaatatggggaaatttctggaaataggtttaatttaggctgttagacatgtcagatgaggtctgtgataccactgtgtatcacagtatatataatggtggcatttttgtaattaatatatttttctaatgatgaaaataatattcattctactaaactagagaacataagaaagtatacagatgtaaactaaaatcatcataaactcacagttcagaaataaccactattaacattctatttcattctagtctttttttgtatgtaattttttcttacagattctttttcctttgaaaaatgtcctttaaaaaaaagtacattggctgggcatggtggctcatgcctgtaatcccagcactttgggaggccgaggcaggcagatcacaaagtcaggagatcgagaccatcctggccaacatgatgaaaccccgtctctactaaaaatacaaaaattagctgggcatgctggcaggcgcctgtaatcccagctactcgggaggctgaggcaggagaatcacttgaacctggaaggtggaggttgcagtaagctgagatcgtgccactgcactccagcctggtgacagagcgggtctccatctcaaaacaaacaacaacaaaaaaaaccacatttgggctttttttgtatttagtttatactctatttttatactataatatttaacccataattaaatattctttattctgccaatctctgtcttttaattagagaacttaatacacttatatttaatgtaattactgataaggaagaacatctgccattttgctatttgttttctatgctttttggtttttttgttcaattcctccattactgctttcatttgtgttaaatgtaaaagtatacccttgtaactttcttgctgtttcttttactatatatatttttagttattttcttaatggtggttaacttggtgattacaattaacatcttaatttatgacaatgtagttcagattaatactgactgaattttaataatatacaaaaaatttgctcctctgtagcctccattacttgcccctttatgctattattgtcacaagttatatcttcatacattatgtactgcttaacatagatttatcattgttgctttacatagtggtcctaaatcagataagaaaaagaggaattacaaatgaaaaatacattattactgtcttttatatttacccatgaagttactctttatcagtgttctttatttcttcatgtgaattcaagttactgtctagtgccttttcattacagcctgaagtatttcttatagggcaaatatactaacaacaaaatcagtttttctttatctggaaatgtgttaattttgccttcattttcaaaagatagttttgttggatatagaattcttgattgacagttgttttcttttggcactttgtgtatgttatttcatgccttctggcctctgtggctgaggagaaatcatgttactcttctggtaaatattctttaaaaatatcattataggccaagaacagtggctcacgcctgtaatcccagcactttgggaggccaaggcaggcggatcacctgaggtcaggagttcaagaccagcctgaccaacatggagaaatcccgcctctactaaaaatacaaaattagctgggcgtggtagcacatgcctgtaatcccagctacttgggaggctgaggcaggagaatcacttgaacccaggagacggaggttgcagtgagccgagatcgcaccattgcactccagcctgggcaacaagagctaaactctgtctcaaaaaaaagaaaaaaaatcattataagtggcggcataatattcaatcatatggctataccagaatttatttaaccatttcccaatggtgttttaatttttataaatgcttacaaataaatacacatatatgtcctaagtgctccttttctgtgtccctcttaccacaacctgtaccctgagtgcagatctgagttactagcaataagtaaagaggtagagatgggcagtgatggaaagaatggtgattgactgttaggaaaacctcatgtaagacaggcctcacatatgtgaggtattttggaactgctagaatcacgatctgggtaaatggcagtccgcatttaagtaccctcctctcacccttatacctgtaaatggctaacagatcctcagccacttttaaatggaatgggccaagaaaggcaataaaataaaggactcaagctccccttcttgtctggactgagattactgtctgactttaaaaaaaaaaaatagccttttggagatgtaatttaaataccatacaattcattcatttaaagtgtgcaattcaatggtatatgagtatattctcagagttgtgcaaccattatcacagtaaattttagaacattttatcaccccaaaaagaaaccttgtatcctgtagcagtaatcctccatcaccttctgctatcctaagcacctactaatctactttctgtctctatagatttgcctattctggatatttcatataaacagaatcatacaatatgtggtctcctgtgactggctttttttgtttagcatgttttgcctattctggatatttcatataaacagaatcatacgatatgtggtctcctgtgactggctttttttgtttatcatgttttgcctattctggatatttcatataaacagaatcatatgatatgtggtctcctgtgactggctttttttgtttatcatgttttgcctattctggatatttcatataaacagaatcatatgatatgtggtctcctgtgactggctttttttgtttatcatgttttgcctattctggatatttcatataaacagaatcatatgatatgtggtctcctgtgactggctttttttgtttatcatgttttgcctattctggatatttcatataaacagaatcatatgatatgtggtctcctgtgactggctttttttgtttatcatgttttgcctattctggatatttcatataaacagaatcatatgatatgtggtctcctgtgactggctttttttgtttatcatgttttgcctattctggatatttcatataaacagaatcatatgatatgtggtctcctgtgactggctttttttgtttatcatgttttgcctattctggatatttcatataaacagaatcatatgatatgtggtctcctgtgactggctttttttgtttatcatgttttgcctattctggatatttcatataaacagaatcatatgatatgtggtctcctgtgactggctttttttgtttatcatgttttgcctattctggatatttcatataaacagaatcatacgatatgtggtctcctgtgactggctttttttgtttatcatgttttgcctattctggatatttcatataaacagaatcatatgatatgtggtctcctgtgactggctttttttgtttatcatgttttgcctattctggatatttcatataaacagaatcatatgatatgtggtctcctgtgactggctttttttgtttatcatgttttgcctattctggatatttcatataaacagaatcatacgatatgtggtctcctgtgactggctttttttgtttagcatgttttgcctattctggatatttcatataaacagaatcatatgatatgtggtctcctgtgactggctttttttgtttagcatgttttcaatgttcatccacgttgtagcatgaatcagttctttattgattttgctgaataatattccattgtatggatgtactacctttcatttatccactaatcattgatggacatttgggttgcttctacttttttggcttttatgaaccatggtgccatgaaaatctgtatacaggatttttgtgggcatatgttttcatttctcttgggtatatacccaggaatggatttgatgggtcatatggtaactctatgtttaacatttaagaagctgccagattgttttccaaagtgtctactctgttttatattcccactagcaatgtatgaggattctgtattctccatatcctctccaacacctgttattgtctgtcgttttttaaatagccatcttagtgggtataaagtgttaccttgtggttttgatttgtattcctctgatggctaatgatgttgagcatcttttcaagtgcttactggccatttgtatctcttctttggaggaatgtctatccagatcgtttgcccatttttaacaggttgcttgtcttttattattgatttgtaaagttctttatatattctagatagaaatcctatatcagatatataatttgtaagatatgtatattctctcccattctgtgggttgtcttttcactttcttgtgtttcctgattcttgcaggactccagaaagttgtttccagagaaaattatttttgttggctgagacaggtcatattacagtcagagaataaatgtgtaagaagctaaaaatgtgtttcaacatgaagagttagggacagcacagctctgtttatgctgttaattaaagaaaaggatgtgcactaatttgccctgtagaaatcttgctgaattcagtgacaccatgcttttgagaatacaggaaatccagggaaacgcttgccttaactctgaacataccatctcatgctaatggcctttatgccttcaatctttgataggctcaagttggcttaccagaagttacactgggacttctccctggtgcaagaggaacccagcttctccccagactcactggagttcctgctgcacttgacttaattacctcaggtcagtatagaccttggcaacaactgtctagattagtgtgaagaattggactaggatttagaaaaattctggcttgaccacctactccctatgtaaccataaaaggattcttgaacttcttggcctctcgattttctgatctgtaatatggagaactacctttctgagcttctcaaacgttatcgtgaagatcaaatgtgagagccttttaaatgaaagtgcatgcaaagagcgaatcaaatttaggattttatttcagttcaagtgactattcatcaacactggtgttcacatagactgcattatattcagaactaatttagaaattgtaatataggccgcacgcagtggctcatgcctgtaatcccagcactttgggaggccgagatgggcagatcacttgaggtcaggagttggaaaccagcatggtgaaaccccatctctattaaaatacaaaaaaattacctgggcatggtggcaggcacctgtaatcccagctactcgggagactgaggcaggagaatcgcttgaacccaggaagcggaggttgcggtgagctgagactacgccactgcactccagcctgggcaacagagcgagactcatctaaaaaaaaattgtaatataaatgagaaaaccataattttcaaggtatgttttcaaattttaatatgaaaatgactaaatttttcactggcaagtattaagatatcagctagaaatgcaagttgttctttttattttcttttttttgagacggagtttcgctcttgtagcccaggctggagtgcagtggcatgatctcggctcacggcaacctccacctcccgggttcaagtgattctcctgcctcagcctcccaagtagctgggattacaggcatgtgctaccatgcccagctaattttgtacttttagtagagacggggtttctccatgtttgtcaggctggtctcaaactccctacctcaggtgatccacctgccttggcctcccaaaagtgctgggattacaggtgtgagccaccacatccggccagcccggtgctttataagttgttctttctcaatagagaatgtgaacactacaacactagaccacatttagagaccctggatttactctctttctctctctctctctctctctctccatatatatatatatatatatatttttttttttttttttttttttttgagacggagtctcactctatcgccaggctggaatgcagtggagtgatctctgctcagtgcaacctccgcctcctgggttcaagtgattctcctgcctcaggtttaccatatatttgtttgtaagacattaaagagactttcagttgaggtcaatttagaagaaagaacatatgcaacaatacacttcaaacagatataactaataataagaatttaggtcagtcatcttacttttttgtgccttattttctttataaatgtagctaggaatagcacctactatagggtgatgtggcgaaaatcggataagttactgcgtacaatgtccttaggacagccccacacatggtgatcactccataattgttagatatatattattattatttattaataatttctttcttgagatggagttttgctctagttgcccaggctggagtgcaatggcgcgatctcaactcaccacaacctccgcctcccaggttcaagcgattctcctgcctcagcctcccaagtagctgggattacaggcatgcacctccacacctggctaatttttgtatttttagtagagacagggtttctccatgttggtcaggcttgtctcgaactcctcacctcaggtgatctgcctgcctcggcctcccaaagtgctgggattacaggtgtgagccactgggcctgacctatttttttttgagaccgagtttcactcttgttgcccagacggggatgcaatgctgcgatctcagctcaccgcaacctctgcctcctgagttcacgcaattctcctgcctcagcctcccaagtagctgggattacaggcatgcaccaccacgcccagctaattttgtatttttagtagagtcggggtttctccatgttggtcaggctggtctggaactaccaacctcaggtgatccgcctgccttggccccccaaagtgctgggattacaggcgtgagctgctgcgcccagccaggtatatattattatacccaaagatctgtcttttttagtaaaagaggaaaattgaagaaaagtgagatgaagatcttggtattagactatatgctgaagaacaggccataaaaagagcacaagctttagaatcaaagacctggctttgaatcccaactctaccacatataaataatatgccttgtgcaacttaatttttatttattcatccagcaattattaattttctctcatatgctgggcccttttctaggcattaggcctatagcagtgaaatgaaccaacaaaaatttctgccttcatggagattgtatgaagaacagaacaataatcacaacaataatcatcattgtcatatttcattaattcaaaaatgtccttttccccacagctttcaaagtgagatgactctcagattcattgtaagtcatggtttaatttacagttttttcctagtttctgtgttaggaatttgggagcagcttacttgggatatagctcagggtttgtcatgagatcggagtcaagacactgtgactagggctgtagtcatctggaggatctactttctttctttctttctttttttttttttttttggagatggagtttcactcttgtcacccaggctggagtgcagtggcacaatcttggctcactgtaacttccatctcctgggttcaagtgattctcctgcctcagcctcctgagtaactgggattacagaaatgcgccaccatgcccggctaatttttgtattattagtagagacagggtttcaccatgttggccaggctggtcttgaactcctgaccacaggtgatccacctgcctcagcctcccaaagtgctgggattacaggcgtgagccactgtgcccggcctggaggatctactttcaagatgacccagtcacatggatgactagatggtgctgaccttggcaggaggcttcctttcctatgtacggggacctctccatagagcttcctgagtattcacacagtgtgacagctcgcttcctccagaaagacaccacagtgtcttttatgacctaccgttagagtcacatgccatcttttctaaactctcctattggctatgcaggtcttctctattcagtatgggaagaagcttgaataccaagtggttagacttgctgggggtcactttggagactagccaccacaactgtatgcacacacatatgcctacctattatataatttagatagatagatagatatagacaggtggagataagtgctaagaaaacacaaaacagaaagggagagatataaaatgttaggaatgggaggtgaattaatatttcaggtagggtagctagaaaaggtttctctacaaaatgacatctgagtaaagacctgaagaaggtaaggaagcttgttatgccaatatctggaggaagaaatcccacatacagaaaatagcaagtacaaagacctgaggcagggacatgcttggaatgttcaaagaacagcaagaaggtcaatgtaactggaatgaaatgagtcaggggaaaagtagtaagaggatgaagtcatatctttttgggcttggaaggttatagaaagaactttggcttttcttgtgaatgaggaagaaaggcattggagtgtttcaagcagaggagtaacatgctctcacttaggtttttcaaacaatcactctggctgttgaaaatatactaattggagacaaggacaaaaacaggaagactgagggctgctatcataatccaagggagagatgatgggggcttggatctgagtagtggcaatgtaaatcataagatatggtcagattctggagatattttgaaagtagagccaacaggattttgtgacagagcagatacgagatgtgagagaaagaggagagtcaaggatgatctaatggccagagtgagtagctggaaggatggtgccatcactaagactgggatttctgctgatagagcaggttttatggaagtatcacaagagcttcatttgggacatgttaagtttgagaggcctgttacacatccaagtggagatgtcaaatagacaattggatagacaggcctggggtttaggagagagaggtcttctgaactcctctaagcctctgttttctcatcagtaaacaaccacatggttgttttaaggaataatgaaataacatgacatgcttctgatatagtgcctgttaaacagaccacatttcataaacggtatctggcccccaaagatgtccacgtcctaattcccagaacctgtgaatatattatgttacattcaaaataacctttgtacgtgtgattacattaaagatcttgagagggagattaccctggactatctagctcagcccattttatcacaagagtccttataagagggaagcagaaggtcagagaagagagaagacactatgtgctggctttgaagatggcaggagaggtcacaagccaagtaatgtaagcagcttctagaagtggaaaagacaaggaaaacattctttcttacagcatccagaaggaacaccttctgctgacctgttttagacttttgacatcttaaactataagatagtaaatgtgtgttttaagcctctgagtttgtggtaatttgttacagcagtaatacactactaatacaaaagctattagtaatcacgatattcagaatcctgctttggtttggaaaatatttttttctttctttttttttttttttttttttttggtgacagggtctcattctgtctcccagactggagtacagtggcacgatctcagctcaccacaacctccacctcccgggttcaagtgattctcctgcttcagcctctccagtagctgggattacaggcacgtgccaccacacccggctaattttttgtatttttagtagagacaaggtttcaccatgttgaccaggctggtctcaaaccgccgacctcaagtgagccacccgcctcggcctcccaaagtgctgggattacaggtgtgagccactgcgcccggccgaaatttttttttttctaagaaagggtgttaaagaaaaagattagttaaattgtgaaagttgaagattccctactgatgtgaatgaggaaaaaaagtgccaactttgtaggcactgttcccataggaaattaataagtaaatagatttaggtggctaaccctttctgatcttctgaaatccataagacaggtaattctggaaagtagagtgattacaacagcaaccttctccacaatttccttagaatgccgtctgaaaatgaacgaatctttagcagtaaccacaaaggatatgcctgatcatattgcagttcgttcgctgatgttctctgtccaatcaactgacaggactacagtgtcctgctcctctttctgttttattttctaggtgctgtcccctttgttcacagaaaagcatagaaagctctgctgtattctcataaagcttggccccagccctgatgagtttctctatactcattcacaggacaggctttgagctctagactttggtgggatacctcttactacccagaatactatggggggaaagaggaattgggagtaacatctttatcctgcctgccttttagctgtaggtccaggtgggttttcgctatacattttttagtactagcacctcaaggctctcaggcagaaataattaatatcagcaaatattgttctatgaccaaaagaaagacacacaaaaattcttaaaactaaaacaactgcaactctaaaacctatgaaaatattttatgacttaaaaaaaaagaaacataaacgtcagtctgctgaaacattaaagaaaacaaaaaattttagaaaactcacattattctaaactagaaaagaaaatattttgttaaataagaacaccgtatttaaaatcaaaaccttagccaaaataatttctttttgaagcaataaaaagatgtggtaggatagattacagaatcaacaacatagaggataaaaagagacacatctaaagaattcagaagaatttaacaaaaagataaataaaatgtaaatgaagatagcagacatggaagatacataacagaggtctctgctttgaataatacgtgctcccaaagcacaaggcaaaaaaaatgaaagcaataaccaaaagaaaaaatagaagaaattcttcagacattaaatagcatcagagattgtactttaacaagcatgccattttcctggaaaaactgatgaggagataattctttgatgtgtcttggtaaagattttaaacttccagaaaatagaatcctgcaagcttccccaggataaaaacaaataaaacgaaaggttactttcaaaggaactaaaattataccagccacaagtaaatgctgtggaatattcacatgctaggatgctatgtaatatttatgaagaatgatgatctaaatctcagggttcttaaagtgtggtccagggactctcgggtgtggcctaagacctttacagagtccttgagatcagatctattttcgtaataataagacattacttgcctttctcacaaatgtgtagtggaattttccagagactgtaatatgccttgtgatatcacaacagattgaatgcagaagcaataggagaatgagaatgcagctgtcttctgttaaatcagacagtaaataaatttgcaaaaatataaaacaattgcactcttctccctaatttttaaattttttatataattattttgcataaaaacattatgctaacatgcagtgagtttattattttaaaatgaactaataaagaaacatttttaaagcttgcagtgatttttctttttttatttttatttttctgagatggtatctcccactgtcacccaggctggagtgcagtggcacgatctcggctcactgcagcctccgcctcccaggttcaagtagttatcctgcttcagcctcccaagtagctgggtccacaggctcgtggcacacccagccaatgtttgtatttttagtagaaacagggggcggggggcaccatgttggccaggctggtctcaaactcctgacctcaggtgatcctcctgccttggcctcccaaagtgctgggattacaggtgtgagccaccacatccggccttgtgatttctacacccagacaaaagcttgcagttttaatttctaatacagtaaatattgatatatataacctacataaacacaagctttttggagttctccataatttttaagagtgcaaaggggtcctaagacccgtttgataactgctagtagaaatccgtatagaaaccatgatataaaattgtgtatacattagccaaattagaaaataatgtgaggcgggccgggcacggtggctcatgcctgtaatcccagcactttcagagtccaaggcaggtggatcacctaaggtcaggaatttgataccagcctggtcaacatggtgaaacctcatctccactaaaaatacaaaaaagtagccgggggtggtggcatgggcctgtagtaccaactactcgagagactgaggcaggaaaatcgcttgaacccaggaagcagaggttgcagtgagccgagattgcgccactgcactccagcctgggtgacagtgagactccatctcaaaaaaaaaaaaaaagaaaaaaaaatatcatgaggctatatgcattaaaaatggatttttcctttaaatggggggatgattttataaatctgtagtgtataaaaggagagttagaccagaaatatgacatttatttccttcaataaatcaagttagatagttttaatttataatggtataataaatacagtttaaagaatgtgaactattttaagtatgtaatgtcaaattcataaaaggatgcttaggatccaacatactacaggattcaaagcacatgagacaatttattgtgcaaaagacaaaataggaagcaaagaagcctaaaatataggaggaaatcataatagtgtaaaatgagtctgtaaatttgagggtttacagatacttaaagtatatgggggaatattgaataattttgttgccctatttgcagtattgcctgaaaccaagattattggaagaaatcaggaaaactggctttgacaaaaagaaataaaatgaactaggattggccttttcccaaagcactgcttaaagaaacatcactatttttaacatgcagaaaagaggtaaaaacagtaagaatatgatggggttttgatttgcatagaaaaggtcatagtgaattagaagaaagctaacattagaattatacacctgtctttttaagtagtctgcacaattttaggaaaacttgaatatgacatttggaaagagttccatgtggaaaaaaattgtaaaggttagaaaagaagctatcaagaaaattggaaaaaattgagattactcaggttggagaagaaactctcaacctcagttcccttagggcacacagggttcttattagagcccattggacagtggttgtcatctacacttacgatgtcataagaaaaaacaattttaaattacagcctaagaatctggattggatatacagagccatgtctttagatccttagttctttgatacaggataaaagtccagctatgcatcattgaacaacgagatatattctgagaaatcattaggcgagtttgttgttatgtgaccatcatggtttacttacacaaacctagatggtatagcctattacacacctaggctatatggtatggcctcttgttcctaggctacaaacctgtgcagcatgttactgtactgaatactgtaggcatttgtaacacaatggaaagtatttatgtatctaaacacatctaacatagaaaaggtacagtaaatatatgatatcgtaatcatatgggaccaccatcatatatgtgttgttgacagaaatgttattatatggcatatgactgtacttggaatcccattgactctgttagaatagtagtggtactcttccaattttgtgaaatccaagccagaagaaatcattacagctagagaaatttttagtctatctgggagtagctcacattctccctgcttagttgacctcaaaatccttttataataatatccaggtttccatgtcccattttgtgtttgcttggttcccttaacctgggtaggctgattcactctctccttaccaaagtgattttatacacaggatacttatgtacagaaaccatttatgtacctcttaccctactccttactccagaaggagatctgaaagcctgttttcagagatacttccagaaaactgcccaaatactgcttttcaaagagagacctaccaaaaaaaaatcactgaactttctatccaatcaagaaaactcatttgtagttctctgaagcaataataagaaccaggaatggagggtttgtctccgatggcatccaccaacactgtaagtgcagtgaagactgtgggactgttgccaccaagatggatttgatggttgcttttcagaaggcaagatggtactggcaagaaagcaagcgatgtgtcactgtcttcttccttctgaccctggggtaggggatgctgatgtcccctacctcttacctcagaatatgcagatcaaattgcatatttacaactggtgaagaactgtcaaggcaaatttaggaacggtgcaaaccctcatcaaacttctatatctcctattgctgacattctgtactggaggatgccaatggcatgattggatgctaagtataccagcaccaccactgccagacactagatattggcacctgtgaaatgagatttaacctgtcgctgctgcttagtgtcactaactccaagctaaaaaccctcaacagagcactcagttcactaactggggtcatgggccacactccagctgccacagtcaaattgtcaattgtctaatcatctgtgtccttttcagcttctgtagtagaaggcagggcttcaaagctcacacaatagcaattccacaaactaagggaggagctgagatgctgggtagccaaaaactggcagaaatccatcccatttgtcctaggtaattttaattataccttatagaatgtcaacttaatttttttctcattgagttaactatatttatgtctggggactatcttttttttaaattttctctctctctctttttctttgtttttggagatggagtctatctcttttgcccaggctggagtgcagtggtgtgatctcagcccactgtaatctccacctcctgggttcaagcgattctcctgcctcagcctcctgagtagctgggattacaggtgcccactaccatgcccagttaatttttgtatttgtagtagagacagggtttcaccatgttggccaggctggtctcgaactcctgacctcaggtgatccacccgccttggcctcccaaagtgctgggattacaggcgtgagccaccgtgcccggtccttttttttttttaaccatccacagccaatggggtgtgctagggataaggtagatactatatattactctgctgctgctacttctattattattataaaaaactaaacatctcacatttctatagagatctgtagttcataaagtacttctatagagatttatagaatataaagagaatctgttattctcacttaatactcagaattactgagataagcataattattgccatttgccaatgaggaaattgtggtcctggtgcagttcttcatggtcacacaaatagtggaaactagagctggagcttgaatccaagtttcctggttacctcagtggtgatctttctattctttcagtgagtgtggttcttacttattttattcaataatagatatttatatccagacagacagcctttcctactagagagagtaatgcttttgctttaatcttacatcgctctttgatttgttgttattgttgttgttgtttatttcaggaagacgtattttagcagatgaagcactcaagctgggcattctagataaagttgtaaactcagacccggttgaagaagcaatcagatttgctcagagagtttcaggtaagaagataataataaaaatagccaaagactgtaaacaggatacatgttcatttaaataagaaactcctggccgggcgcagtggctcacgcctgtaatcccagcactctgggagtccgaggtgggcggatcacgaggtcaggagatcgagaccatcctggctaacacggtgaaaccccgtgtctactaaaaaatacaaaaaattagccgggcgtggtggcgggcgcctgtaatcccagctactcgggaggctgaggcaggagaatggcgtgaacccgggaggcggagcttgcagtgagccgagatcgcgccactgcactccatcctgggcgacagaacgagactccgtctcgagaaaaaaaaaaaaaagaaaatcctgaggctgggtaatttataaagaaaaaaagatttaattggcttacagttccgcaggttgtacaagcatggtaccagcatgtgctcagcttctggtgaggtctcagagcttttacccgtggttgaacgtgaagcaggaataggcacgtcatatggcaagagagcaagagagaagtgtggaggtcccaaactctttttttttttttttttttctgagacagagtcccgctctgttgcccaggctggagtgcagtggcgcgatcttggctcaccacaacctctgcctcctgggttcaagtgattctcttgcctcagcagcccaagtagctgggaatacaggcgtccgcccaccatgccccgctaattattgtatttttagtagagacggggtttcactatgtttgccaggctcatctcgaactcctgacctcgtgatctgcctgcctcgacctcccaaagtgctgggattacaggcatgagccaccgcgcctggccccaaactcttctaaacaagctgatctctcatcaactaagtgaaagctctcttatcaccaaggggatggtactaaaccgttcctgagggatcagctcccatgacccagtaacctcccaccaggctcccacctcaaacactggggaccacatttcaacatgagatttggagcggacacacatctaaaccatatcacaggctctataatttaccgcagtaaaactgtgggccttgagaacttctgtctccgcaaactgagttatgtccttctctcagtggtttcttactttatggactcgggatgttcctttcagagttctttcagtggcactcacagaggtttttttgtttgtttcacagtttcttttcagtctatggatgttgtcatctttaaatgagcaagatggagagggtaaaaatagccagaaaaaaataattgggaagagtattgcgttacaggcagaacagagtgctggtctcccgcttggtggcaggcaatggcccagtgtcattcaaaggcattcttttgaaggagtcattcttttgttgaccttggcagagaccaaacactttcctgaaataatctttcttttttgtggctctagccagttactgtttcaatgtgaaagtaaaagcttgaactggagaggggaggaacgatggggagaaaataatggagacccctaaagagaatcagcaagtccttgcccaaatagaaataaatttcctactatttttctcggcctttcaggcaaccttcactgtgttttcatcattgtgcttcccgagggggcttattgttttgttagaagtcacttgacagacacacagcaaaggctatttgcatttggaggtcccgaaatgattctttggtttgctaaaggtagacccgtgtctgtcattcacatctgtagttttagtttgtaaaggtctcaatttcaacaggaagttcttttccttaagtgatttccctagattctgatttgagaattaagttacttcaagaaatagttgaggttcatgatctaggagacctggatccaggtctcaaccttagctacatttctaaaatggtctggttataactttaatttattcacaatttaaaattaattgtaaacattaaattaagcatttttactttataaaacttacaaaatagtgtttcatctcaacgacattatacagtttgtccacttggtggcatccaaatattgaggcaccatttgctttaaacctgtaattcaccttttaacacttcagggctttagacaattatgtgttactattttaaattataatcatgaaaactatatagaaaaatgtaaaattgtgatataaaaatgtgtagaatataaatgtacatgtatttgcaattatacagtatataatcgtgtatagagtaatgatcattatctggagtatgtatgaatacagatacaaatggaaaggaaataagcaaaaatgaaaatgttagtttttctccaaaatttcttaagtgatttttgcttttgttttgttttattctccagcttaggataagttagttttctcaaacatttctaaattatttttggttttgtttttattttttccagctgtattgaggtgtaatttctacagataaaattcatgcattttaagggggagtttggtgaattttggtagttgtttacagttgtataaccatggccacaatcaaaatatagttctatcaccctaaaaagtattctcatacccctttcccataaatccttttttcttccccttggccgcaggcaaccagtgacctactttctgtcatacttttatggtttttttagaatctcatatggatgaaatcatgcagtagtatatagtcttctgtggctggctttattttgtataatgtttttgagagccattcctattgttgcatgcattaatattttgttcctttttattgacttgtattccacattgtgggtaaaccacaatttgtttatccattatcagttgatggacatttagtttgtttccactttgggcctacacaagtctttgtagacatagtttttcctttttcttgggtaaatacctgagaatagtattgctgggttgtaataagtgtatgcttgactcttaaatgctttttaaaatttattaataaaaaaatcagtgatttaaaagacactaatttttgccaagcagatcagaacagatggaacaaatacggtgagactgagtttaaataagctctcattagaatgcttgtaatacatcctgtctagaaggcagctggacaatcacttatagaggcttaaaattactcataccttttcacttagtttttctattcttaggaatttaccatagagaaataatcacataaatacacaaagatttgtatacagtaatactcactaaagcttttagattatcataaaatattggaaacaactcaaatatttagttctgggaaattaattatgtaaaaacgataatctcaatgaactgactccattcagctattacaacttccatttttaaagaaagttgaagaacttggaaaattgcttacatatagtattaagaagaaaacagccaggtagaaaattttacaagtgtgtgcgtgtgttcttatatgtacctgcataaggaaaaaactataaggcgatgtaacaaattttcagtagtggttgtacttgggtggtaggtaatctagactcttgatttgaaaaaaaatttatcttttcctaatatctaagtcattaaatttaccccctcccccaaaaaaatggatgactttgggaggccagtgtggaaaggacgcagtctgttagagaaatgggctcaggactggaggtcaggagagacagaggtctcagctttagctacgggaccttaacaaatcatctttggggctttgttttatgtattggtaaaagaaagggttcaacaaaattagctggtttcaaatcatgttctgagacctcacaggctacagtggttgggtgcttagttatttgtccttgcaacaactcaagcaaggttttggggtgtaatgtgtgttttggggtttaatgattagaatcccatggaaaccctaggacttttactgttttttcttttttaaatgagttccactgtttgaaatcctatgatttcttggtgctgctttgtaatagacaaacgctggagatcaaggtagagaaaaagacagatcaaccaaggattaactcagaatcttgtcaacatttgccatttattctcttaccaaatttataatttaaggaggcctatttatttgcctttcattttcatttgaggtattgtgcctatcttttctttttgtgcttccccactttcctcttttttctctttctttttttcttttttttttttttgagacggagtttcgctcttgttgctcaggctggagtgcaatgacatgacctcggctcactgcaatctcctcttctcaggttcaattgattctcctgcttcagcctctggagtagctgggattacaggcatgcatcaccacactcagctaatttttgtagttttattagagatggagtttcaccatgttggccaggctggtcttgaactcctgacctcaggtgatccacccgcctctacctcccaaagtgctgggattacagccgtgagccaccgcacccagcctctttgttttaaatacagtggttagtgtgtggtcatttagcagaacaaaattgatggattaacttgaaggaaagtttccacaaaaattcaatatgttaattacattaaatatatatgcatttattagaaatctatagttatggaaagctagagcaattgtcttgatctagagccatggtcctcaaacttcactgtgcatcaaaattgctttttggtgggcttgttaaagcacggttagcagggccccactcattactttctgattcattaaatctggggtggggcccaagaatttgtatctctaacaaacatgcttaggtgatgttgatgctgtgttctggggaccacactttgagaaccattgatatacagagaacaagggtaagaaaggagataatttttgctagttttgattttttttacacctgacacgcaaacactacctatagtctttttttttttttttttttttttttttgagacagagtcttgcttcttcacccaggctggagtacaatggtgcaatcttggctcgctgcaacctccgcctcctgggttcaagcaattctcctgcctcagcctcccaagtaactgggattacaggcacaaggcagcacacccggctaatttttgtgtttttagtagagacggggtttcaccatgttgaccagtctggtctcgaactcctgaccccaagtgatccacctgcctctgcctcccaaagtgctgggattacaggcgtgagctaccgcacccagctgctatagtcttaaagatatttttgtaaatcagttatgaaaggcatggttaaaatgcatacacatatggttgcacaaccttgtgaatattctgaaaaacactgaactatacactttaaagtggtgacttttgtggtatgcaaagtctgtctctgtcttaaaaaaatacatgttgaatttttgtattcccttttcccatttgtaaccatattccaattattcagcctattctcactcccactgctcaaatgtttgctttaaaacaacaacaacaacgaaagaagaagatgaagaacatttatttagtttctacttcttataggaaaggagggagaaaagggaatttccaatggtcaaggttccaatcagcacttttggaaccaattacgagtgggaagggagtgtagaaggttaacatacctaaaacgcaatttgggacttagcggcacatttctctacaaacttaacactgtatcctggtgagttgactgtggaagttcattagctttatgcattttaatgttcgtattctatgaagcctcccagactactgcagtgcaatggatttagcagtgcaatgcagaattacttggccaaaccagattgcattggctaaactagggaggggagcatcctataaaatgctatatatttgcacatgcatgtggctagcagcctgcctgtttctgaactaagaactcctgttctcatgtgcatgtttctggcatgatgctgaatgtgtgtgctgttattcaaagaccaagagactaaaggctctctctctctctaccttccccagctggaatgggcacagggaattatccagctgggagtgtcaactctggaacctaatgctccgttttcctttctgtaatgaaccctggtcctgttcctgtggctgtgctgggctgtgttagccacttttaacaattctaattctgcctaaagaccttggtctatttgttcttttggagttgtggcttttaaaaaaccttagtggttttatttgtctttctcttcattttatcttcttcactttgtaatttatttttacccgctgtgaacatttatatgaacatgtttcaaaagagcagagtgacctgccttacataggaggcctacgcacatgtctaaattgagcttcctttttacctgctagacaagttctgtgggtcaccttcttgaagcctgttaatgtgcagttattctgtctgtcctttgcaaagcttttatgatggacacagctttctgtttatcagggttagagagagagagagagacagattccttgatgtctgtgttcacgatttccgtgaaccgcatgttgagtctctctttagcctaggcagagaaaatcttttcctgccattacagcagaagaagaagggaaaataatcacctccttttgttccttcagaaacgtgactcacttatcttttttatcaaaaatgtcatagaatacctcatagaactaagaaaaaatgtgaatgggtcaaggaaagaattcaattaatagtatatttgaatcactgattacttcctttcctccccatttccctgggcagccaatgctgatgctgacatactgacacttgcctctcttattgtataggtactgctgagtgacttgaaaactaccaagtatacaagaaatacactttgaaaacaactgtacttatacacccaaaggggaaattctgaatatcttataactgaagttgtaagataacagcatccttagttatagctgtagcaagaaagagataggaaattgagcagggaaaaaccatctatgattgtgcccggatccaaaattttccagtgggtatgcttagtttggccctaggactggtctagacaagtgccttggatagctcccaaaatgcccatatgcagtctgcgaggttttcagtgtccccgggataataggattatgctgatcagaactaattactgcacaccattaagcaggctttcttttcatttcagttttgttctctcctctctttttttcccatcttttcttttcaatctctggcctaaaatgaaattgccaggaactgcagctgtccttgattcagtggcggacaacactctctgctcttggagctcccagaggctataccttaaaatcagcttctgaacttttcaagaatagtcttactaggccccacctttaaatattccctttttttttttttttttgagacagagtctcactctgtcgcccaggctggagtgcagtggcacaatctcggctcactgcaacctctgccgcccagattcaaagcgattctccttcctcagcctcccgagtagtagctgagactacaggcacccaccacgcctggctaatttttgtatttttagtagagacggggtttcactatcttggctgggctggtcctgaactgctgacctcatgatccacctgcctcggcctcccaaagtgctgggattacactgtgcccggcaaagattcttaactgaatctatggtgaggcctgggcatggctactcttaaaaaattcagcagttaattttgaggtatgatgtgggcatctgaacttcgtaaactcttcaaataaatctgatgtgtgctatgatgttgagaagcacccccaggaatgctgggaacagaggtagtatcacaagacagagatccaactctaagatatcccagcgctgtctatgccctgttacatggcatagattgcaccggcagcccagcctgccttcctcctccgcttgtgcctccatgctcttgttctctccttcctctccccattgtccattcttgtcttccttttaggtcaccggcacattaaatcatctgtagaccctgggggagtccccattcttctctgctgagtttgctttcccttaaattgaggattgggctaactctttgggtaattgagcaagtaattggtgggcctattggatacggttcatgttttttcaaagtagtagggtgagagggaccacatgcctataaccactgtcttctctccattcctgaatcctattctttaacatcatatgggaaatcattaattcagaaactcattctttccaacactacttactaatcaagcattaagaaaatattcttgtctctttgatttaaaaaggaggctgagattatacaatatatctatattaccatgtgcacatgattacatccaaaccttactcacgttcccttggacacgcctaacacaccaatgccagaggggctcaatgccagatgcgcttatgttcatatgtctttttatggtgaaactgctctggtataagccctggtaggctttctgtctaaataactaagatgtacatttttgataaaatggttttattttttaagagatgccagtacattatagaaaacaacttctggtatagctgaagttttggtaactgtaagttgttatgaatttattattttatgaaaactttggaatcattctgtaaagttattttttaaaatagtaccataaggattcttattaaaatttcatatataatacatatggaaaatatatttttatgctattaaatatttatatccagaagcatggtgcttttctgtttttattaaggtcttattttatgttcttcaataaaatggtatagttatcttctgaaaggtcttgtacctttcttgataaattcatttctagatacactttaacagttttaatgaggcgtgatttgccttatagattgtgcagccatccccataaatcaattttaagacttgtccactcccacaaaaagtttcttcatgcccattaacactaactcctactcacatccccagccctaggcaaccactgatctttctgtctctatagatttgcattttttggaccttggatctaaatggcatcatacaatatgtaatgttttgcatctggcttcttttagttagcataatgtttctgaggctcatctgtatctgtattgtagcatgtatcaacagtttgatcctttttattgctgaataatattctattgcatggctctatcaaatttctttagtcattcaacagctgatggatgtttggattgtttccagattttgctattataaataatgctgccatgaatatttgtagacaagttttctttatggcatatgctttcatttctcttgtgtagattcctgggagtgaaattgctgggttgaacaatcagtttatgtttatctttttaagaaacaactaaactgttttccaaagcaatgtgctgttttacactctcagaagcaacgtatgaggcttctggtttctctacatcatcaccaacattcagtagtgatggctttttattatagtcattctagtaagtctaactgcataacaaatgaccccaaaacttagtggcttaaaatcaaacatttattccacaatttctgtgggtccagaatccaagtgtcctaggtcctctggctttcagatttcaaacaaagctacaatcaaggtgttgtctgtggctgtagtcatctcaggttgattaggggtcagggggagaatctgctttcaaactcactcaagcggttgttggtaggattcagttccgtatgggctgttgtactgagggcctcagttcctcactgactgtgggctgaaagcctccctcagttctttgccacgtgggcttcaccatagggtggctcacaacagggcagctggcttccatcagagtgaccaatttgagagggcaagaaagtatgagcaagactgaagccagagtctttttgtaacctaatctagaaatgacagcccattacttagagtctgtctaccacatttgttgcggttttaatttgcatttccttaatgactaatgatgtcgagcatctttttgtgtgcatattagccattcacatatgctccttgatgaaataactgctcaagtttttgcccgtttaagaaattacattgtttacctaattattgagtcataagagtttgttacatattctggaaacaagttctttatttgatatttgatgtgccaattatattttctattgctgtgctaaaaaattaccacaagcttagcagtttaaatcatccgaaattattttcttacagttgtgtagactagaagtattgtagaggtctccctgggctaaaatccaggtgtcagctggtgcactcttttctggaggctctaggggagaaactgtttcctgcttatttgggttgttggcagaactcagtactttgcattgtgggatcagagtccccatgttcttgcttgcaaacttgcgaccttgtaaaccttaaaggtcaatcccagcttctagagaacactgcattctttagttcttggtctcctttcctcatattcaaagctacatcagtgccaacaggtcgagtcctttgcatgttgcatttctctaacccttcttccttgttgaatccccctcaccacagtcaggaaagattctctgcttttaaggactcatatgattagattgcactcaatcagataacacagggtaatatccccatctcaatgtctaatttttttttttttttgaaatggggtctcactctgtcacccaggctgcagtgcagtggcacgaccttggctcactcactgcaacctctcaggctcaaacgattctcccacttcagcctccagagtagctgggaccacaggggtgcgccaccatgcccggctaattttttgtatttttggtagagacagagtttcaccacgttgcccaggttggtctcaacctcctgagctcaaagcaatctgcccacctcggcctcccagagtactggaattacaggcgtgggctactgtgcccagccaaggtctttaatcttactctcacctatacatctctttaccatgtgaggttatacattcacagattctaggaattaagacatgaacatttggtggggggggtgttattctgactaccacacaagtattttcttctagtttatggcttgtcatttcatttttttttttctgttttttttggagacagagtctcgctctgtcaccctggctggagtgcaatggcatgatctcggctcactgcaacctccacctctcaggttctagcaattttcctgcctcagcttcccgagtagctgggattacaggtgcacaccaccatgtccagctaattttttgtattttagtagagatggggtttcaccatgttgcccaggctggtctcgaactcctgagctcagacaatccacccgcctcggcctcccaaagtgctaggattacaggcgtgagccactgcacctggctgtcatttcattttcttattgatatcctttgaagaacaaaagtctttaatttttatgaagtctgatttcttgtttcttttgtatgtcatgcttttggtgttgtatctaagaatactttgcctaaccccaaggtcctgaaaatttttttatattttcttctaggaatttttatagtattagttcttcaatttagatttgtgatctgttttcagttgatttttatatatggtgctaggtaaggacctaaatttttttttttttttattgtttttggcatgtggatatccaattatcccactacgatttgttgaaagattctccttttgaggatttttttctgaacgattattatctaaagtgtgttgttgctttagggtcacagtatgcttgtgtgcatctgttaccatgtcactgtggtccttcgctgagtgcccttaggggactagaatctttccaataaaccacgtttgagatcgtatgagtcagcgtgcagtgtagcccacacttgagagtgtggatttatgtgcacagtcactttgctctgggtggaagtaggttatagttgacttactttctcggtgcttgttcctacagcccctcttttcatgtgttgctcaatctccctatcccttcttggtgcttgcacatctcagaccctttagccagaccctttagccaaacccttgccaataacagtatttttgttctcagttctgttccctctggttgcggagactttgaataaaaatgcacacacctattcagtgggatttagctggaaaaggtgaccttccaacctcacgtcaacttctggctcctcaaacagtaggttggcagtaaggcaggaaagttgttttcccatttctcactgagcagattgtgaatatttccatatggattttctgttgttaatgttgctccgattctttgttttaaaataaaaattctgaatgtgaaaaaaagagactctcctttcttccattgaattgtttggacacctatgttgaaaatcattggctataattgtaagagtttatttgtgaactctcgattctcttccattgatatatatacctatccttgcatcaataccacgctgtctccttttctaggtattttaaagtttttgttactattaggaacggagttaaggttattttgaatctaaaatattcactcaataatagacactagagtctctactacaggggaagggagggaggatggcaaaggttgaaaaaccaacttctgggtactatgctcactactggggtggcaggattattcatatcccaagcctcagcatcgtgtgatatacccatgtaacaaacctgcacatgtatgccctcaatctaaaataaaagctgaaataatttttaaaaattaataaataaaatattaactcagaaccgttttccttagactcattaatatttaatatattaatattaattacagattaaatattaatctattgattaatttaattaattaatcattaatctattataaaattgtcttggtcttggattaaaaagaaaatacaacttttatgcctaaactaggtaacctaaaattgctttgagtctactaaattctatcttgtaggactgtgttgcaaagatatcagagatgttagtgtacatatgtttagtgtacattaaatgtcttaatgaatagcttttagtttgtgctttgaatttgaacaggttattgttattactatatattcacattccctttgtacaagtaacatttccaaagctctgatccttcttattcctttcagatcaacctctagaatcccgtagactctgcaacaagccaattcagagcttgcccaacatggacagcatttttagtgaggccctcttgaagatgcggaggcagcaccctgggtgtcttgcacaggaggcttgtgtccgtgcagtccaggctgctgtgcagtatccctatgaagtgggcatcaagaaggaggaggagctgtttctatatcttttgcaatcagggcaggctagagccctgcaatatgctttcttcgctgaaaggaaagcaaataagtggtcaactccctccggagcatcgtggaaaacagcatcagcgcggcctgtctcctcagttggtgttgttggtaagaccatggggtaatgaatggaatcctccaaatctgctcatgtaatgtgctaccatttgcttagggctaccggatgctaggtttcacgtaagacacattacttgtgttagctaagctaattctcacaccaccccatgagctctcttctttaacatgagaggcctagagacgccagccttctcaatggtgagctaaacacgagtagggtgaaagtctgaccctaggtctgactccagactgggaatgttttattcttttttttttttttttttttttttttgagacagagtcttgttctgtcacccaggcaggagtggagtggctcaatctcggttcactgcaacctccacctcccaggttcaagtgattctctttcctcagcctcctgagtagctgtgactactgccaccatgcccagataatttttgtatttttagtagagacagggcttcgccatgttggtcaggctggtctcgaactcctggcctcaagtgatccacctgccttagcgtcccaaatttctgagattacaggtgtgagccaccattcctggcctagcattttttattctatgctacctcttccctgtatgaatctctcattcctggatttcctgatgatgatgatttgtaccacatttcaaggtgtggcctgtcactctcatagctgggtatttgcaatcaagtctctgtctttccgtcccccgatccattcacttcacctgttcaaaaccactatcctcaaatccatcttaaccctgaaaccatggcttccttactttttttccctctggaattttcccaaacaaaatatcttccttcctcagatgctagctccctgattggcttctctgggccactttcctaagcttcacttgctcttagtctcggctcaagaacggtctttggtggattttaaatcccttgagatggtaagtgaagcattctttgcaccagcttaggtacaatcttctggggagagggtccatagtttactaaaagcatcaactttctttcttttctttttttcttatatttaagtttttttaatcataattaaagacatgcaggaaagttataatagtacaaaaaattctcatatactttttatccagatcctccaaatgttaacgttttactatatttgttttatttccctctctcttttctgaaccctaagaaaaagttacagacttatgtgtatttcctaaaattaatattctcatacatgaccacagtataatttattttaaaaaacagggcaattaatataaagaactattatttagtctatagcccttattctgatttttctttcttttttctttttttttaaccatctttacgatttgtaagtatacagttcagtagtaataaatatatttatatccttttttttcccttcatctcccatccccccctccccttcctggcctttggcaaccaccaatctaccctgtatcattatgagatctacattttaagctcccacatatgagtgagaacatatgatatttgcctttttgtgtaaaagcatcaactttcttaacccttgcccagctgtctagcacagtggtctccaaccttttggcaccagggaccagtttcacggaatacaatttttcacggattgggggatgatggttttgggatgaaactgttctacctcagatcatcaggcattaaattctcagaaggagcatgcaacctagatccctcacatgcgcagttcacaatagggttcgcgctcctgtgagagtctaataccaccactgatccgacaggaggcggaggtcaaggctgaaatgctccctagcctgttgcttacctcctgctgtgctaacaggtcacggactggtaccggtccacagccagaggttggcgacccctgctgtagcaccaacccaacttggaggcaaagatctcactccacattttctcagtctgtttgttctctcaattcaactttggtatcaaagaatctgtctctaatataaatacattgtgctcctttcagctctgactctgttgaggtctacccttgattcgcttgggatttttttttttttttttttgatatggagtttcgctctgtcacccaggctggagtgcagtggcgcaatctcagctcaccacaacctccgcctcccaggttccagcaattctcgtgcttcagcctcccaagtagctgggattacaggtgctgcgccaccaagcctggctgatttttgtatttttagtagagacagggtttcactatgttgtccaggctggtcttgaacctctgacctcaggtgatccgcccaccttggcctcccaaagtgctggagttacaggcgtgagcctttgtgcccagcctcacttgtgattttttaagaagatggataagtagagtgacaaagaactatgattgttcctctttttgtactattaaatatttcagcaataccaatatttatttctagttgttgtgcacttaacctctttctccttcaattccttcaagtcaagaataattaatgcaaataatagcaagctggtaagtgtatcagtattgtgtttgtcaaccactgtttgagaggatttcccgattttgttgtgaacctttctttaaaagccttcaggtttgtttctggcatataatgtgtaaaagtttgaagtatttttttaaaatgatatccacattgttttgaaaaatattggaaagggcgtactaaatatataaaagacacgtagatagaaatcaagtaagaggatctggacgtttctgccctcttcatgtgtattgctacactgccatgcgtttcatcttcgtgatgcaaccttccaccgctccctcgtgtcctctgacagactccatgacactcctctgcctcctgactgaaacccggcttaccctgaggacctgcatctgctgccctctccagggaatgctgccgcttctcccacactccatggacagctgggtcacttctcagaccattgcgctttatgggacactgtcctttgtggtcctgcactgtggtcttgtcgttctatcccttttcattactgtcatggctgccttccatttgctgaacactttagtacctggctcacagttacccactttggcccaaaccctgctgccatcctggttgtcctcatcgtctctatggacaatcattccctccttgtagcatctgggttttttgcctcctcagactcagggacattcacctcacctcacttccacattccacactcgcttctccacaggtcttgtcgttaccctgaatatttctccacttccaaaatctgaaacccctctcttcactaccaccaccacctcatatctttccttgtatctttcttaatgggttatttcaactacatccattacttgatcagctccccttatctttattttcttctctattcagctttaattttaagagttatcatttcagccactctcgggccaaagtctccaaactccatgattcattgcccttccattgtgctccccgcaaaatcctaaccctgatgatctcaatttttggcttgtttccatgagcccaggcccaggcttctcagccccgcaggagacgcagttctgattagtaaccctgcaagttcacgttctcacaccacacccaggctcccaggcctgtcaggacaggggaatgtagttgatcagaaactgcaaaactaacatttaaaacatccttatttggtatttacttctctgagtagaagaggttcctgatcaaattcaattccatggcagtcaaaagcagtaatttggcaggggagcaggactccttgcccctgtctatatgcatctgtgaggcaaaattagagaactatatgaagcttgaaaccaatagctaggaggccagagtttcaaaccccacattctaccttttaatgtagaaaagttttatcaaagctaaagtttaggatacaagttgctatagaagtgagagctgttcaaccttcttgttcttgagagaagtgcagggggttaataaatttggaaaactgtgttcttaataatttaatatatttattatatagtattgagtaatttaatacacttggaaaattaactaaatatgttctagagagactaaatcagtgatttctgatgactgatacatcctatcttcaaaaccaatcctccatgctagtaaatacaaagtatagaggagtaatatataagtggctttcacaaagctgttttcatccacagtgggctggttaggcaacacatcatctgccactgtaacaggtaacccagcaatctcagtagcttaacacaataagtgtttatttaatgcttattccataaggtcattctaggaccagggttttttcccactagtggctctgccattctccatgataagggtcagcaaactttttctgtaaagttccggatggtaaatatttaagctttgtgggccatacagtctctgttgcaactacccacgtctaccgttgtgcacaaaaacagccatagagccgggcatggtggcacatgcctcagttgcagccactaggggggccgaggcaggaaggtcacttgagcccagggcatagaggctgcagaaagccatgatgccaccactgtactccatcctgggcaacagagcaagactgtatctctaaaaacaaacaaaatacaaaacaaaacaaaaacccagccatagacaatatggaaacaaattaaccttgtgttccaataaaattttatttatgaacactgaattttgaatacgatataatttttcatgtgccacaaaatggtacttttaaaattttttatttaaaaatgtaaaaacatgtttttgcctgcaggcagtgcaaaaatcggcagtgggcggggtttggcctacaggccacagtttaccccatcacctactttaggcctcctgcaaggcctcagagtcattctctgcattctctacatctgggtggcaatggaggatcttgtgggagattttaggagccaatccaagaacccacatttcccccaatcaccaccatcgtatttcattgaccacagttactcacaggccctaacaggatgcaagggatctagaaagtacagtcttctgtgtgccggcaggaaaatgaattggtgttgggaacaaacaacatttttcatcaaataatttttcttcattttccatttttttcttgcctttgcttaaaatatttctccctatgtttttcccttcctcgacctggatggttcaacttcctcagttttacctattacagtctaatcttcctttaaggtccatttcaaatgtctttgtcttgaagctttttttgattcatccaactgaatgtaattttttccctttgaatcaaagaaatttgaacttttcacatcatttactttaccatatggaatggatattgtgaattcctctttccaccgctaaatcagaagctccctgaaggttgatgctcttcatgtttttttttaataacagtttaattgaaatgtaactcacatataaaattcacctttttatttatgtatgtatctttttttaaattttttttttttgaagacagggtcttgctgtgttgcccaggctggagtgcagtggcacaatcttagctcactgcagcctccatcttccagtttcaagcaattctttgtgcctcagcctcctgagtagctggtactataggcatgtgccactatgcccggctaatttttgtacttttagtagagatggggttttgccatgttggccaggctggtctcaaactcctggcctcaagtgatccacctgcctcagcttctcaaagtgctgggattacaggcatgagccactgtgcctggccaaaattcaccctttaaaagcgattcaatgtaaaatggtacagctgcggctgagcacagtggctcacccctgtaatcgcagcactttgtagggccaaggtgggtggatcacctgaggtcaggagttcgagaccagcctggccaacatgatgaaaccctgtctctactaaaaatacaaaaaaattagccaggcatggtggcaggtgcctgtaatcccagctactccggaggctgaggcacgagaatcgcttgaactcgggaggcggaggttacagtgagctgagatcacaccactgcactccagtctgggtgacagagcaagactccatctcaaaaaataaacaaataaataaataataaaatgttgcagcttctatggacaacagcatgacagtttgtcaaaaaggtaaaaattgccatataatccagcaattccacttctggatatttaccccaaagaattgaaagcaggggccaggcacagtggctcacgcctgtaatcccagcactttgggaggccaaggcaggtggattacttgaggtcaggaattcgagaccagcctgaccaacatggtgaaatcccatctctactaaaaatacaaaaattagctggacgtggtggtgcacacctgtaatccctgctacttgggaggctgaggcaggagaatcgcttgaacccaggaggcagaggttgcagtgttccgagatcacgccactgcactccagtctgggtgacagagagagactccatctcaaacaaacaaacaaaaaaagaattgaaagcagggactcaaatagatatttttacactcatgttcataatagcattactcacaatcgcctaacagtacaagcaacccaagtatccattgaaggatgaatgggtaaataaaatttggtatatacatacaatggaatattattcagccttaaaaaggaagaaaattctgacacatgttacaacatgggtgaaccatgaggacatactgctaagtgaaataagccaatcataaaagatcaaatactgcataattccacttacatgaggtacctggagtagtcaaatgcacagatatagaaaatagaatggttggccagggttggggagagggaaaatggggagttatcatttagtaggtgcagagtttcagctttgcaattcgaaagagttctgatgatggttgcacaccttgtgaatgcatttaatgccactgaactgtgcacttagaaatggctatgatgggaaaccttatgtgtattttgccacaatttttaaaaatcagaaaatgcatagtaagcatatcaccaaaaaagaatacaattcaatggttgttagatattgacagagtttatgcaaccattgtcacatcaattttagaacattctcatcactccccaaagaaatcctctacccatcaacagtcactctccatcacccttccctccagcccttggcaaccacgaatctattttctgtctctgtggatttgcctattctggacatttcatataaatggaaccatacaatatgtagccttttgtgtctggcttttttttttttttcttcaagatggagtctcactctgtcacccaggctggagtgcagtggcacaatctcaactcattgcaaccactgcctcctgagcccaagcaatcctcccacctcagcctcctgaggagctgggaccataggcacatgccaccacacctggctaatttttgcatttctggtagaaacaggattttgccgtgttggccaggctggtcttgaactcctgagctcaaatgatccttgcgcactggcctcccaaagtgctgggattacaggcatgagccaccgtgtccggccctggcttctttaacttagcataatgctttcaagattcattcatgttatagtatgtatcattattttattcttttttttcgagacagaattttgctcttgttgcccgggctggagtgcaacggcgtgatttcggatcagtgcaacctccatctcccaggttcaaacgattctcctgcctcagcctcccaagtagctgggattacaggtgtgcaccaccacgtccagctaatttttgtatttttagtagagatggggcttcaccatgttggtcaggctggtcttgaactcctgacctcaggtgatctacccgcctcgtattttattcctttttatggccgaataatattctccattttgtgtatctatacaccagttgatgaacattcaaattgcttctattttttggctaattttttaacgtgagaaaatgaaatttatttttattgtataaatgcaaaatttacaggaaaatattttaaagctttaaaaaatgccaagtgacattgatacaggaaaatcacaaagcaggagaactacactaaattaatagatttcattttaaaatgtctcatcgtatctcagattttggaatattccatttctgtggaagacagttgattctgttgaagatataatgccccctagtttaattaacaagtactgatagccactgatctatttctcttaaggaggagataagaaagatgtgtatacattctgtgtacaggtaatatacacaattttctggatccagccttagctcagggtttctgaaattatttttttaattttattttagattcagggggtacgtgtgcaggtttgttacatgggtgtatgtattgcgtaatgccaaggtttgggcttctaatgttcactcaagtagtgaacacagtacccgataggtaggttttcaactcttccgtcttccctcactcccccttttggaatccccagtgtttattgttcccatctttggggccatgtgtacccagtgttcagctcacacttataagtgagagcatgcagtatttggttttctgtttctgtgttaatttgcttaggataatggcctccagctgcatctatgttgttgcaagtgtgtgattttattcttttttatggctgcatttggctattttgaataatgctgctactgaacattcatgtacaagctttatgtggacatgtattttcagttctcttggagatttagatatcagtggaattgctggatcataaagtaactccatgtttaacattttgagtaactgctaaactgttttttgcagcaactgtaccatttaaaaaatttgccagcaatgtatcagagttctaatttctccaaatcctcaccaaaatttgttattgtctgtctttttcattattgcaatcctagtgggtttgaagcattatctcactgtggttttgatttgcattcccttaatgactattgatgttgaacactttttcatgtgattattacccatgtgttgcttgtgctttgggtgtcatgtcttagaaaccattgcctaattcaagatcacaaagatgtatccatccatcagacttactcctaagatctgcttctaagaattttatagttttagctcttacatttaggcctatgatccattttgagttagttttgtatatggtgtgaggtaagggtccaacttcattcttttgcatgtggatatccagttgtcccagcatcatttgttgaaaagactatactttctctgttgaatgttcttggcactcttgttaaaaatcaattggccataattgtgtgggtttgcttttggctatcagttctattctgctaatctatatgtctatccttttgcaatgaccactatcttacactgtcttaaatactataggcttcttttttttttttttttttttttttttttgagacagggtctcactctgtcacataggctggagtgcagtagtgtgatcatagctcactgcaatcctcaaactcctgggctcaagatatcctcctgcttcagcttcccaaatagctgtgactataggcatgcaccatcatgcctggctaatttttgttgttgttgttgttgttgttgttgttgttgttgttacagagtttcaatcttgttgcccaggctggagtgcaatggtgcgatcttggctcactgcaacctctgccacctgggttcaagtgattctcctgcctcagcctcccaagtagtggggattacaggcatgcaccaccacacccagctgattttgtatttttagtagagacgggttttctccatgttggtcaggctggtcttgaaatcctgacctcaggtgatctgcccacctcggcctcccagagtgctgggattacaagtgtgagccattgcacctggccccctggctaatttttaattttttatagagttggagtctcactgtgttgcctgggctggtctcaaactcctggttccaagtgatcctctcaccttggcctcccaaagtgctgggattacaggcacgagccacctcacccaaccttgaatagttttgtcatacaatttgaaattgggaagagtgaatcctccaactttgttctttttcagtattgttttggctcttctggatttcttgcatttctatgtgaattttaggatcagcttattgattctgcaaaaaaccagctgggatttttataggaattgtgttggttcttcacatcaatttgggtagtattaccaccttaacaatattaagttgtctgatacaaaaacatttaatgtttttccatttatttggtcttacttaatttctattaacaatgttttgtactttttagtgtacaaatcctcctattctttgttaaatttcttcctgtgtattattctttttgatgctattgtaagtagaattgtttcttttaattttatattcagattgtttatttctaatatatagaaatatacttgatttttgtatatcaattgtgtacctacaatctcgttggactcatttattagtttgtatagcttctatttgtgtgtgtgaatctgactaatttttatatcctctgaaacacttaagagagtgcagagtcttaactagtactcaatccatttgtgtttcttgactcaatctctttaaatgccacattgtcacataagccttccatccagtgaataatttatcagttcccaataccactgaatcattctttttctcctttgatttttatctgcaggcttgggaacaatgggccgaggcattgtcatttcttttgcaagggccaggattcctgtgattgctgtagactcggacaaaaaccagctagcaactgcaaacaagatgataacctctgtcttggaaaaagaagcctccaaaatgcaacagagcggccacccttggtcaggaccaaaacccaggttaacttcatctgtgaaggagcttggtggtgtagatttagtcattgaagcagtatttgaggaaatgagcctgaagaagcaggtctttgctgaactctcagctgtgtgcaaaccagaagcatttttgtgcactaatacttcagccctggatgttgatgagattgcttcttccactgatcgtcctcacttggtcattggcacccacttcttttcgccagctcatgtcatgaagttgttagaggttattcccagccaatactcttcccccactaccattgccactgttatgaacttatcaaaaaagattaaaaagattggagtcgttgtaggcaactgttttggatttgtggggaatcgaatgttgaatccttactacaatcaggcatatttcttgttagaagaaggcagcaaaccagaggaggtagatcaggtgctggaagagtttggttttaaaatgggaccttttagagtgtctgatcttgctgggttggatgtgggctggaaatctagaaaggggcaaggtcttactggacctacattgcttccaggaactcctgcccgaaaaaggggtaataggaggtactgcccaattcctgatgtgctctgtgaattaggacgatttggccagaagacaggtaagggttggtatcaatatgacaagccattgggtaggattcacaaacctgatccctggctttccaaattcctatcacggtatagaaaaacccatcacattgaaccacgtaccattagccaggatgagatccttgaacgctgcttatattcacttatcaatgaagcattccgtatcttgggagaagggatagctgctagcccagagcacattgatgttgtctatttacatggatatggatggccaaggcacaagggcgggcccatgttctatgcttccacagttgggttgcccacagttctagagaaattgcagaaatattacaggcagaaccctgatattccccaactggagccaagtgactatctaaaaaaactggcttctcagggaaaccctcccctgaaagaatggcaaagcttggcaggctcccctagcagtaaattgtgattcagtcttccagattatgcctcacatgctagcatcaggtaatgctgactgaatttcagtgaaattaaatcaaaaatccaaagtaagattgttctgaaatacaaagcaaaataaataatcattagaatcttctgtgtaacgactctaatggtcaaatctttaggaatgtgcttcctatgcctctgaatctgtccttatcagataaattcaatgcatgaacttgtgtgaatataataccataatagctaatgaaagaggctcaggcataagttgagattctcaaatgcttttatcattggataaatgtgtcatcaattaataaatgataaatgcagctaagtcatacattcattttgactcctttcaatgtcacacacatagtattgatcagaaatcttatgaatcatacatacactcaacaaacattaaagttgtaggaaaaagacagttggaaattggtaagggaactgagtacttcaaaccagcacagggaacttaggttagtgtggcaagcctttcctcttctggtctttcctcttctgtttatggagaaataatagaaagtagtaagtcgttaacttagtgtaagaagggtcttagagaacatctaaccttctaggatttcccaattctgtgatagagtaatgacaccagttttcctgtcatgacaagcctctgtgatgttacatatggaaatggttgaatcttgaaaaatctaaaattgttgcaaaacatattttgtatgattttgttgtaagagttcttctctttttactttttgccttgtgtagttaaaaattaaggggctggtcaatacaaaaacttgtacacaaatatttatagcagaattattcataatggccaaaagctgaatacaacccaaatgtctatgaactaatgaatagataaaccaaatctggtatatccatacaatggactatattattcagccataaaaagaaataaagggccaggcacagtggctcacacctgtaatcccagcactttgggaggctgaggcaggaggattgtttgaggccagaaatttgagaccagcctgggcaacatagcaaaaccctgtctctacaaaaaatactttccgtacattagtggttgcctaaggctagaattgggggtgatgaatggggagtacaggattcatctaatgggtacaggatttctttatggttcatgaaaatggtctaaacttattgtggtaatggtcacataacaatatattaaaaaccattgagttgtatattttaagtgggtgaattatatggtatgtgaattatatctcaataaagttgttagtaaataaatggggctgaagatgttatccttcattgtggtgtaaatgaactttcacaatattttcacctgtgaacccaaataaaatgattaaagttctgatggaaaaatcttgaatggagtataagttttccgttgttaaaaagcaaacaaaaaaccaacaaaaaatccaagtgtgccttgaattgtacagagcacaattattatgtttgaaatgtgtactacttaattttatataatttggtttgtgaaattaaagacatcaataaaaatgattcctgaaagtagtaa

SEQ ID NO: 154 - DNA, 10247 bp, Homo sapiens
ataaaaaccgtcctcgggcgcggcggggagaagccgagctgagcggatcctcacacgactgtgatccgattctttccagcggcttctgcaaccaagcgggtcttacccccggtcctccgcgtctccagtcctcgcacctggaaccccaacgtccccgagagtccccgaatccccgctcccaggctacctaagaggatgagcggtgctccgacggccggggcagccctgatgctctgcgccgccaccgccgtgctactgagcgctcagggcggacccgtgcagtccaagtcgccgcgctttgcgtcctgggacgagatgaatgtcctggcgcacggactcctgcagctcggccaggggctgcgcgaacacgcggagcgcacccgcagtcagctgagcgcgctggagcggcgcctgagcgcgtgcgggtccgcctgtcagggaaccgaggggtccaccgacctcccgttagcccctgagagccgggtggaccctgaggtccttcacagcctgcaggtacgtgtccccagggctggttctccgcgcccctagtggctctcctggcttggaagggtatggacaggagtggggcgtgggggcggggtgcgcaactgtggctccctgggcttccctgcgtcaagggatgggctccccccttaggaagccgaggagggaggttcgctcaaggccaggaattcaagaccacctaaagcaaaatagcgagacccccgtctcttctacacacacacacacacacacacaaaataaataaaataaaataaaataaatataaaattaaaaaacgaccgggcgcagtggctcacggagcctccacctgctgtcgagactagcctggccaacatggagaaacctcgtctctactaaaaatacaaaaaattagcctggcatggtgtgcatgcctgtaatcccagctacttgggaggctgaggcaggagaatctcttgaacccgggaggcagaggttgcagtgagccgagatcgcagcactgcactccagcctgggcaacagagtgagactcctcaaaaaaataatagcgataaaataaaaataaagccaggtgcggtgactcacgcttgtagtcccagcactttgggagggcgaggccagtggatcacctgaggtcaggagttcaagaccagcctgaccaacacagtgaaaccccgtctctactaaaaatacaaaaattagctgggtgtggtggtgggcgcctgtaatcccagctactggggaggctgaggcaggagaacctcttgaacccgggaggcggaggttgcagtgagccgggatcatgccattgcactccagcctgggcgacagagctcgactccatctcaaaataataataataataaataaaataaaatacaaatacaaaaattagccaggtgtggtggcagctacttgggaggctgagacacaagaatcacttgagtctgggaggcagaggttgcagtgagccaagattgcgccactgcactccaacctgggtgacagagcgagactctgtctgaaaaaataaaaaataagccaggcatagagctgcatgactgtagtcccagctacacaggaggctgaaaacaggaggatcgcctgaccccaggagttggaggctgcagtgagctgtgacagcaccactgcactccagcctgggcgagagaacgagaccccgtcattgggaaaaaaaagaaaaaagaaagactcccttgcctggcctcagcggatggagatttggaaggatggatgagtggatgaattaagaggttggggtaggcaagctgggtcctcaccaaggttttcacccctccccagacacaactcaaggctcagaacagcaggatccagcaactcttccacaaggtggcccagcagcagcggcacctggagaagcagcacctgcgaattcagcatctgcaaagccaggtaaccctaggatcaagggagaaaaggtccctctgatagctggaccccaggttgagagggaggtggtgagaactggacgtgtggctggggacgtggggccaggcaggacctgacaccctcctcccgtcccatcctagtttggcctcctggaccacaagcacctagaccatgaggtggccaagcctgcccgaagaaagaggctgcccgagatggcccagccagttgacccggctcacaatgtcagccgcctgcaccgtgagtgtctgcccctcgatgctctccggtggccacccctaccccgccacttgccattgctggtcctctccttgtcaggtccaccttaaggagaagatgtcctggcctggagtccctgagggctcaccagtctctgggtcaaagctgatgggagcacctccttcctcagccctgacctggcccagccaggccacccaacccttctcctctgcaagccagtgggctgtccctgaagccctgctgatcactgattggaacagaggtggagaaagaggtcttgagggacttgagctgcaggggtgctggagaaggtagaaatggggttcggggtgccatcctgaaggttagaaccttctaggggagggtgtcatggaggagggggtgccaggtagtagtgtttgtagatttgggccctccacaatgtcttggggtatgtgggaattagggctgggaacccccagctcccagaccagaaacactcttgtatcttacaaatccaatgctccaggtccctgacccctcttcctccttcctctcttgttctcctcctccctccccgcccccgccggccccctccccaccgcagaaagtgggcttttgctgccaccacaagttgtaggtgctttattcccaaatctccgttcatctcgaaccacagcatgtccacgtgtgtccgatgcagactcgcggttctctaagttcacggccccacacggtttctctgtggtcctcatccttccctgcatctgtggctgtccacagccaactgggtgaaagtttggatccccctctcacaccctagggtcagtggcaggcttccagcactgtagacctgagggttctctcctccccaagctcccgctccttcccacctccgtgctgcccgcccccaaccccgccaggctagcatctcagcgtggtcagggtcctgtccaccctcccaaagccaccatcccaggatgaggggcttctggagggtgacgggggaaggcacaagtcctggctgggaaatgcggtggaagggggcaggggttctgtgggttcgggactcccagactcttggctcaggcccgccaagtaggagaaagttcagagctgggaaggcgaacagctggcattcatggaagccacactggtggtttggccgcgtgcccatccttactggatgggaggaaagtaggggaaaggggagatgcctgaggggccggaaagcgtcttcctggtcactctgggcccgcccccacccccaccgtgcagactcatttcgacctttcccctacttttccggctgggctgggggcggttcctcccagtctggagcgtctgagcctccagacgtgctcaacgccatcctcccctcctccctccctctttctttcctcaaccctgcctcctctccctctaggagctgggaccccaggcagagcctctgagatgctcctgctcagcacagttcttcccgttctggacctgctgcctcattcattcattcattcattcatttgtcaagactgttttgtttgctttttgagacggagtctcgctctgttgtccaggctggagtgcagtggcgcaatctcagctcactgcaacctctgcctcccactgggttcaagtgattctcctgcctcagcctctcaagtagatgggattataggcgcctaccgccaccacgcccagctaatttttattcatttatcaagtcttttttttttttgagacagagtctcactctgtcacccaggttggagtgcaatggttcaacctcagctgactgcaacctctgcctcccgggttcaagtgattctcctgcctctgcctcctaaggagctgggattactggcgtccaccatcacacccagctaatctttgtatgttttactagagatggggtttggccatgttgaccaggctggtctcaaactcctgaccgatccgcccgcctcccaaagtgctggattacaggcatgaaccactgcgcccggcccattcctcaagtctttattgagcagctgctatgcgctggggcctgcgtggatgctggtgccaggctgtgggcagagctgctccttgtccccagcctcatggagcctccattgagtcagaggagagaccattagatgacctcagtgtccaggagtgggaagtccttgctcaattcccatttggggtgttctggcctggtctgggggtgaggcaaggcagggtgtccttccagaagctgggacccagagagagaagtgaggaaagagagtcccgccgggcgcagtggttcacacctgtaatcccagcactttgggaggccaaggctggcggatcacgaggtcaggagatcgagaccagtctggccaacatggtgaaacccccgtctctacaaataatgcaaaaactagtcgggcgtggtggcacatgcctgtagtcccagctgctccggaggctgcggcagaattgcttgaacctgggaggcggaggttgcagtgagccaagattgcgccactgcactccagcctggcgacagagcgagactccgtatcaaaaaacaaaacaaaaaaagagagtcccaggcagggggaacagcatgtgcaaagtccctgtggcaggacggtgtgtggtacaagggtgggaagaaagcctgtgtgccagagagggtgtgggtacagcatggcaggaggaggatgggcacgggggctggtcctccaggtgccttgtggaccatgctgaggaaggacatagggagccatggaagaggttaggcagatggcagagaggtggtcatgagataagatttgccttttacttccctggtcatccactgttaagcccccagatatgcctggctcctgagaccccccccaggggctgccctcctgtttcaagtctccactttatctcccttcagggctgcccagggattgccaggagctgttccaggttggggagaggcagagtggactatttgaaatccagcctcaggggtctccgccatttttggtgaactgcaagatgacctcaggtagggtgtgttagtccaccaggggcccctctccccataggccctgttgtctttctttaaattgaaaacaaaacaaaacaaaaaaattaaaggcagggtcttgctatgttgcccaagctggtctttttttttttttttttttttgagatggagttttgctcttggagctggagtgcaatgccacgatctcagctcactgaaacctccgcctcccgggttcaagcaattctccagcgtcagcctccccagtagctgagactacaggtgcgagcaaccacacccagctaatttttgtatttttagtagagactgggtttcaccatgttggtctggctggtctcaaactcctgacctcaaatgatttgccgactttggcctcccaaaatgctgggattataggcattagccactgctcctggcctcttttctttaaaatgcagcccttgtctgggtgtagtggctcatatctgtaatcccgacactttgggaggcctatcatgaggatcacttgagcccagaagttcgagaccagcctggacaacatagtgagagctcatctttacaaaaaattttgtaaaagtaaaaaaaaaggccaagtgcagtggctcacacctgtaatcccagcactttgggaggttgaggcagacagatcacgaggtcaggagttcgagaccagcctgaccaacatggtgaaaccccgtctctactaaaaatacaaaaattagccgggcatggtggtgtgcacctgtaatcccagctactcaggtggctgaggcaggagaatctcttgaacctgggaggcagaggttgcagtgagctgagatgacgccaccgcactccagcctgggcgacagagcgagactccgtccccccatcaaaaaaataaaaaagagaaaataaaataaaataaaataaaattcagcccttgctgggcatggtggcacatgcctgtagtcccagctactcgggaggccaaggcaggagggtcacttcagcccaggagttaaaggctgccgtgagccgtgatcacacctgtgaatagccaccgcactccaacctgggcaacacaacaaaacctcgtttctaaaaaaaaacaaaggctgagcacggtggcttacacctgaaatgccagcactttgggaggctgaggcgggcaaatcacttgaggtcagaagttcaagaccagcctggccaacatggtgaaaccctatctctaccaacataaacattagccgggcgtgcctgtgattccagctgcttgtggggctgaagcacaagaatcgcttgagccccgaaggcagaggttgcagtgagctgagattgcggcactgcgatccagcctgggcaacagagtgagactccatctctaaaaaaaaaaaaaaaaaaaaagaaagcttttttttccactgagaagtcctttccattacaagaggttacaacacggggttttacccagttcagctggcccagagaggctttgcagatttccactgcctactccctcccacactcagtccctgctgggttcttgggacaaagatcttcccaaggccagcccataatattcctccctctgacccaccctcctcgagtcctccagggatgagtgagggagctgctgtcttcctgggtttggagggggtttggtgcttggcagccagatgagggagtggggtcgtctgtgaagagggacttcctggtgaccttgtacctttctgggcagatggaggctggacagtaattcagaggcgccacgatggctcagtggacttcaaccggccctgggaagcctacaaggcggggtttggggatccccacggtaggtgtttctagtggggacagaggcaggggaggaagagggaccctcagaagtggccctgcctcatggagtggcctctcccactccaggcgagttctggctgggtctggagaaggtgcatagcatcacgggggaccgcaacagccgcctggccgtgcagctgcgggactgggatggcaacgccgagttgctgcagttctccgtgcacctgggtggcgaggacacggcctatagcctgcagctcactgcacccgtggccggccagctgggcgccaccaccgtcccacccagcggcctctccgtacccttctccacttgggaccaggatcacgacctccgcagggacaagaactgcgccaagagcctctctggtgagcaggccctgccatgccacacccagccagcagcttccctccttatctttctgctgctctgtcctgccttcaaccccacattgcatctgtttcctgcccccacctcttccttacatgccgtgtgtgtgattgggccactaacttagcctatctggcctcagttttcccatcctgaaaagggtcttgaccgtctttacttttatttacttatgtgtttgtttatttatttatttatgtatttattttttgagacggagtctcactttgtcacccaggctggagtgctttgtggcacgatcttggctcactgcaagctccacctcctgagttcacaccattctcctgcctcagcctcccgagtagctgggactataggtgcccaccaccacgcctggctaatttttttgtatttttagtagagatggggtttcaccgtgttagccaggatggtctcgatctcctgacctcgtgatctgcctgcctcagcctcccaaagtgctgggattacaggcgtgagccaccgcgcccggcctacttatttattttttgagacagagtcccgctgtgtctcccaggctggagtgcaagtgacgtgatcttggctcactgcagcctccgcctcctgggttcaagtgattctcctgcctcagcctcctgagtagctgggattacaggttcccgccaccatgcacagataattgttttgtatttttagtagagacggggtttcaccatgttggccagggtggtcttgaactcctgacctcaagtgatctgcccacctcggcctcccaaagtgttgggattacaggcgtgagccacaatacccggccacaaacatctttataatggtgctccacaggattctttttttttttttttttttgaaacagggtctcactctgttgcctaagctggagtgcagtggtgcgatctcggctcactgcaacctccacctcccgggttcaagcaattctcaaaaaaaaaaaaaaattaggcacggtggctcacacttgcaatcccagcactttgggaggctgaagcgagtggatcacttgagcccaggagaccaatctgagcaacagggcgaaatcctgtctcaattaaaaatacaaaaaactagctgggcatggtggtgcctgcctgtgttcccatctacttgggaggctgagttgggaggatctcttgagcctaggagataaggctgcagtgagctgagactgcgccactgcactcaagcctgggtgacagagtgagacccctgcctcaaaagaaaaagaaaaaatgcaggcatggtggctcacacctgtggtcccagctacttgggaggcccaggtacaagaatcacttgagcccgtaaggttgacgctgcattgagccatcaccacaccactgcactccagcctgggcaatggagccaggccctgtctcaaaaaaaattgtttttaaacttaaaaataaggccgggtgtgggggctcacacctgtaatcccagcactttgggaggccgaggtgggtggatcacctgaggtcaggagttcaaaactagcctggccaacatggtgaaaccctgtctctactaaaaatacaaaaattaggccaggcgcagtgggtcatacctgtaatcccagcactttgggaggctgaggagggtggatcacatgaggtaaggagtttgagaccaacctggccaacatggtgaaaccccctcactactaaaaatacaaaaactagccaggcgtggtggcgggtgcctgtaatcccggctactcaggaggctgaggcatgagaatcccttgaacctgggaggcagaggtgcagtgagccgagattgtgccactgcactccagcctgggagatagagtgagactcagtctcaaaaaaaaagaccaaaaattagccaggtgtggtggcaggcgcctgtaatcccagctactcgggaggctgagggaggagaatcacttaaacctgagagacggaggttgcagtgagctgagatcgcaccactgcactccagcctgggtgacagagtaagactcaatctcaaaaaaaaaaaagtcaagtccaaagcccagcctggtccccaacctgcctcatcctcaaccctatccctatctcctttcagccccatcggtggctcaaagacctgaccatgttccctctcccctgaccccggcaggaggctggtggtttggcacctgcagccattccaacctcaacggccagtacttccgctccatcccacagcagcggcagaagcttaagaagggaatcttctggaagacctggcggggccgctactacccgctgcaggccaccaccatgttgatccagcccatggcagcagaggcagcctcctagcgtcctggctgggcctggtcccaggcccacgaaagacggtgactcttggctctgcccgaggatgtggccgttccctgcctgggcaggggctccaaggaggggccatctggaaacttgtggacagagaagaagaccacgactggagaagccccctttctgagtgcaggggggctgcatgcgttgcctcctgagatcgaggctgcaggatatgctcagactctagaggcgtggaccaaggggcatggagcttcactccttgctggccagggagttggggactcagagggaccacttggggccagccagactggcctcaatggcggactcagtcacattgactgacggggaccagggcttgtgtgggtcgagagcgccctcatggtgctggtgctgttgtgtgtaggtcccctggggacacaagcaggcgccaatggtatctgggcggagctcacagagttcttggaataaaagcaacctcagaacactt

SEQ ID NO: 155 - DNA, 71470 bp, Homo sapiens
agaatgcactgctgacacgtgtgcgcgcgcgcggctccactgccgggcgaccgcgggaaaattccaaaaaaactcaaaaagccaatacgaggcaaagccaaattttcaagccacagatcccgggcggtggcttcctttccgccactgcccaaactgctgaagcagctcccgcgaggaccacccggtaagcggcaggccgcagaacgcagcgagggcggaggcttccctcgggggtctggccgacacgtcagcggcgagagcgggaggaggaggcgaggggcaagagggaaggctcgcgagagcgggtgggccaggcgcgccttgcggtgggcgagaggggttcccgccggcgcagggctgtggctaaggctgaggcgggaggcgggaggcgggaggcggaaggtggcgggcggtgccagcccgcggggcggggccagggcggggaaagcgggggcgggagccggcgctggggtcgcgcggaagggagcccccggagaggcgggagccgggtgttggcgttttggttctttttgttcattgagcgcaggcagctatgtcttcttcaaaggagaggagcaaaggtgaatttctctgcctcggactcgtgggagccgtgaaaagctcgcccctttgagccggtcgccctctacagctggcctcgtcctccccgtccctcacacccctgcccccaaaccccattcgccggggcgccaggaggggcgaggtccaattagaggagcccggggcgcggctgttacccctcccgccctccgccttttattcccggagggaggcgggttcgcagaggccagtgtcttccctccattctttttgtggacgccaggccatatcttcaaagcccgtgagagatttttcaggtgctgtttgttggtttgctctttttaattttttaggtgggtgcgtttacaactacgaaccctctatgatcttatgtgtccagcgcaccgaatgggggaaaagacttggagttttataacatgggaaattgggtaccagaatcttaagggaagagaccaaggagttttctagcaaagtcctgtatgtgcctggacttttgttctaatctgaaacttggaaaactcccgggcatctgattttattctaacttgtgccccatttaatgcatctaaactgtgatgtgatttgacttagcatttatcaaatgagcagagcacttttgggccacccaacttcagctctttgtggctgtcactcactgtcagtgatatgccctcagacagatcgttttctccttactcccctgaaaggttgttacaaacagtagaattcataccatgtgttgagatcattcattacctaagcttagatggaaaacatgttcattgcgactttatacattaaacttgaattgatgtttcaatgttatgtgctgtaccagagtcacctggaaataagcactcatatacattattcatatacaagaaaggctgcatcgaaaaagaatttgttttcctagatatatcagagatctttttcaccaacccactactcccagtaatagagcctgcttcttgagaactggactaattatactttgtatattatacattcgaatttatttttgctttattcggtcatattttctcttgatttctccaaaaacgtttaccaaggcatcagaaaagaaaagcaggctctatattggtattttttgttttgtcctctaataaaaagcattaacttgattgattggctggttgtggaagatgtgttgctgcatgtatgtgcaactgtgcatgtacattttaaaacaaatggtacttttaaccagttccatatttcagcaggtagttccaataacaattatacaaatttcgtgtttatgagaaccagctacagggaggccagcctggccagtagaaagttggattgattatctgggccatggagagagccagaggaaactcacatgagtggtagttccaagttggtagtgttagggcctcaaatcgggctggaaatgagcaccaaatgatttttaaaagttttattttaggctgggatatgtgcattctctgtcttgtttgtggatcttgagtgattgacttaatgtgaaaaaatacatacaggagaagcaccttggaagttttgcaatgttttaataaaaatgcagaagtggagaaggaaaggcaattcagataacaggcagagcatggtggcttatgcctgtaatcccagcactttgggaagcggaggcggaaggatcacttgatcccaggagttcgagtccagcgtgggcaacagagagagccctgtctctacaaaaagttaagaaattagccggccatagtgatgcggggctgtggtcccagttactcgggaggctgaggtggaggatcacctgagttcaggaggtcgaggccacagtgaactgtgattgcgccactgcactccacactgggcagcagactgagaccgtgtctggaaaaataaaattggtaacaattcagattggccaccagagttggactgggggctagcaggcaatggttttacctccattttgagattggcatcttctaactcaagtttaatacgggactgagggtaagagacctgcatgccttttatgtcagcattacattatcttgattatggcagctttatagtaagttttgaaattaagtagtgtaagttatccaatgtttttcttcattttcaaaattgttttggcggttcagggttccttacatttccatataaattttagtatcagtttgttattttttttcagaaaaccgtgctgtgatagactttgtaggaattgcatttaattttgcatatctatttgggggagaattgccatctcatcatgaacatggaatctctttccatttgttgagcgctttaatttctcttagcagtatttagtaattttcagtgtacaaattttgcccttttgtaaattaattttgaagttttatttttgatggtattgtgaattgaattatttttaaaatttcattaaaattttttttatcgataaagtgaaagcaagttttttgttttttttttgagacagagtctcgctctgtttgcccagactggagtgcagtggcacgatctcggctcactgcaatctccgcctcccgggttcaagcgattcttctgcctcagcctcccgagtagctgggactacaggcacccttcaccacgcccggctaatttttgtatttttagtagagacggggtttcaccatattggtcaggctggtctcaaactcctgacctcgtgacccgcctgcctcggcctcccaaagtgctgggattacaggcgtgagtcactgcgcccggccgaaagcaagtttattaagaaagcaaaggaataaagaatggctactccacaggtagagcagccgaattatttttaaaatttcattatggattgttgtcagtatataaacatacacttgatttcacttattaatcttatatcttgcaaccttccttgttgaacttgatgattacttccagttttttgtgaattacacaggattttctacatacggcatcatgccaatatagttttacttttctttccatgtggatgcctttagtttcttttttgcctgattaatttttttcttacctggttcgaccctccagcactttgctgaatagacatggagtgtatattattgacttatttctcatcttagggggaaaacatttaatcttttaccattagatacgacgttagctgtaagtttttcataaatgcactttatcaggttgagagattttccttctgttactagattgttgagaattcttatgaacaaatgttagaaatgttgcttttctgcatctattgagatgactgtggttttgttcctttatcaatatgatttattaactgatttgtgtatttatactaaccttgcattctaaatcccatttagtcatgttatataatcctttttacatattgctggatttggcttagtaatattttgtttaggatttttgtattatgttcatggtaatattagtaatattttgtcttgtgatgtctgtctggctttggtattaccgtaatagtggcatcttagaatgagttgggaagtgttccctcctattttttcagagtttgtgaaggattggtatttttttttcttcaaatatttgatagaattcactcacaaagtcatcagttcgtggatatttctttatagggaaatttgaaattacaaattcaggttctccagcgcacgcatgcgtgtgacttctccggtgaaggttgtcgtgcgcgcacctggccgtgactcctccagagcgaggttgtgcacacatgcgcgcgccttctccatcgccagcttccacatactttctccagcactggttcccaggcacacacgtgacgcttctccagggcggagctcccatagtgtgtgcggctttctagcgctcactcttggtgggtgtgctttgccagcgctagctccctggggtgtgccgcttccccaacgctggctcccgtgcttgggtgccgccccagcacctgttcccaggcgtgtgcacgtctccagcgctaggtccttggcatatgtgcttctgcagcgccggcttctgtggtgtgtatcttccccagtgcaggctcttgtagtgcgctgtgatcagctgcacccaatggtcaactgtgtacctcagcatccccctcaggcgattttgtaactgagcctgtggtgggacacctccctgtgaacacttttcctggcgccctagaggatgggtttctggcaagttaccaaaggtggttttccagcaagttgtactggtacagcacccacagagacatctctcgtattcagtgagccatggctgtgctccctccaaaaagttcttgatcccatttctgggaagaagtgggtatttttccttagggcacccacctcagccctaggggcagtggctcctccttatatctcctattcctgtgttttgtagaattctctgtacttcttactagccagcaccttgttactccagtcctgttacagtgaatagttcttgactgggcatggtgacttatgcctgtaatcccagcactttgcgaggccgcagggcttgggagaattacttgagactaggagtttgagacaagcctgggcaacatagcaaaacccctgttctacagaaaacacgaaattatctgggagtggtgtgtgtcccacctactacggaggctgatgtgggaggatcgttgagcccaggaggttgaggctgcttggagccatgattataccattgcattccagcctgggcaacagagtgagaccctctctctaaaaaagaaaatgacaacaacaacagtaattatttatagttgactttccttattcaaattattatgtggtttctttttactgactggacccagactgatttatcacctttgctctgaacttcctcaagaaatcatgagtggtgagagtatttagtctgttcattttcttgaattgtgaaagttaatcctaaggtttctcccacttccacatgacgaaagacacgtttgtgtgagagtatgtaggcttttatgaagtgatgaaactgcctttccatgcctttgcaaattagaaacagtatagattatcatggaaagtggggtcagagattaggaggggaggagaagaggacaggattagaactgtggtcgaccttatggcatccagtgggcagggttcccagatgacctgactttagatgtgactgtacttctcattatctttcacccctgtttttcatttttcagatttctgggacttgtgttttcattttcctctagagccccaatgatgcttttgtaattcagaaacatttatgtgtgatataaacattttatatacatttagctattttagtggaatctgagatctgttactctggtgactacccataagacagtttgaggctgcggtttttcacacacacacacacacacacacacacacacacacagattcagaggagactatttaaacaatatgaatttggctgggtgcagtgctgtgcacctgtagtcccaactatttgagaggctgaggctggaagattgtgagttcaagtctcctgggcaaaattgtgagaccctatctccagggaaaaaaataaataaataaaaggctatgactttatgtctgtgattccttctttacctggttcagttcaaaggtatggaattgccagacacttttgcttcttttataagattttggaggtgccatttaccttagtgacttccaacaccctcctatggctggttcctttttgttgtcattttgtttttgttggttgttactgtttacttaaagctataacattataaggcattgtacttagcctaatcctatttttgtaattatgcttgtacattcaagtgctgtactcaatagatttccttattaactcctgattttttttttttttttttttttgagacggaatctcactctgtctcccgggctggagtgcagtggcgcgatctcggctcattgcaagctctgcctcccgggttcacaccattctcctcctgagtagctgggactacaggagcccaccaccacgcccagctaattttttgtatttttgttagaggcggagtttcaccgtgttagccaggatggtcttgatctcctgacctcgtgatccgcctgccttggcctcccaaagtgctgggattacaggcgtgagccaccgctcctggccaacgcctgatttattgatgaccatttgtggttatgcataatgacttttcctctgtctttgtgcactgcagttcatattattgccttatgtgtatatgcttgtttccacaactcttagccaacttcttcagggtatattcttttttattatataactgcattgatgtttgttgagtgccaacatcctttcctcccttctctgtcataacagaccctagattttcttttagtagtcactattctatgggctctggggaacactgatactacctctagctcctgggggtggacttttattggtttaaggagtgtgttttattgattcgtcacagtcattggttaaggatgggcataagctcaagcaagtccagtctgaatacatctgaggtctgtctcttacttgggatgctggaacagaagtatgtactctatttttgggtggtatggatgtgatgtgacttctgtaatggctaaagctgttttgctatcatgagggaagcaggatggagagacagatcaactgtgaagtctgccctgtttctggacttgccagtttcttgaaccaacgaattccccccctccttttttttttttctcttttgaaacagggtcttgccctgtcaaccaggagtgcagtggcacgaacatagctcactgcagcctcaaactcctgggctccaggaatcatgccacctcagccacctgagtaactaggactacaggtatgcaccacaatgtctggctaattaattatcattatttttgtagagacagagtcatgctatgttacctaggctggtcttgaactcccagcctcaagctgtcctcctgcctgggtctcccaaagtgctgtgatgagaggtgtgagccaccatgcctggcctcccattattgttttagctggttttgcttggtgcagcaggggcatttaatgcttactaaatatttagatcttccctcacatttcccagttcacttgcagctaggtaggacattgtgattgttctagccaatagattttaagcaggttatttccaggtagaagcatttagtagcagattcctgacctagctatctcttctttttgcaatggtgattctggaggctaggtgttgagatgtctgagcacctgtcatgctggatccatgagtgactgtggagcagaacaacacccccaccccacaaacatgtgtgtcccacataacatgttggacatatagtatcagaaaaaagttactacatcataacttagcctatcttgatgaatagagttgggttttcaattactggaaaccaaaggcatcctaggtgatatagtataattttgtaattcttagtgtgtatttggtgatttacaatgtatgcagattatacattgtaattgattagtaagacacttgtctgaaggaatcagttatatttagccctagctttctgaatttggtgtacccaaacatgaccttgtccaacatggattgtaacgattacttagcctatctacccctacatattaaagattataataaaacactatataaaatatacatttatacaaataatatcgaattgctgcttttgcttgaagccgttagctaggaatttccaatcataggccgtaagagtgagtaaccgtttattattggtataacagcatgcattttatttatgaagtagtattttctgcagtatttggcacccagaagagtatcttgtgtttctgatactgactagtaccattagaatttttagtcattacactaaaaaagttggcaaagctagtgaaacttttgcttgatgataagtattttgataagtggtgactttttgaaactatgcagccagttttaggagtaacagaaatatttttatatgaaatggtataatatgactgattttttcttaaaattgagtagttgtaagcaagaaaagtgcaatacaaatatctttttcttttttcgagatgcatctcactcggtcccccaggctggagtgcagtagtgcaatcataactcgttgcagtcttgccctcctggactcaagtgatcctcccacctgagcctcctgagtagctgggactacaggcatgaggcagacactgtgcctgcccttaaaaatatcttgaattttggtagtgacattcctttgaaggtattaaaagctagaaatttgtttcattctatcaaagtttcaggtatcttcatttagttctacacgtgtgtgctgtacccatctaatgtttgcctaaaattgtactgtctttttggttttaaaataatttaagtctaggccgggcgtggtggctcatgcctgtaatcgcagcactttgggaggccgaggcgggtggatcacttgagtcctggtggtcaaggatgcaggtcggctgggcaaggtagctcctgcctgtaatcccagcactttgggaggccaaggcgggtggatcacttgaggtcaggagttcgactccagcctggccaacagggtgaaacctgtctctaataaaaatacaaaaaaaactagccgggtgtggtgacatgtgcctgtaatcccagctacttgggaggtggaagtacaagaatcgcttgaactcgggaggttgcagtgagctgagattgggccattgcacaaacaaacaaacaaaaagcggtgatctgtgattgcaccactgcactccagcctgggtgacagagcaagaccctatctcaaaaaaaaaagaaaaaaaaattaagcctaagatgtttaatttaaaaataagtttttaaaaaagtatgtttttgaggcaaaatggtgagaataggacaagtatttgaaaatattgtggtacttgatcagaaccacctttggttacattgttttgtggccaaagtggctatgactaaatgactacatgttattttaaaaacattgtttctaaggtattactgatgtacatgaatggattgatattatcatggagtggtttgttataaaagcgagtttggccctcttgtgctctgtcgctgtgtgatgccttccattgcgatgtgacccctcaatcttagacttcccagcctccagaactgggagctgataaatttctgttatttgtaaactactgagtctcacatattctggtatagcagcacaaaacagactaagacaggcagttgggcaacagcaagtctgagttcccttccagcagcaactggcaggagtgaaatcctggctgtcttctttgcagtcaaatgctctaccactgagctatacctactggctatcttctttggacagttgctgtttttcaccacaagcctgtctaattgctttactcatttaacttatctgttgtggactttgaatttatgacctttgtctaaagtaatttaagttttgaataattctgaaatgcattcagttgttaaactaacacttagaaaaaaatggacagatcagaacaaatttgtcatacttattggagaaattactgcattaatcagggttctctggtgacttctaagtttcatatctgtagaaaaggttattattattcttgagcagtaagatactgtataccctttataaatcagagctttttgttctgttgattttatacaaatacgttggttttataagcatggtttttttttgttaactacttcttttgatttcttaatttatttctaacattactttgggcaatagccctattaaaagtgctttgtactttccaaattatttccatatagattatatgggattctcacaataaccatatgtgctaaggtaagataggcattttaaaaaaagaaaaacagggctgagcacctgtaatcccagcactttgggaggcagaggtgggcagatcacttgagcccgtaagttcaggacgagcctgggcaacatggcgaaaccttgtctctacaaaaaatacaaaaattatccaggcgtggtgacatgcaactgtagacccatacagtgtgacatgcaactgtaggctgaagtgggaggatcgcttgagcctgggaggttgagggtgcagtgagctatgatcataccactgcactccagcctgggtgacagagcgaaaccctgtgtctaaaaactaaataaataaataaaaattagaaaagaaaaatagaatggagacttttcaaaaaaattactttggctcataattaaggaattcccaagagattgcccaaaggaggatagctactgatgaacttcttgggttgattgtgtgtgtacagcttttaaatgtgtcttaattgttatgagatgataaccttttcaataatcaaaagagccgggtatttctggttacccaaacccaactgattttagcagaaaacatttgccttaaataataacttctctttgaaatgtttagagagaaggaaactgagtttaatggcagggttgttggctgttacccagggaaactaactcctgtctggtgctctttttgttgcaccagtagttcgatgtccaaggggggctgaagcttcctatggaagcattgttaagcaagtctttcgcaggctttcggttgcatctttctactgtgtaaataggggcattaggagaaatgtaatctttgaatactgcccaaccagtttctgcttggtaatgtgccctgaaaccctcaatgaatgccagcaaacaaattagatccacagtgtatttgatacgcatgtcttttccccaaacaaaattcaaatttcacaaacacaaactgagtcattttccaaatgtttgtatatgaatggaagtttttgtcctgttcttctgtaaccaataccataaaacttctgaaggtccttgatgcatttattgtacaatgttaatccaaaacaaaactttattctgactaaacttgtaggtatagagagataccaaactcatttttgttgatcagtacaacatgtttgtaccaaccagatctaaaaaatgtgtaaaggagtgccatgctgtaaagaccttattacagttgtaaacatcagtgcagctgttacaaatctagcaaaacctcaggttaaacaatttcaaatttactgaagatgacattccagacccagttttcataacataaacactctaggaaatgcctttgagatgagtgggattgtcattaatattaatgccaccaaattcaaggctgagaagtcatttcttttcaagctttattttcactcctaattttggaataaaatatacttttaacctgaagtatggcgtgtcttttcacagcctgaaaacatttgatcctgttgcctttgaattgtaggaatgcaaaaatacagtataagtcttttattcttgatggtcatttaacttaaatgagtttgttagaattaaagttgggaagaattaactgttaatggaactcagttgcattgttcaattaaaaaataaaaggatgctaaaaatagttgctgtttaaggattgtattagtgtgacattttagaatgctgcatttagggaaggaattttattctaaagtgatttgaagcacatttttttgtggtcctgtctttcatctagacaaggtaggacaagcattcaaaacctgtaccagtcttaatctgtttttttcttcttagtttccacttagtgggacatctggtgaggtatcattttggccatatagtcatttctaaagtttctttctgtgctctgatttccaattaagtcttctatgatgtttgccaaatttaagagcatgcaggggtccactggaagtgctgaataactgggctttggcctaattctttgtgcatggctgtatgtgtggggtgattttgttttctttgcttgtttattggtaattgcattaaattccatttgcctttactgaatttttttttgttggacttttggggaaacctctaaattggataatagagcaattaagtgactgtttgtaagcgatcctcagtgctctattagagaggcagcatttatcaaaagaaaacagttgaatttctcttgtttaaacttgcttttgaaattctgttaattttctaataaggagaattgaagccaagcattgtcaagtaccatattgtaatctgaagttggtaactgtggaagcacatagttgatatggtgatacctttttcagaggaactttggctatttccatcagcataaaggacacaacagactgcatctattgccttcacctctgccttatttcttctgttttcccttttttttttttttttttttttttttgagatagagtcttgctctgttgcccaggctgcagtacagtggcacgatcttggctcactgcaacctccgcctcccaggttcaagggattcttgtgtctcagcctccaaagtagctgggattacaggcgctcgccaccacgcccacctattttttttttttcgtttttagtagagacagggtttccccatgttgcccaagctggtcttgaactcctgggctcaaatgatctcctccctcagcctcccaaagtgctgggatcacaggtgtgagccaacactcctggcccccttttttttaaaaaaaattaaagaggttgtggaggtttctttgaattcttttggtgtttttaaaaatgttatattttgagaagaaaatctgggcaggtacaaagaacccctccctttcctgtttgaaaacttttttgcagtcgccctggaattttccttcactgtcattcatccttctctcctttcttgatattgggtcttctgtttactttattttctttctttgttttctccctcctcttgatgtgaagcagatgttctagtatcttcctaaagcagaatgtgtgggagatgaattatttctagtcactgcctgttgaatgtgaagttattctagtcacatttgattgatagtttgtctagataagaattccaggttggaaattattttcctttagaattgtgaggcattgtttaatttccttctaccttcctgtgtttttacaatttcatgatgatgtgcctggtgtggatctcttctcatccattttcttgggcacttggtcagccctttcaatctggaaactcctgtcttttcgttctgagaatatttttggtgattatctcttcccttccatattggaactcattacaagaaagctaattaaggaagagtagagggttgtgttatgggctgaattgtgtccacccctcccccattcataagttgaagctgaagctgtaacccccaatgggactgtatttggagatggagcctttaggaagtcataccggtggggtcctaatctggtaggattggtggccttagaagaagaggtagagagagagatctctccccacatgagcacaaagaagaggtcatgtgaggacacaggtggctgcctacatacaagccaggaagagggctctcaacaggacctaataggccttgattgtggactttacagcctccagaattgtgagaaaatacatttctgttatttaagccaccatgtatgtgatattttgttatggcagcctaaactgacgaagacaggttgaggtcaagctaggacctcagcttcataaaggtgaactgcatgcgttgcaagagaatattaacatgatgctggtgcgcgtgtgttctcctttttgactggtccctttttgaacttagctcactcatctgcatatcaccctttgtgagttagcacaagtcattaacccaaggttctagatctgtgctgaccaatgccatagtcaataggtacgtttaattatataaatttacattaattaaaattaaataaaattcaaaattcacttcctcagattcattagccatattgcatgcgttcagaagccacatgcagctggcgcctgcagtattggatggacagatagagccagaacctttccatccttgcagaaagtctggctgtacaaccgtattctagatacttgccttacacctctccctctctcttttttttcttgtccagtgggtctgaacttttttaggttcaagacatacttaggaatactagaatttgtagtggacatcttcaaggttttaaaacaacactaagaagtaaacagccattatagtgcaaactctgccaaagtgtcatatgcatactgagtctataactgcgtctgcagtgatcatgctattcatttggccatgcttctgcagtatggcccttagaagagctgttttttacccctactgggctttctgatatgtttgtaggacagagaattgcaggaagcaggccttcatatctgagccgtgctgctctggtttgctgtgctgaatgttgctgtgctctcccggaagaggtaggcacaagtgctttagaaggaactgtcagaaccccactgctctactgagcactggtgagtctgaggattcacaggctaaaggcaggtcactgaaagcggcctacattctggaatttctcggaacagattatttcctgagatgacaaaaagtataattttggtcagaaggatcactgaatttcctggaatctaccccaccaggctgtgtcttcataggtgggaactgttctcaagaatcctcaaaacagccctttgaggtaggttctgtttcactcccaaagagaagcgaggttggcactcagaaatttcacatcatttgccctggctcactgaatgaactagtgaatagtgacgccgggttcagacctttccgtttttctttaaaacttgtgtttctttctaccagaatgcaactagggttggccagtgaccccttctgtccaccacgtgggagcagctctcctaaagctgggctctgcattaaagggattgtttacaaattcattaaattaaacatgtttaattcagggtaaaaactgaatgatttagaagatcttttttcttttgtttttttctttgttttttttttttttttgagatggagtctcactctgtctcccaggctggagtgcagtggcgccatctctgctcactgcaaactccgcctcccgggttcctgccattctcctgcctcagcctcccgagtagctgggagtacaggcgcccgccaccgcgcctggctaatttttttttttttttttttagtggagatggggtttcaccgtgttagccaggatggtctggatctcctgacctcgtgattcacctgcctcggcctcccaaaatgctgggattacaggcgtgagccaccgcgccaggccttttttcttttattttaaagaactgttgttatttttatttcaattaaattgaaaaacacagggaaaaaatgcaacaacaacaaatcccaggcagggcatggcaactcacgcctgtaatcccagcactttggatcacttgagtccaggagtttgagaccagcctgggcaacatagtgagacctcagctctagaaaaaaagaattagctgggcatggtggtgcatgcctgtggtcccagctactagggaggctgaggtgggaggatcgcttggaggaggttgaggctgcagtgagcctaaatcagtcatgccactgcactccagcctgggcgacagaacaagaccttgtctaaaaaaaacccagaaccaaaaaaaacaaaaaaccccaacaaatccctcatagcaccagcacttatttttgaagacttcctgtacttacacatataaatattttgtacaaaaatgttatgatattataaatatttttctgcagcttccttatttgacttaagaatttatgatgaacatctttctgagtcagtcaggaatattcttcatgcactgttaactcctctgttactttaacaattttgtgtgtgtgtgtgtgtgtgtgtgtgtgtgttttgatggttattgttatactgactttagccacttttcatcattttagcctttaggtctctttttttctttgtgtggtcttaaccgagaaataattgcaagcgaggaacaaagtcttaaatttggtggcactcaccaccaaataattgcagatgtttgccttccttctacatagaaagagcccactctcatgctgtatttgttcttctcatcctcccctgtcttatttctctttcatttcgtttaattttaacctcaataccagacttattttgtgcagcccttggcctgctgcggagttatctttgccactggctctctttccagcccccagtcgctgatgtgtctcttggcagctagtgtaaatgatggtggtcctctcattctgacgtgggagcaccccaagtcagcagtaatatttggtgtaacaagtaccagggtgggataaccacatatccctggactgggattttaaaattgtcagttgtcctgtcatttgtggtttagggatcaacttgagcaagagaaactccgtctctactaaaaatacaaaaaaaaattagccaggcgtggtggcagttgcctgtaatcccagctactcaggaggctgaggcaagagaattgcttgaacccaggagtcggaggctgcattgagccgagatcgtgccactgcactccagcctgggcgacagagcgagactgtctgaaaaaaaaaaaaaagaaattgtatttatttcctacagacttctttttcttggttatcacctgacattgccttatcaggtattttattatgtattttattcctttttattatttttggcttaaattttccttttagtcttttacttggatcattctttcttattttctcctccatattttggattcttcagacttcttcccttttcttaatcttaccattaccagatttcccttctgcttaaatttcatgatccagtttttcagtggatggagatagaaggctgaggtgaggaaggtgggggtaaatacgatacttgctgaatttcaaatataaaacaagatattaaggaacttatttccttttttattccctatatttgggagaccatagaattggctggccgctaatatcaagtggcttttgtgtgtagacccttacaaagaaatgactgataaagtccctacttctgggagttctgatagtaaaaagtgtgacatccatgacacatacattgccagtcaatgatggatagaaatggacagactttgaggagatgagttttgagtatacagagataccattttgtgtgtgtgtgtgtgcgcatgcatttgagacagggtctcactctgtctccctgcctggagtgcagtgatgcggacatggctcactatggcctcgacctcccaggcttaaacaattctcccacctcagcctcccgtgtagctggaaccacaggcatgcgccaccatgtctggctaattttttgatgttttgtagagctgaggtctcactatattgcccaggctggtctcgaactcctggactcaagcgatcctccttcctcagcctcccaaagtgctggaattacaggtgtgagccactgcagggccgcagagatacagtatatttgtgataccattagtaacttttatttgacagagggttaagtattgactaagggataaaacctattctggggcttagaaaacaaggttttgctccaagaaggcggttagatgtggataacggtttcagtactgaatttggaacctttttactaaaatgtagtctacatgtgggtatctagcaatagagtcactgttagtaaagaactatatatgtgacatacagaggaaccacatacagtttcttaaaataatatgttcttcatctttgaggaaatcctagacaaagctggaaaaatttcaagttttcttattgctcattacaaattatagggattttgatattgtgcagttaaaagttcagtagattttcaaaactagttattaattgacctcggttctgcacatttttgttgctttgcaagagtacccttaaggctcaaataaagttaaaagtaaggtaaatggtgtgttagactaaaactgtattttttgtctgtcaacacttaaatagaaaaacaaactagcttaagaacatgactgcaatttaggatcttaaaaccatatataccgtagtatttttaaagcctgcaaccaaaaagtagaatcattgtgttttatagcactttgaaattctgtctgatgttactgtatgtctgtgctgtcctgatatggcttttggattgcgtttgtggtacaagattgatttcttgtatttgtatattacttggctgcacagatggtatccgcttcaaatctactaaataaaactagaacaatgattttgccagttggttttgactgcttttatttattttggatggctgtagtctttgtgaagatggcagactaaacctggaagtgacagctaagaacagaatgggtgggctacaggtctgctaattgatctcagcagaactcatgctacttctccctgggtacaagacgttttcttcaattgaatgttcacaggccagctgagccatcctttgctcccatatctctattgtccttggcccagaccttttctcatcctccctgggttatctcatccatttccatagctttagttactgtctctctgttgatgtttctacatctatgtcttcagctcaggcctgtttcctaacctcttcctcacatacccactgcctattggacctcttcatttagatgccccaggtctcttgtactcaccatgccctaagctgagcctatctttttatccaagtatgttcctactcctttgttgcccctttcagtgtatggtggcataacacatctagttctctaatcagaaacctaagcaacatctttacctcctctctattccttttttttactatgtctgatctaaatactaaatactatgtgttctccctgataagcatctcttatctgggtgcttttctctattccttcatgtgactagactaggcctcagttactgtaagatggtcttccatcttacagtatgatcttgtctcccctggtggtccattttctatattgcttgtgtgatttttctgaaacagaaatctgagtatatcactttaatgctaaaaatcctccagtgacttacctttgctcttagaataaagtccagagtccttactctgttttgtaaagtccttttaaatccatctactacttgcttgagcagggtgacagtcttggtaaaatgtacttttatagccagaagtccccctcacacttaacatatcatgatgctttcctttcttgtgagaagcgagaaattttattgtgacattttgtccattagtaaaccacactcagatctgtgtgcccctcttccaaaaaatacattatacatatttctacaaagagagaaaacatgtaatagttgtcaggttcttttgagaaatccttttgtagaagttatgcttggtgttgttttaatgtttttattacaaagtagagagcctgtctgatgaatcttacacaaataaagtaatggaggtaattagataacaccacagcctttcctttctctccagaagaggtaacaagagtcagcattcatttggaagcagttgcccagacatgccaacagaagttgtgggcatctgtatctccttctaagaaagcgggtttcctgaaaaccttgggaaaggaaggaagagagggacggagagagggagggaagatgctatgtaggtgggccagtcaccagcagagggataaaaaatggtgagatcaaaatataaaagcacgagtagtgtattcctttggctggcctctatctctagatgccctaaaatgtttatctccattattataagtcagtgtagatgcctagagaaaggaggcatccctgatttgggcaggattctaaacaattgccttttgtattgttagtctacactttgctgaaagtccctcttgcctcagtctgctgttcccctggtgagcccccacatatggttcagttctcagtgtcaggtctctttttctggaaactttcctcaacaccccaaatctgggttaagtgctccacttagtctgctgtactatgtaacacttctcactctgcagttttagtttgtattttaagttcagtgactatgactaatgttattgtttgaaatgaaagagattttaagagtttcttcaagaggattgaccagagtcctgagacatttctccattcctaaatatataaaagccatgagttgcctttgaacttcattacaattttgaaaatttttagacatatcaaaggtattctgtagatgagagctagcccgcttcaatccagttgtgactatcttgagtgtgaatgtcagtgttcatgtttgatgttctttattttggtgtatactctaggtgtaaagccagcccaatattgtcccaacacatgactgtgtttgtttggctaactgaatacaccttacctgccttttctccactttctgtcttcatatcgaaatccatacacttgaaatattctaatccattagatatatgtaatttcctcatttatgctttactgaaaccctgttggaaaattcaaattaattacccttagattaaaaaaaaaagcctaacaaagctctgtggatttggtatgggaacatatcaataaattttttaaaataaaaaccacataattatttttaaagacaacatttattttcagatctgttgagtttttccacctatttcttcaaagttttccttgtcatccaaagacatgacatttgaggatctgtctctttactacttttctatttttcaggcaatgaaacctcttgttacatttaattagtgtgtctaggtcatgatccttagtcattttaaattggagtgtgatagagaggttttaatatattgtgcagtagatccttgatattttcagatgtaaaaggtttgttttgatttttaaaatcactttattgagatatgattgatatataaaaagttgtacatatttaatctatagaactcaatgagtttgtggataagtatatacccatgaagttatcaccaccatcaaaactgtaaacatacccatcacctcccaaagttccccctgcctgttttgttattatttttttgtgtatggtaagaacacttaatataagctctactcttttagtacatttttactatacagcataatattgttagccatgggcactatgcaatatagtagatctccaaaatttacttctcttttaggactgaaactttgtacctttaactatcacctctcaatttcccctcctgccagcccctggcaacagccattgtactctttttttttttttttttaattgatacagggtctcactgtgttgcccaggctggaatgagtggcgtgatcatagctcactgtagcctcaacctccggggctcaagagatcctcctgctgtagcctcctaagtagccaggactacaggcatgcgccatcctgcctggctaattttttattttgtacagatggggttttgctctgttgcctaggctggtctcaaactctggcctcagatgatcctctcttattgtggttttgatgtgtatttccctgatgattactgatgttgagcattgtttcaaataactgctagccatttgtttgtcttctttgaagaaaagttggttcaggtccctttgaccatttaaaagatcaggtttttttgttttgctttgttttgttttgctttgttttgttttgttttgttttttgttttgttttggtattgagctgtttgagttccttatataatatattctggatattaacaccttctcagatgcatagtttgcaaatattttctcccattctgtaggttgtctcttcacgctgttattttctttgctgtgaagacatttttagtttgatggatttttagtttgatgtaattccatttgtctgtttttgcttttattgcttttgtggtcttatccaaaaaatctttgcccagaagaccagtattatgaagcattttctctatgttttcttctagtagtttcataatttcaggtattacatttagcccattttgtgttgatttttctttttttttagatcaacatctcaaactttataatacactcacatttatacacaaatttctgtttacaagtacaaaaggcaaagaactgcaaagaagctaagcaactgcatcatcagccacattcaatcgaattaatactgttgtcccccgtccgtagttttaatccagaggaaatggtagatgccgtctcacacatggactccactgttagttttagaagttggagactgtgtgtggttccgcagaagtctgggtttctacagagctgaactgagactccatcatgttccaggccatatcagccagaagaaagtcgtccattgttgtttgagtttcgttgttggtgaagaacaagctccccagggtttcaaacccagaactcatggtctgtgtttctatactgttcaactgaactttgctttctagagcaggtatatctttaacagtggagattccttcagtttgtgtctctgtgtcagatgaatcagtactcatggaaaagctggagtgtttcagaatacttcccagaggcagatgagggctactgtctaagaaaaagtttaagtctgtctgtgtttgtctgtcaaacatctcaaggcctaagaagttagaatttcccctacacccataggactgagcagaggtatctgcgagtaagaagtccgtttgagtctctgtgtccagtgactccaagactggctcagtgttcatggtgctaagttcactctcttcagtttgagtctggatatgtgaggccgaaaagaactcttcaatatcaaaattgattccagggttctgggctgggccagatgggagctgggtgtcaggtccaggatttgtgttagacaaaagactatgatgatccaatgtctgagcaggcagattacttgacaagatgttttccaaatcacttaataaatctatggtttgggtctgattatctgtcatgttctgtgaaggaagcatactgttctgtgcactgaagtttataattggtgcacatttctcaatctcttgatttaaagtcttaggctcattctgaggtaacaaactatgagttactatctctgctactaaactgttgcttataatgttacttgtagcaacattatatgatgaatgaacactcaaaaatgtctctgcacattccagcttggtccatctgtacatggtcatccgttggactttgtatcccactggtttgagtttctcaggagaccccacccgactggaaacaggtgtccataaatgcatcagtctgagcagctatagatgaagttaccttagagctgggcaaaaatgtctgagtgtgaacactaatgggaagagacacttgagaatcaaacaacaaatcagtttgagaacaagacgacacagaggaatcagcggtggcccactgtgcagaaggtataaagttttgtgaggcataagacagatctgtctgcacgttgattgaagaaatgccgttcttctgacatgtgttccctagttcttgtaaagtattagatggacttttacccaagttcacttgaacaccagtacttattggctcaacagcaacaggatcagcaatttagaaaagaagtaggctctctttaagagagcaagcctctgaatctaggccgaggatcagggttcctactgacaagggcaggcagtaagtgcacagcccctgtggcagagccctgatcaacacctaacaccacaggctgggctgaggagtcggctgtaggcacaaagacaggcatgagagaaaactgcatcacgggtagtttaagcaaagccactttgggctttggtaaaagcaacttttgaggctatctcggtgatgttgtaagaaagagtctgcttgtcagtgttagagccacaagagtcttcaaaagatggttctagctttatttctgaagcttctagttcttgggtgtctggtctagggattggttggttgttaaatgattcagtggtcttgttggataacttctggttttgcacagttttccattttccttttcttactaggtgggtccctgtgttctgcagggatctcgtggccagttcggtagatgtgagactgcaatgcttttctactggcgtagggacagccgcatgtgcaccggaaggtcttgccacagtcctctgcaagtcttttcaggtcccattctgtaccgtacgaattgctgcacttgctacatttgtgcttcttctcagcatggattttcataaagtgctgttttacgagagaaaactgagaaaatggtctgtcagggcctctggggcagccttcgattggacaacagtagaatttcggtacagttttcaaatcttttcttattattggattgactgtgctatactgcatgcggtggctcttgaccaggtgcatgttgagcgcggggctgttgggcaggatcttgcggcagccgcgcacggtgcacaggatgttgggccatgtggtctgggacagctcgctcacctactgctggatcagctcccccgccagcacggaggccgcgggctgctgcgtcacccccgcgggccgcggccggctgcccctcagtcggggtcccgggggcacccacgggcccgaggcggcggcggaggctcctctcgtggccgccgggacggcgcgggcacccgccgccagagccgtggaccccgccgccgccaccgcctccgaggccgccatggctcccgcagggcggccaggcccagctcgcagttgtgttgatttttctaagtggtgagagatagggtctacctccgtttttctgcatgtggatatccagttttcctgaacaccattcattgaagagactgtcctttccccagtgtgtgttcttggcgcctttgtcaaaaatcagttgactgtaagtgtgttctcttttctgttccatttgtctgtgtgtttttatgtcagtactctactgttttgcttactatagctttgtagtatattttgaagtcaggtaagattgatgcctctagctttgtttttttgacgcaagattgctttggctctttggggtcttaatatatatatatatatatatatatatttttttttttttttttttttgagacagagtctcactctctcacctaggctggagtggagtggcgcgatcttggctcactgcatcctccacctcctgggttcaagagatcctcctgcctcagcctcccgagtaaccgggactacaggtgcctgccactatcctcagctaatttttgtatttttagtagagatggggtttcgccatgttggccagggtggtctcgcactcctgacctcaggtgatccacctgcctcggcctcccaaagtgctgggattacaggcatgagtcactgtgcccagcctccatacaaattttaacggacttttaaaagatacgaattcttccaatctgtgaacatggggtatcttcccattttttgtgtgtcttcaatttttttcaatattttatagttttcattgtagagatctttcacatccttggttaaatttatacctaagtattttatttctttttttttggcaggtattgtaaatgggattgctttcttgatttatttttcagatagtttgctattaatatttggtgtatagaaacactaatgatttttgtttgttgattttatatcctgcaacttgactgaattcatttattagttctaatagtttttttttagtggaatttgtagggttttctatgtactgtgtcatctgtaaacatagacagtttaacttcctcctttccagtttggatgccctttctttctttctcttacctaattgctctgggtaggatttccagtgctgtgttggatagaagtggtaagagtggacctcgttgtattgttcctgattttagagaaaatgcttttaacttttccccagtcggtatggttagttgtgggtctgtcacagatggccttgtgttgatgtacattccttctatacctaatttgttgacagttttttttatcatgaaagatgtcgaattttgtcaaatgctctttctgcatctattgagatgatcatatgatttttattcttggttctgttaatgtggtatatcatcttcatagattggcgtatgttgaatcatccttacaacccaggggtaaatttcatttgatcatgatatgtgatctttttttatgtgttgttgaattctgtttgctagtgttgtgttgagtgaggacttctgcatctaagtttatcagggatattggcttatgattttctttttgtgtctttgcctcctattcttagcagtgttcccttgaaagcaatttgtctttttataatctctgtctgcttttaggacttcctctttgcctttagtttctgcagttttactgtgtattttacttcagaggagtgtgttttgtcccattttccagaggtcttgttggactgagctctggttacctacccactctggtagttggcttaataaccctcctttcattggctgtgattccctgtgtcacttctctactttcttaatggtgttccctttattgtccaaataaactactctactcaaatccctttttcaagatctccttcttgggagtaatagggcttcttcgatctgaggattaatgttcgtgttgatcacaatggaatagtgatattgctgacagaaagatatcattggttatacttggaagatcctcagtttccctaatggcaaaagacttgggaatctgtggatcaagatggagcatatatgatcccagacagaagtattgtttctcaggtcccccagagttccccaaaggatggatttgcatggcaagagaagctcccttatcacttctaatggggttttatatggttttggtcaattacccttccactgcttgaacattactcttctggaacccagtgacatgtgtgcctactcaggaggtagaattaactgattcacaacaattgccaaacgttttttagagtttactgcaaggttggatgacatgaagaccaattttctggaatcagtctttcagaagatgtaagcctcaggcatgtctgatttctattctaaaacgtgtggctgggcacaatggatcatgtctgtaatcccagcactttgggaggctgaggcaggaggatcacttgagcccaggagtttgagaccagcctgggcaacatagcaagaccctgtctccacaaaaaataaaaataatatcagattagtcaggcatggtggcatgtgcctatagtctcagccatttgggaggctgaggtaggaggatcctttgagccttggaggtcaaggctgtagtgagccatgatagcaccactgtactccagcctgggtgacagagcaagaccctgtctcagtcagtcaataaaatatcatacagttatggttaaaaactaaaacaaatttttaaaaatttgaatgaacaatagagaatgtattaatatgctttgaatttatattaattttgtggagaagaatcatttagaattttagctcaatcataagcctgtagatgatgacacatgaaattattatccccccgtgaaatacaagtgtgaaagatgactacctttttgtggtatgatttctatatactatactcacgcgcacttcaaggttcagttgtgtggtttttcagttcttactccagccactggttgtgcaaatactccgtgattgtgtaaaaatcatacctgttaatttatatatactgttactggcaggagacagacagatagtgctatttattagaattatatgtgcttctgagcattagttacctaatcaggtattttaaaagttcagaaaaaaatttttaagtctgaaccttatgtagtaactctgaaaaactatagaaaacagagtaataaaatataaaagtagtagattgaaatgatactcttcttattatcattatttctagagacagggtcttgctcttttgtctaggctggagtgcagtggcatgatccgtagctcattgcagcctcaaactcatgggctcaagcagccctccctcctcagcctcccaagcagctaggactactggtgtgtgtcaccacacctggctaatttttgtttgtctgtttttttgtgaagatggggtctcactgttaactgagctggtctcagaactcctgggctaaagtgatcctcccatctcagcctccctaagtactagggttacacgcttgcactaccaagcctggtctgaaatgagactcttaaaggaaacaggaaacagtgaacaaagagaagagtcattggaaattaaaaaaaaaaaaaagtgaaatgccctatgtgtgatcaaatagaagcactggattcagattatcaacaaactaatcaagatggaagagcataggaaatttcccctggcaagagcttggtaaccaagacgtcaggggccagagtgaaacatgctgaatgcatgagccaagtgctgggactcagttgacctataagaacaaataaaaagaaatccatgtaaatccatataaaacacaaaaccatggacacttgtattaaagtatggcttgtcaatagaatttgcatcagtgcatgctaaggttaagtcacagtcaaagcctattcaaagaatagcctagcggttttcaagtagctgggcaggtaaagaaaatcccttgacatatataactcttaagatctgctgtaacaaatagttattatactagccaaaccaagtttaattttctcctatatatggtcttggtaaaggcatcatgttatatagaacaaacatgatcgacttggataatgaaattgtaaataaaatcctgctttacaaattattattgctgaaacagcctgtgttttagagaaagcaagaatgtttttagataaaagaaataattattccacttattaatattaaaattaaattatagcattttattttaatgtcagaagtacttgttctgtacagagattatgaagaactgggatcatgaatctgttgctgataaataaaatttcagaggtcttgggataaattatgaattcagtttgggagaacaggggttccttatcagctagaaaaactgattttactaccatatggcagtggtaaaaaaaagtccataccaaattccttatcttggatatgtatcttgaatttttatgcaacagaacagaaatacagttttgttcaggaaaaaaaattgcagaaatactactctgtgcagctcctgtctagaacatgcctgcctttttgttgtacacaagaaagagaattttctagtttaattccttgaagagcaatttgaatggtttccacttgggaaattatgtaatttcatattaaatagcaggtggtaaggtagtcagatggaaatgttcagttcatccagcatcatcagattgatttgacaaatggaattcttttaactctatggaaagcatttttctccctttatcctttggcagaggcagacattgtctgtggtttccccacaaaagtttgagtgggtaaactttggatgtgtaaatataaacagcagacagagacattgcctctgacagctggaaggatccactgaggatcttagaaggagactgctgatatggatgatgttggatagagagacttgagggaggaattaaccaatgtgaacataaatgaggaatgcacatgcttagaaaaaatgatagttcctccttaagtttaggttgaggttgttgaaaatttttgcttttgatatggataaaaacaacaaaaaactgacttttatggataaaaacaacaaaaaacaataaaaaactgacataccatgtggatgagcacatggtatgtttcttggtgagtggctccatctcgtacatgatatgtaaccttgggcaagatatttgggcaagatatttacttctcttttccttagtttccacacctgtatagtgggattgtagggactgagataagtttacggtgcttataattgtccttggcatagaataagcaccatgtaagtgatagctgctataaaataataataattattattttggtggattgagaaattcccttaaggaggaagctatttgcttcctctaataaccttagtatagttgatgtatttatatataaatgagatacagaattcaggagcaaattatttagtgtttaagatgatttataaagatatgttcatattaccttttaaaaattaaattgtgaagaatactgcaggtgcccgccaccatgcctcactaaactctgagcctttgcacgtgccaggaaagtgctgtggctggacactgggtctgatgatgctccccttttctttgcttgaacagtaatcagccctcgagactcttctggtttgtgaaatctttgtgcccccacgttatgtgtgtgtgctgccattagatcaatttcacattattattggaatttttgtttgcatatctgctaccccactcagttgtgtgttttccagtctactataaaatgtttcaaagattaaaaattacatcttttcattagccacagtgcctgctgcatagtaggtgtttttaggtaaatgattgaatgataaataaatcataccggtcatgacagtattcaaaagaaaacagttcttctcttgtttttcctgtaaggagcaaggaaatctttcctggaagcccctacaccagacatctccacgtattggcctaggatacagtcactgacaagggaatggaatttccctagttggcttggaaaaggcagtttgtgtttaaccacaaagatcactgcactggttacaaaaataatacatgattattataggaaatttataaattaatgaaaagtacaataaaataatctggcattacacaaagaaaactgttgttaacattgtggtgtttgctttccagtttttggttgtatatgtatatgtttgtgtgtatagaagaaaattgcaatcatattgtatatagctttttatagtcttacatttaagtctaacataagcagttttccgtaccattaagtcatatttttctgaaattagactaatggcttaagttccttcatatggctgtattacaaattatataattcattgcttattgttggagatatagattgttagcagttttttactattgtaaataaatatgcagtgaacatccttttatatcaatcatgtacatctctggttatttccttacactaaattcctagaagtggattaatgagtgaaagggtataaacacattcaaagttttttgatatacttctctgattatctttcagaaaacttggaccaattacattaccagaaacctgcatatgagtggctgtttaactgtattcttgccagtactgggaatttttttttttcaagacaggatcttgccctgttgcccaggctggagtgcagtggtataatcatagctcactgcagcctcagcttcctgggctcaagcaatctgtgaagtattttttaatcactgattttatagtcaaaagtggtttcactctgcttttttgacttgtagtgttatttttcatttagtcagcatttagtagatgtttgttgaaagaagaaatccgtgtttcttgatatgtatattgtttattcacatctattattggcattattatttttgcttttttattgtgatatacaaaaagtacataagctgtactaatgttaagtgtaaaactccatataatttatggcattctattttcagtttgctgttttggatattagtttgtttagtttatagtattataataatttataatattatctcagccaagtctgttgggtgagatttattccatcatagttatattctccctagggctcctaattacatagagacttcatttttggttctgactgagaaataaattatttctttctcaattcctttatattatttattacatgtctatggtttttttgcacaatccttctctttggcaacataccgttttatttatcttcatgttcttctagatatcaaaatctttttttttcagtatttagaagaaccattaaattatttcctttttatgctttctcccttattccttggctcagatttattttttctgtgtgtgtgcgtgtctctctctgtgcgtgtgcgcatgcgtatgtttgtgtgtgtgtgtgtgtgtgtgtgtgtatgtgtgtgtgtgtgtgagagagaggagtcttagagttcaagtaaatgatactttcctgtgttatttattaacagttacaactgctgttgttaatatttatctcatttaatctttttttgtctggtaagactggtacatatcattgtgtttttcatttagagggaagtgaaatattttgggccatactgttaatagtgctgtgtggatcagagctgagattagaacccagtatgctagtgatatgtttggatttcaagttataaactgtactgggtttagtcttgcacataaaaagaggctgaactgaagtttccaagatgttgagaaatttacagtttatttaaatttgagtcttgctctcaagtacactcttttcccagttatttgcagctagaaaagcaaaagtcttcaagtataatttaatatgaccaataggaaccacatgacttttacagtcattttgttgcgtactagtgtttatacaactcatgacttgacagccgaccaaactgtcttatccatctcatattaacatattgtgaatgtagtaggaactggcttagcaaaatcttgaaacctctgactctaatatttgtgggatagtaaagtaaacaactttggggctttcaggctgtgtgatgcacagcccgttcaggacattaatgcttattctctctgttgactccattgcttttgtgaacagttttgccgacaggtgtttaggcttgccaagagagattatttctagctagtagaggactcttggagaaagacattggtttctacttagaaatacaataactaatgataataactgacattgaatgggtgttaaaatgtgccaggcacaattctaagtgctttctgtgtaattaatgtattttattattcacagcaaccctactaggtttttcccattttacagatacagaaacggaggcatagactggcaaaataacttcccaaggtcacatagctagtatgttatagagtagggattcaaacttcggcagtctgcctccaagtcagccttcttaatcactctgttatgctgacatttattagatgaaaagaaagaggcacaggtgagtcataagtggctgtttgtgtttttggaaaatatttgactttatgcctactggcagcttgaaataattaagctgctaccattcattaaatttttatttttttgtaaagtgagttatttgcttgcatgtaatattataattggaacatagtgagtaaagtatacccttttatgtttgtacaaatttagggtaagcctgtattttcattaaaaaagtggtctttgagaaagaaagtgtttgaaacaaaactttgaagagtgggttcagaatcagggtgacagccacagagtagtaagttatttggtcaatgctctgtaataaatagcagagactgccttattggtcctgtgcgccatcttgaagagctgaatgttgcagaaatggcaggctaaatgttttggagtaacccaagctgactctaggcagaatttgtctttggcatcttctcattttgcctgtcactggcacctgtctcattcaccttttgtcattgccagatatggtatggtgcctaacaacctttactaactatcaacaagtccagctgggtgtggtgacatgcacctgtagtcccagcccctggggaggctgaggaggaggatcccttgagcccacgagtttgaggctgtagtgagctatgattgtgccactgcacaccagtctgggcaacagaggaagagccatctgttcaaaacaaaacaacaacaaaacaagtttctcataaaatattaattaatgtttaataaaagggatatcctttctcagggtatttgcatttaatagatcattctcaaagtttgggctttgggttatttttgagagttggcatttattgctataaacttccctcttagaattgtttttgctctatcccataggatttggtatgttatgtttccgttttcatttgtctcaggatatttttaaatttctctttaaatttattcattaactcattgtttaggagcatgttgtttaatttctatgtatttgtaaagttttcaaggtttccccttttattgatgtctagttttataccattgtggtcagaaaagatacttgacaagattttgatactcttaaatttaaaagacttattttgtggcctaacatatgatttatactggaaaatgattgatgtgcagttgagaagaatgtgtattctgtacctgttggatagaatgttctgtaaatgtttgttaggtccatttggtctagggtacagttcatatctgatgtttctttgttgactttctgtctaaatgatctgtccattgctgaaaatagggtgttaaactcttctactagtattgtgttacaatctatctgtttcttgagatctattaatattggctttatgtatttaggtgctctgacattgggtgcatatacatttacccaacatcagagcacctaaatatgtaacatatccttttgctgaattgaccaaccccattatcatatattaatataatgaccttctttgtctctatttacagatgacttaaagtctattttatctgatataagtatagccactcctgttttggtttccatttgtgtgaagtatctttttccatttatttactttcagtctatgtgtatccttataggtgaggcaagtcttttgtaggcagtatatagttgggtcttgttttctttttttttaaatccatttagctactctgtgtcttttaattggataatttaatccatttacattcaaagtaattattggtaggtaaggatttactactgtcattttattaatttttttctagttttgtagattctttttttctttctttcttcctttgaggttaagtgattttctctagtagtatattttgattctttgctttttatttttagtgtatctattataggcttttgctttgtggttaccatgggacttataaaagtatgccttatagttataaaaggttattttacactgatagcaactttgatcgaaaagaaaatactctttaactccactcccccattttgagcttttggtgtcaaaatttatatctttttatattgcatgtcccctaacaaattatcgtagctattatttttaattgtgttgtcttaaccttcttaaaaaaatatatgatgtacataccaccattacagtattagagacttcagaatttgactgtgtacttgcttttatcagtgagttatatactttcagatgtttttgtgttgctcattgctatccttttctttcatcttgaagaactccctttagcatttcttgtaagacaggtctggtgctgatgaattccatcagcttttgtcgtccagaagtctttattcttttcttcatttctgaagtacagctttggtaggtgtaatattcctggttgatagttttaatttttttttctttaggactttgaatttcttcaggacaatgtttctgcttagaggtctcttgttaggcatattagtactcccttataaattatttgcttcttttctcttgctgctttcaggatcctctctttgtgcttgatctttgacattttgattataatatgttgtggggtagtgttatttggattaaatctgactggttgcccttgatcttcctgtacgtggatagctatagctttctccaggtttgaaatactttctgttattatttctttaataagctttctactactttctctttttcaaggttcccccttgaacaccagtgacccacatatttgctctttagatgttactcataaatcctgtaacttcattcctttttcctttttcacctttagttacgtattttcaattaacctgtctttgaattcactgatactcctctaattgaacaattctgctattgatgctttctgttggattttttattttgttcattgtagtttttagctcctggatttctgtttgattttaaaaaattatttcaatctctctgttaaatttctctgatgaatttctgaattgtttttctctactttattgaagttagccaaatttccttaaaacaagtattttgaatttctgtcaggcagcttttctataatcctctctttaggatcagttactggcagcttatctttgtcccaaagcatgtttttcctcctttgggccagctggttatttagtagtgccttgttcagtttccacatttgtgaatttcctttgaaacttcctgcatttatttttaattgctttttttgtcatcagagcacatttgttatattactaatgttcttttaaatatatgaagactcattttatgacctagcatatgatctgtttagaatattccatgtgatcttaagaaaaatgtatatactattgggtggagaattctatagatgtaagttagatctagttggtttatagtgttattcaagtgttctgttttcttgttgatcttctttctagttgttttatctatcactgaaaatgacagtttgaagtctccagcgattaatattcaattgtctgtttctccctttctgtcaatttttgcttcatgaattttggtccttagttgtgtatgtttataatggttatatcttcctgatggattgacccttttatgattaacaaaatgtccctctccatctctaatagctttttgttttaaaatttgttttttttaatatcagtatagccacaattaagtttcttgtttttgtatgtttgcatgacatatcttttctatccttttacttccaatctgtttgtatttttcactctaaagtgtgtcttctatagacagcatatagttagatcatgttttcttaaagtctgacaatctttgtcttttgatgggaatttttttttttttttttttttttttgagacagagtcttgatctgccactcaggctggagtgcaatggcacgatctctgctcactgcagcctccgcctctcaggttcaagcgattctcctgcctcacccacccgagtagctgggattacaggcacctgccaccacagccagctaatttttgtatttttagtaaagacagcgtttcattatgttagccaggctggtcttgaactcttgacctcaagtgatccacccaccttggcctcccaaagtgctgggattacaggtgtgagccaccgtgtccagcctgatgggattgtttattccactcacatccatgatattattgacatagttggctttatgtctgaacttttactttttctgtatatctcgtcttttttttgtaactctgtttctccttttattacgctcttttaagtaagtattatctgttttttttttttttagacagggtctcactctcttgcccaggctggagtgcagtggcatggacatggctcactgccactgttgacctcctgggctcaagtgattctccttcctttgctgcccatgaaactgggaccacaggcatgcaccaccacacctggctaatttttctatttttgattttttttttctttttttttcttgagacagagtattggtctgtcacccaggctggagtgcagtggtgtgagctcggctcactgcaacctctgtctcccgggctcaaactattctcatggttcagcctcctgagtgattaggactgcaagcatgcaccaccatgcccagctaatttttgtatttttagtagagacggggggtttcaccatgttggccaggctagtctcttaagtcttggcctcaagtgatctgcctgccttcacctcccagagttctgggattacaggtgtaagccagcatacccagccaattttttttatttttttgtagagattttttgttgcccaggccagtctcaaactcctgggctcaagtgatccttctgtcttggcctctcaaagtgctgggattacaggcatgagtagtaactgatgcctgtaagtgaatatttcataatgtagcattttaatttctttaatgatgttttcactattctttttgaattttttttttttagtggctactctagagtttgccgtagaataattaccgtgatatatagaaatgttactcctatacatatgatttttgacttatgtcctatacatatgattctcgacttatgatggagttatatcatcataagttgaaaatattgtaagtcagaaattcacttaatacacctaatgtagtgcacatcattgcttagtgacaccgtgcactgtagagtgttacttgtttacccctgtgattgctgggctgactgggagctgtggcttgctgtcactgcccagcattgtgagaaaagcatacttgagaagaatgtatgttctgttgttgggtggagagttctatagatgtctgttaggtctgcttggttatagtgttattcaagtgttctattttctcgatcttttttctagttgttttatcagtagttatggtatcacatatcagtagcctgggaaaagagcaaaattcaaaatttggagtatggcttctactgactgtgtatcactttcatatcattgtaaagtcaaaaaattgtaagtctaaccttcataagttatggatcatctgcatagctttattcccttctcttcctttttttgtgacattattgttatacatattacctctcaatgttatgaattcaacaatgttttaattattactttaacatgtgtagttacttccttagcccaatacagcttggctgtttaactcatttgcactgtgtttggcaaatatatttacatatcttattcctttctatatgttataggcccaacagtacagtgtgtacatatcattttatgcaattcatttttatgtcagttatgagaataagagagaaaaaatgtgcatttataattacataattatcagtgttcttttattgtgtggattcaaattaccttctggtattaattcacttttttttgcaaagtgggttttctagcaacaaattcagtttttgttcttctgggaaagtctttatttcaccttcatttttgaaaggtagttttgggggatatgggattcttggttgacaacttttgagcactttgaatatgttttcccatgtttttctgggatcttttgtttctgctgagaagtcacctgttaatcttattggggttcccttgtaagtaatgggctatttttctatttctgcttttaagactttctccttgtccttgactttcagcattttcactacagtgtttttgtttgtggatctcattgcatttatcttatttggggtttgttgatgttcccaagtgccaataaatttggggagtttatatgtttctttttaaaaattattttatttttaattggcacgtaatgtgcatatttatagggtgcaatgtgatgtttcaacacatgtatatattatgtactgatcaaattaggatgattagcatatccgtcatctgaaacattgtttctttgtggtgagaactttcaaaatcctcacttctagttattttgaaatatgcatacattatgtttaacccttttcccatttaggaaaaaaggtgcagctcactacccagcgctcatttaattttacattaatgtgctctttgaggctgaagcaaatctgacagattttcaatgtgaaaataaaatataaaaactgtttttggagttatttctaaacagaactaacatcagaattgtctgaatcatcagaatcatctatttcagaaaaattgaattgaaatggatctttggctaataactgttcaagaacaatgttaccatcatgcgtaggaatgctgcattttctaggatttgatattttcagcgattgagaattactatattttgtaaatggaaataccagtgctaaaaacagaatgttataaatagaatgatgttttttgtttccaaattcaatgtactagagcttgcgaaaatagtagtaaaagcgagcaaagttatctcagagtagacgctgcagcctcatgtactgtgggcgagtattctctgggcaaacgggaaaagggttaactgtagtcaacctactgtacaatagaatacaagaactctttcctcctgtctaactgtaactttgtactggttgatgaaccgataattatgctttttaagctcgtggaaaatgtttcagatctttaaccacagttagtaggcaaaagtactcatactctttctttgatttttgttgttgtcgttcttgagatcctactcaaatcaatgtggtgaagccttctgagtattgccagaccagatataattcttggggtatgacaaggaatgagtagtagcaccttatgaagccttaggttaggtatacatagaaataatcatgctgttacttgagattgccctgcccctaaataagtggtcttgaagatgtggtaggcaagggacagagaaagaccaagctccctgtgaccagaaaaggattatctgttatttagaggaaagggttagagaaaagctggcccattgaattaatgcaagaaaccagaggtactgttaggatattctgcagactaagtcagggtgaaaacatatttaagaacaaattcagcaactgagaaacttcatgtcttgaatgtgagaggcaatctcccatatgaaactgttagttgacgttgaaaattcattcatcctggtggttgggttaggaggagacccaagaagagcttttgtatttagtttcctggtggttggagagttcaaacactagacttggaagcagataatacctcatagtacaaggaacaggaacttttctcactgtctggaaaaaccaagcatctggctgtctgattttagtgaaattgtaattcagggggaactgattaattttattagacagggtgtgagtcctgtggctcctgccaggtgtaactgagatccactcttgccttctctctctgctcctgctatttatgatccttatgctcagagtgtgtagagtaggtttgcattcttttttttctttttagagactgaggtcttgtgaagttgcccaggctggatttgaactcctgggctcaggccatccttctgccttagcctcctgagcagctgggattacaggcatgcaccacctagctaggtttgggttctgtttggctacacttcctcctattcctgccaccaaggtttgtagttgtcgttgattttaatagactattttttagagcagttttaggttcacagcaaaattgagcagaaagtacagagatttcctctataccccatgcccccacatgcataacatccccctactgtcaacatcccccaccagagtggtacatttgttaaaattgatgaacatgcattgatacatcattatcacctgaagtccatagttaacattagagtttactcttggtgttgtacattctatgggtttggacagatatacatgtgtccgctattatagtatcatacagaatagttttatggccctacaaatcctccgtgttctacctattcactcttccctctcccctgcccgagtggaatttctgtttttattttattttattttttgtttatttatttttttgagataggttcttgctctgttatccaggcaggagtgtggtggcacaatcatagctcactgcaacatctacctcctaggctcaggtgatcctcctgccacagcctcctgagtatctgggagtacaggtacacacaaccatgcctggctaatttatttttcttttttttttttttttgtagagacagggtcttggtatgttgcctaggctggtgtcaaactcctgggttcaagcaatcctcctgcctcagcctttgcaatcccaaagtgctgggattacaagcatgagccaccacgcctggcctgtttttatttttaaaaattacttgaggaactggttctaattccagtcctgtgctgaacttgtatcatacatagttcagagaattcctacctatgtagggactgcagatatcctccccttatccctttcctcctttcccttccccaaataatggcaagtcagtgcccatactgtgtatcagtccatttcattttttgagatttccttgatggtctgctaatttggagacacttctggacaaatgataaatttctggcagtacaagcccaaagtagtaaggttttgttctagacactggagctagaatgaaatttaaaaatggttccttgcttttacactgttggtgggagtgtaaattagttcaaccattgtggaagacagtgtggaaattcctgaaggatctagaaccagaaataccatttgacccagcaatcccattactgggtatatacccaaaggattataaatcattctactataaagacacatgcaaatgtatgtttattgcagcactgttcacaatagcaaagacttggaaccaacccaaatgcccatccaatgatagactggataaagaaaatgtggcacatatacaccatggaatactatatagccataaaaaagggtgagttcatgtcctttgcagggacatggataaagctggaaacgatcattctcagcaaactaatacaggaacagaaaaccaaacaccacatgttctcactcgtaaatgggagttgaacagtgagaacacatggacacagggaggggaacatcacacaccagggtctgtcagggggtgagggatttggggagggacatcattagaagaaatacctaacgtagatgacgggttgatcggtgcagcaaaccaccatggcgtgtgtatacctgtgtaacaaatctgcacgttctgcacatgtatctcagaacttaaagtataataaaaaaattaaaaaatggttcctactctctatttacaaattatgaccacttcatccaaagatcacaaattctaaagtgatacaatctttctgggtagccttaactaaaagagctgtatcactcttgagttcctctatgcatatgccaatcatttcctctttgctacaccctgttttgaagtgtctgcccagacagtagtactcatcaaccaccaatctttgtgggatgagcaactgaccccgtagaaaactatctaaagggtctgttggctggattgagccaatcacatcctcttccctgagaatggggaccttgagatactgagctgattagataatggttagttcttgggctgaaatttcgtatagaattgtgaccaccttctgaactacagcataaaagacgtgcaagctgggggaacaaaaaaagccacagacagcagagacagcagaggcagctagtgtacagagagatgtgcttgaacggagcagaaatgtggacaccctgagatgtggcaggagcttctagttccacttcctatttggaccagctaaaccttttctttccttgggtgttgttcatgagatctttggtcatagccttttcataacacctcttcccccatttgacttgtgctagttgagtggatttctgttctagagctgaaatgcagtgccagcagaatctagtgcaatagagtcttatgtaattaaagtcctaaagactctttgggttgtgagacacacaaaaagatagaaaaccaaggttgataatcagtacaaaataactacatgttggggtacccttcagtcagtcaatgtcttcctcaccggtaggcatttagtgactcgttcaccacccttccctcgtcgaggctaaagaatgcctacgtcatttcatcttttctcaaaaaagaaaaacattctgctgttttctgcttctttattgatcacatttgtccttaattccttcatataacctcaggtagaatattagtctaggtgccaggggatgtgggttctgttcttgttggggttctaacgggatggatggtctctgtaaggttcttcatctctctgtacccctacccccacacctttgccggacagtgaagagttatgctgatcaccgatttctagctgataactcccacaaaacaaggtgtgaataaagagtgtgaagaaatcaagctacttcacaggcatttgctatagatgaaataaatatgcctatccctcacttaatgatgttaattctaagaatcctgccagtaagtgaaaagctagaaaatgaaaaattacttctgttaatttttttgttgttgttttggttttgttttttgagacagagtcttactctgttacccaggttggagggcagtggcgtgatctcccagctcactgcaacctccacgtctcgggttcaagcaattctcgccacagcctcccgagtagctgggattacagacatatgacaccacgcccaactaattttttctatttttagtagtgacagggtttcactgtgttggccaggctgggctcgagttcctggcctcaagtgatccacccgcttggcctctcaactgcagccggctaacttatgttcattttagtggtaaaagttatgatgtgttccatcccaacctaagatgtccaaatactttctacaaatagaaaaatatatcattgagcaatgaaaactttttattagtaaataatccaaaattaaataaatgtaattggtacataaaatgtgttaaaatgatgctttgttgcctcaataaaaaagaggaggcggggccgggcgcggtggcttgtgactgtaatcccagaactttgggaggccaaggcaggcgaatcacgaggtcaggagatcgagaccatcctggctaacatggtgaaaccctgtctctactaaaaatacaaaaaaatttagccaggcgtggtggcgggtgcctgtagtcccagctacttgggaagctgaagcaggagaatggcgtgaacccgggaggttgagcttgcagtgagccaggatcgcgccactgcactccagcctgggcgacagagcgagactccatctcaaaaaaaaaaaaaaaaaaaaaaaaaaagaagaggcttgatgggattgatggaagagggaaggagccatactttggaaggtggttggtgagtcaggtgataaacttttaaggcgtgcattcagcagcaaaagtgcttaataatatttttcattggggattttgacagtagaagaaactcctaatgtggaaacctttggtatattggtagaagggaatcttcagatcaaaaaaaaaagcaagatgtaactttgcttccctttttgtaatttgcaattcatacacctccttgcaggatgcgatattagtttcccgaagctgttatagcaaattactacaaacttgttggatcaagagaacagaatcatatcttgttgcagttctggaggccaaaagtgtgaaaactgacatggccacattccctctggggacaccttcctctcacttctggcggccagcatggcattcctgggcttgtggccgcatccctccaatctttgcttctgtcttcactttgctgcctcctctgtgtctgtctccaacttgctctgcctctgtcataaggttgcatgtggcctaccctaccctgatattccaggacaagctccttctctcaggatcctgaatgttaccactttgtagtagttgttgttgtacaaggtaatagtcattcctttgccatgtaaagtaatattcacaggtcccatgtgctagtgtgggaatgaggtgccgacatttgggctgctaattctttgttgtgggagactgtcctgtgcttggtagatgttcagcggtgtacctggcctctgcccactgggtgccagtgacatccttctcccagctgtgacaaccaaaaatgtcttcaaacattgtcaagggtcccctctggggcacgactgtccttggttgatgagcactgctttaacctaatcagagcccattcttatcccactcaaatatgctgactgggaagtttccagtctcgttaagaagggggagggtggagaatggatgctggagaggtgactgctcctctccactacacctaacattctagtgaagtccacaaatgggccaaatcgagcaggattatgaaatttttgctagacccctgttagtgtattctaacattgtggcattttatattagtcaactaaatctcaatattatgttttaaaaaaatccaatggacctctgaatccccaggttgggttttttctactttacctatgttaaatatgttaaatacctaggttgccctttatcttagaatttgtccatgtatcacctcattctttttcagcaggtccctttctggaggttttcatactcagttggatttatcctccctgcgactgctgcctgctccttgccttgccatgcggcattagtagagtatgaactgcacatttagcacagcagtttatgcactagagaatcaggattggaatttttctgaagtatcttatttttctgtgaaataattgaaacagagtatagacacatttgctgttttgaagtttttatgatttccaaagtaataaatgtgcactctcacagttctcgggtggctgatctctggagtgcttgccgtttctccgggtggttgctttgtacaggctcccctctcgtgttggcctgcaagtgctctcgctgcgacgggtccctgaccggtactggatgagaggactagtactggtgcagatgttggcataaacaaaagctgcagctttttaatcatgactaaggcatgggagaggctgacatataattgtggggaaaagcgagagagatcagattgttactgtgtctgtgtagaaagaagtagacataggagactccattttgttatgtactaagaaaaattcttctgccttgagattctgttaatctataaccttacccccaaccccgtgctctctgaaacatgtgctgtgtcaactcagagtggaatggattaagggcggtgcaggatgtgctttgttaaacagatgcttgaaggcagatgatcaataaatactaagggaactcagaggctggcgggatcctccatatgctgaacgctggttccccgggtccccttatttctttctctatactttgtctctgtgtctttttcttttccaaatctctcgtcccaccttacgagaaacacccacaggtgtgtaggggcaacccacccctacaataatggttcccagagtgtccctctcagaccaataaaacatagcaaaactacgtgataaccaggctggaatgtatgtgaattgttcgagtgagtctgtgtcacttgaactgtactgggcagtacctaggggcttcatgtaaggcatgaagggctccagaaagaacccgctctttgccttcagttgtattctatatgtttaatacacagcacagcagaagcaatcagctctccccaatgttacttatcccataaatcatctttccttacacctacgtattttcttctgtattcaattttattaatggatcatctgatctccagctttgctggtttagaacctctgtgctcatcttaagctcctcaaggagaaaaggactattgtaatcatctttcaacgagtttgtaaaaacaattcccccatcacagcactgtgcctcatagggtttaaaatttgaccgaatgactgactttacatacatccttcccagaccctttaggactactgctcccctagaggttttctctgccctttggaaaacaggtaggggaagagggatctagaaatggcagtattcattaagatagccaaagcttgataggaagagacattcattttactgtggtaattaaagtgaaaatgggagaataagaaggcatgctgcttctttttcaggagtcttggcaagggttctagttttaaaagaaagagacacagccaactagattgaaatgatgtggagttcatccctccacagtcatattttactgagccatttttcaataaatggactaaattgtcccttggaactcagtaggtggtgctcttgtgctatagcatagcatcggctttggagaggttctgagagcacagcggctggttccagggcctgtgtcctgtcagtcccctttcatagctgccaggcacacacctggagggcatcacatggctggtctggtgagaggctttctgtctttggaaatgagggggtgaattaaggtctttaccttctctagcctgtctgagctctgctttccaggggaacctaaatgagaggttttctaaccttttaaagaaaaaaaaaatgtgactgtttatccaaacaattacgatgtgtattgttaccagttttccaagattttttatattgttattcatctgtgattcctcaaatcaaagttcctttccacataactcagggtatcattcttgtttatgttttcctttatgttaatgtttgtttcctgtttaagcttcagagaagatgcagcagaaagaaataaatatgtagtagagaaatttggaagtgatgaaggaatacaggtgaaagccatcgagttcatgcagcagctagtagtaacttagctgacaacagacccttttggcaggagcccattgctttactccttttgctatataatgagttccttggtccgaagttggttgtgataccatgatggtgaataaggaatccagtcaagtccacatttggtgatgctggagaagtgtggtgggcaaagaagataaatttaaatccagagtgagttatctattacaaggaggacaaatctgttgcctgaagcatttcagggtctgctttttcatcaagtttctgtaggggttgtataaaacgaaagttacttcacctatatccaccaactggtaggggagaggcaaaatgctagtgggactcacagcctggatgtgctgatctgacccattcagtcacctgtgatgtcgaaaggctaccagccaggtccgagtgaggccaggctgtggggccagcagctgggctcctgagctgtgctgctgcagatccagtgatgtgcagtgtgttttgtcaagacagagtgcttcctctccagtctactgtctagtatcttgtgcactgagtttttaggttttaatgaccgtagtcctgatttacatactttgcagttgatttttttttagccatcttttaattctgccttttcaatttatactttcttattttttaattagcttttttaaaaagcaccctaaatatactgatttttgttggttttaaaaatcaccttaaatatattttgttgggattattttagtgtcttaagtatactttgttaggattttttagcatctaaatatacctatttgttggactgattaacttcatctgaagtgaatttgtgatctaatgtctgatattgttagttgcatttatttcttcatgtactttagaactttggttaaatgacatgttttgaatgaggttttaaaaacttttcactcattcagtcatttttcgcctctttctccctctctgcacactctcccctgtgtagcctcattctgcttgtctctgtctggcttccatggagcctgggtgcagaactagctttcacagtgggggcttagttacctgggcattcatggctgcttcacgcagtgcctggtcctgcctgacaggtgtcctccatcctccctagaccgccactccataggaggcaaggatgctgcgagccttccttcaggcatggaggggtagggctctagtcagcaccttccatcccaccttccagcaagggtgctagtttctcactctgtcgtttgtgcctctgtttagcccccaacccttctaagacccaaacctacagtttcattgcctgtttttggaccctagcataggaggggctggctgctcatggttttgtcctcggggtcttgcctctttgtgtttctgtctcgtatcgatttcatagaaatgtttattttgtgtgtgtgcttgcctgtatccttttccttttttctttttatgtttcccctctcattgctgtatgtttggagtaaagagaatccatccaaaagtgaatttaccgtgccatcttaactggaagtcacatgggcagagagtttaaaggaaagaaagatacttggttttacatagtactgaaagctaaccacaagaacgcttcctatgtgagctcagtgacccatagcatatagttacttaaactccgtctgaggcttgcaggccccaaaagatgagtgggattaggcaggtgggatttattagggtgctatggttctctacaaaggtttcaccttctatttttcattttggtggtaattttttaaaaattcataattccacacacctaaatgcctgcaattctaactaagtaatgtcttaaaatttcagtgcctggagttgtgtttgtattggtgccaaggagcactgctttaaatatagggagatattataaaagaacagaggtgaaaatgtaaataacgtgtttgagctaagagattgccgttgcacagtggttctgaagaggaaagtgatgcgtgaattaagctgtctccctgcatgtgttagtattggccagtcaacagaacctgcctgtcggtaccaagccctacatggttagtccaaagtgagtttcaatgactgcatcattgatcacgctgaattaattttgtcaatttaaattttactcattttgtagatttgttggtatttaatttgtatattttttatattgtggttgtgtaagagttacaagcataaaggttttactggtttatgtttgttaatatttaactaataagaagaatgactttagataatactgggagctctcaacagtttttaagtttgagaaccatgggtcaaatggtaatttaactcttgctgttggttgcagcaagcaccttgcatttgattttgatgtctttagctcactcctgctcatgcttcctgacctgcttagctcaggatcgtttctctctggggactctgacacctccatgccgggctggtgccccttcctcatgctgcctgcagccccctgtgtttccttctctcccagcccttcccacagtgtaatctgtgtatgggtcccaatttcctcattagccataagttgcttgagagtggggaacactgtcatctttttatttgcagtgattttcagagctcttgtcataaaataggctcctaataaatgtatgggtttccttgtttttgtttaggtagtaataaattacctgtagaatcaaggagagaaagaggcagaaataacttggagccaagtcacaaggcaagaagaagcttcctaatattttaataactaatgtgttcctcagctcactttctaactggtctaaccaaaacccaagtcttactgtcaggtaagtgaagtgaggacaagaaacgcaaggaaaggaagtaatgattgtaatagaatgcatgagggaaggctggtatttttcaagtccgaatgatggctccttggtgctctgatggagaacaaggtcagagatttctgtcttagcagcctcgatggcaagcgctgtggtgaagggatgcttttattttgaagccaagtccagagaatagctcctctccccccattgctgaggtcttgggtgggagaattgagcctagtaaatccccagagttatctgctagattcagtttccttaattctttgcaaagtcatctgaagagtatatatacatactctgcacctggattgaagttgcctcctccaattccttaggcccagattttgtttacaattgaggtttgtttgaaattatctgcaaatttcaggtctgtgtttttgattagactatctcagaggtggaacgccactgactcaacagagaaatagccagctcctcctagtggaacttttcttaaaacctcattggttttaggaggaaaaataccatttgtttctttcataagcacttaatgggaacaagaatcttttattgtgactttcaaaaaaaaaaaaaaagccacaaacacaggggtaaattgaccagtcttaccctgtgaagtgaagcaaagaaacattacatttcagcaaattaaaaatagttatcaggctttcatcaaggaagaggaagaatcttgtcaacttaagtggaattgaacataaatttcttaattttatatttgattatattttagggggttttaaatattttctgacaaggtcatggtgcccctagttgatgacattgattgattggaagctaagtatttgatttgtcttttttttctttttccataattagtgtgttttgtagcattctctccatacatctcctgtttggtgcttatttcatgagagaaaggacctcatgctgagggtaaatgggaaaaaagtgcactttatcaggtcgcctccactttgagaagcttatatggtccatatttggcatgagtagacttagctctctgggcttagagatgttttagaccaaaggaaagcattcttagactttcttgtccccctgacaggtaccatgtatagctacttttgtgtggtttaaaatgagctttgttttaaatgttaacaatcttggagctacaggggtttctatcaacataaaatcagtcagaattttatctgttttatttttcttctacaacagccttgttgctttttttatgtatttattttccatacatttgttcagtacatatttatcatgctcctacaatgtgccaagtattgtgtgagtttgtgggtttcaaaatatgctcagcaaactaggtcctgagatgtgtcagctaggatgtgtttgattgcaagtaacaggaaagccaaagaatggtgttaagggattaagcaaaaagagcagttccacatttggctccttcattgcctcaactatgctgtgaggacacggggctgtgattcttctttgctgtttgcagtatgttggccagtcccctcaggtttccttatccctgggtctcaaggtgactgttaccgttctgagtatcacacaaagactactatgtcagatatggaaaaaagtgaactcatttaaaactgaggaaaactgagaaaccttttgttgaagttcagttctcatgccctatatttccataatatacctgttcctacagtttgataggcgagcaaaagtaaataccatgactggtctgtactagccattcccaaaatgtggctgagggcccagggtccccgagacccttttaggaggttcacaagggtaaaactatttttataataatgctaagctgctatttgccttttcgactcgcattcgctcactagtgtgcggtggcgttgtcaagaggttacatgatagatgatgatgacctctctctgacagctaatggaatgtgtgtttgtatattttgtctttttaattgttctcagttttagtttctggtggtaaatatctatctatctatctatctatctatatctatatatatatagatatatatatatatacacatacatacacacacacacacatatatatataaataaaactctttggggtcttcagtaacattgaaggatgtaaatgggccctgagaacaaaacatttgaaattacctgctctgtgtgaatcaagattcacccctggcactggcggatatcccagtctccctaagacatatggccttgagattcctggacaaaactcttaacaaagaggaaatggagagcttagggctgctgggtgggcaactagcagtgtgtgcagccctgttctgagggggccctgaggagacagcagggcagggatgcagcatgttctccaggccccacctctgctgggccagccaggactggagccactgtaggtttgtcatttgtgtgttgttggttttttaattgtggtaaatataaataagattgtaaccatcttaaccacttttacatgtaattcagtggcattgattacattaacattgtttaaccattgccgccatccatccccagaactttcccgttatcccaaacagaaactctacccattaagcagtaacattccattactgtctcccctcatgaattaatttgcctctgtgaatttgactattgtaggtacctcatctgtgtggaatcaaagaatatctgtccttccgcattttgtctgatttcacttagcatggtgttttcaagatttattcctgtatgtatcagaattacattcctttttaaggctgaatgatattccagtgtgtgcatatgccacacttcgtgtatccttttctccactgatggatatttgagttgttctcacttttggctgttacgctgctatgaaattgggtgtacaaatatctctttgaaaccctgcttttaattcttttgggtatatacctagaagtgggattgctggatcaatggtaattctatgtttagttttttcaggaaccaccatactgtttttcgtagcagctgcgccattttacattcctaccagcagtgcacgagagttctggtttctctgtgtcctcatcaacacttgtcgttgttttcttgatagtagccgttctaagtgaagggagatggttttctgtttgtttttaatgaattaggatgcattgccccagcctgtcacccagcgtctcctccctctttgttatctttcttcagacactgctcaagtgttttaatgcttttacttccttctgctctcatgaattgtgcttggtgagctccatattcttgtaaggtacattttccatgaagtttttgaatatatccttctcctaaaggatagaattcaccaaaatgaggaacctttagtcctgaggtaatactctttgttgcctgctgtactttgaatctgagccatgttatctcggtgactcagaccatgagcccctgtggacagtggtgtatctttgtatcatggctatttgagttcataaaatagtacttaacaagcaaccaaactcttgagcaatttatatgtgtgagaagaagggcaatggcagtggtcctaagctgatgccattgtgaactggttccttttcagtatcttggatgtttgcatggccccatggctggtttcccttggtactttatcccagcccctcacctcttcctgcttctgaaggatccgctcccacctggcaggaaacagggacaggatcaagcatgtgtgggtccttcactggacactgccttctgttccagcgtctgcatctctctgctcatacgactttgctttagtcccctctgcataggaatttctgaaggtctttatttaatttctttattttctcctggaaatacttactgagggatctaacagcttctgttgtttttagtctgcatacgtggagaaggtgaaatcatggtttgttttgattccttagggactgggtaaatgcactaaaagatacattatgcaagaaatggaaaaagtggatttccttctgatttttcatgccaattgcttttgctgcattagtatatgctgtgcgtgtatgcacaaaatacttgttaacatcctgagttttcaggaaatatgttataaaacatttaccttttttatttcttaaaaatgctaaacagtatttctctaagagctagtaatgaaatgaatttaggtacatacactaggcagaatcataagaaagtcaaggacttacatttggagcaagataaaggattttggtattgagcaaaaaatatagtcagctgtcaattgtctaataggtttgtagattacctgcgataaaaaagtagtacatctgtgaaaaaagttgaaattaccataaatctgaagaatcagccccatttttcaaggcatgcattttttggagctgcacggaagccaccttatatgtctgcttcgggtgacactgtcttattcctccgtgaataatgaattgaacgtctctccctctttgtgacaaagccctctggggcaaagcagtagccgtacaggtaagatagggggtccagacagcaggttttggattttcccctccttagagccaggactggaaaaatggagtcattatttgaggactggaaggaaaaggagggagcaagtgctaggactgttatctctgcccatcctggtgggtggttttaatatttccagacagagaactcagttaaaaaaacaaacaaacagaaaatacatactatttcaacaatttgcaaaattttgttgtattcatcaagtactgtccatctttattcacatttataaactataatactttttccttttttctttgcctgtggggtgatgtctttatggtaaatgtgtatctggaagttttttttttttttttatattttaagttctgagatacatgtgcagaatgtgcaggtttgttagccaggtatacacgtgccatggtggtttcctgcacccatcaacctgtcatctacattaggtatttctgctaatggtatccctttcctagtcccccaaccccctgacaggccccggtgtgtgatgttcccctccctgggtccatgtgttcgcattgttcgactcccacttatgagtgagaacatgtggtgtttggttttctgttcctgtgttggttgctgagaatgacggcttccggcttcatccacgtccctgcaaaggacatgaacttagccttttttatggctgcatagcattccatggtgtatatgtgccacattttctttatccagtctatcatttatgggcatttgggttggttccaagtctttgctattgtgaatagtgctgcaataaacatacatgtgtgcatgtgtctttatatagcaggatgatttataatccttatatacccagtaatgggattgctgggtcaaatggtatttctggttctagatccttgaggaatctccacactgtcttccacaatgattgaagtaatttacactcccaccaacagggtaaaagcgttcctgtttctccacatcctcttcggcatctgttgtttcctgactttttaatgatcgccaattctaactggcgtgagatggtgtctcattgtggttttgatttgcatttctctagtgaccagtgatgatgaacttgttttcatatgtttgttggctgcataaatgtcttcttttgagaagtgtctgttcttatcctttgcccactttttgatggggttgtttttttctcgtaaatttgttttaagttccttgtagattctggatgttagccctttgtcagatggatagattgcaaaaattttctcccattctgtaggttgcccgttcactctaatgatagtttcttttgctgtgcagaagttctttagtttaattagatcccatttgtcaattttagcttttgttgccattgcttttggtattttagtcatgaagtctttgtccatgcctatgtcctaaatggtactgcctaggttttcttccagggtttttatggttttaggtcttacatttaagtctttaatgcatcttgagttaatttttgtataaggtgtaaggaaggggtcctaattcagttttctgcatatggctagcagttttcccaacacaatttattaaataggggatccttttcccattgcttgtttttgtcaggtttgtcaaagatcagatggttgtagatgggtggcgttatttctgaggcctctgttctgttccattggcctatatctctgttttggtaccagtaccatgctgttttggttcctgtagccttgtagtatataatttgaagtcaggtagtgcgatgtctccacctttgttctttttgcttaggattgtcttggctatatggacttttttttggttccatatgaaattcaaagtagttttttctaattctgtgaagaaagtcaatggtagcttaatggggatagcactgaatctataaattactttgggcagtatgaccattttcatgatatctattcttcctatccgtgagcatggaatgtttttccatttgtttgtgtcctctcttatttccctgagcaatggtttgtagttctccttgaagaggtccttcacatcctttgtaagttgtattcctaggtattttattctctttgtagcaattgtgaatgggagttcactcatgatttggctctctgtttgtctgttattggtgtataggaatgcttgtgatttttgcacattgattttgtatcctgagactttgctgaagctgcttatcagcttaaggaaattttgggctgagacagtggggttttctaaatatacaatcatgtcatctgtaaacagagacaatttgacttcctgtcttcctatttgaatatgctttatttctttatcttgcctgattgccctggccagaatttccgatactatgttgaacaggagtggtgagagagggcatctttgacttgtgccagttttcaaaggaaatgcttccagtttttgcccatttagtatgatatttgctgtgggtttgtcataaatagctcttattattttgagatacgttccatcaatacctagtttattgagagtttttagcatgaagggatgttgcattttatcgaaggccttttctgcatctattgagataatcatgtggtttttgtcattggttctgtttatgtgacggattgcatttattgactggcatatgttgaaccagccttgcatcccagggatgaagccgacttgattgtggtggataagctttttgatgtgttgctggatttggcttgccagtactttattgaggattttcgcattgatgttcatcagggaattggcctgaaattttctttttttgttgtgtctctgccaggttttggtatcaagatgatgctgacctcataaaatgagttagggaagagtccctctttttctattgtttggaatagtttcagaaggaatggtaccagcttctctttgtacctctggtagaattcggctgtgaatctgtctggtcctgggctttttttggttggtaggctattaattactgcctcaatttcagaacttgttattggtctattcagggattcaacttcttcctggtttagtcttgagagggtgtaagagggtgtatgtgtccaggaatttatccatttcttctagattttctagtttatttgtgtagaggtgtttatagtattctctgatggtagcttgtatttctgtgggatcagtggtgatattctttatcattttttattgtgtctatttgattcttctctcttttcttctttattagtctgactagcggtctatctattttgttaatcttttccaaaaaccagctcctggattcattgatttttttgaagggttttttgtgtctctgtctccttcagttctgctctgatcttagttatttcttgttttctgctagcttttgaatgtgtttgctcttgcttctctagttcttttaattgtgatgttaggatgtcaatttagatctttcctgctttctcttgtgggcatttagtgctataaatttccctctaaatactgttttcgctgtgtcccagagattctggtacgttgtgtctttgttctcattggtttcaaataacttctttatttctgccttcatttcattatttacccagtagtcattcaggagcaggttgttcagtttccatgtagttgtgcagttttgagtgagtttcttaatcctgagttctaatttgattgcactgtgatctgagagactgttatgatttccgttcttttgcatttgctgaggagtgttttacttccaattatgtggtcagttttaacagaagtgtgatgtggttctgagaagaatgtatattctgttgatttggggtggagagttctgtagatgtctattaggtccacttggtccagagctgagttcaaatcctgaatatccttgttaattttctgtctcgttgatctgtctcatatgacagtggagtgttaaagtgtcccactgttattgtgcgggagtctgagtctctttgtaggcctctaagaacttgctttatgaatctgggtgctcctgtattgggtgcatatatatttaggatagtaagctcttcttgttgtattcatccctttaccattatgtaatgcccttctttgtcttttttgatctttgttggtttaaagtctgtttcatcagagactagcattgcaacccctgcttttttttttctttccatttgcttggtaaatattcctccatccatttattttgagcctatgtctgtctttgcacgtgagatgggtctccttacagcacactgatgggtcttgactttttattgaatttgcaagtttgtgtcctttaattggggcatttagcccgtttacatttacggttaatatttttatgtgtgaatttgatcctatcattgtgatgctagctggttattttgcccattagttgatggagtttcttcacagagtcgatagtctttacaatttggtatttttttgcggtggctggtactgggttttcctttccatatttaatacttccttcaagagctcttgtaaggcaggcctggtggtgacagaatctctcagcatttgcctgtctgcaaaggattttatttctccttcgcttatgaaacttagtttggctggatatgaaattctgggttgaaaattctttaagaatattgaatattggcctccactttcttctggcttgtagagtttctgcagagagatccgctgttagtctgatggacttccctttgtgggtaacccgacctttctctctgactgcccttaacattttttccttcatttcaactttggtgaatctgacaattacatgtcttggggttgctcttctcgaggagtatctttgtggcattctctgtatttcctgaatttgaatgttggcctgtcttggtaggttagggaagttctcctggatgataccctgaagagtgttttccaacttggttccattctccttgtcactttcaggtacaccacacaccaattaaacgtaggttttgtcttttcacatagtcccgaatttcttggaggcttagtttgttccttttcattttttttttctctaaccttctcttcatgctttatgtcattaagctgatctttagtctctgatatcctttcttctgcttgatcgattcaactattgatacttgtgtatgcttcacgaagttctcatgacgtgtttttcagctcaatcaggtcatttatattattctagttagcagttcctctaaccttttttcaagattcttagcttccttgcattgggttaaaaaatgctcctttagcttggaggagtttgttattacccaccttctgaagcctacttctgtcagtttgtcaaactaattgtccgtccagttttgttcccttgctggagaggagttgtgatcctttgcaggagaagaggcattctggtttttggaattttcagcctttttgtgctggtttttactcatcttcatggatttatctacctttggtctttgatgttagtgaccttcggatggggtttttatgtagacgtcctttttgttgatgttgatgctattcctttctgtttgttagttttccttctaacagtcaggcccctctgctggagtttgctggaggtccactccagacgctgtttgcctgggtatcaccagtggaggtttcagaacagcagatattgctgcctgatccttcctctggaagcttcgtctcagaggggcacccgccagttgccagccggagctctcctgtatgaggtgtctgtcgacccctgcttggaagtgtctccttgtcaggaggcatgcgggtcagggacccacttgaggaggcagtctttcccttagcagagttcaaatgctgtgctgggagatctgctgctctcttcagagccagcaggcgggaacgtttaattctgctatagctgcgcccacagccaccccttcccccaggtgctctgtctcagggagatgggagtttgatctataagctactgactggggctgctgcctttctttcagagatgcccagcccagaaaggaggaatctagagaggcagtctggctacagcggctttgctgagcgaacatccctgcggctttgtttacgctgtcaggggagaaccgccttctcaagcctcagtaatgggggacgcccctccccccaccaagctcaagcatcccaggttgacttcagactgctgtgctggcagccagaatttcaagccaatggatcttagcttgctgggctccttgggagtgggatccactgagctagaccacttggctccctggcttcagcccccttttgaagggagtgaacggttctgtctcgctggtgttccaggtgccactggtgtatgaaaaaactcctgcagctagctcggtgtctgcccaaatggccgcccagttttgtgcttaaaacccagggccctggtggtgtaggcacccaagggaatcttctggtctgtaggttgcgaagaccatgggaaaagcgtagtgtctgtgctggaatgcaccattcctcacggcacagtccctcacggcttcccttggttaggggagggagttccccaatccattgtgcttcttgggtgaggtgacaccccacctggcttctgctcaccctccgtgggctgctcccactgtctaaccagtcccagtgagatgagccgggtacctcagttggaaatgcagaaatcacctgccttctgcattgatcctgttgggagctgcagaccagagctgttcctattcggccatcttgccagcctgtggaggttttaaaaactattttttaattgtagaaagtaacatattgaaaagcatataaatacgatttatactttggtgagttattaaaatgtggatagatagtcattgccacacaggtcaggaaatagaatattgccagcatcttggtgccattcttgcacaccttcccaatagcacatcttcctttcctctaaagcagggttccccaagccccgggccacagaccggtaccagtccgtggcctgttaggaaccagaccatacagcaggaggtaagtagtaggccagtgagcatcactggttgagctccgctccctgtcagatcagtggcggcattagattctcataggggcatgaatcctcttgtgaactgcacatgcaggggatctaggttgcacgctccatatgagaatgtgactaatgcctgatgatctgaagtggaacagtttctcatcccacaaacacatcccccccatccctgcccccgccctggtccatgaaaaaattgtcttctgcaatgggagatgggtgcaccagaatctcacaagtcaccactaaaggacttaccgtgtaaccaaataccacctgttcccccaaaacctatgggaataaaaaattttttaaaagagaaatatctgaaacagtaattactgagaattttccaagttaatgtcagacaccataccactaatacaggaagctttcttattttgaatggaagccggaagaaaaatgcactttacctgtagaggagcagaacattcaacttctcctcagaaaccatgtaaggaagaagagagtggagtgaaatatttaaaaatattgatttaaaatgttgagagaaacaccttacattattaagaacatgagctcagatacctctagggatctagattaagagagcctttgaatgactgagttctacctgtcaagactcagattcccagcagggtcagatatgcccaacaggtgtgatcatcccacatgtggccgatggcacagggtactttaattaaccagatgctggcagcagccatcacccacactccctggtcatcacaactacagcaccatgttttcacccctcccagccccagaggttgtggagcagcatattgaggatcagtgcactgcatgattcctaaagctgtttgcatttaaaacaatcagatacatttctattgctgagcgaaggttgtttgcctttttttcttttttagacagtctggctgtctcacacaggctggagtgtggagtgcagtggtgctatcctagctcacagaggccttgaactcctgggtccaagcgatcctcctgcttcagcctctagagtagctgggactataggcatctgctattatgcatggctaattaaaaaaaaaaattttttttttttagagatggggtcttggtatgttgcccaggctggtctcaaactcctggcctcaagcgatgctcctgtgaccgcctgccaaatgctgggattacaggcatgagccactgttccaggcctgcatttttttttttttttttttgagacagagtctcgctctgttgcccaggctggagtgcagtggagtgatctcggctcacttacaagctgtctcccaggttcatgccattctcctgcctcagcctcctgagtagctgggactataggcgcccaccaccacgcctggctaattttttgtatttttagtagagatggggtttcgctgtgttagccaggatggtctcaatctcctgacctcgtgatccgcccgtctctgcctcccaaagtgctgggattacaggcgtgagccacggcgcccagccccgggcctgcaattttatttgaataaaatgtttgtctcttttatcaaaaagttcttcattttactgggttcccaaatatctaaactgatctgcatctagtgccatatgaaatatataagaaattcatcagtttgttagtttcttcagtttctttgtttcttttttttttcttttttttttttttttttttgaatcagtctcactttgtctcccaggctgcagtgcaatggtgcggtctcggctcactgcaacctctgcctcctgggcaagtgattctcctgcctctgcctcccaagtagctgggattacaggctcctgccactacgcccagctaatttttgttattttcagtagagatggggtttcaccatgttggccaggctggtctcaaactcctgacctcaggtgatctatccacctcggcctcccaaagttctgggattacaggtgtgagccactgtgccccgcctcttcagtttgtttctttaaggacacagactttagagccagaccctggattcatattccacaatcatagctctgctgttaactagcagttacttcctttcagtttttacataatcttactttgggcaattatgtaatctcttggtgcctctgtaaaatggagatgataatagtacccatttcatagtgttgctgtaatgattaaattagtatgaataaagtatttaatatattgccaagagcatagtgtaaatgtatgcaagtataaactattattatatttataaaatgagatattactaattaaatttcacacaggcaacataaaaataccttaaaattttttttggtggggaattaccttttaaaaattaaattactggctgggcacggtggctcatgcctgtaatcccagcactttgggaggcagaggagggcggatcacttgaggtcaggaggtcgagacccgcctagccaacatggtgagaccccgtctctactaaaaatacaaaaattagccgggcgtggttgtgtgtgcctgtaatcccagctatttgggaggctgaggcaggagagtcgcttgaacccaggaggtggaggttgcagtgaaccaacatcgcaccacttaactccagcctgggagatagagtgagacttcgtctaaaaaaaaatacataacataaaaataaaattaaattacttcatctggagaagcgttttgctgtggcatttagcttagaactgtactatgaggaataccggtgaattattcattccttaattcagtattttttgagtgtttgccaggcatatgctgcattctaggaagacagggaatttacacaccagtagaggaagcggtaactaagtgaacgaataaagcccaggataattaactggaatcagcagaaaggatttgttgtgtgcatgaagcagatgagaggcatgggctggaccgtggtgagctggggagagaggaaataagggctgtcagagacggtgctggagccatgttttgcagggtcttcaagactccagcaagcagctgggagtatctacggggagtttaagtttcttttcaaggaagcgtgaagagaggttttacccaggggaatgtgctggtctcatttacatttgctaaagttttttctgtctactgcatagagaatgaattggagacgggcaggcccagcctggcagtagacaagtgcaacactccagggctaggctgaggggtggcaatgaggtggaaggaagtgcatgcagtcaagtcggatcacacacatttattttggtggtagacttgacaggtggtgatgatagcttggatgaggaagacaatgaggaggcatggacattatctagatttttggctaagtgccattttgacagttgcatatattccctctattattaaactttcttttcatttagacatgatccttctcaaaactgtaaatgttctagtgtgtgtgctgcccaagtgaacatgaagactgcacattttttaggtattttaaaactttcccgatctagatttttttgcactgcagccaaattgtacagtcgtttcaaatttcttctttagtaatgggaacctcctttgttgatatcttgggtatttaattgggagcattttacctgttaattatggttgttgaggattttaaactcactttatttaccactagtcttttgaaattacattgctgaatatcctgcctgccctggggagtgtcagagcctgtgaaggcctgcacctgttgagaggcagccttccctcctctgcgattcctgcttctggcttccatgggtgatgaagggttgtgggatgggaggggcagctggagccgctgagccagctccacctgagtctcactgtgtaactccattgttctttttagcatggccttcaggggtaggaagtcaggcttatgagattttatctactgtcactgggactagtatacctcctcagtaagtggaatttattattattttactaaaatatggtttcttcgtgtgaatgaagtgagatcaagcatataaagcaatctttagttaaaagattgcttaaattgttacatgtggaataaattattttacttttttctaagaaatgaagagaaactgggaaaaaaattcgttagacagtaatgcatagagatttttttacacctaaatgagaagccagaaattcatataaaacataagaacttcaaaaacatttcttaggcacagactattattaaacactcatggatgttttttattttctattacattaaaatactcaagtcaacttcatattcagaacatttaaaaatagctcaatcttaaaaagaagatataaagtattatcagctgtgctttttgtgcataattagcgtgtgcctgtggaggtataaagacttctagcctaatgatagtatcatgataaaaagttcagatggtaaaaattggagctccagctggatgacatattttataacaattcaaagatggctccagcatagaagccatgctattttagttctttgtaatccctccttcacccatcaatgggtcgtgaaggcactgataaaagagccttttagaaatgcttctatttgttccctttcttacagatttaatgtgtgccgaccatttccttcagtgctggacaggctgctgtgaagggacatcaccttttcgctttttccaagatggctcaagattcagtagatctttcttgtgattatcagttttggatgcagaagctttctgtatgggatcaggcttccactttggaaacccagcaagacacctgtcttcacgtggctcagttccaggagttcctaaggaagatgtatgaagccttgaaagagatggtaagtagtggaccagaataatgaaattattttctgacttcagggactctaccagatttcaccaagacagaatgccacccagaatcgggacttgtggtattgactgaagtgccgatggattaggaagacaaattactcaagagctggtttcctagtctccgatttattatattattataatttcttcttgagtagctgtattgttacatgacacttcctgaccaagcaagttgttcttaaataatcaagatttcatgcttgttgtcaagtagtaaatgggattcttttgaaggcctttgtgtcccttgaatcttggagaatttgctacatgcttaacccttcttcaaccctcttgtcaagtgggctgtcctaagagatgatagatattaagatctcttcttataatactttttataaatattaagattttgagtatctttactattatataatttattattttcaaaatttaatatattttcattttgatgtcatgtttcttttattatgatagatatttttatgatttagcacatgttgttatattatgagctagtattttgtatttaatttcaaaatgaaaagcaaaattgtcacttaacaaagtgttcttgtgttaagcttttcttcccttaatcaaagagtaaataggaaatttgaagaataatttgtattgataatatgagttcatatgtctttagaaactataaggaaagatacagtctgtgtgaacaaccgatgctaatttttagaattgtttttttaatgagacatacgtaacttgacctttatatggtcccaaaaagtgtaggaccaggcttgatgctgggacacatgtgagagatgttttgctgcagtagcagaaagtgcccattgtgtcggcttacctgcatgttatcctagtttgcttttatttttgaaattttatgaaaggtaacaagtggaaaaaggtccggttgtacaatagcatgcatgtgtgtttttaaatcttaagctgttttctatttggttgatcctttttctatttcagggtttagattgttacagactatgatgtcatttgccatacagtactcaaaatagtaataaacagatatatacatttatgctttggctgcttttatttctttttacaagttccagagttctcatccctttaaaccttcttctttgaaatagtcttactggagctgagttcgtaacctctcttatgttagaataaaaaaaccaggataaagatacgggattatatagttattaatcaccaataatgtgttttcaactcttaagcagtctttattatttttaaataaagtagcctttactgactattaagtatgagtagaattaattttgcaacacaattgattttacctatgtcatacatcttagtttggtgaccccatttaaggatgaagtaagttggttggttgctttttaaactttatttgaattacttacctaaagatcttctctaatccttttgtgcttacttttaaaaatggtatactaaacaagaagcattcacgttccctcaatctataatgtcagttcagtatttctaagttgcataatgcctttactgaccaaaatttatttttctttcacaggattctaatacagtcattgaaagattccccacaattggtcaactgttggcaaaagcttgttggaatccttttattttagcatatggtaagaatcaaaaacgtgtcctctcaaaatggctattttaatctttgcattgtttcacagaggcttacattatgaacctttctcctagttttttttttttaatggaacaacttatcaaatgtattcattgttctattacaaagatggcttcctatactgttgtccatgtatgtgtgtgtaggtttgtatagataaacacacacacacacacacacacacgcgtgcacgcacccatgcagatcttcaggaaaatagagctcttcgtattagaggacagaaactcccagatgatttaaatatctacttttgcctgtaatcactttcataacttcattttaaattcaatataaaatggctatactaatgataccgagttaattttgtttcacggtttcataactcacacactctttcccatgttgtaaagtcattcttcagagtgtgaatcctgccgtgactttgcctttgacattggctgctttgaccttatttaagggtgccattttggttttatccaaggtggagatgaatgtgggggcactttggggaggtattccttcactgagctcctgtctgctgtccagtctcatttcctgtttcatctttcacagctatacctcatggtggtagccaggtcctattactaacagtgcctgaaggcactttgtgtcaggattcctttcacactcattctcctttgaaatagccttactggcctgaggtaggagctgctgggagtgtctccatggcctccagcatctccctttaatacacttacttcactgtctgatgccctgggaagacagcatgcctctcgagaacaggaaccatggttttagttctctttgttgtcctagggcctcccaaggaacatggctgaggtttgctttggattgactgtattattagctaatgtaatatttacttttaagattttttaaagtcaaagactaattgcataatataatgacattagaacccaaaataaaatgaatattcccctttgatgttttaaagaatcatgcagtttcccatttataggttgtcataatcattattggaagagacgtgaactaggcaggaaagggacaatatgtgtgtttagccctgtgagcaggcgtgcgtggacgcccacacactcagcctccctcactctaccccaccctcgtatgtccctcctccttcccactta

SEQ ID NO: 156 - DNA, 2121 bp, Homo sapiens; identical to SEQ ID NO: 107

SEQ ID NO: 157 - DNA, 71540 bp, Homo sapiens
gcggccgctgctcgcgctgaggtgcgtcggtgcccggccccccgcgcccccgcgcgccgcggctcctgttgacccggtccgcccgtcggtctgcagcgcggctgaggtaaggcggcggggctggccgcggttggcgccgcggtcgcggggttggggagggggccgcttccgcggggaggagcggccgggccggggtccgggcggggtctgaggggaggtagcgcgggacgggcgccgggtgcgggagcctcgccctcgggggaggggacccctccctaggccagcagcgagtcccgggccggcgtccagcggtcggctggggcccccgcagtgccctgcaccggccctccgtttcccccgcgctgccaggccccggctgtgcccagcgctctccagacccgccgctgcctggccgttccctgggctccgcgcacgttgcagcccggggggcggctgtgcttcgtttgaagccatcgtttctcattttccctctcccctttcctcctttgtggtgggcatcgggcttcggctgggaatgtggttatgccctttgccagatggcgataggaaaggtcatcgcttggcgctgggggagccgagggctcgaggcctggaaagaggggtgcgataggaagggagggggcttgttggatgctggccaggtgtgaggaaggctggtgtggtctcggcattcagccgactgggattactcgggcagccatattgggaggatgatctgacaaatcctttaggagccaagtccagttgttggaaggcaccgagtgacagccctggcagctttcagggtgactggccagaccagaagccaagttgtgggggttgggaggctgcttgagcaagctagtcattgttcatgcaacacaaaacattcccgcccctaacgccagaatggagcttccagatccctttttttttttttccttgattgctaaatgagcttccaaggtaaactgccttcaagattccattcttgttggggtgaaattccgtgtttctctattcatcttctgcgtccagtgcgggggctgtgaaaggcctgctgatgctttacatgtgcataggccgatctgagaattgctaaggccactgtatcagtatggaggcctcgagtagccgtagagcattggatggatagattttcagagtcgctcgacttgcagagaagaagtaaaccagagtattctgatagtgggcgaggctagtggcggcatttctgaggacgcaggctgtcatctttgtggaatctcgaggtagctgaaattagattgtcaacagatcccttgctcatatctcttactgctctgagcagctgttctgccaccattgaacattccgctttgtgtcatgatgtgcctgtctgagcctgatgaaagtgtgctgatgagatttgaataactcttaagaggtgatatcatggtggatattttatttaaaggctggcattttgtctccttagtttagtcataacaaaatctagttcttgtgttcctctaagaagtgaggtggtgctttctgattaagttgatatggttgctggattatagagcaagtgttgttaatgtattgtttgaaggtggaatatgagaattacacataggttggtattgtaaagcaggtctggagatgatcaataactgggttcagcatgagtctgtagatctgttcttttctatatcctagatgtggacaggacctggagagatggcatgcctgctttcttctttgtggcctttgctttcattcaagttcaatttgttcataaatacattctcataacttctcaggttgaactatgtaaaaaattttgggatgggtgtggtggctcatgccttgtaatcccaacactttgggaggctgagacaggaggatcccttgagctcaggagttcgagaccaccctgggcaacagagtgggactctgtctctacaaaaataaatgaataaataaatacctgggcatggtggctcatgcctgtattcccagctatttgggagactgaggtgggaggattgcttgaggctagcctgggcaacagcaagaccctggctaaaaaaaaaaatgtgtatatatatatgtgtgtgtgtgcatgcgtgtgtgtatatatatatatatatatatatatatatatatatatatatacacacacacatttaaaaaatttggatagcttttgctaagcaaggtcttaacactatttttttgttatttttgtcatcaagctttagttttaaaacttgttgaatcaaatgtaacttcaacagaaactagtgttttttgcattacactagtatgagagaaatacagaatgtctgttttgaaattccatgccctaagttagaagtatttctaagtttttaatttttagagttactttattagtataaagatctgaatatttttgattaaaaataatttcagcatttggtaaaatcagacctgattgtgaatctgatacagaggctaggttttatgagtatgtgtagctctgctctgatgagtgtttttccaaaatttatccaattaagtatagcttttaaggcttagaacagactgtttttccttttcaagaccagatatgaatgcacttttccttttttctctctttcttctttcccattttgatttcgtgcagggaataagtgtccaagaaagtctgccaacggagtctttcttaaggccaaagctttttagcccattttctcactgtggtcttgtcctgggtacaaagtaaaggacaatgggccccctgccttcctgtttgtaatccccttcccaggctgctaatcatagtagatcttttccaggaggaagcatatccttttggtcttgtaaactaacatgatataatttcataatgctctgaagttattttatgtctatttcatgtatttctctttgaaagatggcctcgtttgaacaggtactggtgaatatctggattctgtgaaacagtgtgaataaatatgcatacttcttgaactttttttgtgcagcttgtcaggatagaagagaaattaaacagatgtgactgtggtaggaaaaacctgcaaaaggtgccttgggccggatgcagtggctcacatctgtaatcccagtgctttgggaggctgaggcgggaggattgcttcacatcaagagtttgagacaagcttggacaacatagcaggacccccatctctaccaaaaaaaaaaaaatctggatgtgggtggtgtgtgtttgtagtcctagtgcttcggaggctgagtggggaggatggcttgagtttgagattacagtgagctaagacagcgccattgcactccactctgggctcagactttgcctgctaaaaataaaaagatgccttggacttctcagagttgaactgtttggttaacgggccactgattcattgatgctcttttactataggcattacccattaactgagggtgcatgtagagatttagttctttaccttccaggaactcacactttaccacttctttctttctttctttcttttttttttttaagacagagtctcgccctgtcacccaggctggagtgcattggtgtgatctcagctcactgcaacctccgcctcccgggttcaaatgattctcctgcctcagcctcccaagtagctgggattacaggcacctgccaccatgcccagctaatttttgtatttttagtagagatggggtttcaccatgttggccaggcaggtctcgaactcctgaccttctgatccgcctgccttggcctcccaaagtgctgggattacaggcatgagccaccgtgccctgcccttttttttttttgggatggagtcttactctgtcactcaggctggagtgtagtggtgtgatcttggctcactgcaacctccacctcctgggttcaagtgattctcctgcctcagcctcccgagcagctgggactacaggtgcacaccaccatgcccagctaatttttgtatttttagtagagacggggtttcaccgtattggccaggctgatctcgaactcctgaccttgtgatccacccacctcagcctcccaaagtgttgggattacaggcatgagctactgcacctgggctaccatttctatatagaaatggtgagataaagttaactccaactccttttcattttagtacaatttagtatcctgatatggtttccgtgatttccagtcagagcattttcaaaattctttgtaatgttgtatgtacataatactgtacttattatctaatactcaattggtacttttacatttgtcttgtggttttttgtatagtgtttgaagtcacaagcttgtaaatgtttgatggatttaaaaatttatatattttatatatatatatatatatatatatatatatatatttttttttttttttttttttgagacggagtttcactcttgttgcccaggctggagtgcaacggcgcgatctcggctcaccgtaacctccacctcccaggttcaagcggttctcctgcctcagcctccctagtagctgggattacaggcctgtgccaccacgcccagctaattttgtatttttagtaaagtaggggtttctccatgttggtcaggctggtctcgaactcccgacctcaggtgatccacccaccttggcctcccaaagtgctgggattacaggcatgagccactgtgcccggcctattttttgtatttaatatcacattgtttataccaaagcatatcattcaaccatactaccctctaccattgcccgtttttttccccttgagacaggctcttactctattgcccaggctggagtgcagtggcgcagtcatggctcactgcagccttgacctcctgggctcaagtggtcctcctatctcagtctcctgagtagctgggatcacaggcatgcgctaccatgcccagctaatttttaaatttttgtagagatggaggtctcactatattgcctattgcccagcctggtcttgaactcctgagctcaagtgatccacctcagtcttccaaagtgggaggattaaaggcatgagcccctgtgcccagccccattgctcttttggattactatattgttggcttagttctctctttcatccagatttttgacatcatcttggcagatgtcaatgactatgtaaataaacaataacagaaacaacaatagtgataaaatagcttattcatattgagcactttctgtgtgccaggcttttttctaagcactttacgtttattaactaatttaaccctaatagcagccatatgaaataaatactgttattcccattttacagatgaaactaaaacaggccaagtgacttccccaaaatcataagtactagtaagtaaccactatgctgagtttcctttgtaactaccgttaactgtgaaatttcttgaattgagctcaagcaaacattggcttcattctgttccagttgtttagtgttatggccacatttttaacttgtcatcatgttaaggtctcaaattcaccttcaagtcttaaactgtgataattgatagctttcactttcataatcactttatgtgtgttctcccactctaagtctcctaaaccgtcggcctcttccagattttacttcttttccttccttttctatactacgacctctgggttgcattgcttgcagtttttattctttcttattattcttcaggacttactatgcagaagccagcctcacatcatccctaccatccataccctccattcttactccgtgtcatggagaaacctgcatagtgctggggattagtgccacaattaatgtgtagtccgaggtctcccttaaatctgtctttggtccctgtcggagcagttctgcttagctccctccccatttctccacagttgctattataaaatctggaccccttgactcaaacctgtcactgccccatgcttggcagaataccttgcctgccacctcataggaaaaaagggcatgaactccctgagctttcccttcctctacttacaaacttctctgccctctttcttctgttctttcccccagtgtgagaaagaggttactctgtcttggcctctgttagggatagcactgttctaatctgtaggaactcgcagtattggttactcttcttttccctgcagtacttgcccattttcttttttttttttttttttttttttttttttttttgagacagagtcttgttctgtcaccaagactggagtgcagtggcctgatcttggctcactacaacctctgcctcccggattcaagtgattctcctgcctcagcctcccaagtagctgggattacaaacgtgtgccaccacgcccagctaatttttgtatttttagtagagatggggtttcaccgtgttggccaggctggtctcaaactcctgacctcaggtgatccgcccgcctctgccttccaaaatgttgggattacgggcgtgacccattgtgcccagccttttctactgttcttgaacacaccaggcatagtcctaccatagggcacttgctcttactctttctttttcttttttttttttttttgagacagccttgctgtgtctcccaggctggggtgcagaggcacaatctcctgggttcaagcaattctcctgcctcggccacctgagcagctgggattataggcacccaccaccaagcccagctaattttgtatttttagtagagacggtgtttcaccatgttggccaggctggtcttgaacttctggcctcaggtgatccacctgcctcagcctcccagagtgctgaggttacaggcgtgagccaccgcacccagctgctcttactctttcttctgcctggaatacttttcccctgaaatctgcttggctaactcctttacctctttcaagtctttgcttaaatctcagcacatcagcaggcccaccctgacctcatttatgcacctgcacagcaatccttcccaccaccacaatcttgaaccccctgactttgctgtactcccccgtgatgctgattacattctcgattctctatacctgatttattaattttaatgtcctccctctccctactagaatgtaaattcctccatgacaaggaggtttgtttatcttttttgttcacggattatttttcccaggaactgcctgttgcattgtaggcacccagtaaatagctattgaataaagtatagaaatgtgcaagtctttcctattacaaataaagggctggggggaggaaaatccctccttcgtttctgttccttccaataaaatccttcattcctatttgctctctcctgctcatcatagccaggctctgacagtgtcatggatactggcatttcccacttccgtgccaacccactacaggctggcttcagtgtcccctcctgccccccacttcatggatactgcccttgctgtggtttccagcctttattgctgaaaccaggaggcacacttcacacttttgcagtactaagtatgttactcattttgtttttttcttccttgaacttttggctacttctgtttgtgggctggtttcagtcttctgaaactgctgtttttctggctactcacatggctattaaattcattcaacataaatctttgtgcaactttttttttttttgagacagagtctcgctctgtcatccaggctagagtgcagtggtgtgaccttggctcactgcaaccttcatctcccgggttcaagtgattctcctgcctcagcctcccgagtagctgggattacagtcatgtgccatcacacccagctaatttttgtatttttagtagagacagcgtttcatcatgttggccaggctggtcttgaactcctgacctcaagtgatccacccgccttggcctcccaaagtgttgggattatacgcgtgagccacgatgcccagccgatctttatgtaacttttaaaagcttgctgtgtcgtttggttttatttgtttttaggaactagaactttgactacacaacatatttacagtgttaaatagcagaataggctattacaggaagtttttatttatttataatttataccagttactacttctagaaaggatttgagcagcttaccacaaatatatacagtgaagctattaaaatataaataagtaaaaatttatgtaacaagaaaaactaaatgtataggttgcctcggctaatgtggttattgtaatttaatttggaaacatggaatttaatgcaaaaagggaaagataaattgtacaattttcactctggtaaaagaaagcctaatagtttgtcgagagaaaccttttttcctagtattaaattctaaagatgttctaagagaaaattgttataaacatcctgatataaagatacgtacggccgggcgcggtggctcatgcctgtaatcccagcactttgggaggccgaggctggtgcatcactgaggttgggagtttgagaccagcctaaccaacatggagaaaccccatctctactaaaaatacaaatttagccgggcatggtggtgcatgcctgtaatcccagctacttgggagactgaggcaagagaatcacttgaacctgggaggcggaggttgcagtgagccgagatcatgccattgcactccagcttgggcaacaagagcaaaactccatcttaaaagtaaaaaataggccaggccttatggctcacgcctgtaatcccagcacttcgggaggccgaggcaggcggatcacctgaggtcgggagtttgagactagcctgaccaacatggagaaccccatctctactaaaaatacaaaaaaatcagctgagtgtggtggtgcatgcctgtaatcccagctactcgggaggctgaggcaggagaatcacttgaactcaggaggcagaggttgttgtaagctgagatcgtgccattgcactccagcctgggcaacaagagtgaaactcacctcaaaaaaataaaaaataaagacttactagggctggggacagtggctcacacctgtaatcccagcactttgggaggcctaggtgagaggattgcttgcgcccaatagttcggtatcagcctgggcagtgaagcaggatctcatctctattaaagataaatttagtggatgggcgcggtggttcatgcttgtaatcccagcactttgggaggctgaggcaggcggatcacctgaggtcaagagttcgagaccagcctgaccaacatggagaaactccgtctctactaaaaatacaaaattagttgggtgtggtggcacatgcctgtaatcccagctactcgggaggctgaagtaggagaatcacttgaacccgggaggtggaggttacggtgagccgagatcgcgagccattgcactccagcctgggcaacaaaagcgaaactccgtctcaaaaaaaaaaaaaaaaattaggtaggtgtggtggcatgtgcctgtagtcccaataactccagaggctgagggaggaggattgcttgagcctgggagattgaggctgcagtgaactgtgattgttccactgtactccagcctgggcaacagagtgagaccctgtttcaatagatagatagatagatagatagatgatagatagatagatagatagatagatagatagatagatagatatgtactaaatgttttcaacagcttctttaagtaaaaggaagaaatgttcttcaaatacctttacaaaataaaataaaaaataaacagggcagtgatgcatgcctatagtacccagctactcctgaggctgaggtacagccaaggagttttgaggctgccatgagcttcaatcacaccactcactccaacctgggcggtgaaaaagtgagaccccttttctttgtttcttttcttttttgagacagagttttgctcatgtcgcccaggctgtagcgcaatggtatcatcttggctcactgcaacctccgcctcccaggttcaagctattctcctgcctcagcttcctgagtagctgggattacaggtgcctgccgccaagcccagctgatttttgtgcttttaatagagacggagtttcaccatgctggccaggctggtcttgaactcctgacctcaagtgatccacccaccttggcctcccagagtgctgggattacaggcatgtgccactgtgcctagccagatagtagttaaaacatttggggagcatgactgagcctgtttagccatattggagattaaaaatctgatatgtcaggagactactcgtgtatagtctgattcttggattgggttagaatacagaaagaagctttttttttttttttttttttgacatggagtctcgctctgtcactgaggctggagtgtaatggtgcgatcttggctcactgcaacctccacctccgaggttcaagcaattctcctgcctcagccttctgagtagctgggattacaggcatgtgccaccacacccagctaatttttgtatttttagcagagatggcatttcaccatgttggccaggctggtctcgaactcctgacctcaaatgatctgtccgcttcggcctcccaaagggctgggattacaggcatgagctattgcgcccggcctccttttctaatatatgattcattttgaacttccacagcgtggcccatggttaacttttattcagagtcaaaaatcaagaataaatagtgactacatacagacccacacacacaccaattcttaaattttggggggccattttatcagtatatccattgtcagcagcacagtgttaggtccgaaaacctgcttggtcttcatggaaagtattggactgagagatgcaaaatgtgatataaggaggactttttcatagcatctcaaaaggggatctctagctataaaaatttatttttggatacatattcattctttaaattataattcacactttaaaatgtaattcagaggaaaatgttatattttaaatagctacttgtttcaaatttgtttttgtataacaaactgtgctaatattgaattaattaattaatttagacagtgtcttgctctgtcgcccaggttggagtgcagtggtgcaatcttggctcactgcaacctgtgcctcccaggttcaagcgattctcatgcctcagcctcctaagtagctgggactacaggcatgtgccaccatgcctggctaattctagtatggaatttaaaagactgcatttctgtttaattctaacaaatgtactgaataaagtattagtatatgagaggtaagggaactactgactgcaacataggggcagaatgaaataaatgggaaagtgaggaatcagtcgaataattttatggagcaaaggaaaaaaaaggtatgcccttttactcagaaaagcagacggatattaagaaatgaattaacgcatcctgctccatggtctcatttgaccttgtccttgaaagatgtgaacttgtaataggttgagaagggagattgggctcctaggaatccatgtgtatagtgtaggaaggtggtggctagtggagaagaaggcttagagttgggcaaggaaagctgagacaggggaggtaggttggattgtggaggcccttgaacttttaggttatgctctgaggctgtggcaaccaactgaaggtttttaaggagaggcaatggcatgaactgatcatttttttaggaatataatcctggctgttttctatggaaaaggaatgctacaaacacaaaccaaccaaaaaactagtattatttcattcttgtttatcactttactgaaagatcaatttgagtcttctccttagattccttataatccgaagtgcctttgagggcaagtgggaattctacaagatcaaaattaagcaattgggcaaaaattgagaaaaattcaaatgaattagacctaaatgttttattgtctctttaatgttagtgaatgcttctggaatttttgctccattccactttcctaacgcttctaattgtatgtcgcaaggaaaagtggtcagaagaacagtttagaactcaggctgtgtaagtgatttagagtatgtatggttaccttttctacctttctgctctggctttcaaaacttggaagatgtatttttttgctaattattaagaaatgttgttttcctataacttcttaaaaataactctgtaggctgggtgtggtggctcacgcctgtaatcccagcactttgggaggccgaggcaggcgggtcacgaggtcaggagttcaagaccagcctggccaacatagtgaaactctgtctctactaaaaatacaaaaattagccaggtgtggtggcacgcacctgtagtcccagctactcgggaggctgaggcaggagaatcgcttgaacctgggaggcagaggttgcagtaaaccgagatggctattgcacttcatctagcctgggtgacagagcaagactctgtctcaaaaacaaaacaaaacaaaacaacaaaacaaaaagcacctctgtaaaattattgtttcttgctggattttaaacttgatttcagacttacataagtaattctttaaaggagcagggagttttgaaactaagtctttgatggatgtctattataatggatactgtttatagtagtagagaagtgacagaataactttctgtagtccacttaactgtagctttgaatgactggataacattttcactaaattttgaagatggttgcaaggtggtttttttttttgttttgttttgttttttttttttttttttttagacggagtcttactctgtcaacaggctggagtgcagtggtgcgatcttggctcactgcaacctctgcctcccgggtttaagcaattatcctgcctcagcttcccgagtagctaggactacaggcacgtgccaccacaccagctaatttttgtatttctagtagaaacgggatttcaccacgttggccaggatggtcttgatgtcttgacctcatgatccgcccgcctcggcctcccaaagtgctgggattacaggcgtgagccactgtgcccggcctgaagtttttaccatgagacagtaaaatcagaaaaaatatttaggtttaggttgttttgagaaagtaattaaatataaacttctaaaaaggatagatgttattagcacacaacaatgcccggctaatttttgtgtttttttgcagaaatagggtttcacatgttgcctaggctggtcttgaactcctgagctcaagccatctgcctgccttggcctctgaaagtgccagaattacagcaggtgtgagtcagagtgtacagccctgaccgtggtttttgtttgtttgtttgagatggagtctcgctctgttgcccaggctggagtgcagtagtgcgatatcccagctcactgcaacctccgcctcccgggtttaagcggttctcctgcctcagcctcccgagtagctgggtttacaggtgcgtgtcaccacgcctggctaattttttgtatttttagtagagatggggtttcaccatgttagccaggatggtctcgatttcctgaccttgtgatccgcccgcctcagcctcccaaagtgctgggattacaagcgtgagctgccgtgcccagcctgttttgtgtgtgtgtttttttgagatgttgttggctctgttgtccaaactggagtgcagtgatggaatcatggctaattgcagcctccaactcctgggctcaagtgatctacccacctcagcctctcaagtagctgggattaccgatgcatgccaccacacccagctaatttaaacaaaaatgttttttggtagagagtgtctgaatatgttgcccaggctggtcttgaacttctggcctcaagcaattctttcactttagcctcccaaagtgttgggattataggcgtgaggaaccatgcctggccccaatttatgttttttatttaatgctgtttaaatgttagtttgttgacatccagttaaataggaattcaaccaaaaaaaataactattgtattcaagacccatcctgtgttgtagggcagctgtccccattctttttagccccagggactggttttgtggaagacggtttttccacagacagggttggggtgatggtctcaggatgaaactgttccacctcagatcatcaggcattagattctcataaggagtgtgcaacctagatcccttgcatgcacagttcacagtaatgtttgcacttctatgaaactctgatgccatcgctgatctcacaggaggaggagctcaggcaataatgctcacttgcccaccgctcacctcctgctgtgtggcctggtttttaacaggccacagacctgtaccactctgtggcctaggggttgaggacccctcttgtagaggattagaaacttgactaaggctgggtgtggtgggacatgcctgtagtcccagctacttgaggctgaggctgcagtgagctgagatggttccactgcactccagtctgggtggacagagtgaggccttgtcttaaacaaacaaacaaaaaattagccgggcatggtggtgcacccctgtagctccagctgctcgggaaactgagacaagagagtcacttgagcctgggaggttgaggctgcagtgagccatgattcccttgacagagcaagaccttgtctgaaaaaaacaacaaaacaataaaaaaagtaatttattctgccttgggtaaggtcaatgatttgaaaagtgttaaatagaggagcaattgtatttggttttggggtggagagaatccatcaagactttagacaggagcaagtgagaaggtcctggaagaataaattggaatttaaaaagaacaagacaaaggacacagtggggaaagggaaagttggagcaaaaacacaggggcagaaaaacttgggatgcattctggaagtcctctggtgggtggttgtaaaagaatgtggctggaaggcagtgttcatgtgggcttgtaaaaataggtggtttatgttgcagaacactttgaatgccattgtggggagttcagtcattgcttcgtagacaggaggggaacttggaggattttgaagtggacagtgatagaaatagatctgtacttcaggaaggtgaatcttggcaatattatgtggtacagatagggcagatgaaaagggataattcacctaattggataactgtggtaaagataataaaaaatatttttaaaaaagaaaatggggatattgtgtagtatggatagggtaggaggaagagagagaaagctggttaagaaggccttgggtgagaagtattgaaagcctaaaaggtaatggtggtggtagaaatggagagattttatagatataagctgattagatggatagacaaagcaagcttttagcctgtgtgagaacagcagaatggtgagaacattaaaaagaaatagaaaggaggccaaagagctggtattgttttggggatagaggtttcggctttagttgtgtgagattgaatgaaatgctggaaggatagctaggtagaggagtcgagtagtctatagaaaaatgtatgtgtgtatgtatggggacattaggtattagagatgttaatgttttggttcatagttacaaatacatagtactttatatctaaagcccaccaaggaggtttcagcctttcttgtcttgtttgtaacattcaacactttggtaggtcctaggtagaacacaaaagaaaaaagttttgttttgttttttaaaatttaaatatcaacagtattcaacaactatcaacattttggcaatcttgttctgtcatcccctaacaaattccttaatatcatctaatacccagcctatcttcagactacctgattatctaaaaaatgtatttttaggccgagtgtggtggttcacacctgtaatcccagcactcgaaggctgaggctggaagattacatgagtccaggagttcgagaccagcctgggcaacatagcgaaaccccgtccctactaaaaatacaaaaagctagccaggcgtggtggcgtgtgcctgtaatcccagctacttgggaagctgaggtgggagaatcacctgagcccaggaggtcaaggctgcagtgagctgagatcatgccactgcactccccagcctgggcaaccagagggagaccctgtctcaaaaacaaacaaacaaacaaaaaaatacattgtatttggttgataaataacgcaagtctctcttttttttttttttttttttttgagatgaagtctcgctctcttaccaggctggagtgcagtggtgcgatctcagctcactgcaacctctgcctcccgggttcaaacaattcttctgcctcagcctcccaagtagctgggattacaggtgcacgtcaccatgcccagctaatttttgtgctttagtagagatggggtttcaccatgttgaccaggatggtcttgatttcttgacctcgtgatctacccatctcagcctcccaaagtgccaggatgacaggcgtgagccaccgtgcctggcccacaagcccagggttataaaaccctgtctccccaattatgctatttgtttgaagaaacttggttgatttattctgtagattgtttcatatactgaatttgcctgtttatatctttgatgtgtcatctaagttgcttctttcctccctatatgtcttctaaactggtagtcagatctaaagcttgattttattcagggtttggttttttaaacagttttcattttaaggggagtggggcaagaatacttaataagctgtgtatttcctttgttcgagaccagcctggccaacatgttgaaaccccatctctactaaaaccacaaaaattaacctggtggtgtgttgggcacctgtaatcccagctactcggtaggctgaggtaggagaatcgcttgaacccatgaggttgaggctgcagtgagccaagatcgtgccactgcacttcagcctgggtgacaagagcgaaacttcatctcaaaaaaaaaagagttgggaaaaggtaacattctataattctttcatttcttctgcatttattagctagaatttttctgtaaagaacttaccctcagccgggtgctgtggctcacacctgtaatcctagcactttgggagactgaggtgggcggatcatatgaggtcaggagtttgagaccagcctggcctacatggtgaaaccctgtctctactaataatacaaaaattacccgggcgtgctggtgggcttctgtaatcccagctactcgggaggctgaggcaggagaattgcttgaatcccgaaaaaggaggttgcagtgagccaagatcatgccactgcactccagcctgacctgggtgacagagtgagactccatctcaaaaaaaaagaaaagagaaaaaaaagaacttactttcattgactatttggttatcctggaatattttatacaggctatacagactagatgtatgcttaattctgttttatttgctgttttcaggataatgcattttcttccctctgtaaccattgatctattaatgaagtttttaaaaaaaaaagtatcgtaagcttatgaatttatatatttgacttttaaaaatcaatttgcagtattttttacatgttaggaacaagagaacgttcttgctattggaagtgacgttgaaagtcatgctttagaggggttgatcttgcaacagggttaagcagtggtttaaagcagtgctttttagctgggtatttgtaacataatctttgaaaattaacccaaatcaacaaatccatatctggggcctatctagactgggagagtctagactcctttgtttttcaaaaggcccccgtgtcattctgtttcatacaactctgtttaaggactattggatcaaagactaaaagcccaaagaacagtccagctattgcaagtatcctaggtatgtggtagtaaggacatggattgaggtaatatcagtgggaatgagaggaagggagggatagaataaagcaactttatatcttagaagtttccatatggtattttgtgaataatgttggtaataatacaaggtttcaaagagtagtgacaaagatgactccaacatttatggtatcggggcctgggagaatactgttgatagggaagattggcagagattgctagtttaggggagaagataatggttttttggacatgaggagagttaagatgatggctgtatttcagagggaactcggggaggttgcaatgtgttttatgtcttgctttttctgaatgtgtcattcattctcttggcatagtactcaactagtgaatataagtcatgctccattgattgggaaggttaataaatgctaagttttcatttgatacatgtgatcataaaaatatttgatatttaaataaagaaccatcagtttaaaataaaatggcaaacagactagaaaaaacattgtagcaaatagaaaaagattaatataaaaatatgtaaacatttaaaaaacaaaaaaatcagtaaactaggcaaaggacttaaacagataattctcacaactgggaaatgtatgtcattcatttcatcaacatttactgagctcttatgtcaggtactgttgtaagtgctagcaaacgagacaggagatctctgagcattctggtggtagagtgagagacagacagtgtgagagatggacaatagacatgctccagaaaacaagaatttcaaatagcgatgatgctattaagaaaattaggggccagacagccgggtgcggtggctcatgcctgtaatcccagcactttgggaggctgaggcgggtggatcacgaggtcaggagatcgagaccatcctggctaacatggtgaaaccccatctctactaaaaaaaaaatacaaaaaattagccaggcgtggtggcaggcgcctgtagccccagctactcaggaggctgaggcaggagaatggcgtgaacctgggaggcggagtttgcagtgagccgagatcgcgccactgcactccatccagcctcctgggtgatggagtgagactccgtctcaaaaaaaaaaaaaaaaaaaaaaaaaaaagaaaagaaaattaggggccagacgtggtggctcacacctataatcccagcactttgggaggctgagtcaggagtttgagaacagactgggcaacataacaagactttgtctctacaaataaaataaaatattagttgggtgtgttggtgtgtgcctgtagtcgcagctgttttggaggctgaggtgggaggatcacttgagcccaggagttcaaggttacagtgagctatgattgtgccactgtacagtagcctggacgggtagggcattgaggtagagagtgactttggtttttatgttatttatttatcctgttctcgggaacacatcggttatggtgttgtgtagttggaggttagcattcctaattatctggaaaaaatattggtcagatttaagttctgttgtggttcctgataattggattcgtaattacttttcttttttagatttttcctttgtttggttattcttgaaaaagattttatattggatagagtgtagagtttttcctaactagaaaaattggttgttttttttttctttctttttttttttgagacggagtctcactctgtgacccaggctggagtgcagtggtgcgatctcagctcactgcaacctccacctcctgggttcaagtgattctcctgcctcagcctcctgaatagctgggattacaggtgtgtgccaccacacctggttaatttttgtatttttaatagagacggggtttcaccgtgttggctaggctggtcttgatctcctgacctcaagtgatccacccatctcggcctcccaaagtgctgggattacaggcgtgagccaccgcacgcggccggttgtttcttacagaagttacttacttggattcttttcacacagtagtgttggctttgttctgttgggagggaaactattcctctaaaaaatgttcacatttttcctattacttcattcagtagtgaaatgtaatgatttgactctgccatgagtcagtggcatatctgagggatctttgaagttaaaggaaattggccaggcgcagtgactcacgcttataatcccagcactttgggagaccgaggcaggtgaatctgaggtgaggagttcgagaccagcctggttgacatggtgaaaccccgtctctactaaaaatacaaaaattagctgggcgtggtggcgtacgccagtaatcccaggtactcaggaggctgaggcaggagaattgttgaatccgggaggcagaggttgcagtgagccgaggtcgtgccattgcactccagcctgggcgacaagagcaaaactccgtcttaaaaaaacacaaaacaaaagaaaacccagaagttaaaggaaatcactgtatagttaaacgaattgactagaaagtgtctttgtcctttgctatttaattacacaatatatatacatcatgtaaccaaatgtttcaaactataattaatgtatggagagttcagtgccctttttttttttttttttttttttgtgagatggtgtcttgctttgttgcccaggctggagggcagtggtgggatctcaggttcattgcagcctccacctcctgggttcaagcaattctcctgcctcagcctccctagtagcggggatcacaggcgcataccaccatgcctggctaatttttgtatttttagtaaagatggggttttaccatgttggccaggctggtctcgaactcctgacctcaagtgatccgcccaacttgacttcccaaagtgctgggattacaggcatgagccaccatgcctggcccaatgcacttctttaaagagaagtagtaagtggtttgcacgtggaaagttatctgtttaaggaacttctttagccaataaacattttgtgtttttcatttattattgaagatcgatccagaaacacacacagagagagagatacctgttactttgtagttacgttttttattaataaatagggactttttaggtataagaaggagataatagaaagggaaaacaaattttagtctttaattttctatttaataatttactgttgggaatataagatttgtcggggaggccaggcacagtggtgtgtgcctgtagtctgagctacttgggagactgaggcaggaggatcacttgaaccctggagttcaaaaccaacataacaagaccccatctcttaaaaaacaaaacaaaacaaaacaaaagatttgcacgggagaaaagggatgaatatcgtttttataaatggaaacagaaatagaactaagatagtagttcttatgcttaagttagccagttcttgctttaattctgactacctcatatggaatttttttcttttcaaaggaaacttggctgtaacttcaaaagaagatttgattctttatttctggactgcatatatatatataacaaggccattaaaatgtcgggagcctcagtgaaggtggctgtccgggtaaggcccttcaattctcgagagaccagcaaggaatccaaatgcatcattcagatgcaaggcaactcgaccagtgagtacatgttgttttctctcagctgtgtatcttactttcctttcttctttccctgtcgtcttgctgtgttcagaatagatgaacatctgtatgttaacactttgaactttgctattctgaatgatccattgaatgtattcccctctgtggtatttgctatagtatatttaaatatggactatttattttaccctgtacaattgagaaaccctgaataactgaactaatttagcaagtgtttatgcttattaagttgaaattttaatgataataaaggtataaacagtgctttttgccaagtcctaatgtgaaatatacctatcgaggctgcaagattcattgtttttctttctagattttaaataatacttgattttgccaagatgatcttagaacttttcagtgattctttgagttgaacaatggatataatatatagtaaacttatacattattactaaagttatcagtaattgcttcatagtttgtttctctatagaattgcttaggtgaaaaatgacttaagttgtttcttttatacctgcattaccaaatttcttgatatggttccataggcaaattatcaattaaaatagaggtaggctctactgtctttaaatctgtaattttgtgataccagaagaatcgtcaccctttcaggcacaagttactgctgaagtacacattctaacctcattagcttgtgctccatttgccaatgttctgtgtagaggagtctactggtggaaatgtttgttccaccaaaatctagctagatattgcagcccacatttcaggtagttcacatacaactttgaatgctccactgcttatactcttctctgaacttgacagataagggcttgcaacaatctttttttaaaaaaacatttgaaggccgggtgtggtggctaatgcctgtaatcccagcactttgggaggctagggcaggaggattacttgagtccaggagttgaggctgcagtgagctgtattcatgtcactgcactccagacttggcaatagagcaagaccctgcttcaaaaaaagggtctgtttttgagaccccgtatatatatttaaaaaaatttaaaagtagaaggctaaacagctgtaccattgtagttcactcttctatgtcaacattgccaacagttctgtgaattatatcgtatgaaaaattgtcaaagaaaaagagatgcaaaagtcaacattgaattgaatactttaaatcggtgaactttatggtatataaattgtatctcaataaagcttttttttttttttcttttttgagatggagtctcactctgtcacccaggctggagtgcagtggcatgatctcaggtgcctgccaccacacccggctactttttgtatttttagtagagacagggtttcaccatgttggccaggctggtctcaaactcctgacctcaggtgatccacccgcctcggcctcgcaaagtgctgggattacaggcgtgaaccaccgcgcctggccaagttttggtttcctcaactataaactggaggtaatattacatattttacttatatatatggctaccaaagagggttgttttcagcacaatgctgaattcctagtggcttttccaccataatttgtccaaaacctttctagggaataggccgagtggctctgctttgccttgagtatcctttccatcccttctatcggatttgcaagtttgctgtaatgttaggctgtagggatcacagagttataccatgggaccctgcccttaaggaactttttttttttttgagatagaatctcactctgtcatccaggctggagtgcagtggtgtgatctcggctcactgtaacctctgtctcctgggttcaagcgattctcctgcctcagcatcttgagtagctgggattacaggcacccaccactatgcctggctaatttttgtgtttttagtagagatggagtttcaccatattggccagcctcatcgcaaactcctgacttcaagtgatccacctgccttggcctcccagagtgctgggattataggcatgagctgccgcgcctggctgttttttttgtttgttttttctttttttttttgagacagggtctctctctgtcacgcaggctggagtgcagtggtgcaatcatggcttactgcagccttgaccttccaggctcaatcaatcctcctgtctcagcctcccaagtagccggggctacaggcatgtgccactatgcctggctagtttttttctattttctgtagagacggggactcactatattgtgtaggctggtcttgtattcctgggctcgagtgatccttgccttggcctcccaaagtgttgggattgcaggtatgagccactgtacccagcctcccttaaagagtttttaaagtttatggttggagagactagacatactaaaataatttcttttctttttcttttttttttttgagacggagtcttgctctgtcacccaggctgaagtgcagtggctggtctcccactcctgatctgaaacctctgcctctcgggttcaagcgattcttctgcctcagcctcctgagtagctggaactacaggcacctgtcaccacacctggctaatttttgtatttttagtagagatggggtttcaccatgttggccaggctggtcttgaactcctgacctcaggtcatccgcctgcctcagcctcccaaagtgctgggattacaggcgtgatccaccgtgctcggccaaaataatttcaatacaggataaaaagtgatcgaagtgttaattaccgtaacaaaggattattattttattttattttttgaaacaggatctcactcttgttacccaggctggagtacagtggcaccatctcagctcactgcaacttccgcctcctgggctcaagtgatcctcccacctcagcctccctagtagttgggaccacaggtgcacagcactatgcccagcaaatttttgtagttttagtagagatggggtctcaccatgttgcccaggctggtctcctactcctgagctcaagcagtccacctgccttggcctcccagagtgctgggattatgggcatgagctgctgcacccagccaaaaaaaaggattattaaaaagtataggccaggtgcagtggctcatgcctgtaatccctgcactttgggaggccgaggtgggtggatcacctgaggtcaggagttcaagaccagcctgaccaacatgatgaaacctcgtctctactaaaaatacaaaaaattagctgggcgtggtggagtgtgcctgtaatctcagctactcaggaggctgaggcaggagaatcacttgaacccgggaggtggaggttgcagtgagccaagatcacaccactgcactccggcctgggcaacaagaccaaaacactgtctcaaaaaaaaaaaaaaaaaaaaagcataaatgagagtttggcagaaagcaaatataaggatttattgatgatattccatttaagctggaccttgggatgtaagatttaaactaaacatatagtatatttgggccgggcacggtggctcaagcctctaatcccagcactttgggaggctgacgcggatggatcacgaggtcagaagttttgagaccagcctggccaatatggtgaaaccccatctctactaaaaatacaaaaattagccggacgtggtgatgcgcgcctgtagtcccagctactcaggaggctgaggcagaagaatcgcttaaaccctggaagcggaggttgcagtgagctgagatcatgccactgcactccagcctgagtggcagagcaagactccatcccaaaacaacaacaacaacaacaacaacaacaacaaaaacccatatagtatatttgggaaaattttcagaattgtagcttattacagcttattagtggcagtgttaggactagataatggtactcctaccctcagctgattataacacattgtttccctgcatgtacaatttcggcaggagtaatttgtgacttttaaattagcattagtctactgaaacagaaatcctcagtaggttaatcagccttgcaaaaatgcgggttagttttctagctaaatactttgtcctggctcagagatttacagtcagtttggttcctttgaaaggtatctgttcttggaaggcaattaatcatatgagaaccattatatctattgtatgaggaacttttttctgtagaatatttgcattttccatgttctacttgttttctgtttctgttttcagccttctatggcaatttcttagtaatttgactaatatgtatgccaagtaatttttaagtgagagatttttaacatttgtatgaaagatgatattttagaaagtattattggcttgtttttttttttttaaacaccattgggcttagaatggaagtgggcatgcattttgaacatagacttgttggaaatgaatatgctgtacacatgtgttagctgcattaaaaaggctgctttgctggcaagctggcctggactgttgctcacaaggattataactgattgcagatggaatgcactagaatgtttctgccataaactctcttatgaaaaagtagaagagtatgaagagtactttagggaatgtgctaaatctgaaaactgagaagtagctattttatttaagcactttctggtcttggaggaaatattctccatggcacaaataaatgttactgtcttgacattttggagtcccaagcacatgcaaatggctctgttcaataatatcccattatattccaaggttctcccacttgagaagcatttcttattgtctaattacttggtaaaaagggaaatgagccaaagtgaatgatctaaccgcttacatttatggttaggttatttgtgtaaacctggagacattaaacctgtataaatgcactcaaaaacaggaagtagataaaattggttttcacttataatatgaggtacactccatcaagtgactgaactgtgatattttactttatttttacccacaaattgtctcttgccctttggtgaattttgttcatatatttaacaaccttcctttgccaggaccttttttttccccagtgcccaatcttggttgggatagaagtagccctgacttttttttcctgtttattactcatattatatgtcttataggctttttcattcacgcatacatttctaaaccaaatgccgcacagcgtaactgatacaaataatgatttcatgtccactattgaaaatttggggggtgggtgcagtgactcaatgcctgtaatcccagtactttgggaggctgaggcaggcagagtgcttgagtccaggagtttgagaccagcctgggcaacatggcgaaaccctgtctctacaaaaaatacaaaaaagctagctgggtgtggtggtgtgcacctgtagtcgtagctactagggaggctgaggtgggagtatcacttgagccctggaggtcaaggctgcggtgagccgtgatcacgccactgcgctctagcctgggcaatggagtgagacactgtttcaggaaaaaagaaagaaagaaagaaaatttgggatggaggaagggcaaaatggagatttggaaaggaagagtttagaaagtaatgcatttaggctggacacagtggctcacgcctataatcctagcactttgggaggccaagttgggtgggtcacctcaggtcaggatttagagaccagcctgggcaacatggtgaagtctcatctgtactaaaaatacaaaaattagccaggtgtggtggtgggcacctgtaatcccagctaatggggaggctgaggcaggagaataacttgaatctgggagacggaggttgcagtgaactgagatggagccgttgcactccatcctgggcgacaagagcaaaactttgtctcaaaaaaaaaaaaaaaaaaaatacagaaagtaatgcatttaggccaggtgtgatgactcatacctgtaatctcagcactttgggagcctgagatgcgcagattgcttgagctcaggagttcgagaccagcctgggcaacatggcaaaaccctgtctctaccaaaaatacaaaaaattagctgagcatggtggtgcgcgcctgtggttgcagctactccagagcttgaggtgggaagatttcttgagcctgggaggtggaggttgcagtgagggaagcttgtgtcgctgcactccagcctgggtgagacattgagaccccatccaaaaacaacaacaacaacaacaacaacaacaacaaaaaacaccaaaagaaagtaatgcatttaaatttgtatactttttttagtataaattactataaccacatgaaaataaatgtaaatgcatgtaaattatgaacattgtgaataataaacgagaaagaaaagtcatctgtattcttacctccttaaccacagcatactgctgcttttgatggatttttttggtacttttttctttcagtttttttgtttttggtttttttgagacagggtctcactctgtcacccatgctggagtgccgtggtgcaatcttggctcactgtagcttccccctccctggctgaagcagtgctcccacctcagcctctccagtagctgggaccacagtcctgtgccaccacacctggctaattttcgtattttttgtagagagagtttctacaaaaaaccatgttgcccatgctggtcccaactcttgggctcaagtgatctgcccgttctttcagttttgatgaatacagacacaagcaaaattatttccaatgtcaccacgcagagagaactaccattaacatctggatctgtattcctctaatcttttccttgcattttacacatattaagatttttatgtaattggattatatgtactgttttttggtttgctttttttattttctgatttttctattctattgctgctgaacaaattattttctaatatttttaatgttactatttttctatacaacttttgaaattttgtaatatgggtatattacaactagttttgttggtttttttaaaagtgtaattatatgctttaatattcaggaccaatgttggaacacaaatgtgttcctagatattgaaccgttttcatttttattttttattttattttattattattatttttttgagacggagtcttgctctgtagcccaggctggagtgcagtggcacagtctcggctcactgcaacctctgcctcccggcttcaagggattctcctgcctcagactccagagtagtgaagactacaggcgcccaccaccatgcctggctaatttttttttgagatggagtcttgctctgtcacccaggctggagtgcagtggcgcaatcttggctcactgcaagctctgcctcctgggttcatgccattctcctgcctcagcctcccgagtagctgggactacaagcacccgccaccatgcctggctaatttttttgtatttttagtagagatggggtttcaccgtgttagccaagatggtcttggtctcctgacctcgtgatcagcctgcctcggcctcccaaagtgttgggattacaggcataagccaccatgcctagctgctaatttttgtatttttggcagagacagggtttccccgtattggccaggctggtcttgaactcctgacctcgtgatccgcccgcctcagcctcccaaagtgctgggattataggcgtgagccaccacaccctgccaaaccttatttatttatttatttatgaggcggagtctcactttgttgcccaggctggagtgcagtggtgcgatctgagctcactgcaacctctgcctcccaggttcaagtgattctcctgcctcagcctcccaagtagctgggactacaggtgggtgccaccatacctggctaattttgtatgtttagtagaggtggggtttcaccatgttggccagtctggtctcaaactcctgacctcaagtaatccacctgtcttgtcctcccaaagtgctgggattaaagccatgagccaccacacccggcctgaaccatttttaattccatagtgatctagaagtgccatcgtaaatagcactcagagtgcagaaaggggattgcatagagttggatggctagaagatgttatggaaattaccttaaatattgttttcttcttgtgatatatccattactttcaataacatgaaaaatcaatataaaaatggattgaatggatttaagaatttatgggtagttcatttttttttttttttttttttggtagagacagagttctcactttgttgcccaggctggtcttgaattcctggccccaagtaatcctcctaccttggcttcctaaaatgctggtattacaagtgtgaaccaccacacctggccctcatttcttaaatattcctcaagaacatgatttcagtagctgcttaatattgtattctatttatgaaccatacttcatttatattcatcctctgttatcagacacttgagccttaggttcttcatttattgagtggaaatattgctgatgccttcccagtctgctgtctcaggttgtgaggatcaaatgaaatcatgtatactatatagcatactattttaaaaattatgtaagttgttcttgtggttagttttgtgtgtgtgtgtgagacgaggtcttgctctgttgcgcagactgaatacagtggcacaatcatgacccactgcagcctcaacctcctggggccaagtgatccgcctacctcactcccctagtagctggggctacagccaccacacccagctaatttttaatttttttggagcgatggagtctcactatattgcccaggctggtcttgaactcctgggctgaagggatcctcctgcctcagcctcccaaagtgctaggattacacgcatgagccaccatgccaagcctgtggttagttttagtgtctaaattttcagtgggaatataagtttaaaggcagaaataactgaacctatcactaagttggaggcagtttttgctattgtgtattcggagtttctttttattacatgatataatttaataagcttctttacctaaataaatatttttcacatcaaaatggctaagagaagtactggaaaaaatcatcttggtggaaacgtcctctttctttgtgctttgcatgttgttgttgtagtctttgagattgtcataattaaaatccaaagtaaactttgtgctgcctttatatatgcatttgttggtttctcataggagaaagcaaccatgcccaattttttttttaatgccttctttgcaactctcaagaggtgttttggagttcatttttaaaagtctagccaatatcgtggtggtgattgcttttggtagttgcctagtgaagtgcgaagtggtgtaatggcagctagcaaagtctggaatgcagttcacaagaccgtgaaagggatgctacttctgtctctatgtcagacaaagtgggcattcatagttcagttttcggtagtacctgtttatcaaggaatgtgcattgtataggtgaaagctgttcttagttgtggtgtttagggatgaatgccttgtacatacatacaggtgataagaataagaaatacgaagttaggtttttgagagcacctataggaaattaggtttttgttattcagcaagcctaggtgtcaaagctttcagagagattttagcattgtcttagatagagataaataatcaaagcaatgtgatgactattaggagagcaccgagaaagggcgtctaaatacagtcatgcgttgagaaatgtgtcggtaggtgattttgttgtgcaaacagcatggagtgtacttacacaaacctacagggcgtagcctactccatacgtaggctctgtggtatagcctgttgctcctaggctgtaaacctgaatggcatgttactgtactgaatactgtaggaaattgtaagacattggtggtatttgtggatctaaacatatctaaccatagaaagggtacaaatatgatagtaacaatacgatattattaatataatcttttttttagacggagtcttgccctgtcacccaggctggagtgcaatggtgcaatcttggctcgctgcaacctccgcctcctgggttcaaacaattctcctgcctaagcctcccaagtagctgggattacagatgcccaccaccatgcccagctaatttttgtatttttagtagtgacagggtttcaccatgttggccaggctggtctcaaactcctgacctcgtgatctgcccgcctcagcctcccaaagtgctgggattacaggcgtgaaccactgcgcctggcctattaatataatcttatgggaccactcatatatgtggaccttcatgtatgcagcccgctgatggacaggttgttatgtggtgcatgacttgtaattgagaaggatggcagggaaaggtaggtaatgtctgagaagcccttttggttttggcttaccagaaaactgtggggccggaagtatcagaagcaacacagtgaggaaatgatttaactaaacttactctttccacaccacattgttccggtctgttactgacacgtgttcctttagctgtgaataaacttgaggaggcaaaatgggagattttacaattccttttaggccaggtgtggtggctcacgcctgtaatccctgcactttgggaggctgaggcgggtgaatcacttgagctcaggagttcgagaccagactggccaacatggtgaagccccgtctctactaaaaatacaaaaaaattagctgggcctagtggcacatgcctgtgatcctagctactcgggaggctgaggtgggaagaacgcttaaacctgggaggcagaggttgcagtgagccaagttcgtgccactgcactccagcctgggtgacagaacaagactgcgtctcaaaaaacaattgccttttagtggggggaaaaaataccataattagtaattaaaaacaacaaacgcttaagttgtgccaggcacaattaggcagattttaacttactgaatccttgcaataattatatggcaggtactctttccccatttcacagatgaaggaattgatacaaagaggtattattggctgtcttgcctgggctcacatatctattaattgagggaagtagaaaatgaagttgggctgtctccagaacccttactattggagagcatatcacctctcacaatatttattaagttttactattctgtgcagtaatgctgaatgtctatgcttaatttgaatttaacttagattaaaatttattttgatttattttcttgatggagggaaattatgaggaaaaagctgcggggaaggggcagatgattatcagtttacatgtctttgggcattttaggtagagtgaaatctaggccttgcaaatcatatctctttagaatcattcaaaatttgcttaggaagagcagaattgttgattgtttattcaatgtgtatgctaagtaacatgttttatagaagagttataatttttttcctattttcctattgtatatttgttttttaatactctgggatcaagtatacagtgaatatgtatagtacatttatccctgttttataaaaaaatgggaaactaaatttgttgtaaatgattaaggaactttatgattatagatcttttgctcaaatctttatggcaataggttttactatgtttctatattgtgaggaggggagcgagttgcctgtgggttttggttttatggttttaaaatataagcagtgtataaaatatttttattgtgtgccatttttcttttttttcttttcttttttttttttttttgagatggagtttcgctcttgttgcccaggctggagtgcaatggcccgatctcggctcaccgcaacctccgcctcccaggttcaagcaattctcctgcctcagcctaccaagtagctaggcttacaggcatgcactactacgcccggctaatttttgtatttttagtagagacagggtttccccatcttgaggctggtctcgaacttctgacctcaggtgatccgcccgcctcagcctcccaaagtgctgggattacaggcctgagccaccgcgcccggccctcctttttttttttttttgagacggagtcttgctctgtcgcccaggctggagtgcagtggcgtgatctctgctcactgcaagctccgcctcccgggttcacgccattctcctgcctcggcctcccgagtagctgggactacaggcgcccaccaccacgcctggctaattttttgtatttttagtagagacggggtttcactgttttagccaggatggtctcaatctcctgacttcgtgatccgcccgcctcggcctcccaaaggactgggattacaggcatgagccaccgcgcccggccgccatttttcttaattgttgctctaggaggcttttagagcggaagattgtgctgaagatgtcactgggatttttaacaagccctaaacgtgcttggttactaaagttaatataaagttacagtgttgccacacagataacatcaattatagttgcaggcaaaatctttagtagtttgccaacaacagtataattactagacactgagatattagataaatttattctggggaattaaaaggcgtttaaatactaatcttgttttgactgccttattttctagggctcagtaattaaagtgttatttctgcatctttatgctaaagtagcaaagttgtgaataaggcagggagaaaagggggtaaaattagggaatttagtagactgtcttaagtcttaacttgaaacttcttcaagaaagagaagatggtcagttgtggttcatcagtaaactaagacctttgaaacattttgtgatagtcattttgatagcatttacgtttatcttggataaaagtcttcaagtcagcctttatggaaattatagtgtcctgcccttctccagctctcctaaggttagtgttggctacaccattaggaataaaaaacctgaagacaaaagggaaaagatacaaaagttgtatggagaggataaaggaaggatcatttttcctttggacttggaaaaaaatacatttaggtcttagatgttaaagctgccttttagatttatgaaggaaaatttaggaaaacagccttgaaacctcatgggatttggatggtaaccaagaggcaaggcctggaggtgagagtgagcagagcaagttattggggaaatcaggagatagcctgaactcattcttctagagagtcctgtaagtggttatgatgataatcattgtaataaaggtagggaatataacgtgactgactacttcaaacagttcattttcttggctcttagtaccccatactctcctaattgccttccttcctcccaggttggttattctttacctccttcggttaaagtccaccaggcttttgtcctcagatctctctctccagaaaagagagacgccctagatgatttcttctagttctgggggcttaaatgtcattgagatggtgataactcccagattcacttctgtagcctggacctctctctagaagtatagacttggctacccagctgccaactgaactctacttgaaggccacagaagcatctcaaactcaacatgtcctaaacataactattgttttttcccttcctgaccacccagagtggctcctcctttatttttatcaattcttttagttgcctagaccaaaaatattggagtcattcttaccttctccgtttttctcataggccacatatatcaatcagtaagtcttgccatctttgccttcacaatatatcctgaatcagttactttttgccatttctactctagtcaagataagtactgcaatagcctcctgtctctctgcttttgcccttgtttccatgcagtagccagtcatattttagaaatatacatcagggctgggtgtggtggctcacgcctgtaatcccagcactttgggaggccgaggtgggcggatcacgaggtcaagagttggagaccagcctggccaacgtggtgaaaccccgtctctactaaaaatacagaaattagccgggcatggtggtgcacgcccatagtcccagctactcaggaagccgaggcaggaggatcgcttgaacctgggaggcgaagtttgcagtgagctgagatcgtgccactgcactctagcctgctgggcgacagagtgagactctgtctcaaagaaaaaaaagaaatataaatcagattatgtcacccctttgcaatcagatcatgtcacccctctgcttaaaattcttcactggtttcctgtcacatttatttcattttaatgtaattttaaattttttttgtagtcagagtcagagcctctgtcgcccaggctggagtgcagtggcatgatctagtcacacttgcagcctctgcctcccaggttcaagctgttctcgtgtctcagcctcccaaatagctgggactacaggtgcgtgctaccacacccagctaatttttgtatttttagtagagacagggttttgccatgttggccaggctggtatcgaactcctgagctcaagcaatatgtccacctaggcctcccaaagtgctaggattacaggtgtgaaccactgcgaccagtccttatcacttttagaataaaactaaaaatcctcactttggccacacagcctcacagaatttggcctctggctagctatctgatttcacatttgatcattgtttgcccacctggctatactgctggtcttgctgttccttaaatttcattcagattcctgctcagatatctcctcagaggtggcagcttgtttgcttttatctaaaatagccacttctaccactttcactgtgatcttttatctcctaacccggctttatttttctttccaacattatgctatttgtattagttaattgtctcatgctgtcattagaatgtaagctccatgtaggcagggacttgttttcactaggtatctataggtcatggtagacatgcaagtatttgttaaatgaaagaatattttgtacatttactttatgctaggccttgagccaaaatgtgagaattaaatgacagttctgtatagttaggcactattattaatatgcccatattacagataagaaaattaaaaattaaggcttacagagtttattacatgcttatagatggacctagggtaatgttggatacttagagtgggatcacattaaagcctctacagcagtggtccccaacctttttggcaccagggaccggttttgtggaagataatttttccacagacgggggtggaagtgtatggtttcgggatgaaaccgttccatctcagatcatcagacattagttagattctcataaggagcgggcaacctagatccctcacatgtgcagttcacaataggattcatgctggtatgagaatctgatgccgccactgatctgacagatgctcgcctgttgctcacctcctcctgtgtggcctggttcctaataggccatggacagtaccggtctctggcccaggggtggggccccctgctctacagcattctacttcatcggtaaaatctttgaaaatgtcttctagaaatatttttaaggtcactttaccttttgatcattgaatattgggtcaattttgttgttgttgttgttgttgttgagacagggtctcgttatgttgcccaggctggatggagtgtggtggtgcagtaacggctcactgtagcttcaacttcctgggtgcaaatgatctttctgcctcagcttcctgaataactgggactacaggcgcacgctaccatacttggctaattttttgtatttttagtagagataagacctcattatgttgcccaggctggtctcaaactcctgggctcaagtgatcctcctacctcagcctcccaaagtgctgagattacaagtgtgagctactgtgctcagctgacataatcttttgatgtatgaatggacccatctctcttgctgcccctgcaacaccagatactgggactcatcgatttctgatgatgaaagatgtcgttctcatgggagtctttatgttatacaaatggagagcaaagttcccaaacatgctgccgtggttgatgtgttctgtcatctggtaataactggagttattacagtcatccaagtgagagaagtggtggttgaaccagggtggtcacgatggtggtggggagaagccatatttggaaagtagaactgataggatacatcagatgtggaggatgaaagaaaaaagccaaagatggctcccagatcatctgtggaatgttgcttgtagggtccaggtctggagtatgctgtgtgtccagagcaacctagattgaagaaaagacctcaggcacagaagctgtaaaagaggccttgaaaagcagcttgaaaaggtggattataggaagtaaaacaatatgaagtctataatacttttaaaagagttattttctgacactagtcctcaaaaatattcctggagtccattctttgcaggaaaagtggcgacttgtcctagacaaagcctacgtgctgattccatgtgaccctgggggtgggtactaaattcgtaacagcttgtgggtgaaaatatggtttatatgttgaatgtgttccttaattactgtaattctgtttttatgtgcatggtttctgtgaaacaaattagaagtccaacacactattttagctcagttgaccttgatacaagaactgctgtgttaattatgcccagtctttcagtagtacaatcctcttttttttttctgtgaatgttagtaaaatctactggtattttatgtatatattgcacagctatacactgtttttctttttatgctcttgaaaatggaatttaatcagagttgtacatgacacatggagggcattcatttgagtccttggtatagggcagtatagaggatccataagacatggtccaagcactttgaggatatatgatgttgggggagcatcagagatttgttgacacatttaagtaaggacttgaatgtcgtactttgactgttggcaagaaataggctcttggctgggtccagtggcccacacttgtaatcctagcactttgggaggccaaaacaggagaattgcttcagcccaggagttcgagaccagctggagcaacctagggagaccctgtctctacaaaaaaataaacaaattagccgtgcatggtggcacgtgcctgtggtcccagtcactcaggaggctgaggtgggaggatcacttgagcccaggaggctgaggatgcgtgagctgtaatctcaccactgcactccagcctagggcgacagagcaagaccctgtctctaaaagagaaaagaaacagaattcttacattgtgctttagtttatcagttagtgaacttttctttttttgttgttgctttttattttttgtggagatggggtctcactatgttgcccaggctagtctcgaacgcgtaggctcagatgatcctcccaccttggcctcctaaagtgttgagattacaggcatgagccactgaacctgggcctggtgtgtttttcttaccttggtttaaagatcaaatggaatattatcatacctactgaatattgagagtttaaaacagggtaaaatacgtatttaagaaaaattaacgtatgtgtaagtgtttcactcctttaattctgtaaactaggtattacctcaattttagagacgacacagacgtgcagtcatacccaaggtcgtaaaaaacacctaaatacagtatttcttaactttttttttttttttgaaacggagcctcgctctgttgcccagggtggggtgcagtggtgcaatctcaggtcattgcaacctctgccttctggtttcaagcagatctcttgcctcagcctcccaagtagctggggttacaggtgcccaccaccacgcccagctaatttttgtaaatacagtatttttaaattgttctttcatatgtttagaatattaagccaggcatggtagcccatgactttgggagggcaaggaaagaggattgcttgagccaagagtctcagtccagcctaggcaacatggcaaagccccatctctgcaaaaaaaattaaaatttggcttggcatggtagtgcacacctataggcccaattacttgggaggcagaggtgagaggttcacttgagcccaggagttgcaggctgcagtaagccatgattgagccactgtactccagcctgggtgacagaccgtgacgctgtctggggaaaacaaatggattagttgttgatagaagcagttattctaaaagcagcttgggggcgggtgcagtggctcacacgtgtaatcctagcaatttgggatgccgaggcgggtggatcacctgaggtaaggatcctgttcaaggccagcctggccaacatggtgaaaccctgtctctagtaaaatacaaaaatcagccaggcatgatggcgggtgcctgtaatcctagctactggggaggctgagacaggagaatcgcttgaacctaggagacagcggttgcagtgagccgagatcgtgccactgcactccagcctgggcagctgagctagactgtctcaaaaaaataaataaataaaataaaagcagcttggttttgaagatataagttaggaaaatctattagtttcagaagctttaaaagtctgggagaaaggaatattgaagaagaggaaaaggatttcatgtgaattgaggaagttaactcattggtgtagtttttcctttctttttttttttttttactaaggaaaagagaacaaagcgataaaatctgagtagtctttcagtcattcttggtagaattggtagctaaaaggctgagtgaaatatggcttaaaagctttattggctgggcgcggtggctcacccctgtaatcccagcactttgggtggcttaggtgggtggataacctgaggtcaggagtttgagaacagcctgaccaacatggtgaaaccctgtctctactagacatacaaaattagccaggtgtggtgatgcatgcctgtaatcctagatacgtggcaggctgaggcaggagaattacttgaacccaggaggcggaggttgcagtgagctgagatcctaccattgcactccagcctgggcaacaagagcaaaactccgtctcaaaaaaaaaaaagctttatcatttattttttggccctgtcttatggtgcagaggcttaaaagttttttgacagcaaattttctagaggctaggagtgtttattataaccatgtttttgagcggtgaggactacctcagagggcatgccttgtgtcatcattgttcttattgctgagctaccgaaacctagaatctgactcacacaatatgacacttatttccgttttcttggtagagtttgtgtggtcattcatcttttagatcttttagaaactacagtcctcctagttcccacttttatatttatttatttatttatttttgagatggagtcttgctctgttgcccaggctggagtgcagtggtgcaatctcggctcactgcaacctctgcctcccaggttcaagcaattctcccgcctcagcctcccaagtagctgggattacaggtgcgtgccaccatgcctcgctaacttttgtattttttgtagagacggggtttcaccacgttggccaggctggtcgcaaactcctgacctcaagtgatcaacccccctcagcctcccaaagtgctgggattacaggcgtgagtgaccgtgcccagccatcagttcccacttttaaatgagaggttctttgtttttgtggggtttttgttgttgttgttgttgttgttgttgttgctgttgttacttgagacagggtcttagtctgtcatccaggatggagtgcagtggcacaatcttggctaactgcagcctggacctccctgggctcaggtgatcttcctacctaagccccctgagtagctgggagtgcaggcacacaccaccatgcctagctaacttttgtattttttgtggagatgagatttcaccatgttgcccaggctggtctcaaattcctgtactccagcgatcctcctgcctgagcttcccaaagtgctgggattataagtgtgagtcaccgagccaggtcataaagacagtttttttttgttttgagatggagttttgctcttttgtacccaggctggagtacagtggtgtgatcttggctcactgcaacctccacctctcgggttcaagcaattctcctgtcttacttagcctcccgagtagctgggattacaggcgtgccccaccacgctgcactgattttttatatttttaacagagatggggtttcaccatgttggacaggctggtctgcaactcctgacctcaggtgatctgcccacctcagcctcccaaagtactgggattacagatgtgagccactgtgcctggccaataaagagaattttaaacaatgcctacagtgtgattttagtggggtggccacatacatgtaggtgtgcacatgtatttccatgaaaatgccttcctgcctttagccttgacaatgctgcatatagggaataagcatttaaatgatggtgtctgggctaagagtgtgaactctggagccaaaccctccaaaattgcatcctgaatctgccactagctagctctggagccatgaataacttatttaacctctctgtgatggtttatctatctgtaaaatgggggtaatgaaacatctggctcattgagtgcttgggagcatcaaataggttagtaggtctggtgtggtggctcacacctgtaatcccagcactttgggaagctgaggcatgaggatggcttgagcccaggagtttgagaccagcctgggcaacatagtgagactcccatctctacaaaaaagaaaaataattagccgggtgtagtggcatgaacctgtggtcccatctactccagaggctgaggtgggaggatcactggagcccaggaggttgagtctgtagtgaattgtggttgtaccactgtactccagtctgggcctcagagttagatcctgtctcaggaaaaaaaaaggttcgtagacagaaagtacttatggctcagagtaagtgttctgtgaatgttggctgttttttaaatcttgcatttaattcctctttggttagaagtatacttctttgcttggattaccatttgcatgtggagagatgttccttctagaaccatgtctccttgtcacatgattatgtacagtgtgagctttattaatactctgtcagcatttgaggttggaacataaatgcgtggctgtacccagtggaatccagcaagagagagaactaagcaccgtagcaactgttgctatttgtgtactgagcaacagctgtgcgagacagatttattttttaatcctgatctcactgatagcctgggatgtggccttgccacatctcaaaggagtagattggttgagatatccagtctttgaggagatttcatgaccacatgccataaagattctgtttcatttcaaatatgaggagctaaagctttgtgtgtatgagtgagggagaaagattaagctttaaagcattcatagtcagtccctgaaatatagtgtgactggattaatgacatgataaatcacttttaatgtgggtggtgagacttcatgcatttcagtcaaaaaagtaattttgctgtaatgtggttcatttccaaattttggctgctaacttacctaggatggataaacattatcacagagtatttactgagcatctactttataccagggtcttttctgaatactggtaacatgcagttaattacactccaaaatgacttagtctgtgattccactatatactacattacataaatacacacacactaatcatttacatacttgtcaaccttagatttcagaaataacactgtatttgtaatgaatgcttcattaccaaatgcttttctgaagtacatagtaagatctttaaaaagagctttcatggccaggcgcggtggctcacgcttgtaatcccagcactttgggaggccgaggcgggtggatcacaaggtcaggagatcaagaccatcctggctaacacggtgaaaccccgtctctactaaaaatacaaaaaaattagctgggcgtggtggcgggcgcctgtagtcctagctactcaggaggctgaggcaggagaatggcgtgaacctgggaggtggagcttgcagtgagccgagatcgtgccactccccttcagctagggcgacagagggagactctgtctcaaaaaaaaaaaaaaaaaaaaaaaagctgctttcaaatagtggttggattcattcaataactttctaattttcatttctcttttttttcttgagatgaagtcttactctgtcacccaggctggagtgcagtgcattaatatcagctcagtgcaacctctgcctcccgggttcaagtgattctcctgcctcaacctccccagtagctgggattataggcacacaccactatttctggctaatttttgtgtttttggtagagatggggtttcaccatgttcgccaggctagtctcgaattcctgacctcaagtgatacacctgccttggcctcccaaagtgctgggattacaagtgggagccaccgcgcccagctccatttctgatgtgttccaatatttcagggcttaacgggtgccttgaaatagtaatgtgggccaggtgcagtggctcacgcctgtaatcccagcagttagggaggcggagatgcgcagatcacctgaggtcaggagttcgagaccagcctggccaacatggtgaaaccctgtctctactaaaaataaaaaaattagccagttgtagtggtggatgccagtaatcccagctactcaggaggctgaggcgggagaatttcttgaacccgggatgaggtggttgcagtgagccgagatcacaccactgcactccagcttggggaatagagcaagactctgtcttcaaaaagaaaagaaatagaaatgtcgttcatttccaaattttggctggtaacttacctaaggaggataaacattgtcacagaatatttactgagcatctactttataccagggtctgttctgaatactggtaacacgcagttaatgctgttggtctggtttttcatgttccatgtataaattacctcttaaaactatgattgttttcattcattcattcatttttgagatcgggtctcaaaataggctggggtgcagtggctcgataacagctaactacatcctcaaacctccaggctcaagccatcctccgacctcagcttcctaagtagctgggactgcaggcatgtgccaccatgcccagctagttgttgttgttttttttttttttggtatttgttgtagagacagggtttcaccatgttgcccagggtggtcttgaactcctgacctctagtgatccacccagctcggactctcaaaatgctgaaattacaggcatgagccactgagcccagcctattaatttttgattgccctattcagatttagtggtatgaatttactgattgggatgttttgaacacacagaataacatgtttaactaaagaacttgtaattgagtgacttataaaatgaaacatttttatcttctaggtattattaacccaaagaatccaaaggaagctccaaagtccttcagcttcgactattcctactggtctcatacctcagtgagtaccctcatgccacagcactgccagctcctgcctcctttcctctttccttgccgatttgtcttttctcttagctgagcagatccaagttttgcttcttaactgttgtgtagcatgagttcattctttgatacagtgatatagtattttcattcataaagtatttgggttgatggaaagtttatgtacacatatacataaatatatacacatatatacatacagaacatatttagtttacaccaaatttatactgaatgtacactaaatttatactgatttagacatttcttgaggatttatttatcagtatcttaggatcctcattaccaacattattgcccattgatcttaggaaatgccaaataataataataattattattattattatttttcttctgagacggagtctcactctgtcgcccaggctggagtacagtggtgccatcttggctcactgcaacctccgcctccgaggttcaagcgattctcccgcctcagcctcccgagtagctgggattacaggcgcgtggcactatgcccagctaatttttgtatttttagtagagacaggatttgaccatgttggccaggctggtctcgagcttctgaccttaagtgatccacctgtgtttgcctcccaaagtgctgggattacaggtgtgagccactgtgcctggctggaaatgccaaattaaaattgcttagggtactgttaattttaagttgaattttgagggaatggccagcaagattggaatgaccacagagaaattgttttttttttgtttgtttgtttgtttttggctaggctgatcttgaactcctgacctcctgatccacctgcctcgacctctcaaagtgttgggattaaaggagtgagccaccgtgcctggccaattttttttttttaattgtagtagagcaatgtgggttctgaacattttgaaagatgataccgtgcctctactaaaaattccaaaaaaaaaaaaaaattaggtgggcttggtggcgggtgcctgtaatcccagctacttgggaggctgaggcaggtgaactgcttgaacccagggaggtggaggttgcagtgagccgagatcgcaccactgcactccagcctgggtgatggaacatgactgtgtctcaaaaaaaaaaaaaggaaagaggctgcagatccacaagggaaacaaaagattaccagtattacgaaaatgcagagtagggcccttcctggtacccttactcagtgtggaaccccaaatgttgctgcttcttagggattgttcatagagtttacttctgcatcattcatctctttgttacatgtttttggttttgtttttcctgttttgtatttttttttaaagactgagtctcgctctgttgcctaggctggagtgcagtggcatgatctcagctcactgcaacctacacctcctgggttcaagcagttctcctgcttcagcctcctgagtatctgagattacaggcaggtgccaccacacccggctgatttttttaatttttagtagagatggggtttcgctgtgttggccaggctggtctcgaattcctatcctcaagtgatctgcccgccttggcctcccagagtgatgggattataggcatgagccactgtgccctgccctggggaatcgatgttttaaactattgacaaagcctaattgtcaagggaagggactgagaaggggattggaaatgctgtttcctgaaagctgtgtttattgagaaatagtcccagtagctggagtgagttcaaagaagtatttttatatgtggacttgacctttggtcttttattctcattttccacttaagaaaatcttggctgtgtgaatgaaagagtgatacttttaaggttatagaaagtgaaatgtaatcatgccagataattttatatagatatttttatgtatggctgacctggatgactctaacagtgcatgtgtttgtgagtgtgtgtgtgtgcatgtgcgtgtatttaatgagaaaagtaaacttgtgtataggaggcttaaaaaatgtgtagggaattttaggtgactgttctgattccagacacttttattatggaagcaatcaagtaagtataggaagaaatattaataaaaggttatttatttctccttttactctttacagcccgaagatccctgttttgcatctcaaaaccgtgtgtacaatgacattggcaaggaaatgctcttacacgcctttgagggatataatgtctgtatttttgcctatgggcagactggtgctggaaaatcttatacaatgatgggtaaacaagaagaaagccaggctggcatcattccacaggtgaaaaacaaaacaaaacaaaaatcttctcttcattattagtgttagtcttaaattgctttaacagttatttttatttggcgaacatttatgcggggattgttttatgtcaggcacaaagatgaacaacccattattttccctcagaggagctcacaattgaatgggaaggattgacatgtacacatgtctgtcattaaaggtgggaaagtcagtgttttgtaatgattttgccatatatccaatgccatattattttgtcatttgaaaagtgttaccagcttgttaaagctctgttctaagtcctggagatggggggatattgttgatctgattttttttcaaattccatgcatagattacctctgaagaatgtgattatttttggtttttttgatagccttattcggagatactttcattttattttcctaatttaatactatgactttaaacttcaaacactctgagattctccctctttttttttttttttagaacagttagtattattgggtttgatcctttattgtttgggaatgaagaagcgttctgacatagatatttatttatttttattttcattattcgtttcacttaggatttaatggtgaaagacataagtatttaaaaagaacttcattatttacttatttatttgagacagggtctcactctgttgcccatgctggagtgcagtggtgtgatcttggctcactgaggccttgtcctcccaggctcaagtgatcctcctgccttagcctccagagtagctgggactaaagccatgtgccaccacacctagctcatttttaaattaaaaaaaaaaaaaatttttttttttttttgaggtggagtctctctctgttgcccaggctggagtgcaatggcgccatcttggctcactgcaacctccgcctcctgggttcaagtgattctcctgcctcagcctcccaagtagctgggacaataggcacccaccactatgcctggctaatttttgtatttttagtagaggcggggtttcaccatgttggtcctggtctggatctcctgacctcaggcaatccgcccacctccgcctcccaaagtgcagggattgcaggcatgagtcaccatgcccggcctttaaaattttttttttagagacagggtctcaccatgttgtccaggctggtctcgaatggacctgggctccatcctgggcttgggatgatctgcctgcctcgacttccagaagtactgggattacaggcatgagccactgtgcggggcctaaaaacttaagaaaaaaaaaagattaagtgagaagattgtatttaaaattttccttttatagtcatgcatcacttaagggtgggggtacattttgagaaatgcatcattagtcgttaggtgcttttgtcattgtacagatatcatagagtgtacttacacaaaccctggaaggtgtaaactgctccacacctagactgcgttgtatagcctgttgctccaaggctataaacttgtgtagcatgctactgtactgaatactacaggcaattataataggatggtaagtatttgtatatctaaacatagaaaagtacattaaaaatatgatataaaagatttgaaatggcacacctgcatagtgctcttacactggagcttgcagggctggaagttgctctgggtgagtcagtgagcaagtggtgagtaaatgtgaaggcctaggacattgctttgcagtattgtagactttataaatgctgcacacttaggctacactaaatttagttttaaaaacagtttcctttcaataattaaccttagttaaattactataacttttttactttataaactttaaaattttttaaactttctgatccttttataataacctttagtttaaaacacaaacagccccagcatggtggctcatgcctgtaatcccatcactttgggaggccaaggcgggtggatcactggaggtcaggagttcgagaccagcctgaccaacatggtgaaaccccgtgtctactaaaaatacaaaaaaatgagccaggcatggtggcgcatgcctgtaatcccagctacttgggaggctgaggcaggagaattgcttgaacccaggagacggaggttgcagtgagctgagatcgcgccattgcactctagcatgagcaacaagagtgaaactcggtctcaaaaaaaaaaaaaagaaaccacacacacactttgtacagctgtacaaaaatattttctttcttcatatctttattctataagcttttttgtattttttaattttttttttctttcttgagacagagtcttgctttgtcacccaggctggagtacagtggcgccctatcagctcactgcaacctccgcctcctgggttcaattaattcttgtgccttagcctcctgagtagctgggactacaggcacgtaccaccacgtctggctaatttttgtatttttagtagagacggggtttcacaatgttggccaggctggtcttgaactcctggcctcaagtgatctgcctgccttggcctcccaaagtgctgagatttacaggcgtgagccactgcacctggccaaattttttttttttttttttagacagagtttcactcctcttgcccaggctggaatgcagtggcacgatcttggctcactgcaacctccgcctcctgggttcaagcgattctcctgcctcagcctccagaatagctgggactatttttgtatttttagtagagatggggtttcaccatgttggccaagatgttctcgatctcctgaccttgtgatctgcctgcctcgtcctcccaaagtgctgggattacaggcatgagccaccttgcccagcccaaatttttaatttttgaaaaaaaatttaaacttttttgttaaaaacttaggcacacatttattagcctaggcctacacagggtcaggatcatcaagatatcactaggtgacaggaattttccagctttcttataatcttatggggatcactatcatatatgcagtccatcgttgaccgaatcatggttatgcagcgcatgactgactttattcaaagcattaatcgtatcttgatgtttatgacataatatattttgagatggagcaagaaaggacgtctggctaattcattgagcacgcgtggatgacttagtactcctctcatttgtgctcttcatgcctctctcattctacttccctagttatgtgaagaactttttgagaaaatcaatgacaactgtaatgaagaaatgtcttactctgtagaggtgagtacagccgtgagttgacaccgtaagcccttgttttccattctctcaagcatcacttaaatggctccaaattatgactgtggtacacatcacttcaccattccttcatttttgtcctttcaggctatttctgggttttgggtataatgaatagtgtcctgctttaatcttttttttggggggtgcgcggtggggacagggtctcactctgttgcccaggccctggagtgcagtggcgtgatcacagctcactgcagccttgaccttctgggccaaagcgatcttaccccctcagcttctcaagtagctgggacaacaggtgtgtgccaccaccacccctagataattgatttttttgtagagatggagtttccctatgttgcccaggttggtgttgaactcttgggctcaagcaatcttgcctcctccacctctgaaagtgctggggttgcagtgtgaatcactgagcccagccacaattaaatctttgttcataagtctgtgcatttatttgcagttattatcttttgtatgtttcttggtttttaaataatacatttgaattgccaaatgcctttttggaaagtaatgctgggtaacagttttcagtcacactaggagggtgtaagcacccattgtgcccttgccaacatttttctattttttaatctttgctaatttgataatgtaagtattctcttacttaaattttgaatttctttgattactagtatggttgaacgtcttgtaaattatgcatatgcctgtttacattttgggttcacaatgtctttctgattcatttgtgggaactcttctcctttaatattgttaataatggtttttgacaggcattggttttaaatatatataatcaaatctccccctttcccacttttttaattgcttataaaaacttggaaagtaattatccatcctgtgtttaccctggctctttcatgaagtctatagaattactttatacacatttgcttatttgataaacattctctctgttttgtatgtgcttaaagaagctgttttggggctcatacctgtaatcccagcacttcgggaggcgaatggatcacttgaggccaggagtttgagaccagcgtggccaacctggcaaaaccctgtctctactaaaaacacaaaaaattagccggctgtggtggtgcacacctgtaatcccagctactcgggaggctgaggcacgagaatcgcttgaacccaggaggcagaggttacagtgagccgagatcatgccagtgcaccccagcctggagtctgtctcaaaaaaaaaataataataataaataaataaaaagaagaagctgctgtttctttctcttcctccctctctctctcaccgccacccccccaccacacccttttttggtattcactttcatagtaactgaaattattaaagtgttctgttaccatgagtctgttttgaaaaaataggctgccttttaagcgatcttgagattttttttcttttctttttggtatttgttctgattctctgtagccttacagcatttcattcctagttaattcatttaattgctttggagttttttcttcacctagaaggtgttgcataaatatgtaaattctaaggaattctgtcttgtgactgtcatacaccaaaaagagaatgtgctgccctaagcatattttgcgttaaaatgaattttctgaatagcttgtcccatagttattcttttttgaatcaggtgatagaatttttgagcttacaggtaataaaagaagatgcccttttcttttgtattagagtttccaggcttaacttggagtggagcatagattcctagttgacactgtggtttcttgccacatttgcaggacctctctacctgtctcttctacttccttccctgtttactctgctccacccatattgccttttttcctgtttcaagaacataccagaaacattcctgcttcaaggcctctacatttacttctcctcttgcctgaaatgttgttcacttggatgtcattttgactaagtttctcacgttcttcaagtctgcataaatcacacactctcagtgaggcttaccttgaccaccttatttaatattgtatcttgccctttaccccacatcctgagctctcttccccattctattttcttttttccatcatactcatcatgttctaacatgctttctcagttacctattttttatgtttgttgtttattatcagtatcccttgctagaagcataagctcactggggcagggttctttgtctgctttatttagtggtgtataccaattgcctagaacagtgcctgtaagagaacggtcctcagtgagttggatctgccaggtggcatctggagtggttggtgcagaagtaaaagaaatgatgatggctttggatggattcacatatcagagcataaggaatggagcacatgaacttttacctagattatttgggttctctttgtctcacatttgtgtgaaaaggtacgagtgttccaaaagatgtaatatattccggggattcagtattgtatgtacaaatttaagtacacagcaatgattgaagaatcatctcactttctaggatgacttgctgtcagaaagaatatttgttgttctgttactttactctcataatagattaattactttatctttcagagttgtctttttttttggagacagagtctcactctgtcacccaggctggagtgcagcggcgcggtctcggctcacttcaacctccgcctcccaggttcaagcaattctcctgcctcagcctcccgagaggctgggattacaggctcctgctaccacacctggctaattttctgtatttttagtagacacagggtttcaccatgttggccaggctggtctcgaactcctgacctcatgatccacccgccttggcctcccaaagggctgggattataggcgtgagccactgcgcccggcctttttttctttttcttctttttttttaagacaaggtcttgctctgttacccagactggagtgcagtggtgcaaacagggttcgctgcagccttgacctcctgggctcagtgatcgtcctgcctcagcctcctgagtaatttgcaccacaggcatgtgccacagtgtgtggctcccaaagtgctaagattacaggcatgagctactgcatctggccaagttcttaattttttaaaatggattttatttatttatttatttatttatttatttatttatttatttatttatttttagagacaggatctcactgtcacccaggctggagtgcagtggcgtgatctcagctcactgcatccccaacctcctgggcttgagtgatcttcccacctcagcctcccgagtagctgggaacacaggcacacactaccatgcctggctaattctttgtatttttggtagaagtggggttttaccatgttacccaggttggtctcgaattcctgagctcaagcaatctgcccaccttgacctcccaaagagtggggattccaggcatgagccaccatgcccagcctttaactgattttaaaacacaaattaaggccaggtgcggtggctcacacctgtaatccctgcactttgggaggccaagatgggaggattgcttgagcccaggagttcaagaccagcctgggcaacgtggtgagaccctgtctctgcaaaaaaaaattttttttaattagctaggcatggtggcacgtgcctgtagtcccagttactccagaggctgaggcaggaggattgcttaagcccaggaagtcgaggctgcagtgagccatgtttgagccactgcactccagcctgggtgacagagtaagatacagtctcaaaaaatatataaaaataaaatacagtataaaaatacagttagagactgaatgaaagaaaaaggcaatagaaatggaattaagattccattccagatactctgaaaacatgtccatagacatttaaagtttaaaaatgcaggagctgtaatgtaagcttgaatagctccatgatacagaaggatctgtttcctgggtagcatcgtaatgtggcctattgtgatgaatttaccctagttcagagccttgtttgcttagaagtctgattttgtagattcatcaagaaaaggactatccttacaagttaagacttgagtaaagctcatttgactgatgttatgaaaccaacttgttggtttgttactttaccatgagaaataactattactaaggctagaacactcaagccattcgcaagactatttaatatatttctgtggacagacctcgctgttggaagcctgttggttgtttggtgtgcatggaattagaaggagaggagttgcttagatacatgtttaattgccccaggttaagaaatgatagcttaatgcattaatcaccatgatcgaatggtcctgccaatgagacaagaatttatgaagtgtattgtctgaggcttctttctccctcacaaatcttggataggtcctgccaccaccagctttcatgctggtcaaccctcatcccttctggaggatacatcgtccatagttagtaacagtgtggtgagccttaaagaattagcatcacccgtctgttttgtcttctctgctctgtaatattgatattgttccttggttttaactctaatagaaatcttatttccgagttcttggagtaacctcaatgcaaatcccagttactgacaacagtatacattttaaaaaacattgataactgataaattgctactaaaatatcttttagctgtcactacattccagagataatctgtttacctctcccttacagagaaagtctgaaggctggttctaacctattcagtgtaattacctgtgcgtattgttaatagaataaaagggcctagagttacggcatttcactttgtaaaggttgctgatctctaatcttagagcttttaataaaagttaaaaaaattttttttctgtatgtgatttcttttgttttctttttctttctttctttctttctttttttttattaagacagagcctcactctgtcaccgaggctgaagtgcaggggtgtgatatcggctcactctaacctccacctcccaggtacaggcgatttctcctgccttagcctcctgagtagctgagactacaggcatgtgccaccacgcctggctcctttttgtatttttggtagagacgggatttcaccatgttggccagactggtctcgaactcgtagttcgagtgatctcaagtgatccgccctccttggcctcccaaagtgctgggattacaggcgtgagccaccgcgcccggcttctgtatgtgatttctttttcactctaattcactttactaatttgttcataggtgagctacatggaaatttactgtgaaagagtacgagatttgctgaatccaaaaaacaagggtaatttgcgtgtgcgtgaacacccacttcttggaccctatgtggaggatctgtccaagttggcagttacttcctacacagacattgctgacctcatggatgctgggaacaaagccaggtatggtaggaaatagagtaatgactgaggtctttggcaccttttgaggtccttttttcccagttaagggtttgaggccacatttatagctatgaaagttgctttaattgtggagtcctctgatcctttgactgtgctgtaacagtgagggcttcagagtgttaagtatcttctcatctaaacagtacattgctgaaacatgttagagctctcattgagttttactcttaggttttgatcaagtcatggtaaaatgttagttatcatgtatatatgcggctgtggtagtaattgattctggaataaatgagcaccaataaagaataaaaattaaatgcttcattggtttctaaagggatagctggagtatgaaaaatgattctgatggggtgcctttggaattggagagtaacttgatgggctcacaaataaggcagtattgagagcaattgtgtaagtgacaatcttgcaatctgtgaataagtttaagactattgcttgtgattgttatgcttataatgtggagcctgctgtccatttcaactctcatctaagaattcccttgtcacgtggtcacctttatgtttatttaggacagtggcagctacaaacatgaatgaaacaagtagccgttcccacgctgtgtttacgattgttttcacccagaagaaacacgataatgagaccaacctttccactgagaaggtaggagagtttcagtctctaggcttgagttgtgaaggatggagattttgagaagtcccttttgttgccctctgctttttgtggaaggttgggtgttggggggtgctcttttacttaatggagggtgttttatacctctgcttatcatttttcttccaccctacaccagttttctgtataggttcttaaatgaagttgtaagatagagaatagggttaagaaaaaaacaatccaggactttgggtctcaaaaactactcaatacaagacagttaagcagtcttgcaggagaaagttctttcttttcttcttcttgactgaacctttttattaccttattagctgcctttggtatgtgtattctttttttttttttttttgagctatgataatgttatagtgggattaaatgtttaagcaaatgatatgtttcattcctggaaaataactccacaacagttctggtgttcttcaaatacctttctttgcttattgatttttcattttctatagtggttaaatgtcacagactttagcgttggattgcttgctttgaattctgattctgccactcttcagctatattactttgggcaaactacttaacctctttgttcctcagtttccccatccataacagcctgataggattgttaaaaagattaagcgttaatataggttaagtgcatacaataatgtctggcacagagtagccactcaataatgttaattttattgttattgttagtaataaaaaatttatgttgaatactactctatctgcatccctaagaaggatgcacctggatttttaagcttcaagttaggtttattgtactggcaattataaaagatcctttgccttataaaatgagtactttagacaccactgtcactaattattaaaatcaccttttatttgttgacttatttctagctgaaaatgatttttaaaaatatactcctgctgggccgggtatggtggctcacacctgtaatcccagcactgtgggaggccaaggcagacagatcaagaggtcaggagtttgggaccagcctggccagcatggtgaaacccagtctctactaaaaatataaaaaaattggctgtgcgtggtggcatgcgcctgtggtcccagctgctcaggaggctgaggcaggagaatcgcttgaacccaggaggtggaggttgcagtgagccaagatcgtgccattgcactccagcatgggtgacagagcgagactctgtctcaaaaaaaaaaaaaaacacactcctactgggcatggtggctcacacctgtaatccaagcactttgggaggctgaggcgggtggatcacctgaggtcaggagttcgagaccagcctggtcaacatggtgaaacccagtctctactaaaaatacaaaaaattagccggtcatggtgtgtgccggtaatcctagctactccagaggctgaggcaggagaatcgcttgaacctgggaggcagaggttgcagttggctgaggttgcgccattgcacttcagcctgggtaacaagagcgaaacttcgtctcaaaaaatatatatatatttcttatatagatgatcaaataacttgtttagccagaggttataatattagtgctatttattagttagtgtttatctgaatgccagcaaagaacattgtatgtgaaggtgttttttgcccttctcccatgatgtcgaatctacaaaattaatgttaatcccataatcatagctttcctggtaattcattttggatacttttgtctaaactttcctgaagctttatttttttacagtgttattgaggtattattgaagtatacagtaaatggcacatatttaaagcgtaaaatttggtcagttttgacgtatttgtatacctgtgaaactagcgccacaatccagataatgataatttttattctcaaaagttgcctcatatctctttgtagtctttctctatcccttcttctgtggcaattcccgggcaattccggacctgcccttttgtcactatatattaatttacattttctagaattttatataaatggaatcatagagtatgtactgttttttgtctggagtctttcacttagcatagtgattttgagattcatctatgttgttgtgtttatcaatagttccttttcattgttgatgagtattgcgttatacagatacaccacagtttattaattcaactgttgatggacttttaaactgttgccagtttttgattattacaaacgaagctgatgtgaacatttgtgtacaagtctttgtgtggacatttgtttttgttctgttggtaaatacttaggagtaggatgattgagtcttattgtagctccttaagaaatgtcaaggctgggcacggtggctcacgcctgtactcccagcaccatgggaggctgaggcgggtggatcacaaggtcaggagtttgagaccagcctggtcaacatggtgaaaccccgtctctactaaaaatacaaaaaaaattagctgggcgtggtggtgggcgcctgtaagctcagctactcgggaggctgaggtgggagaatcgtttgaacccaggaggtggaggttgcagtgagccaagattgcaccattgcattccagcctgggtgacagagcgagactctgtctcaaaaaaaaaaaaaaaaggaaagaaaataaatgtcaaattgttttccaaagtgattgtaccattttacattcccaccagaaatatgtgattgttccagttgcttaaagcttcacttttagtaagccatttaatgagttgatgagttttatatatttttataacatactctagtaaattatgtcatgtttatcctaaagttacttttttttgaaccgtgataattgctatgaattttgtgcatgctctttttttttttaattaaaaaaaatttttttttagagacacaagggtgttatatgttgccaggctggagtgcagcagacagctttgaactcctgggctcaaaggagcttcctgagtagctgggactacaggcatgtgccattgcacctgccgtgtgtactgtttaaactaactgatagatgttgtcttgatctttttgtgccatatttaaaagctctaatacttttagttttttccataccttaatcttttaaaaagcattctgcctctaaatatttcctgcttctatcttgcttatttttgaattgcccccatgttattgttctttatcaggtcagtaaaatcagcttggtggatctagcaggaagtgaacgagctgattcaactggtgccaaagggactcgattaaaggtatttattttagcaaataaatggcctgatcaataaatggccactacctgtttttgtaaataaaattttattgaaacacagctacatacatttgtttatgtattgtctatggctgcttttgcactacaatggcagtgttgtgacagagaccgtatggcccagaaaacctaaaataatttgtgtctgtccttctacggaaaaattttgctgactcctgatctgtaacttcaatggaaggataagttatctaactaaatagttagggagcacatcatagtcagggtgagagttgaattgcattttaaggaacaggtagaatttggctagatggaattaagagatggcagtgggaataggatatacaagattcagatgtgagaacagaaatttcatgtcgataagttgagggaagaaggctgcacacatctgtaagcttttggagcacaaatatctcgaagatacttcaggactgtgagttaggcatgtggtctcagcatgttattatcaagtggaaaagaggacagatggaggactaaaggttgtttttagaacttgtaataaagaaatatgctagcatatggcaaatcatattttatgttctgtatgatatagcagtagtagaaattcttcatcattctttcatatttggtatttattttaggaaggagcaaatattaataagtctcttacaactttgggcaaagtcatttcagccttggccgaggtggtaagttttatacttcattataaggggagttgtgtctgttcagcaaatatacttgatgatattttattattgtttatgaaggctgtctttttgtggcccttttctgtaatcttgcctttctccttttagagcttttcagataagatactaggtataacacagtttgactttgtactgaaagtaaaagatactaaggagaacaaaagtaaatatagatctgtaaaaactagagcaaacactgaaggtttgactcatttttttgagccttattttatgtttctcacaaaaaccaagtatatttattgtctcttcttttcctgtataatcttttctgagtaagatgcagtatcttttggagtattttgagcagtttggctttggtgaatgctgttgatttgagggccagtagttttttttttttttttcccccaatagttttgttctttcctactcctttatggtagaacagtaaaactaaaactattttttttaaattaggggctttgttgtctacattatttaaattagtcattgtgtgttctagtttagtttaaaacctctttttaattgctaagaagaatgaaatgctttcttgcttgccttggagaaatcataatctatgacatgaaatttaaacaaaatctaattttctacttggaggcttatcctgtgttcttattttctcctttaaatgctttcacctgtaggataactgcactagcaaggtacagtggggattggtagagataaactagaattgacttttatgttttaaatcctcactaggatgtatggaggcataagtaggaatggaaccttcaaaaatcttttcatcatttgttctctggctctggaatttagagtggctgtaaatttagggtgaccacaaatcatgaggtttcacaccaaaattaatttctagaacatgatatgctttggagaaggaattaagaataaaggaacaaggccgagcatggtggctcatgcctgtaatcccagcactttgggaggccaaggcgggcggatcatttgaggtcagaagtttgagaccagtctggccaacatggtgaaactctgtctctactaaaaatacaaaaattagctgggtgtggtagcgcgtgcccatagtgtcccaactattcacgggttttaaactgaagttttaggcctcaaggattacatagtggagtgaaagtttgttccactaatctgaatgactgaaaggcttaattctcccttgaggtctgtgcaatctaaaattgaacctgctattggaaatgactttctgattggtggattgtgtgtctgtgggtagagtggaatgagatgatgatgatgtggacatatttaataagagatggaattaaaatgtttcttgcctactccctttcctcctcctcctcaaaaaaaaaaaaaaaaaaaaaaaaaaaaaacccaacaaacaccacaagactagccactaagaggccagccatgtagtaccctttttctgaatagaaaaagtgcttgtgcaatagtaggatcatccttagtttaaccttggattataccaggactgaattataaaactgctgatttgctggagtggtgtttagcagtgagaccctggctttctccttagtagcttctttttttttttttttttttggagaccaggtctctcactgctgcccaggctggggtacagtggcacgatctcggctcagtgcaacctccaccttctgggttcaagcgattgtcctgcctcagcctcccaagtagctgagattacaggtgcccgccaccacccccggctaattttttgtatttttagtagagatggggtttcatcacgttggccaggctggtctcgaactcctgacctcaagtgatccacccacctcggcctcccaaagtactgggattacaggcatgagccactgtgcccggcctccccttaatatcttcttaaagtgtcacaacgcagtagtcagccagcatatatttgagtagctgttacctgtaaagcatttgcattaatttttacttttagagaatataattttttttcatttaagcactgccttttcattggtgctttttgctttgtcctgtggtaataagaaggatcatgaagaaagcagaataagtagacttaatagaacattcatctttctaaattaccaaatcatatctctttcttagacctttttacttttagtctttgctttaataattggattatttttggcataatttcctttcaaagagaccaaataaatattattttacaagagttactagatttgcaacaacccaaccaatgacatggtggttggccaagtaaattcactaactagatgacttgctcctacacatccaacctggaatgcacaagattagtattttcccctgtgcaaaaataaaaattgaggatggggtatttgatgatgttagggaattattgtttatttaatgcacaagattagtattttcccctgtgcaaaaataaaaattgaggatggggtatttgatgatgttagggaattattgtttattttggtaagtgtgataatggtcctgtggtgttttgttttgtttttaaaaaacatgaccttttccttcacagtaagaaaaaggataaaaaatgatatggacaggatattaggtaatagtattgtgttgatgtttaattttttgaatttggtcattgttttctgtgtaagagaatgttcttatatgctgaagtgtttaggggtaaatggagatgaggtccgcaactgacttcaaaatgggtcaggaaaataagttgtagaaaagtgtttgggggataattgaaagatgattggcagagtattttggtaatggttgaagctgcacgttgggtatggtagctcattatactgctctctcaactgttgtgtatattacacagttttcaaaataaaatgtaaaatgaaaaaattaccttgttgcgtgagtttttggttttgtgaagaattgaaactatgaatgataaacttccacagtgtcggggttgtactgtaatttaatttacttgggaattttagactgatttgcctttcttgggaatttttttccctaacgaaaaatgctaagaccatttcttttcctttaatagagtaaaaagaagaagaaaacagattttattccctacagggattctgtacttacttggctccttcgagaaaatttaggtatgttgaccactagtgaaaagtagttatctttttaactttgattatcttttgtggttaattgtcctgtgtctgttttggagacaaataatctctagatattcatgttactacttgagtgttccttgcctgctttcatttttactcctaatttcagttggttggattcccttggttttaagccagggtatactcccatatctcattttcttcagggcatgaactgtgcagtagttgtcctcccgactccccatacttgcttcagattattgctctttcttcgaagttatttcaaaactccatgcttctctgaggtgcacaaaattagacattgccaacccttaatcctcctcgttgctgatgttttcagaccttcaaatcactgttcttcattcacttctcctactttttttttttttttgagatggagttcgtgctgttgcccaggctggagtgcggtggtgcaatcttggctcactgcagcctccgcctcctgggttcaagcagttctcctgcctcagcctcccgagtagctgggattacagacacacaccaccttgcccagctaatttttttgtacttttagtagagacagggttttgccatgttggccaggctggtctcgaactcctgacctctggtgatccgcccacctgggtgaaagagtgagactccctctcaaaaaaaaaataaaagaaagaaatttgacattacattaaatcttaggatctgagattacaatatcagatttgacacattccataaaatttttcttctaaaatgagtgtgatttgatactcatgattaatctttttaggtggcaattctcggactgcaatggttgctgctctgagccccgcggatatcaactacgatgagactttgagcactctgaggtactttcttttgatctcagtaacaacatagaccacattgccatcagaagccattttgtgataccatggatgtttttatgctatctgggtagttatttatgtaaataatgttcctttcctctcataacagggaaaacttagggaaaaagtgatttgtattataatagaatttacctctttatggttttcagtttcactgggaaagatatgaactttttatttttttatccctcatggatacctagataaggcaggagctttttcataggaaagatttttaaattgctcaagtgagatttttgggtaacttttaggtaatagtgacattttcttattcatttctataaaaagaagtgtcccccttcttgtagtgtttgtcgttatagaaatgctgaagtcggccaggcgcagtggcccccacctgtaatcccagcactttgggtggccgaggtgggcggatcacttgaggtcaggagtttgagaccagcctggccaacatgatgaaaccccatctctactaaaaatacaaaaatgagtcgggcgtggtgccatgcacctgtaatcctagctactcaggaggctgaggcaggagaattgcttgaacctgggaggcggaggttgcagtgagccgagatggcgccactgcactccagcctggagacagagcgagactccatctcaaaaaaaaaaaaaaataaattctgaagtcataataagtaataaaattataggaatatgtagcaatattaaaaaattaccaacatagccaggtgcagtggtgtgcacctgtagtcctagctacttggaaagctgaggcaggaggatcacttgagcacaggagtttgaggccagcccaggcaacgtagtgagactctgtctcttaaaaaaaaaaaaagaaaaaaacaattaccaacagaatgttcataaaaagttttttttgtttgttagtttttgtttttgagtcttgctatgtggcccaagctggagtgcagtggcaagattgtagctcgctgcagcctcagacacctgggctcgtgtgattctcctacttcagcctctcaagtagctaaaactataggtgcatgccactaggcctggctaatttttaaaaatttcttgtagagatggggggtcttgttaggttactcaggctggtttcaaattcctggcctcaagtgatcctccccacttggcctcctaaagtgttgggattacaggtgtgagctgcctcccgaggcctgtatttttttatgtatgagtaggtttcattactttagtctggaactctctacccttcttccatgaaagacacttgatgtaatggaataaacactatacagtctcataagttgggtttaagtcctctcgctgttatttccattgtgatcttgggcaaatcacttaaattcatctgagcctttttcttcatctttaataggtactataaagctttatacaaatgtattattatcaaggctcataaaatgtaaacactcaggatatttgatttagagataatagtatgttacttatgagaagtagaacatatgagaaatgacaagaacaaattttctttttggatctagatatgcagatcgtgcaaaacaaattaaatgcaatgctgttatcaatgaggaccccaatgccaaactggttcgtgaattaaaggaggaggtgacacggctgaaggaccttcttcgtgctcagggcctgggagatattattgatagtaagtgaattaaggatcgttacaaaatctaatcctttcttcttcagggttcttattcagcgttcttatatttaaaataaacttcaagttaaggagcatgatgaagctaaatggtagtgaaaatgttttgttttgttttgttttctttttccttaaaaaacccaatggaaatgatctctagattcctttatgtaatgtgtaccagactatccatttgaactcaggaaattagttttaaatcgcaaatatgtcactagtatttttgttagaattctgttttagatcagcaatgaagtttatttggaacgttaaacctgttatcactgagcaattaattacttcatagaaatgttatttgaaattttgagttttgtttcatgggttgctctggattagtgtcgtggcagtaatataagaaacgcaccattcaagcctaccttcagataagattcacctttgaatggccccctcctcctgtaaaatgctggagtgccccgtgctgcctatgaacatatgaaggggaaaagttcaattcctatgaagttcaagaactacacttccagagagtattgttttacaatgttgtattaaaatttatcttaaaaaatctccgtgatgtgcctatccagtggcttattcagaagttctcttaagtgagtaaaatggattcatataggaatagaatatggtagaatatgggttagtttagtaaagcatttttttttagtgtaaagttaaacttatattccttgaagttctaataagattttcaaggcctcttctagtttaattcttcttattgattagagtccgagtttagatgaataccgtttgtaaaaatgataccgtattctaagtattaacttttccatctccccaaatgccaaaaactgctctgttccctctctgtgtcactgctgaacctgaactttgacccttctcgtattttccctcctgcttaccttcagttgatccattgatcgatgattactctggaagtggaagcaaatgtgtgtatttcacatattggttatttccagtactctgacttgctaatctgcctctgctggatcagccttaaaataagctttgcatgctggcaatccttacagggaaatcccagacagagcatagtatagaatcagaaatgatcctatttttgcccttcttcatttagcaaactaatctttgctgaatttcagtttgtggcttgagtgaagttgaaaggcttaagaatctcttgctgcttctactcttcagtttttcccattgtgattcaattaaatccaaaaatcatagatgatagcaactgacacttactgattttgcataatatgccaggccctattctaggcaccttgaatatattgtcccttttaattctgttaatggctctgaaaatattttattatgttccttttaccaataatcatttttagtcagcaaaactatctatgatttaagagctctgtagatgttgggctaagactcatgagtgcttgtgctaagttgcttttctccataacttgggcctcggaatgattagataaacgttttttcctttttttttttttttttttttttttttagacagtctcactcttgtcacccaagctggagtgtaatgacatgatcgtggcccactgtaaccttgaactcttgggctcaagtgatctttccagctcagcctcctgagtatctgagactacagttgttcgctgccacacctggctaattttttaattttttatttgtagaggtgaggggtctcgctgtgtttcccaggctggtctggaacccctgacctcaagcagtcctcctgcctcggccttccaaagtgctaggattatagatgtcagccaccacacccaaccattcctcttttcataagtcacaaattaaaataacttaggtgtctaaaatgactcaaacatttttaaagagtcacatgaacctcattattctctccacatatatcttaagttggtgaggaaattatttcttacccttttaaggtaattcatcaagaaattgttatcttagaagaaaaatgtcttgattttggggctaatttttagatttgtactgagttatttctttttttttcttttttcttttcttttttgagatggagtcttgctttgtcgctaggctggagttcagtggcggaatctcggctcactgcaacttccgctgcctgggttcaagcgatttctcctgcctcagcctcccgagtagctgggactataggtgcgcaccaccacgcccagcttatttttatatttttaatagagatggggtttcatcatgttagccaggatggtctcaatctcttgacctcgtgatcctcctgccttggcctcccaaagtgctggcattacaggtgtgagccatcaagcccagccacctgagttgcttatttctacagtaaggcatgtaatgaggcttggcagacagtgagaaaatgcataggagaaaccaaacatagccctggctgtggttatgaggttagggcttaaaggcactataatgtcctgatacagaagtgactcttggactgcaacagctctgtctgagatttccaaagctcaacgatactggtgtggaaaaggtgccttcttctttttgcttttgtgctcaaggtgttgctgctgccagcttgttgcctacctcttttcttagcagctgcggcatttcctgaaagaccatgcatgactaagttttaattctgtattcctgagggaaagcagccctgactccttctcagtttccattttgatctatttctctttattccttttagggcttgcatgtgaccattggacctaaactctgtccatcctggtcttttctcccaatggctaattttttgctctaatccctatcccccttttaaaagatgcctctttgcttgttgccctatgttctgtatttgcagatggtggttttcaaactgtcttgaagcaaccactggctttaagggagttaaaaaactggctttaattaaatagtagagatgagtaagcccagggagaactaatagtatttttttccagctatgtgtattgactcatctcctttgaggaaaactgacttagttttgatatgaattttagtttctcaggtttaaaaataagctaattttaaagttggattgcaccaatacttaagatttacctttggtatctttttgcaaaggatgactaatgaaagaaagtaatgaaagaaagtacaaacagcaaattaattaattttgttgtttgtggcttaatttttttttcttttaccaatactgagtgtaaaagcaaaattaacagttctattaaagacttagtaaatggaagtatgttcctaaaacttgcattttatactaggaagcaggcttagcagtgacccatggttgtactgttaggctaattaagggccttaaattagcaaataatcagccttattttttgcttgctctgacagaagaatggaacctgcactaaaactcattaatctgctaattgttcttccctgttgaggcaatcaattagtcctgagtttttaaccaggacttatacaaaattcctctcatttctataattaccccttttttatttaagacatattaaaaatccttttagcatgttgaaatgttgccatacaaagcatactactcagtgcacaaattttgttttaactgtaacattttcttggaaatttttgctgaattacacgtaacactgagccagaccaatatggattattattgataaataaatgatcattgttttcccttactgttacaaactactggaaaagtgtaaatctgaagacattgtagactaggaacactagaaagactaaatggaaggtagtttggcttttttagggagagtgcctaagcagtatcctttgaggctctggtttatccccctgcgagatacagcgttaacctacattggaatcttttagtttgtaaatgcagaaatgattctgaacctgtaggataccactattaaagacagacatgttttagaactgccatctagaacagttgtaacctgtgtttgtattatagcgtgtcttggtcttggcgctttaatgctgtcctttcttacaacgatattccttcctgtctttttttcttcctctgcttctttcccttttccctacttttcctgccttctcttctttct

SEQ ID NO: 158 - DNA, 70898 bp, Homo sapiens
gcgcgcagcgcggccgccgccgccagccccgccgaggcatcccgcaccgcctgggcccggctgggctgggggcgcctccgcagcagccgcggggtcgggaggcggccgggagggaggcagggcccaggacgcaaggtggcgacaagtcgcgtttggccccaggtaacgggggtccggcggcggcgcccgcgctggggtcacggtggccgtgcgcgggggaggttgcctgggctggcagggtcgggaggcctcagaggggacaggaatatctggaatgagccttctgcccgaaagctgggagtaatttacgatagtaatagtcatcgtaatcctaaaaccgctgatactcaggtgcgcactgatgtgggtggcagtgtgctggggagcttggcaagcattatctccctcaacagtaatcacgaagttgttgccatccttaatcccactttatacctcaggaagcagaggcttggaggtcaagggagttgagagccgggaagtagcggagctgggattcaaatttcgcttggtctgatttccagtgctggactcacagcgactccgcagcatcccctgctcgctaactcatccgtgatcccggtgaaggacctatatcagggaaaagaaatgcagcatttcatctttaagtgacttggaaggtgaaccctatgccaccttcctcccaggatatctattttctgggtaagcctgaaagggcagcccctgttatgattctcagacacaccgcatttgtctcgcaggaccttgcatgtgctggtacctctgcctggaccagccccacaacaggctccctctccgtagggcctccttctaacccgtctgttttactctgtatccctgccctctagtcatttccttcttagcacttataatttgtcattatatactttcatttctttttaaaaatcatgctcttctaactaggctctaagctctttgaaggcaagggatcatgcctggtttttggtaccactgcatccccagtgcttagcatggtaaagccagaattaagcaacgcattgtttctcacccacactcatttgttttttcttctgtgcagaaaattatttgttgcctactgattacatgcaaggcaggcaccttgatgggcattttcaggatagtgcaagatcatagagggccttaatgatcaggctaagaagtcgaaactttagtctgcaggcagtcaggagcccttgaaatcttttgagaaggggagcgacatgactaggtgtgctccaggaacattattctggcagcagtgttgaggagggatgacagagcagagccggtaaacctagtccagagcctcaaacttcactatgtgcagaaatcactggggaccctgttaaaatgaagattctgatttagtagttctggaatggggccggaggttctgcatttctaacaagctccggggtgagactaatgctgttggtctgctgaccttactttgaatagtaaggcccttggggacagtttggatatttttttaaaaatctaagtgatttttcaagaaaatcaactattgagcacctgacttgggactcctaagtggccagcagcaagtggctgaccaggcacatctgtaaatgtatgttgatagaaaatagattttggagggtgtatgggttaggaattgcagtttgatactagtagcaaaaaacgtgtacatgagtttattttcctcgtgaaagaagaagtttggaggtcagtagttgctgacattgatttattggctcaaggactgaatctctgaaaatcttttagcccttccctcatgatcacagtaggctgccgacgccccagccatcatttcttcattccaggcagaaagaagaaaagggaaaagagcagcaatattccagccatctaagtaggaagagctttctagaagccctacattataaacaaacacttaaacatatcattggctatcaattgagagtgagcacttgagcaagggagggtaggaaatggtttcttatttctttgtttaaagttagacccatggctgtagagaattcgatcctgccttgctgtggcccttagcgcttgggctgcctctgcccagaggagggaatgccttcttaataacccacacaaattcaccaactctggttgctttatggtaatactaatggcagccaccttttactgagcacttgccgtatgccaagcattgtgctaaattctcgacatgtgttatttaatgtaatcattgtaatggccagatgtggtatgtgctgttactgtcttcattttgcagaggaggcagaagggttaatttgttcacgctttcaccacttacacttactttacacttactttcaagtaagtgtaagagctggaagtctgactttatttattttgaaacagggtctcactctgtcacctaggctggagtcagtggcatcatcatggctcactgcagcctcaacctcccaggctcaggccgtcctcctatctcagcctcctgagtagctgggaccacaggcttataccaccatgccccgctaatttttaaaaaattatttgtagaggccggatgcggtggctcacacctgtaatcccagcactttgggaggccgaggcgggtggatcatgaggtcaggagatcgagactatcctggctaacacggtgaaaccccgtctctattaaaatgcaaaaaattagctgggcatggtggcaggcgcctgtagtcccagctactcaggaggctgaggcaggagaatggcatgaacccgggaggcggagcttgcagtgagccgaaatcgtgtcactgcacttcagcctgggcaacagagcgagactccgtctcaaaaaaaaaaaaaaaccaattatttgtagagatggggtctccctatgtttcccaggctggtctagaactcctgggctcaagtgatcctcccacctcagcctcccaaagtgctgggattacaggcgtgagccaccacacccagctgaggaactctgtgtttagagtccatcctcatgatctccacaaacactgcctctttgttataactgtgaagaaagcttttgagtttataaaagcagtaaactaacatacacaaactactgatgctcccgggcacagaattataacccctttcgagagggaaggatttttcaaaaccatctaatcctaacacttgaattttacaaacagagaagctcatgaatagctgagtgggagggagaacccaggtcctcccactcctaggtcactaccttccactttaaatcttcatattttttattctaatgagcacatggtgttcgacaagtcacttaacctcttggaatctcaaatgtgtccatttatgaaatgggacgttggaccaaatgatttctgagggtcctgggctctgaagttgagtttaggtataaggaaatggaagttaagtgattatgtctcccaaatggggagagatttatttttcagaaaaggacacaaaagaagagacattattaattccttataacttaaaattttctgttttctgtttctatctacggtgcaaaatgctgctcttgagatttggtttagtcattttcccaggctcaaatagcagaagcagcagtagaaaatacataaatcatggttctctcacagcatttatatgcctacttctttcattatcaacatttgttcagtagattaatacttaaggaaaaactgttcacatttcattggccaggatcaacgtattttccttttactgtttctaggaagctgcaggcaagaattttaaatgctttcttaggcaccaaattgcatgccttcatctcaaagcaaaacagctctatgacatttttttcctataagaaaatttccattattcttgtataatcaaattattccttttggacatagaaacaaaagtatttcccacccccactccccaaatcatttatgtcacttctttgatgtacgtatagatggtgtgaatggtactagaaatcctgactgttcagaggaactggttggcaccctttggcagatacagtcaaggtcatgggttccctaatcatgaggtccagtctggccagtgtatcctgtttaacctcaggcttctggccagtcacctgccaataggtacattaaacaccaagttagagaaggttggtttgacttaactccatcccaactcttagaaaaagtgagccaaagtctaggcccagtggatgttggattatcaaagggcagcactcaagttgacctccccatgggacgaagtcataactttgacaatgaaagtgggccttgcggtgaggaccactctggttcatgtccagtttccaccactgactagctgtgcattagtggtagttgtacatgaaccagattgtacctaactgtaaagagcccagactttggctcattgggcaagtctcttgcctgctctgaacgtctgaatatcaaaagcccattgtgggaagattcaattaaatgagattcatttacaaagagtgtagcacaaggtgtgcacacaagtcgtgtgcaataaatggttaactacacttatgcatatttgctcttacctgactatataaatgtcttggctaaccatgatttaattgacttttgtatttcccacctcagcttaacctagcaggatgccctgtacacagtaggttctcaatatgtatgtggcaagtatgagtgtcagtctatataatcaagagtgcaagaagtgcagctgcttcctagaaacctaatttctgactctgtgttgccattttgtcttgctggtggggaaaaaaagaggtagccttagtgcatcttgggtttcatcatgggtccttgctttctcagaatatactgtaatttcaggcaggtgcctaaattgcctagtatatggtcattcaggatagtgcgcgcatgtgtgtggggtgtcccttctcatatttcatcagttgttggcatatcgttcctgttcttccaagccatcgtggtttggtgactcttggctgccttgtgccagacttgtggtgtgagaatctgggctgaggatgcatttgatattagatgcatccacaggtattcttctcagcagtatatctgagaaactgggtgcagctcccctctctctcagtacccttctcttctcctcctcctaccttcatctccagggactccctatatactctggaagagggtgaaaacccagttcttccttgttcttctggacaatgtaattatagtcatccctcagtataaacagggaattcgttccagggcctccgcgtgcacccaaatccatgcatactgaagtcccatagccagccctgcagaacccatatatatgagaagtcagctcttcatatatgcaggtttcacatctctcaaatactgtatttaccatcttgttttgattgaaaaaaaaaatcacatataaaccaacccatgcagttcaaacccatgttgttcaagagtcaactggaatcaatttccctgggaagctgtgttccccaaattcaggtgtttggaaaaaataaaagccgggaagccaccttgccgtaaacctctcctagtcaaggaagcccagagcctgctatccacttgaatgttgggaaggaaagggaaaaatagaggaagaaaaatgatcactgcatatctcaaaatattgtgcttgctgtctgtatttgttgaatgaataactgaatatctttatgtgtatatgtatagcatattgttaaacttcatttaagcaaaatgtgtttagtgaaaactctttaacagttggttttctttctccacatgcaagagaatgaaattgcgccccaaccccaccccatatattttaaaaaattcaaaattgatgatagacctaaaactcagggctaaaactataacaactcttagaagaaaatataggagtaaattttcatgactttagattaggaagtggtttcttggatatgttcccaaaaggataggtgacaaaagaaaaaaatacataaattggatttcattaaaatttttagggtttgtgcttcaatagacaccatcaagaaaatgaaaggcccgcctacagaatgggagaaaatgtcttcagataatgtgtctgatgggggacttgtatccagagtatataaagaactcataactcaaaaaagacaacccaattttaaaaatggacaaaggctttaaataggcatttctctaaaaagaaatgtaaatggccaataagcacatggaaagatactttgcatcattagtcaataggacaatgcaattcaaaccatctgagataccacttcatatctactatagtggctattatcaaaaatgtagatgataacaggtgttggtgatgatatggaggaattggaaccctcagatgatgctggtgggggtggaaaatgatacagctggtttggaaaatgatttggcaactcctcaaaaagttaaacatagagttaccttatgacctagccatttcacgcctaggcatttacccaagagaaatgaaaacatgtccacatgaaagcccacatgtaaatgttcataacatcgtcattcctaataaccaaaaggataaagcaacacaaaggtcaatgaatgaatggatggataaataaaatgtcatatatccctacagtggaatactattcactcataataacaagtactggtatgtgatgctccagcgtggatgaaccttgaaaatactgtgctcaatgaaagaagtcaaacacgaaagaccacatattgtacaaatccacttacatgaaatgcccagaacaggtaaatccatagtgatagaaagttggttagtagttgctgggagctgggggaaaggattggagagtgaccactaatgggtccagagctttttggggggtgatgaaaatgttctaaaattaggtaatagtgatagttccacaactctgtggatatcataagaaaacagaattatcaaaaaaattcatatgaaagtgaggtcacctctgtggcctatggaggtgtctttattaaaaggtggataggagcctggcaagtaacatgaactcctagttatggctttctgagtgagtgcagattcttaaggtgtgatttcttgtactcttacctgaggctggccacagaaataagtcatgccttgccatatgatcatgtgcataaggattgccccctttggtgggccttaacgtttacgtgctttggggctttgatgtttaggtaaacctgggaagagagattaagaaagttttatttaaccaatagctttatattacagcacagccactagaaaagctatcattttttagatccaaaaatgcactaagctgttttgcatatatgattaataatttactcctacaaaatctcctaccccagtttgacagatgaggagccttgagttttaaagcaattaaccatagtctgtggtcacacagcacaaagtagaagagcaaggtaaaattccagtctgtctggaccaaaagcctgaattcttgacaaatatgtacagaaagctttgtcgactaatatataattgaaagaaaatctattgggatgatagaagtattaaactgggattgtatctgctagtacagaattgcgaaaaaccattatgctaacggcataggtggcagtattttaaccacctgaaaataaacactttcaatatcgaaaagaaacaaacaaggagtctacactaacatgttatcactatttacaatgccattattgatatttctataatggttttctaagcaagttatagcaacggctccaagtgagaaaaaaaggccttcttaaaaaatgtggcccctttcttttgcattatatttactagctgtttaaactctctctagtggttaagtcatgttgtgatcctaaattttgcattgacagactcaatgcaaccaccaggactacagtgctactgggagtgccgaagattacaagatcaaacctattccttaagcatctcttcatgtgcatggaataatggtataaatattgcatatcaaagctgctactgctgtaatccttgccttcatctcctttctctcttatttggtcgaaaatcaaatagtgcatcgattattgatactttctactctagagaattacagtgaatatactttatatggtggcgatttggggggtacatccatataaaatgttctgaactatggaacaggttcatagttccataagacacatctttaagttcctgtaagacacatctttaaggatgtacctactgtttcttgaattgctagtttacctattatgcaacgagttccttgtaataaaatatgaaagtttggctcttttaaatgcccaccctctatatacatacacctcccacacacatataaatttttcctatgccaccagcaccaagctttgcattgggtttttatttagatgaggtagagaccctttcatttgcagaattgtaacagttgttaaggagagcatctgtaaaaataaatcttagagataaggcagacagatttttatgataaatcacataaaaagtatgacttgggttcgattctccttagactcccatgtgaacttgcagtggtctgatttccatatgtcaaacattttggataaacagctgcatttctcagagaaacccctgctaccacccttccttcattctcttacttcatctggtctggacagctccctgcacagctgtggccctggcactgccttccaaagcatgctgttctcttctctccctgtgagacttcctgtttcctggaatgaacccacatctttctctttcttgttttattcttttgtttcattttcaagtggtatacatatatcagtagcttcctgagaaagctgctttggacgtaaatatatatatttttttgagacggagtctcgctctgtcacccagcctggagtgcagtggcacagtctcggctcactgcaacctctgcctctcaggttcaagtgattcttctgcctcagccacctgagtagctgggactacaggcacgtgccaccatgcccagctaatttttgtacttttcatagagacggggtttcaccatgttgatcaggctggtctcaaactcctgaccttgtgatccacccacctcggcctcccaaagtgctgggattacaggcatgagccaccgtgcccagccggaggtgaatattttaagattttttacgtatctggaaatgctcttactttaccttcttcatacttgatagtttggctgggaataaaattctactgggttggcaattatgaccaatgatattgaacatttttttcatgtgcttatttgccatctacctatcttctttgctgataaacctgccatattttttcaataaatcatttatttttcttaattgacttttaggagttctttatgcatcctggaaaaaagttcttttttggatataagatttggaaatcctattttcccctggtttctggcttgtctttttatttttttaatagtgtcttttgaagagcagagattttaattttgatgaagttcagtttatcaatttgaattattttatgaattatgcttttacatcatatctaagaaattcttgcctaaaccatggttgtgaaaattttctcctatgttttcttctagaagttttatgattttaggttttttacagttagttttatgttccatgttaatattataaatggtgtgaggtggattgaatttcaatggattgaaattcatttttttaatgtatggatattcaactgttccagcaccccttgttgaaaaacttactgcacctttgtcaaaaacaaattgtccatatatgtgtgggtcttttcctggactctttattctgttgagtttatgtgtttgtctatcttgatgtcacactgtattcattattgtggctttataataagccttaaaatcagggagcattatttctccaaattgttcttctttttctagttgttttggctgttcttggtcattagcattgacatatgtgttttagaatgaagttatctaattctatgataaagcctactgggatattaattggggttgtgtctagatcagtttggggagaattgacatcttaacaatactctcctatacacaaaaaaggtgtatctcttcatttcttcagctcttcttttatttctctcagcagtcttttgtacttcccagtgtatagttcttgtatatctggtgtcagaattatctatcaacattttgtgtttttgatacttttatgaatggtatttttaaaatttttaattgttcatttctaccctaaaaagaatataattgatttttgtatattgacttcatattttgaaattttgctaaactcacttatttcagttttttgagggtaaattctatcaggttttctacatagacatgcgtcttgtctggaatagacaatgttaccgttttttcagtctggatgcctttttatttctttttcttgccttgttgcactggctagaacctttaatacaatgttaaatagaaatgactggagctaaccttattggtctcttctctcatattaaaaggaaagcattcagtttttcaccattaagcgtgatgttagctatggatttttataggcgcctatagatgaggaagttcccttccattcctactttgctgagaggtttttgtttgtttgcttgttttaaaatcagcagtgaatgttggattttgacaaatgctttccatgcatctattgagataaccacactgatttacatttttagtttgttaaatagtgaattgtattgattgactttcccatattaaaccaaccttgcattccttagataaatatgacttggtcatgaactactatcctttttgtatattcttgtattatacttgctaaaattttgttttgaatttttacatctatattcatgagggttattgatctccagctgtttttctttttttcttgtactggctttgtcttttggttcaggatgaaggtgatctaatagaatgacttggaatgtattctctccttttcaattgttttttaaaagtttatgtagaatttttttctttaatgtttggtagaatttacttgtaaaagtatttgagcatggagttttctttgggggaaggtttttaactatatatttcatttcttttatagatatatggctgttcaagttatatattttaccaagtacattttggtggtttatgtctttaaaggaatttgtccatctcatctgtgttaccaattcattggcataagttgttaataacatttcattgttatcttctacatagctataatataaagtcagtattgatatcttctgtgtcatttctgatagtggtacatttttccctgaatagtcctgccagaagtttatcatttttttcagtctcaaataaccagatttttactttcattgatgttctctactgtttttctgttttctatttcattgatttctgctctgatatttattatctcctttgatctatttaatttgcatcctatttgcttttattttctagtttcttaacacagaagctgagtccatctatttgagatctttattcgggcatttgtgttataaattttcccctaagaactgttttggtagaattccatgaatttgataggtgtttttttatattcattcatttcagaatacttcctaatgtccttttgatttcttttttgatccatgagttatagagaagtgtgttatttagtttataagtatttgggggattcccagagatcttgctattattgatttctaattaaattccactgtatcagagaacatacttgtatgacttgagttctgttaagtttatcaagacttttatgacccagaatatggtctatcttggtaaacattctgtgtacccttgaaaagaatgtgttttgtatggttgttgggtgaaatgttttgtaaatgtcagttgggtcaagatggttgatagtgttgttgaaatcttttatgttcttactaaatttctgtctacttgttctagcagttattgagagatgagtgttgaaatctctggctataattctggatttgtatttctccttgcacttctaacagtttttgtttcatgtatcttggggctctgttatcaggagtaaaaaatatttagaattattatatcctcttgatgaactgactcatttatattactaatcgaccctcttcattccaaataatattctttgctccggaatttacttagtgtgatataaatatagcctctccagctttcttttgattagaattagcacaatgtaccttctttttttactttaaaaattatttcattgtaggatatgctcataacatcaagctaaggatcaatgtaactcctacttttgcttacaatctatgcctgggattccaggatgtgtgtgtgtgtgtgtgtgtgcgcgtgcatgtgcatgtgcatggatgtgtttttttgtttttattgtattttattttatttgagatggagtctcaccctgttgcccaggccagagtgcagtggtgcagtcacatccactgcaacttctgcctcctggtttcaagccattctcctggctcagcctcccaagtagctgggactataggtgaatgccaccacacccggctaattttttgcatttttagtagagacagggtttcaccatgttagccaggatggtcttgatctcctgacgttgtgatccacccacctcagcctcccatagtactgggattacaggcgtgagccaccgcggccggctgggatgtgtggtttttaatgaattcttacaattcttttgttcctttaacaggttttctcatatattcctggacaatagtaggtactcagtaaatatttggttgtttcgttttgttgtttttcgagacagggtcttgctctatcgtccaggctggagtgcagtggcacgatctcagctcattgtaacctctgcctcctgggttcaggtgtcctcccactttagcctcccaagtagctgggactacaggtgcacaccaccatgcccggctaatttttgtattttttgtggaaatggtgttttgccatgttgcccaggctggtcgcaaactcctggactcaaacgatccacctgccttggcctcccaaagtgctgggattgcaggcaggagccaccatgactggccaatatctgttaaatggaatgtttgagtctactacatgcagaaagaaaaatgcacactctgtcctttagttttaatctattgttgcctttatatttaaagtgcatttcttgtaggcagccttattgttggttcttgcttttatattcaaccaaataatggctgaaattcaattgggaatatttaaactgtacatttaatgcgaatattaatatggtaagatttaaatctgtcatcttgctttttgttttctatttgtcttaactgctctttgcttcctttttcctatttttatgctttcttttagattaattaaatattatttataatttctttttatctcttttgttggattattagttataattctttgctttgttattttagtgctttatttaggattcacagtgtacatttttaacttatcacagtctaccttcaagtgatattatacctcttcacatacactataacaatttacagtggcatattctcatttctccctcccaacttctgtgctgttattgtcatagatttttcttttattcatgttataaagcccatagtacattgttattatttttatttaaacagtcattattttttaaagagattttaaaaataccaaaattatgttatattttacccatgtggttatcatttccagtgccctttgtttctttctgtacatctacgttcccttctggcatcatgttccttcttcttgaaggaattcccatgacatttcttttttttttcagacagagtctcactctgtcacccaggctagagtgtagtggtgccatcacggctcaccgcagcctcaatctcccaggctcaggtgatccttccacctcagcctcttgagtagctgggactacagccatgcgccaccacacctggttaattttttaattttttggtagagacagggtttcaccatgttgcccagactggtctggggcacatagcctcaggtgatcctctggccttggcctcccaaagtactgggattacaagcatgagcaactactcccagcctgtgacatttcttatggtgttgatttactggtagtggatactttcagctcttgcatatctgaaaacatctctatttctctctttttgtttttgtttcactgattttctctattatttttctgttttgattttattaattttttattttattaatttctgctctttatttttctcttccttatgcttgctttgggtttactttgctcttcttttcctagtttcttaatgtaggaatttaggctgttaatttgaaacctttcctcttttgtaatgtaagcatttagtgctgtaagtttccctctcagtagtgctttagctgcatctgacatgctttaatatgttgtattttcattttcattcaggtctatgtatctttgaattttctttgagacttcctttttaacccatatatatatatatatatatatatatatactgttcaattttcaggcatttggaaattttctggttctttttctggtattgatttattttacatttgttaagttttgttttatggttcagaatgtaatctatcttggtgaatattccatgaactcttgaaaaaaaaattgtgttctgctaaagtgctatatatgacaaatagatcctgctgtctgatttgttgttcatttcttgtatatccttgctgatgttctgtctagcagttctatccattgctgagagtgggctgttgaagttcccagctataattttctattgcctatctcctttcaggtctgtcaagttttgcttcatgtattttgagcctctcttgttcggtgcacatatatgtaggatcattatgtcttcctggagggttgattcttttataattatgtaatgtccttctctgtctctgttaactttactctaaaatctgctttatttgatatttatatagctactcttaactttgtggggttattgttacatgatatctcttttttcattttttttccctttcaacctacccacattgttgtatttgaagtgagttttttataaatagcattttgttgcgtcacgtttttttgctgttgtgtatttgcttgttatttaatccactctacctggtgggggtaaaagtctaagattctcacttggccttgctggcttaggtaggggaaggatcacagttttttctgttgcatttggctggcatagttagttttctgtcttgcaaggctgctcctttggctagagaaactagactcttcttgtctgcgcttgttagcattttcaggttgccagcttctccatctctgagtctaagagatatgagacaaaaagaaaacccagggaagttattgctgtgttgttctttaactactgaggtccctaactggtattccactttttggcctctttcagagtcttcttatgtttattttatataatgttcagggtttttcactatacttcgtgggaggaattgagaaagcatgtcttattccatctttctggcagagaatcttctccatttttgaatagatatttcactgagtatagaattctaggttgacaggttttcttctttcagtactttaaagagattgttctgttatcatcttagttgtatgatttcctatgaaaaaaatctctgttgttgttgttttttgtttgtttgtttgtttgtttgttttttggtagagatgagagttcttgctatgctacccaggccggtcttgaactcctggcctcaagcaatccccctgccttagcctccccaagtgctgggtttacagatgtgagccaccacacccagcctaattcttattttgttcctctgtataaaatgtgtctttttttctgcactgtagcagtttgattatgcccttgccctgccttggtgtgattttcttcatgttttttgtgattggagttcattgagattcttgaatccaagggtttattcctcttaagcagtcactctctaaaagcaggtggctcaacccaccttacagtaaaaattagactgctattaatttgtagttgaactctgatattttccaggttctaaattgtttatttaataggtggtcatatgttttgtacaccagatattcaagcaccttctgccacagtgctctgttttgaacatttagggcataacttgaatattttcataagtcaaagactcacctcattttccagatcatagagatgacttcggagaagtgaaacttttcctaaagtttcctgaagttgcaactgttaggagcacaggcagacttagggtttgaactccatacctcttgctgggtgatgatgggaatgttatttaaccattttgagcctccggtgtgtaaagtgggagatgataatcatacttgttaatacctcatcaggttgatatgtgaattagatgagaatagttaaggattcacaaaatggtagctattgttgctgttgatatttttctttaatagactttctttttttagagcagtttcaggttcacagcaaaattgagtggagggtacaaggagttttccatttatcctatcctcatttatgcatagccttctccattatcaacatgccacaccagatgggtgcattttttataatcaaggagcctatattgacacatcattatcaaccaaagtccatagtttacattagggctcactctcggatttgtatattctatgggttttgatgagtgtccaatgacatgtatccaccattatagtatcattcagaatagttttattttcataaaaatctttgctccgcctattcattccttcctctcctacacctgaacccctgacaacccctgatcctttaactgtctccatagttttgccttttctgcaatgttatgttagttggaatcatacagtatgtggcttttcagattggcttcttcacttagtaatatgcattaaagtttccccaatgtattttcatggtgtaatagctcattgctttttagcagtgaatgatattccattgtctggatgtaccatagtttactgatctactgactgctaaaggacatcttgtctcctttcaagttatggcatttatgaatgtagctgccataaccatctctgtgtgggtttttgtgtggacgtaaattttcagctcaattgggtaaataccaaggagtataattgctggatcatatggtaagagtatgtttagttttgtaataaactgccaaactgtctttcaaagtggctgtaccattttgcattcttactagcattgagcgagagttcctgttgctccacatcctcaccagcatttggtgttaccaacgtttcgggatttagacattctaataggtgtatagtggtatctcattgttttaatttgcagtctccagtgacatatgatattaagcatcttttcttggtacctatttgccatctgtatatcatcagcaagatgtttgctcaggtcttttgtccaattttaaaatcatggtgttcattttcttattgttgaattaaaaaatttctttgtagattttggagctattggtatttttatttgaattactattatcttaagtgcttggacaagagtttcattaagacctcagcattttaaccagtaaaacatgaaaatgttttcttctcattttttggagggaggtggataaatgatcttcacttgaaaaaaaaaaaatgaaaagatgttctgggttactttgatccagaaagaacttcaggctgcctcttaagtagagctgtgacttcatgggcccttcatgctctaataacctccccacaaaattagtttgtgccatgtgtttttcaacaattgccttattaaggagtgggaagtacctgcttagcacagtattgcgtttctttgttaggaatctgtggattcacaaggtgctctgctgttatcagggtggtgacattacacctattagcaagtctcctcaacttgcagagaactgctctggcctggatcattctgtagaaaaactagttactaatgctattgaagaaaaatatgtcccatgatagatggaggtattatattatctgatttccattctcccacccttcactatgcatcaatagatttatatcataggattcattttcgttttatgtctttttatttacgcaccaattcttttgcaagtaattttaattcttcgttttatgagaatgaggctctgtgcctgtgtactcctatgtaaaataaaggaaattattgtttttaatgcagatttgaaaaaaatataatggatttcagctacaccaatctctccccatttagatgagatgaacacctagttagatggggaacgtcattcctcatataatttgaatacatcctgtttccatgacaacttgtacttaccagcttgcctggtaaaagaagtgcttgaattcttcctctgataaaagatttgaccaaccactggggccccagtttcttaattccaataatttcattccagcctggggccagttttctttttaacatgggatgatgttgaggattagaaaccaaaaaaccattttagaggtgaattcacctccaaaataaaaggagaggactcataggccaaatactaatgagcacgagaaatgaagatacttgtgcaggtcatagtcattttctgatatcttccagttaaattgaatcaacagagatgatgcaacaacttattaagatgctatttgatttgacaaagaatgattcagttattcatttccatctggacgttataatcagttggcttgtttttttcactgctaatttatatcttgcctttatgggtggcttgtgccctcttactgctgaatttcaattctaataaggagtttggttttattaatgattttccctcagaatgaaaaataggaaattatttgcatcattaactgtgcttttgcaaactatgaaaaacatgatactgcatttaattgacaaatttatgtttcatgtgttataaaatattttagtccaataaggcaagcagacatgacccttaggcattttaggaatgatagggactcatcccaaatttaggataattcacagtgtatttctgagtgacctggtaggttttgaaaggacgaaagtgactcagctatctccaagatcattgtcaaccacagtatatatttgtgacatcaaatacttgtataaagtcatctgagggataccatgttcatcatagcctccatgagagctcctcttttgtaatgatgacctagtatgatcaatatgtgcatctttttagcctctgggaataagatactgtcttaccacaaacactaagaaaatttaaagcaaataccataaggtgcaacctgccattatgtagataatatgtaactaataagaatgaacaggaaaagagtgaaaaattaacaggatctttctgtattgtgagtatgcaattcctgctgatggtaaaacaaaagagattcagtaactgaaggggtctcattggcctaaacactgcaagtgtccttctgtttctgaatggtgcattttgcacagtagttagagttctaaaaatgtcatgtaattatgattttttttagaaaacaaataatgcagcttcctttcaagaattgctttattttcctttactaattgttcatcaattgataatggcttctcaaactttagtgtacttagctcttaagaagtaaatgacttataaagtatttcaatctacactttaatgaatggttttaaatcacagaaggattcattattcagatatttattgacttcccagtacatgagcagtactttataatagtctctgaggacctcaaaggtgagctccccacccctcaggaagcttgggttaaatatggtacagggaaagatggtacaggaggtctttttgcagcctgactcataacctcctaatattttgccaaatcagcttatattttctgtatcaagatttcttatgtcataaatatgattatttcagcttaaaataaagcttcggaaagcacaatacacttcctcagagaactggcttacaaaatgttcccctaaatgatctatgaaccgtaaatgaaatccccaaaacaaaatcttatccttaaagcagcttcttagatgtaaacaaatgacttgcttgctgttgatttatcccactaggcgagcagttatcagctcatagtggggattagaggcctccaagatggttgctgaaatcctctggaacaggcagtgctccaggacccgctccttgtgtatctaccgttcgggttttcccaggaccaaagggttttctgggactcagaactttcagtgctcaaattggaacagtcctaggcaaattgggacagttgttcactccacctgtctctagatccccaacgagcatacaaaggaggacactcgtattcaaaaagcagagaagatgtagggttatcccctccaggaactgtgataaggaaacgagaatcaacacttgggtgacctttttttgacttttatgtagagcctcaccaaatgttcctgatttgatccttcaggcagcactgcaaagcaggtgttattggcacactcattttttaattgagaaaaaaggagactcagaggttcaccgatttgtcccaaagcacatggctgttagacattggctcaagcacatgtttttggactttcctctgatcacattgcctccctactgctcatcgtttcctttcttttaaaaattgctgaagaccaatttgaggcctgccggctctccccttcagtccagtttctgatgtaagctatctctgtatctctgattgattggctggccaggaatgttcagaactactctttgataagaagccagtgattggcagagtgtttattacagggttgcacatgatagccacaatcactggtaataatctgtgtgcctaacaggaggagttggttatacaaatcattactcctccaatcagtggaattctgtgtggccacaacaaaggtctttaatcagagctcttagactggccacaaaacctatatactgacatcgttgggactttttttttttaaatcagggaagagatttttttttaaatcaggaaagtagtttgggcactgcccagctgtgtctctagaactctgtgaatctcttgtccctatctggggtgtgtttggtgactgattccctgtgagggaacttggcctggcccttgaaggatggttagacaatttagatggtcagaggagagaagaaaggtctcaggcaaaagtgtggagatatgagtacatatggtgtgtttaccaagtggggagtaagcccatcattgattcagtaaagctgggtctcccatgtgccagacaccgtgctaggaacccagaagacagtggtggagggggtgggcccaggcctgtcttcgggagctcatgttgtggcagagctgaaaatgcaccaagaaatagggacaaatctgtttggaatatatatatttccatgtatagctgtttctccaaatatatagatttaacatatatattccaagtatatgtaaatataggtgtataattatatctctctaaatatatttggaaatatactcgcaaatgcatttgaaaaagggggtcaaggtgtggacaatttcaaaggctagattccagatttcagacctcagcctgtgagaaacaggcagcgctttagggcttttgaacaaagaagtaataggacaaaagtgctttttaggaagaccaacatgccgtccatgagaaagatacactggcagaggagaaagacaagaaattaggagacaaagtcacagactcttcctttcaaccaatatctgctgtatacccagtttgtttccttaataaatgttgctggtgtgccagccatggacaggccctgcactaggcactgggtggacaaaggtggacaagagaggcctggccctccccacttggactggatattctgtttcggaagatcggcagttgatgtgtgcagctgacacgtgcactgaaaaaaataatgaggaaggggagaagacctgctttagagtggaggcctaaggcaggagaaggagtcagccatgcaagcggagggactagcagttcaggagaaagaacagcatatgcaggtgccctgtggccacagagaagctttgaggcagggggagagatcagccatggatttggaaaggcaggaaggatccagaagatgccaagtactgttggccaccagaaagagtctgggtttttttctgagagcaggcagaagcaaaccagtgtttgaggactgttgttcaggctgctgtctggcaggagatgagagggtcgggtgttagaagcagggagacccgttaggaggctgttgcagtcctccaggccatgcttggctgactcaggagtgaggactgggagtggctggcaccagtgggaataaagaaggaagagcaggctaggcactgtggctcacgtctgtaattccagcattttggaaggctgttgtgggaggatcacttgaggccaggagttcaagaccagcctgaacaacatggtgaaaccctgtctctacaaaaaatttaaaaattagcagggcatggtggcatgtgcttgtagctactggggaagctgagatgggaggattgcttgagcctgggaggccgaggctgcatgagccaagattgtgccactccactccagcctgggcaacagagcaagactctgtctcaaaaaaaacaacaacaataataatagagaaaaagaaaaaaagaaggaagaccaacacacggattgcaggcagatcaggacgagaactcaatgtctgataggtggatggatgtggagagtgggacaaccaaacctcaaggccacattttccaggctcaatgaccacatggacctcagtgtcctcactgcagatgcttaacacatgccatttcctttgcccctttctcttccattagcagctctgaacaagagaggcctggcctggcccctaaaagatcttcagaggtcttttggaatctagataaataacactagttgagctttttctatgtgcaacttgcaaggtgctttatagacaatgttttcttatacatggctcagagcagtcccttgagagtgctcttgttatctgtaccctagatgaggaatctggagctcagcaaggttaataacttcccagagtcacagggtttacctatggcaggatcttggttagagcagggatcagtctcactctgaagcaatcactcttgaaccacaccgcagcctcccctgacccgtgagtatcccagaatagtgtcaagtctcccctacctttccaagccattgctctaggactgaccagctgcaacacacctttgctggaagcttcagtgagggcctctgccccaggccagtcccttcctgtgccctgtacctaccggcactgaagactgccatctagtggccattgccttcctttttcttttgctgttaaaggaaaacggagttcccacataaaagacaggcctgcatatttatagtatcacaccctgtaaacaggaaacttctcagtgttagagaaggagcccagcaacataaacagcatattgccaatgagttccgccacccattcaacaaacacttaaatacacacacacacacacacacacacacacacacacacacacattctattggaatgtaggctcccagagagaggaatttcttttgtctgtattgctaatgaacctggagagcttagaacagtggcatttgcatagcagatatgcaacaaatatttattgagtgtggaatgaatgaacgcctgacatttactgtatctttactatataccagggacttgacatatacattttctcatttaatcctaacgataactcgagagatagagaccattagcatgtccagtcctcatatgtggagactgaggcacagagagggtaggaagcttgccaggtttagggagaactagctttgacccaggttttctgacattagagaccatgtgttccctcctttcaagggagccactggccaattccctcccatgttctgcctttattgagtggaaggctcccttcccaaagtgttgagacagaggccatcaatggagggaatgtcactagctaactctgtggctgtgtgacttccagtgtccctgaacctcaggttcctcattgggtaaaggaggagactgagttaggacccctgccttcccttccaacgtcatcattctgctgttcctgtgactcccagggagcagatgtgagtagaagagagaggaccacttgttgctaggcaaccagcacccacctcacccatgttgccatggtgatgatgaaagttgggctgatgggattaccagctcctgctaattgcatatgagtgctcaggtttctgtctctttcttgcctgcttgctcgctctgactttctcattcttctaggaactgtagagcgatttccccctctcctccatctgcagcctccctgaggcagccctagtgcaatggaaagcaactgggaatggagcctggctgtgtgtctgaatagctgtgtgaccttgggcaggttacccagcttctctgggcctttcttttctcatttggaaaatgaaggtgttggaaaagtgatccctgtctaaggttcttcccggctctcaaatcctttgatgcctagggagcttgtcaggggagcagaccacactgttactaggcaaccagcaggcaccctgcccaagttgccttggtgactggatgctggaggggaggggagtagctgctgcagctaattgcttaattatttatgagtgcctcaagtccttcttgttgtttttgttgctaggggctgtggggtcaccttctcttcctctcttctgccaccccaagtcgtctgtgttgcgtgtcatgcagtgggacagcacgttggtccggacctcaagctacccacgttctagtcccgcctctgtcatttcctagagctgtggcctcgggtaagtcacctcacctctctgggcctcagtttcctcatttgtaaagtgatgggtttgcttagatgatcgctgaatcccctttctaccttgaaattctagttcctgccatccagttcccagatgagggaaatttccccaatttattatcttctaagaatgattctgaagagcaataaaaataattaagtctcttacatatttcaaacaggaagggaatgaaagttgtgaccattgttccctccttagccattttgtataatctcttttattaatcttaaggtcatttaaattttatctattcatatataccacctacttccaaaataaatttgaggggttcagtgtaaggtgcatatatgctattaggtctttaaaatagaaataggaataaatataaaaatagtgatgcttcttcattggctaatattggtgctgtgattgagcaccaaatgtaattatgagcagcctggaagccaaagcaaaaagagagaaaggtatataattgctattcagtaaagaaaaactgccagactgttcctagttctaaattctggagggaattttttcatgtggtacacaatccttttacagaaactgcagataaaaattcttgactagcccttttttgctgaggatattgttaaaggacataaggaaggagctaaacttgacagtttgactagctttaatcattagaaagcaaaacttcctttctacccatgccttggaattttatacagatatgtgtcacttcgtaaatataaattttcagaatcaaccattatttatatatcagctatatataaattcatgtaaccactttgcaaagcaatttggcaatatgtatcaaatttttaaatgcagccaacaattcttctccaaacttattctgagattagcttgtgtagatgaagaaagccataaatataaaaatacttatggtagcattatttatataagaaaatgtctagaaaccacataaatgttggaggctagtgaattaaattatattacctctttacaatgaattactttgcagcccttaagataaagtagatctatatgttttgatatggaaaaatcttcaaggatataatgttaagtgaaataagaaggtacagcattggtattaaatgcttccattttggttataaaaaagatatagatttataacttatgaatctagatatatgcttgcatgtgcatacttgcatttttctggaaggaaactgttgccagtggtttcctctgggaatgaagattgatagtcttgggagggagggagacctactattcacagcttgtttttacgttgtggacttgttagtgttctgtgtagagaggtaggagagtctggcagttgaaagtctagactctggagtctgaatacctatgttcaaatcccagctgtcccacttactagctctgtgaccttggggttatcttaatcttatctctgttcctcatctgtaaaatgggttaatagtatcttcctcattggcttattgtaaggattaaatgagttattacgggtaaagtgctcagagcagtttaaacaatgccatataccacgcttcttggaaaaatgaaaggagatattaagcaacaagataaatgcatctaaccaaaagcaccctcccctgttttagtgttggacagattttataaaatctgtcattgcttccagcattgtatgttgtatagaagttaagtttaaagcagcggtcttgtttttattattgtcactttatgtgaccttgattaccttttagggagggcatctactctgggattcatgacagtctgctatgatgctgttgatgcccctgaactcatcttgttttgtagctcttccatcccagcgaatgctcaaggcatgaacagaacacatgctaggccaggtagaaggtcaatgaggagatggcatcccacgcccttcactgttcaaagccagagaggaactatctagaaattcaagtgtaaagaggatgtccatgctggttgtgacatgtgtgttcacaggcctcatgcctttgcttttcttttgaaaaagaaagtgacagagacctggggagatgctgtgttaggagggcccctcctactttgggctcaggaatctcaccgcctaagggacttcctgggtgctcagaggtacaggaagcagagcgctctgtgttcacaggtgcccgctttcctcctcccgactcgccggtgctttagggcagatctggatactttggctgattttgggaaatgttctctgaagttagccacacgttaagccaggcttgaggccttcactgtggtcacatggtagctccagaggttgggatgggggctctggccccttcaaatcagcggagttaggaagtatgctctcaccaagaggaatgcaaagcccacctgctccaacctcatgccccagtcggtggttctcttgttcgttcttctttctcgccctttgttctgtactcgcgggcactggagtctctttatccatttggccatcggttcccctctccatttatctgtcacacccaactgtgcttccatctgccctccatccctccttctctcctccagccatctgccagccttcactccatccttctgactgctggtatgtctgtccatccctccttccctcgcaccacgtgggtctggggctccatcccctgtcccatccatccctccatctgtccctagcctgccgctccatcccgctgcccttttgcatggctgcagagccagcccgcagaccgttccccggtccctctcacccccgtgggccctctagcccgtccccggccgccactccaggccaggccgtcagtctcccacgctgggcccgcgcctgagcgggatcggccccccatccctccgtgggtctgtctttgttcggcggccccggcccggccgtgcctcccacggcccctccgcgcggctcccaggccctgaaggcggcgggcggcgggcggcgggcggcgggcggctagcccggggcggggcggggcgcgcggggcggggcggggcgggggccgggggtgactcagccgcgctcgccccgcggtccgcgcgtccgccggccttgcaggcggggcggagaaaatggcgctgcccccggccgccgcgccccccgccggggcccgggagccgccggggtcccgcgccgccgccgctgccgccgcccccgagccgccgctcggcctgcagcagctgtcggcgctgcagcctgagccgggcggggtcccgctgcactcgtcctggaccttctggctcgacaggtgagggggcgcggggcccgccgcgcacggccccgacccgggtcctgccgccaccgccgctttgtctcggcgcggcccctcgccccggccccgctccgctgtggcacagacctcggcccctccgcgcgtccgcctgcgcaccccgggactcgccccgccgggtcggaagccagcttcgggccgcgccgggcggctgttcggcgtcctcgcctccgggccgggggaggacagcgcagcccgaaaagtttcggcaacactttctaccccttgttcccttccgatcggaacgcggcgtgctggcagggccgtgggagagggtaggcgagctgggggtggccgcgtccctgctgcagggagagggctgtcctgcttaccccgcggggcgcctgggagctcaggacacgacctcagctgtgacagcgctcggaaaagttgcccatcccttgggaggtgtgcggtggtgcaatgattattgcacggcgggcgctcccaccccgtgtccggccgctgctgccgtggactcctcttccagttcttcctcatccactgggcaggtatttcctgaacacctacagtggagccacacacctgctatgcgctggagattcaataatgagcagcagctgaccttgtcaggaagggggtgaattatggctttctcaagggacaacccaggtgccatcttttcagaaagaccccctgactaccgtatctaaaatagaaaccttgctccctcgttttgtattctcctgccctgccttctttttcttcctaatgcttaatgcagctggattttattatatatgaatttgtttactttcagtctgtctccccagctcctcaacacctcccctcagttaaggataaaagagcagtggatttttgtttttggacattttggacctagaactgtgcctggtccctagtaagaacaccagaaattgttatgaatgaatagatggatgaatgcaaagccccttcttagtgtctgccctgcagtgggtgcccaatgatgacacctcaaggttgtcccaagagcatttggaaattttgatgaaaccgtgtctattctggctaagtgttaggaagaaatgtgtgacagtgttctgagaagtttgcttggtacacacaaatctggttttaaaaggctttgcataaaatgactgcaagattttgttttaaaaaagtgatattcattttttttttggttaagacaagctcatttcttttttccttttgggttcttatagcacccgtctataagaattgtcacttgctgccattttctttgccggagacccaaaaaagttgggggtgggggagatggagtgagtttcgttctttcaaaacattttcactttcattatgggatgctaagagagcattatactgtcataacaagcgtgcttttggcagaccttagcagaatgaaatcgtgtctgttttcataggtgtgctgcaactgtgctattgttacctggtatctgttttcaaggtgttaaacctggacctgtggtctaaattgtgaatactgctgactggtggaaacagtatcaagagagtttctttttaaacaggtctaaaattagtttacatgtaggaacaacacttttaaggactggtctaaaatgtcaatactacagataacacaatcttttaagactagtagcttaagattatagtaactttaatgaagacaaaaactatatctatactattgatttacacatttttgttctctaaaggtcgatcatcaaatgaaatacattattgccacagtgtccagatctttaatagaaatggctgtattaatttagaaattataatgagttccaatattgtacatatgaattcattttgcccgatcaaacaactcataatttttattgaactttttctccttctgtgggaatccattacctttatatagggtgcccctctcccccttgaggttatgaacacattatgatctagaagttcattagtaacttttctccccaggtaaacaacattctagagactggtgaggttctcaggagagccctccaaggcagccttacctgcagcatagccaatgtctgcctggcaagatgacatcggtttttgagttccatagcatgcaaaggcctcttgctacttaaaactcccctttggcatcctacctcccggcctgtcctactttccagcctactgtgtgctgatgagcaagccatctagctgccccaagcctcactttcattgtaaaatgggatagtcataggctatgtctcacagggcagttctgaggattaaatgagagacatgatgtacaacacctaacaggtgccagctggtagaaggagcttcctaagcataaactactaacactgtcattaccatgctccccagctaccaacccctccccatacccacaccccaacaaacagtctctggagcagcttgtctgaattctgtgttgggaagccagaaacctaaattcattcccctcactggatgagttggagaactcctctgtaaagttattagtatttttaatagtcaactccaataagtccttatttggttaaaaaattagactgtatggttaaggatttcggcatttgaggaaggtaattttagattgggggtacaggctgaagagtttttctccccttttctggacatttaaaactatcctgtcttgattcttggaagccactctgggttatgtgtctctaactgcttccttttgatcttatggtgacccgctcgcctctgagttttttcccacaagactcaggcctcaggcctcttctttgtgccatttacaccagggatctcatccagtcacagtgctttcaggtccacctgaattctggtgactctcaaaaccttacactcttagatccagtgctccttcccctttgtctccatggatgtccaatgtaatacacaaccagactcaacatatactgaactacctcctcaactgccttcccaaacttgtttccttctatctgtatctcagataagagcagttaagagcaagtctatccttccagttgcccagcccagaaatcttagagtcatctgtaaccacctcccacccccgcccccccgaggaaaagccaaagggcttacaggaaccataaagctttgcagctcttcctgccccacccaggacccttttctcccttgtcactctcccttctgccatgcccttctttctgctcatcggtccccttgctctttcgccttcatcccaagcagggaccttagccactgacaccccctactgcttggagtgctctcacctccatcagtgcttgccctgctctttcctgtccttcaagcctctgctcacatgtcaccttctcagaccttccatattagtctgttctcacactgctacgaagaattacccaagactgggtaacttataaaggaaagaggtttgactcacagttccacgttgctgtggaggcctcaggaaacttacaatcatggtagaagccaaaggagaagcaggcaccttcttcacagggcagcagtaccaagtgagtgcaagcagggtaaatgccagacacttataaaatcatcagatctcatgagactcactcactattacgaaaacagcatgggggaagccacccccatgatccggttaccttcacctggtcctgcccttgacatatatggggattatggagatcacaattcaagatgagattttgggtggagacacagccaaaccatcttatgttgcctgaccactgttatgaaatggcgcaagcatcctgacacacacaccccgagcccctgaccctgttttattttctccatagcattaccaccattggcttgtcttctcccactaggatgtaaacctcatgagggcagagttctcgtcccggatgccttgtccttagctcctggattggagcctagcacaagtcagtccgcactgaataccctgaacagggtgttgttgaattctacccgcagtgacttcaccttctcctgtggtggctccattactctgctaatcatttgcaagtctccatctccagccttcagctctcttcggagttctggacacatgtctgaaagctaaggaaatccacaggcactttaaatgcagtactgattcttcagtgactgagctcatttctctctattctctttcttttctgctgaccacgtgttggttaaccatcctgccatacttccagtttttcagaattggaatttccatttgatccttgaatcttctttctctcaagcaccctcctccatccagttctatatttcatactgttaattcccctgggaaaacttgatccaagtctaagccattttcctctctccatgccctctctctgcaggttctggttatgtctagttccagttacctcctagccggctcttagcttcctgcctgctcccaagctctgcccctttccaggcatcccccacctggactggcatggttagccttctaaacatacgccttatcttaccattccaaaactcctttgccctgttcctctgccatagcagcagatttttactttatgtctcttaccacctaagaggacctcttttatgaagttgtgtgatccagacagtagggattctggatctccaccactacgtctaccagagcagctttgagaggtggtggtgtggtggtttgtttttagaaatgggaccccttaggctggatgtggtggttcatccgtgcaatcacagtactttaggaggctgaggagggaggatctcttgaggccaggagtttgagaccagcctaggcaacatagcaatacctcgtctctattttaaaaaaaaaattagccgggcatggtggcaagagcctgtagtcccagctacttgggaggctgaggctggaggatcccttgagcctagatgtttgcttgagcctgaatttgaggatgcggtgaactatgatcacaccaatacactccagcctagttgacagaatgagacccgcctctacaaatacttacatatgtacgtacatacatatataaaaagacccctttagtttcaataaaagattccctactttttttttttaaggaaaactatggacttagagattatggtatacattcatatattgcttttttaagtggaacccacctcttaaaatataagatatgaatatatatatatattttgagacaggcattctctgttacccaggctggagtgcagtggcgcagtcatgactcattatagcttctacctcctgggctcaagcaatccctccacctcagcctcccaagtagctgggacaacaggcatgtgctactacacccagctaatttttgtattttttgtagagacagggtctgactgtgttgcccaggccggtctcaaactcctgggctcgagcaattctcccacctcagcctcccaaagtgctgggattagaggcgccctgtccaaacccacctcttctttaaccttatcacctaccactcttcaactccacattaccactcagtctgtccactcttcctggtcacgtcagactactggccctttccttggatagatctaacttccttatgtctgtgactccagagagtgcacattacagtgcctggtacacagtaggtgctgagtatttgcagactttttttttttttttcatcagaaaggtgagccatcatatacagctgtcaccaaccctacccaatcatggtttagctccaccaagcctgtgtttctcaaagtgtattccctcatccgcccatcagaatcacctggctgtgcttgttacaatacaggctccccaccctgccccagacctactcattcagacctctgtggtgaaaggtagatttgtaacaaatgccatagaaatccaaacttgagagttactgctctaggtattgatcatatcaattgagtatattatttaccagtcaccattccaggttataagattgcaaacatgactacaccttgggccatgtcctcgcaggagggatatctcacatgctgaatgtttcagtagtatcaatgaagaattctgagaagtgttgagttctacagggacccaccctaaagggtgcagtacttcaaaatacattccaatggtgtgttccataataacaaatctgatatgggaaggtagggctgagcttgacaaaagggaccccaaagtcatccttgttcattgagttgcctactgggactaggttggggaggagactggatggaagggccatggttgacagggacagagtggctggcatctgaacttttcttgtctttttcccacacttgccctcctgaatctgtaaactctaaatggcccaggattttattttttgtgaggggtaaaggtcctctgagaacatctggcagggcaaggccctgacatagagtacttccagcctttctacctcaggtcagtggttgcttcttgcagaaaagtatgagggcctttcacatcctcactcagaaaagtttctggtccttacctggcactagctgctcaaaaacatttctgcttttaatattacagagaccatttaaacttacttccaaacccggggcacatggcaacaatttagtgatctgtcatgggaatggttcacaacttggtctttcttaattttgtcgtaaactcttaacactgctgtacttctctacccatcctccatgtactgaagggattaatatatctcaagatgaaaggagccccagttgctactgttaaagagctgtaagatagactaggaatgaccataggaaggcagggagaaatcaaaatcaaataaacatgcagaaataaaacctttaaatgatgtatatattttcagtagatgcattattaactgtcagtaatagggcttgggccatttttgtatgcgactcttgatcagacaggaagctggtgtagccgcaagccacaggtctatctaacagtgattaaaatgaaatcatctttaatggagtgaatggcatacgaggggcatacttaatcatgtaactgggctgtacaaattttccctctgacagctgagcccgatgttgtaaatccaacaggaagactggcatttagaagatataactctgcctttaaagtcttcccctttaaggtgggttctcttggctgaaacaaaattatctctcacataggatggaatattgtcatcattggttttttcagcaaacatttattgtgtgcctgtgtattgggcatgtgtatcgagtaattggatatactgtaccacatactgtttcagacatcttttcccactttaacttgttaatatgaactacaatttactcattcgtgttaagcactggactggatactgtacataattatccataaaattctcacattattgaagtaggatatatcagcaacattttacagatgagaaaattgaggcccagagaagtaacttgcctgaggtcacacagcaatatagaacagaaacaggatttgaattaggactgtatgactccaagccctggtgtccctaaccccactgcacatggctttcctgtgagcatgaacacagatgggacacaattctctcatcctaaagtatcggagctggacaggacttaagaggttatctggctctacctcttaattttacaaataaggaaaccaagagccagtttcatgggagatgattaagccaaggactccctgcctcggaatttgctgagaaaagaagagagcccttgcctgaaaacccatatttaagtgcttttacagaactgtccttcacatataaggataacttcttcttgatgtctttgggtgatgacaaatgcgcttgtgacaatagtgatttttacatttgtcttgtgatgctgtagttcattagattttactttccaagttagcatttcttacgataacttgatttagatgacataggccagcatgtctcaaactctaatgtacatgcaaatcacataggatttagcaggtctcatgaggacctggagattgccgctccaacaagctcccgggtgatgctacccattgcctggttgcactttgagtggcaaagatgcagcagggttcgaagaaaccgtttcagcttctttactttgtaagaagcatctctaggcatacatatggattgtaagtggtgctgtggtctgataaaagatagccaggtaatgattaagatagtgtccttaggtatttacagaggtatctatctccatgaactttcttaatgagcttaggctgcagcaattatatctttaaaagtggggtttaatggggaaggcatatttgggaagtctgaatggaggattgtaagctgcaggacagctggggccatgcttggtgcagtgtttttatgagggtgccaggctgaatattggtcatgcaggagctgtttagtttgggctaatgactaagggcatggttgtcaggtaacctttggttcaagtcccagatctgccactaaccaatggtgtatgtttgggcaagttaccttaccaccttcagatttagtttgcttatctttaaagtggggttgcaactattatttacctaaggtgttttaatcaggataaaaggagatcatgtatgcatgtacaacatgatatgtggtcttttcaattattgggggcccagcatttctggaataagaaaaaggataaaatgggccgggcacggtggctcatgcctgtaatcccagcactttgggaggctgaggcaggtggatcacgaggtcaggagatcgagaccatcctggctaacacggtgaaaccccgtctctactaaaaatacaaaaaaattagctgggcgtggtggcgggtgcttgtagtcccagctacttgggaggctgaggcaggagaatggcgtgaacccgggaggcggagcttgcagtgagtcgagattgcgccactgcgctccagcttgggcaacagagcgagactccgtctccaaaaaaaaaaaggataaaatgctttcaagcacttcacttcttccggaatcatgttatttatattacatttgggggtattttttttgccagggattctagtggcatctagcgctttcctgcacctccacctctgtgctttgccagcagtgtggctagatatatggtggggaggcaagattgacaggcagaaacagtaggtgggcccacggagggatatgacacaagatgtgctatgggacacctatgctgacaatgactgctcagttattactgggagtcagcctagtttaaggggaaggtcatgggcctcagagccagatagaccaggagaagaacccagacctgctacttaaaaacaagttcactgagcctcagtttcctaatctgtgaagtggggataatgaaaccagcctgacaggattgctgtaggaattagagataatatgtgcaaaaccctttcatataatacatggttaataaaagggagccattattacattaatattattaaagaggaaactcctggtggaactattgaaattctttaacctgatccatccaggggcatttattgttccattgctgtgttctcagctccagctgtataccgtgggagggcggcatgtgattcagaaaattccgaaccagggtcctgattcctgggttctgtgattttccacagctctgcctgtatcttctactaggaatggtcattatcagcatgtatgttcctccctcagctttctttcccacctcctcccttccgggagaattaaaaaatgatatgaacattgtttctttgtctttgggagcctggggaattccgagagaggagggatgctggttctaaaacataaactctatgggaaaaggcctttttctagaatgatcaccattgtatccccagtggccacagaaggtgtgctaaaacatttttgttgattaaataaattttaaagcccctgagactatttgttaaacattgccaggagggtttctttgcatgggcaccatggacattctggccagggcaaattctctgttgtgagggctgtcccgtgcactgtaggatgttcagcagcaccgttggcttctacccaccacatgccagtagcacctcctcggttatgacaaccaaaaatgtcttcagatattgccaagtctcttctggggtgcaacatcactctcagatgagcacccctggactgtggagacagggtttggactagggttctgctggggaaggaaggtttataacatgaatgaaaggaaaagatttttaaagctaagacaatatactgtatgtgtgataccagtaaaaatgtttccttctttgacatccattacagacatttaccttcagttgctacaaatgtctactcaggtgacagggaagagaggtgtggctgccggctgcccaggcttcagtgttgccatgaacagcttgcactgctactttaagaaacagtaaccgtagatgatacagctgcagttcaattttgaatcagcaagtccagtacagactgacctgtttacagggcagatcatttaaaaatctcaggttatttgctcttttgaaattgattctatggatacggcccaattttgcttggtaaacaagtatgaagttcgggcatgaggtttgggcacattggtgtttttcagtgactgttggaatcacatttggctcacaaaaggacgccatgccttcctctggcccgccaagtatttactaccatcagtacttccgacatcactattttgttactttgaagcctgaatattcagaaaggtgcccatcagctggaaagaatctttaagatcacagaatcaccctcctccatgaagaaattaggaaactgagtttctatgaagcctgacatatctcctttctttttgtccttcctttttctctttctttctttctttcctttcctttctttcgttccttccttccttccttccttccttccttctttccttccttccttccttccttccttcctttccttcttcccttctttctttcttttttttgagatggagttttgctcttgttgcccaggctggagtgcagtggcgcaatctcggctcactgcaacctccgcctcccaggttcaaacgattctcctgcctcagactcctgagtagctgggattacaggcatacaccaccacgtccagctatttttttgtatttttagtagagcctggatttcatcattttggccaggctggtctcgaacacctgacctcaggtgatccaactgcctcggcctcccagagtgcagagattacaggtgtgaaccactgtgcccagcccatatctcctttaaaatcccaatacatcagtatcatcaggtgttagactgttaaaatagagctcttgttgagtgtaacccttttggtttttgtgaagatcttccctaccctatccattggaaagactattttaatattgtttcttctcagaatattatatgaatacaatcttgtattaaaaatggtgttcaggcctcgaggtgatggctcactcctgtaataccagtactttgggaggctaaagcagtgggatcacttaaggccaagagtttgagaccagcctgggcaacatagtaagaccctccctctacaaaaaatacaaaaattagctggctgtggtgacatgcacctgtagtcccagctacttggaaggctgaggcagaaggattgcttgagcccaggaggtcgagaatacagtgagctatgattatgccactgcactccagcctgggcaacagagtgagaccttttcccaaaaacaaacaaacaaaaaaattgggattcagcaaaaatggtggacttgatgaaaacataccaagagaatcaactgtaaaactccacttaaaaaaggcaagtgtgtatatggcttgaatgggcagctcagcagtgagggatgaagagcaggaaatcacaaatgggtcacctgtattcaaatcacatatttgtggctatgggcaagttcccaaacctctctaagtaccagcctgctcacctgtaatggtgataaataatattgacagctgcataaataggattgcagggattcagtgcttcaacggaggtcagaggctcagcacactagcaagaattcggcacttacatgttagtcactgacactggtgtgttacactaataagtacttcctagttgttattttattctagagtccttttagggcctctggaaacgtgatttcttcaaaaaacctggataatgaaactgaggggacctatgtaacttggtacaattatctcctgcactggaatacaagtaaagaccagactgtggagacggaggcatttaaaaagaaccatatatagcaaattttcatcagtgctttttttttttttttttttggtctaggttaaatggtattatcctcacattgtgtttgcttaaaattgacataatactgtatgaagcaaacatttgcattatactcattataaacctttcaaattgaagtgaactttaaaaattagttaaaaaaatttttttgaaatacagttttttgaatgaaaaaagaatgcaaagtatatttcctccctttgagccctagaatctcccccgcccaccccccgcaacacacacacatagggaagaagccctgtatatactctcctatgtgctttgggggatccaggaatgtatttactgggcatatgtagtagagcagtcagataaaggaagaaaagtcatattttaatgttaaagtgatagatttttcatgctaacagtctattcagaaaaagtttaagagttttgaagtttttttcccctgatttaaaaaataattaaagctgaaaaagatataaaacctacattaaatagccaacttagtatctatccaagttgatactttagtaactatagcccagtcaatccacgtggactgatgtatttcatcaggggcccaggtatgaactgtcattagcaaggtattgattgagtacttcattctttgccacactctttgacatagttattttaggcttaaagtctgacaacaacaaaatgcagtcatggtgtttaatgtggatttgcttttctaaaacaatgtccagcaaatcgagttgtaaattcagtgctttacagtagatttctttattggactgcacctgcccagtggaagtcccgtgttttcccccaaactagtccgtgattgtgcttctttagtgaccttctgataaggaagcggtattcagaattgcattttttgtttttttcagacagagtctcgctctgtcacccgggctggagtacagtggcccgacctcggtgcactgcaacctccatctcctgtgttcaagcgattctcgtgtctcagcctccccagtagctgggactgcaggtgagcaccaccactcccggcttatttttgtattaataattttagtagaggtgggttttcaccatgttggccatgctggtctcaaactcctgtcctcaagtgatttacctgcctcagcctcccagagtaattggattacagtcatgagccacagcggctggccagaaatgcatttttgatattcaggttcaactcttagggagcattcactggttcatagttcaaggactgtagtccttgctgtgcttaccccaacctgggcatgggcctttggcattgcctccacctctgagctcatgtgagttttgtctctagtgtgcagtgttttagcaactgtccaggaagtacaacatactgagagtccttgggggcaacgtctctgggatcagtttctggtaaagagcattgcttttatagattccagatcctagtgggtcagctgtgattgaggtgctttctcctctcagcaagcttcttatttctcaccaacaaccagatgtgggctttcatgcattatttgtgtgatgaaacataatcttaggctgatataattgtaccccaacatttttgagcatgaactgctaattcaatatagagagaaagaaaaggtggcaggaattgagagtcttgaactcctaaggtttgatgggacaggtcattttaccatcccaggcaatggtccttggtaaaaccagttaaattgcagtgtttctggtgactaaacctgtagtatgttgccatctagtggaacacatagcaaactaaagattaatgcagtctgaccataaagttcagctgagctaattaaatcagccagagaaaagaactgaaagtattttctaaaagcaagtgttttggtaacagcaaattcatatgaaaccagagttgactttttttaaagtaggcaaatggtcactctgtttctcaagagtgcttgaatatttgccacccagttactaacaagtttgcaaacatatcaccaggccaggacactgcattttcgttgtcgtctgtacaataggcagtttctcatctaaagtcctggagaaaatgcttggttatcagtaggttattttggtatgttttaaaatgtgattttcaggtgtccattccctttcttattaatacatacttatctttttttttctgttaagtttccaagaataaatctgctgatttttagaagaagccaacacatgacttcacaaagtagggatttcacattttaaattccaactagcatccccaaaatgtccagtcctgtggtttgagacctgatttttaggaagacgtgaaagattctactgtgggctgttttgtgagcactgactgcttgttttgtttgtgtctttgtcctgctcctgcttgcctagatccctccctggtgccacagcagctgagtgcgcatcaaatctgaagaaaatctacacagtacagacagtacaggtaagatcaagagagggactaactggattaacacggcacacgtcagacacctaatcacccaacttgaaatctgttgctgtgctggcagcccctgtccagggttctgctctggagttggctctcgggtccaggttggcacagctgcccttgaccaagtctgctccagggccagctgagcacacagtcaggtggcctgctcttctcttggccacctgctgaacctttatctactacctaaacctttcatagacccgcacaaaaggcagactgcagtgtggttaagagcgaaggtttttcaagatctttatctgtgttcctgttcaaactccagctctgccagtgcctctctgtgcctctgttccccatcagtgagaggcagtggcgccttccctgcagggttactaaaggtttagaggtcacatggggagagcaggatagtgtggagcgtgaaggtggagagtctctgcttggtttcctacttcacttcgcaattccatcatcctaaattaggcatggatcaacccctttcatctctgtaaaactggtctaatggtagcacctacctccatgggttactgtgaagattgaataagattatgtttatgccatgcttagtggaatacctaatacatagcagattctcaatgaatgcaggctcttagttctattagttctttctctatctaactctgatggtggagttggaaaaacacaactgaaaaaacacaactggccaggcgtagtggctcacacctgaaatcccaggagtttgggaggctaaggtgggaggattgcttgagcctaggagttccagagcagcctgggcaacatagacccccatctctacaaacagtttccttaaaaattaactgggcatggtggcacacatctgtggtcccagctacttgggaggctgaggtacaatgatcacttgagcccaggatttcaacactgcagtgagctgtgttcacactactgcactccagcctgggcaacagagcaagaccttgtctcaaaaaagaaaaaacctgattgatttaattgatcccatttctattttcttcaatagcaggttctacccagtttctcctgtcttctagtttagcgggctggtgcaggtagagaataaggctattgtggctgcttcagagttgcattgaccatatgtccataaattttctagaagggagagattttaaatagctttcctgttgtatccctaaatcttttaatgtcttagaaattccaatagatctgcatctagattgtgtctcttaggcagcctcttacatgcagaagtagcacagagatccattttttttttaggctatggtcccagtatctggttcaaaaaatgtggcatgcataattatgaagtcccaggaatctgattgtaaggtgctgcgtgtggctaccaagggcagtgagctgggtgtgaagacacagtcctgactgtgggccatttctggtgtcgttggggaaatgacataagcttgtgggaagcagagcagcagtgctgctgtgcagtgccaagtacagacagcacctcaaggcagcaccactgtccagagaaatcaacgcgctaagagtctgggaggcctccctgcacgtctcttctgtggatttagggacttctgttaccatttcccagcggccattttttaatcctcagagcacttgatttgaaggcctgtcctcatgtaaaggctctcagagtctcattagacttttcccaacccacatgacattagatcatcagggttatgcaaggggttctggggctgacactagtcagatgaggggattggcttggttttcctgaccccacgagataacccagggtatttggtagagcccctgaatccacagcattttagggtcttcagggagcaatttaaagcacccaggcaggcacatactaggaaatacttcctttaaaactactttattgggatataatttgtatacagtaaatgtagatttcttaagtataacttttgacaagggtacgcacatacaaccatcacgcagatcaagaagaaaaaagtttcccttacaccagaaagtgtcttcgtgcccctgccagcctccatcccccaaagcaaccactattctcatttctaccacattacattcattctgttactgaattttatattgatggaataatacagtactatattattgtgtctggtcctttgcactcaatgaatattgaaggattgaatgaatgaatgaggccgagcatggtgactcttgcctgtaatccccgcactttgggaggccaaggtgggcggatcacttgaggtcaggagttcaagatgagcctgagcaacaaggtgaaactctgtctctactaaaaatacaaaaattagcctggagtggtggtgggcacttactggggaggctgaggcaggagaattgctttaacccgggaagtggaggttgcagtgagctgagattgcactgccctccagcctgggtgacagagtgagactctgtctctctcacacacacactctcaaaaaaaaaaaaaaaaagaatgaattagaagttaataaatgaaccactttcctgagtcacaacagactgctcccgtaagaattctgtgggctgcacattctcagtgggggccaaagttgattcttgcaggggaagtagatcagtgaacaaatctcattctttttacgtacaaagcatagatgtccatgcagtccataaacatacggtgtctctgtggtattaaaatttcgtcataggtgattaggaaaaagggttcttttagggcctaaggggggaacagtgaaaaaaatggctgataaacactgccctaaggatcaggaaattcctttctgtctcagctgtctctgctccctcagtttctcatctgtaaaactgaggtagtaatagtgcctactcgctaaggtagagtgaaagttagatgagatggtatatagttcttagtaatgcttggcacttagccctcagatgtggccagcttttacttaagtgttactggattctacccctcagctccatcagttacctggctagggtgtgggctagggttgtcacaatgccttggttgatgtcccatatgtgacacttactagcttggacaagttatataacctgtctgaatctcagtttactcatctgtaagatggaaataattgtgatggtaattttatcatgctgttatgagacttaaatgatacaatgaggtaaaaagccatagtaagtacccaatcatctgccataatttgtctacttctactgagatatcttttcgtgctttcttcagtcatgttttatatcaggaaactatataccactgcttctagattatttatttcaagtgattatactctggatcgcaccaccactaacacagaggtgtatgtaaagatatttaacttatcaataacttttgagttttcagcctgcgagtgtccataacagctgataaattgtccttagtatttaagaactggccaggatactatcttgtaagtaatttgaggatatgcttttgtcccactgtctttttattttattctaggattgtatattaatttttttttcttcagaaacagggtctcactttgtcacccaggcaggagtgcagtggtgctattatagctcactgcagcctcaaactcctggtctcaagagatcctcccaccccagcctcctcccaagtatctgggactatagccatgtgctaccacacccagctaaattattttattttttttgtagagatggggtcttgctatgttgctcaggctagtctcgaatttctgacctcaagctgtgttccctccttgacctcccaaagtgctcagattacaggcatgaaccactttggcctgtacgttgatccttttactctcactccattagcactaaaaaaaactgcttctccaattatgtctgtgttttcctcccatatgtgtttagatgaaaggtaaaaatcatgtgatattaatgattgtcttattaaagacatatgagtctttttatactttgaggccctttagcaaatcaaagtagatggtttgggagaggaatcgttaccccgtctattagttgaggagactgaggctggaggtaagaggcccaaacattccatgattggaaagagccagtcatgccttgcctctaggactagaattccctcccagtccaattctctttcttttactccccgtgattgaggagtggaggagactcagcctccaaaggacctgggaacccctgctgaggacactttcatcacacctaacaataattctctctgcctggagttaaattcatttctactttcctaactttcttggaaaattccattttacatctaggcgtattttccagatgcttattgattctcttactcctttgtgaacctgtccaaattttccacatttctcttgtgattttgcatcctcagtggttgcagtgcagaatagaaaatggcttttagccgggtgcattggctcatgcctgtgatctcagctactcaggaagctgaggtgggaggattgcgtgagcccaagagttcgagttcagcctgggaaacatggcaagacccacatctctgggagaaaaaaaaatagaacacggcttttgaacaagccctgttttacctgttggagaatgaagagctacctgccatttgtgatttgcaagagaagtctcccttctccagtttctttcagccttatctgctacaagactaaaaattccacccctgaaaactcattcctgtacagcactctgtctcgaacatcagttatttggtgtatcgccttaaagattttgccacacctatctcacttgtggtacattctacccagtatttcttataacttgacttcttatttaaatttgcataaaacagaaaccatatttcctctataagtggaaattcagcatcgtttatcataagcagaaagtcttcctaaagagtatatataacctattgaaattaagaaaatgtttcccctgcatatgccaaacctatcctgtgtgctgtcgataatatcaagacttcatatccgcaggtcaagccgcctgactggagttgtgcagttaagttagggcagcagattgctttccaaacccttgggaaatgagggctcttccttcagaagaagaggttttctaggtcagtattgatcatggaggatggtggaaagattgattccaagtacttgctgccctggacacagcaagacagcccatggtgtgtggtgtcctgcaatagaatgacctggagtgaaccacttggctgaagggaggggcctgaggggagagaggaggaaagccaacactgaaaagagaaagagaaggacctgcagccaggtccacttcatagttctgtctagcacagactttgcatccagtataacaagattctttatccatcatttagtttattcattatatgcataataggatcaacatctatagctacaatccagttatgaagaaatataactgaagttaaattgcttgtattcctccacattctcagtggaggctgttgtgtctgtgtattgggtggggtgagacttgaccttgttaattaaaagtaatttagtcacttcaactgtgaaactgggtctcttctaatttaaatctcttttgggaaaaatgaccaccctcttctccttctccatatgaacaggcatatgcagaaatacccctgacccctcctgaccttgggccatgcccaccacctttggccctgctgtaacctcatgttatgaagacccctgctatgtacacacacatccagaccccaggccctgttgtccttaggctttctagcaatttcaagctccagattggagatttaggaaatgttggctgccttcccccgaccccaccagaatgaggggaactctataaggttgtggcaggccctcccggccagaataacccctcctgccttcacagctgttctcagacctgaccgccatgttgctcagcgctgtaggaatgagggccttttctgggagtcttggagcctcttgggctgtaccaggaagcaggttccacactcctctggtctaggcatccccaatctttgggtggggctctctcccatcctttcagggttttaaccccactgtcctctctctccaagcttttaactccccaactcagagttggtttttactaactttctatgtggtgggaaattaccctcacatcctgtcacatctcgtttactctatgatcacaactccacacttgggctctctctttaagccaagccctttttggaattcaaaggaaaacccatttctctctcaagtacctagctcttgtaaatcagaagcactttgctttcagcctttgtgtctgctgtgagttaaaaacatccattaaactcttcagttgcctattcggttcagatgcctattggccctgcccataaataccacttattcagttggtgggaagccccaggcaactagtaatacctaatgagcaaaaatatttgttttgtttttttggaaatactctcttgctacacatgccacaaccttggaataaatcctggaattttttttttttttttttttttttgatgtgtgtttgctgggtggttttgtttctggtttgttttacaaaacagacatatcactttgttgtctgtcaacacatgacatcttttcttctgaagaatttccaagtgcattctttttcttcagaacatttcagtaggaaattgaggaggaaatttgccagttttcttggtaatgaatgattatctatttggcagaaggctgtaaggtggggcatagttgctccaatcagtgctatcagattggggatttatcaagtggtcagcatattaatgggtctaaccatactttgtttccttccttaggcctagcaagtgctttcactttgcatttcatcattacattttccagtgaaatagctgtatccttatacagaggaggcaacgtgggtttcacgggctacatgacctgtgaaggttatgctgagaacctaggtcttaaatccaggtattagactccactggacaggtgtcttccctgcctcagtttctccaggagaggtgccagattggtgttccagaacatacctcccaaggagtggattgctgtggtcaaaagctgaccctcctgcattcagctaagttccccaaggacccgtcacagtgctctgttcacaactgatggtcacagatgttgactgaatgaatgatgttcaacttttatacctctcctagtcttagggtgattatcaaggcttttgggaaaaaaaagcatttaaccatcattaataaacattgtgcttagttttacttttactgcaatcttggatttgcaagtctaacagaattaattataagcctaaaggcttctgaaatctatttgcaagattttatatatagtaaaatttaagtgtttccattttcaagatgtgttacagagagtataatcttgaattaccaggcttccgctgtagcagacctttcacttctgcaagggcggaagaggttttcaggagctgagtaatgctagattccttcctgtaggtatttcaccagcagacatacttcacaaatattctacctattggatgaggtttgcaacagggaaacagaccagtttaatgacacatgcttttcaaatagggcttttttttttttttttaatggtgtgaccggatattttgctcctattttatgctcagcaaaaacgtacaaatatgtgctttaatgaatatgttaagtctatcactgatcttcttgggctgtaatctcttcctgtcaaatttgccaagccaagcagaatcagttgtctgtttttgttttcaagagaagcttctaaagctccaatccttagcatgatctttagtgtttttctgatctttgaaatggaagaagtgttttgttgtattttttcagtgtgcttcaagtactaggttaaaaagtcaagatttgacaactttgaccggggtatgacggcaggaactttggtttgtgatgcctttgaggagacttgaagtttgccagcaccaaagtcctcttagttttaccttaggcaggggttttcctcttaatgttattttgtgcataaattctacagaggtcattgccacatcgtaaccaggttctcaggctggagttgacaaccaccagcctcttgtgaattatgggcattttactggtgggaaaatatcttcaacatgtgtccctctttctgtggcttcatgacctgattcttggctgctaagattggagaaagatgtgtcaaaaacatatagtagtatcttcgaagaaaatagctgagtggttaggaacagaggtttgggaatcaaattgcctggattcagattccagccctgcctacccaccctcacaccacagaaactgaaatattggaataatcttatttgtacaaatagcaaagcatttacaggataggtacctccatagaggcagatgggtgtttgaggagctactgttaatacagtagcttttaactcctcactacactagcaccattttagtagaagggagccaaagtggattctcaattaatacatctgtcatcctgtagttttttgccttcaatttgatcttatagttcatcattgccacctttgcagttaattcagctttattatttttttaacacaaaacaggcttgaacaacccagcaggattatcattcaacatagctaaaattctattccacccatgtgactcagttcatgagccctaggattgatttttctaattgctattttactcgtgctgctttcctcagacctactgggagacccagatgatcaccctatgcttacctcaccacacagaacaatatttcttatttgcacagtaattctgtggatagcattcatagcgtagtaattctatgacctactccaaacaaatggggaagtgttttcttcttcatagcctcaatcctcatcctaatcctaatggtcataccaaactgactcttgggcaggttcgtctctgcctggtgtccttatctttaaaaaaaggataataatcatacctcctcctaagagtgtcattaggataaattgcataaacatgtaaatgttcatagaacaaagcctggctcagagaacagctccagatcacttgtctttgccaagacttcctgttttactattactttattatttttgtataatctatttctgtttaccagttgccctgtgtcttagttcaggctactataaccaaataccatagactgggcagtttatgcaacaaacccttgtttctcacagttctggagcctggaagtctgagatgagggtgcgagcatgggcacatccaggtgagggccctcttcctcgtttgtacatggccatcctctccttgtatcttcacatgccagagggagggctggctctcttcatcttctcataaggacaccaagcctgtcatggtgactataccctcatgacctgattacctcccaggggccccacctgctaacaccatcctattggtagttagggtttcagcatatgaatctggggaagacacagatgtgcagtccgtaacactgtgtatcttgcgcagcttgttgtttcagcacctgagctgttccctcttcctttagcaggggagagataaggggcaaacagagtgtctaaggtagtttctctttgccatctcctttatcccacaacccccaagccatagcatcacagacttcttccaggcttgtagagaagacagggttgatttttttttttttttttttttaaacggagtctcgccctgttgcccaggctggagtgcaatggtgtgatctcggctcactgcaacctccgcctcccaggttcaagtgattctcctgcctcagcctcccgagtagctgggattataggcgtctggcaccacgcctggctaattttttgtatttttagtagagatggggtttcaccatgttgaagacagggtctattgtaacaaaatagttataaatatgttcagtacatatattcagtactaaaggctttagtggatactacctagctgccagaaaaatcattagcaaagtcctttccagttttatgtgtagacatgttgcataggaatgtttgcttaataaccatagcttcctgaaacatagagcttggcacagcatcagcaaggaacatcttttcttcttgttgttgtgtttttgtttttgtttttttgaggcaggggctcactcctgttgcccaagttggaatacagtggtgcgatcttggctcacttgcagcctcgacttcccaggctcaagctattctcccacctcaacctcctaggtagttgggactacaggcatgtgtcaccatgcccagctaattttttgtattttttgtagagatgggatcttgccacattgcccaggttggtctcgaactcctgggctcaagtgatccgcttgccttggcctcccaaagtgctgggatttacaggcatgagccaccaagcccagcattctttaatgttatattacattttctaacagagaattagaagggatactgagaaaaatctattttgaatggataaaacaatgagaatcaaaatttttctttaatgcattaatttgataatctagcagcataataaatcaatactgggtatattaaacaaagtgtttgtttttcttttaaagatattttggagtgtatacaataatatccctcctgtgactagcctgcctttgagatgtagttatcatttaatgagaggagagaggcgaccactttggtaagtgtctaacgtgtaatttaaggtcaaggtgggaggaaaatgtttgtgaacctcataaaagatcatatcacctgagatgtgtgtctcacatggacaacatagaaagtctgtgataccaatcatggcccagggtctgggggtaagtgtcctccttctttaatagcttgatgtagtgatgaagatggacagtaagttagtttgcccaggctggagtcccagttagtaataaatccttatgtcatgtcattcagtctttctgcattatttactcattaataaaatggaaatgtacctcatcttgattagtagcaaatgacagaaacctaatttgtttttgtggggttttttttgttgttgttgttgtttggttggtttcttttttttgagaccaggtctcactctgtcaccaaggctggagtgcagtggcaccatcacggctcaccacagccttgacctcccaggctcaggtgaacctcccacctcagcctcccaagtagctgagactacaggtgtgtgccaccacccccaactaattttttattttttatttttggtagagatgggatttcaccttgttgcccaggctggtcttgaactcctgggctccagcaatgtgcccacctcagccttctaaagtgctgggattacaggcatgagccaccaggcccagccaccagaaatgtaatttgagcaaaaaaattgagtatgtttttaacctgtgactgggaagttcactggtaggggtagtttctggcagatccagctcatgttatcaggaatctgatggtccccaccagaattactctgcttcattctacattggtttaattttctcccatctgaggtggcaaagtggccttcctatgctctggtcttacaccctgtaagtttaccattgtcagtactcacgagcccagataaaatcccaggtctgggtctcattctcccactttgagtcccctttcaatttctggccaatcacaaagactaggaagaggcagtgctctcataggctagcctgggtcagaagcccatctttgaagctaggacgtggagtcaaccctgcctgagtggatctcacagaagagtagggggcaagtggctctttagagggaaactgggatgctcttaccagaaagggagcagatgttaagcagtgacacacagcagatgtcccccacagggacacctatgaggccttgatacatggttgataggagaatcacatgagatcgtgtcatgaccatgacattgaagtgtaagggccttcccttgtggcagctgtatttgttgtccatccccagagtcaagcgagcctctctgcactagtgctttgaggatgaggatctcaagtcctttcaccctccctgcccatgtagccactgaacgccactttcttccctctcaatcgctagctccttcctttttcattaatctgcttctgtatccaacaaaaggactggggaagtgtttattgaaaaatgcccaatcttacccccgttaaaatggcttttatccaaaagacaggtaataatgaatgctggtgagggtgtggagaaaggggagccctcgtacactgttggtggaaatgtagattagcacagccaactatggagaacagtatggaggttcctcaaaagactaaacataggactgttagtgattcagcagtcccactgccagatatataccccaaagaaaggaaatcagtatgtcgaagagatgtctacacttccatgtttattgtagtaccattcacaagagccaagatatggaatcaacctaagtgtccatcaacagatgaatgactaaagaaaatatggtacatgtacaccatggaatagtattcagccatcaaaaaaatgaaattctgccatttgcaacaacatggatggaattggagaacattatattaagtgagataaaccagacatggaaagacagatacctcatgctgtcattcatatgtaggagcttaaaaaaaaaaaaccctgaactgatggagaaagagagtagaatgacggttaccagagctgggaagttgtgggggtgataaacaggggatggttaatgggtacaaaaatacagttagaatgaatgaggtcttggagcacaatagggtaactatagttaacaataatttattatgtattttgaaataactaaaagagtagaattggaatgttcctaacacaaggaaatgataaagactcgaggtgatggatagatagcctaaataccctgattcagtcattacgccttgtatgcatgtatcaaaatatcacatgtaggccagatatggtggctcatgcctgtaatcccagcactttgggaggccaaggtgggaggattgcttgaggccaggagttcaagacgagcctgagcagcaaagtgagagagaccctgtctctaaaaaaaattttaaaaattagccaggtgtgatggcacatgcctgtaatcccagctacttgggaggctgagggcggaggattgcttgagcccaggagttcaaggctacagtgagctacgatcatgccactgcactccagcctgggtgacagagtgagacctagtctttaaaaaaaaattcaggggccgggtgcggtggcttacgtctgtaatcccagcgctttgggaggccgagaccggtggatcacgaggtggggagatcgagaccatcctggctaacacagtgaaatcccgtctctactaaaaatacaaaaaaaatttagctggacttggtggcggacgcctgtagtcccagctacttgggaggctgaggcaggagaatggcgtgaacccgggaggcagagcttgcagtgagccgagatggcgccactgcactccagcctgggtgacagagcgagcctgtctcaaaaaaaaaaaaaaaattcagatataccccataaatatgtgcaactattatgtgtccataataaaaaataaaaaacaaaaataagaaaaatgcccaactattttgtttttaaggtcatctgttgttaaactaaatgtatgaagagatatttaatctaactgtatgtagaatcacttagtcctgagtgtaactttaaacgttggtctttggcccagggaagaggagagtaatgcaaagggtggcgtatggaagatgaaagtccccaaggacagcacggtaggttcctactgatcctcttctagaaccggcgaggcttggagttgttgactgcctgtcatcagcattttgtgctttgcagatagcctatttacctggcagtccccaaacaggctgggggtgagaaattctgttctgaccttgatgattttctgcctttcactgtcaccttgaaagtgtataattgtgcttctctatagacgtggtgtagtatgtgactgtatcatgcagtctgcaggagtaaatgcctgtgaacttcacagaaaagctgggtgaatgtctttatggtggtcattcccttgacagccatgaccaacatgttgcatatggttttacaaagtcggaagcaggatctttccttccaaaggctcttccctcctctacagggggaacaaaagcagttctgagaatgaccatgtcacagagaatagggaggcttggcatttcactatcctttggggtttcatgagagactatgctccatctccctctggggccgatgagaacctggatggtgtgatgacctggtgggatgctggtttgcagtgatcaagtctcagaaacccagatttcccagagtgagctctaattcatcttattgactggaaatgaacgtgaacattaaaatcggttatcttaagccctgggaaactaaaaagcttctttgaaaatggacaaaggggaagtgctaggcagttttaccttttcatggtttctttcatgtggataagctcaaagaactgaaatgtctccagggacccatatgcttgagctggagtcattttactataagaacatacctaaagacacgaccagatttatttgtcaaaggtgcaaactattagtcaagatttgaagctccaacattttactgttatttggcatacataatgaaaaatatcagggcagcagagaatataagagaatgagggaatataaggtgttcttaaaatttcactatgaacactttttgcctttccatgttctttatttactcactttatttactagactttgaactctagtagaagtaatcatgatgtcaacattccttgaaaagcggctgaaaggcagttttgtcctctccttgttagctcacttggctgcgttgggtcacaaataataacgctttcatatccgtgcaaatgccctcatcccaggcagtttagcctacttttcatcatcaaccagtgggagtcttgtgggccaatcctgtctgaattcaaagcagaagggtgaagtctcccttcccctaacagcctctcgcagctctcaacttcatcagtaacagcttgaaggagtgtagctggacagatagaaaacggaagcaatgattcctaggtgggagactcatagaccagaagggacaggctaggaaagagaaaagaaaagaatgaaaggtcacttttcagttccctggctaactgccatggccttggttaaagattcagcgagactgctttaagcttgtgaggacataataatacacactattattatagttaatatgtattgagcacttggaatgtagcaaacacacagctgtttatggcatggatcttaaatgttaagcccttttattgcagtcattgtactaagccctttgtgcacacttgttgactaatttcatacccacaacagccctggaaggtcggacctattattatttccttgttcacctaaagaaactgatgaccagagaggttgttaacccatctggtttgcagatagcaagcagcctctaaggattcaaacctagtttgggggcaatttggagcctgtgaatcacaggaaggaggataaatgggaccaagaacttttcaaaggaagtaatgtgtgtggaaataatgtagctgtctattggatgccactattagatcatgaggagaaagaaactccagtatttctcattggtaggaggcagaccggagcgtgcactgaatcttccagggaaattacatacattcttacataaagttctatcgcctgccataaacagtctgcctcaaatgaatggaatttcccaagactctagtattaaataaacaagaaatgtccttaagtgttctttacttgtgtaaccttttaagtaccttataagtagtaagaaaaacagagaaaggattttgaagagaaagattttactaatagcatccacatataatcagcttctatgttttgaatcagtgagaggtaaagaaatttgaaagttttaagtcatttgaatgcattttccctagaaattcttctgaatttcaccaggggtttcactagagattagcttttaccagactttggctcacttgtatctgtgtaaagttatttgtaaaccaatgaaaaatatgccacggtgataagtgtttgcacctaggatttggaggtgtctgtggactccaagtatgggcacagaaagtgcatgtgaagttgaagaaaacataatttgtttagctcctgaggataattgtctaaaaatatctgtattttgtttgttttgttttttattcttttcccatatcagtccacagtttggaaagagttgctgttagcaaccatcggggaacagttcacagactgtgccgcagcaggtaaagcagcccacggctccggccggccctgcctcgtgtgctcctggcttgtgcttgtttcttgcagcagcttgttatcacgtgtttgactttttacatgttttgaagttgtttattttggaactacaaagttactcaattttttttcatgtgattttcgtgttcagtgttagatatgtgtgtctgtgtccatatgcatatttacatatgtgcatatttatatatgtatgtatatattcatgtatatttttccctcttagcttaatttaatagtatctataaccatctgtccaaaataaataggcagaaaagaaaaatctcacattaactgggcccttaacacaattggtagtaggttccattatctgttccagttcttccagaaggggaaagtgtcttcagtgtctagtgaagtttttaggtggacaggcacaatcctctctgtccctctcaacccctaaccccttcgtcttgttctctctgtcccctgctcaaagaggactagagtggtcggtggggacatgctcaccattatatcctgtgatctcacagtggaggataagacagaagttcttcagggcttttctttggagaccattttcaaatacccagggtatttctgagagcaaaacaaaaagcttttgttttgctttgtgtttatcatgaacccattcaaagagcagaatttaattgcttgtttaaagttttgttttcttttggggtagttccttctgaatgctcctgaagtaacatttagaatactatttttcttccccagctttcagttaagtttttctttttagctaatgacaatgatcagttgtccctcagatgtcttagatggggccgtgtttgagagccctgtaggccttgccagtcccagggcacatttcagattcatctcgtgagcagttccaatcattccacttctgttttgcttacttcttacaccactttttattcagttaagataaaacctgcgctgggcgtggtggcccatgactgtaatcccagcactttgggaggccaagatgggaggatcacttgaggccaggagttcaaaaccaccctacgtaacatagagagacccttgtctctacaaaaaatgcaaaaattagctgggcatagtgacatacacccatagccccagcaactttggaggctgcagtgggaggatcacttgagcccaggagatagaggctgcaatgagctatgatcgctattgtactgcagcctgggtgacagagtgagaccctgtttcaaaaaaaaaaaaaaagaagacctgggttaagataaatttgtctataagtacagattccttctgttttaatagggagtatttagcaacttgataatatacagccaaaaatgtatcctgtgtataattataaacacataaatccctgggagaggaagttttctgcatgaattattcctgtttccagaaccagggaaaaatagtctaagtggtaataaatagccagtattgagtaaagaagaccaattgttttgtggttgacttgggacatgagcgcaccattaactattaaccattagctcttccattaactagctatgacactttaagcaagtcagctaatctctctgggcctcactcccctcatctttaagcagtggctcctcccagctctaatgtcttatgctgccagtaccctaaaataatcaaggttttgctggttgattctacttatgaatattacatgtttgctaatggatctgcctttggataagagttgcagcctttttttaccgagccatttgtgaaagtgctgtgctagtaactgtgcctggttaccaagagccaaaccaaactgaaatattgacagttcggcatccatcagttacattacgctttgaccaatagggtagaaatgggcaacaccaaaagactggagacatgaacatttccccaaaagggtgatgtgacttcatggccactcttgaaagtggtaaactgcaaagcttctctttttatttgatgatttttattttcacataaaatataacattgatctctggcaagattatttttaaagtgtaaattagaaagtaaagaatctgtatctaaaaatattttcttgatgggataataagtttctgtgaatggccatgacaaggtactatgttttttgactcttttgtttaaatgtggcatatatacagaagattgcacacgtcgtatgtgtacagtttgataaatattcacaaagtaagcatacaactgtaactagcatccagatgtacaagcaggacattaccagcccgccaggatcccccctgctctctttccttccttcaaaggtaacctccagtctaacttctaacattataggctaattttccctggttttgagtatttacgtaagtggactcatttttagtgtcaagtcatacacatttagccaggatcaaattcattttaaaaaagaaaagaaggaagagggggagaaagagaagggaagaatggagaaaagaaaggaattactttactgccgattatttcttttagtaaattggatatgtttttatttaaattatatcctaatactaaaatgttttaacttccagaagacaattggaaaaactgatggcatgaatatttagatttacagaggccagcaaattaggcagagcatactaactaaagcaaaattttctcatattgataatgcttatctctcacgtattacatattgatactgtttatgaaagtgcagagagctgaccgtattgcattaccgtgtcatgaacaaggaaacaaagaatcaaaagtttgtattcctttcattttgctgcaaatttatgtaaacaaagtggctgcaagggaggataaaacagtataacaccttactatccatccgccgttctcaactatgtgcaagacagccctaatctggaattttgttttttaaaaaaagtccaccttaatcaatgtggataaatgccttaacgttcattcattgaaggacgatcctataatagcagagctgtactcagaagattttactctcactctatacacagtgctaacagatggtcattggctctctagcccacagtatataatgcccaaaaccagaaaagggatttctagagggaggcatcaggaagcaggaagaattcataggaaaggagcagacaagtaaaccgcagaaagcagatgagcagtcgagaatgcacaatctggctccagttcgtgttggggcagatagcgctgaccactccaaggtccctgaaagcttggcaggaagtcaggagaaattcttgctctccttaacaaagacagcaaggcatcaaggaaaagttcatttcagttcacttggctttcagagggcagggaattatgcaacccattttagaaaaagtctcatcaaaacagagtaagaaatagtcacaaagctttggtaatgttaaaaagggtaaattacttatctggaaaatgcatttggctggaacactttatctaagtccctggataaatgtgatgtgactgctacagcttttgtgcactgacttgctttcctccagtgattccccatagaaacaattatttcttacaagttatcttgtgccaccttcttttttccatcttatccttaattttcagataaaaagactaagttcttagaaacagtcagactgacttggaagtatcactcattttttttttttcctgtcttcccctcagatgatgaagtaataggagttagtgtcagtgttcgggaccgagaagacgtcgtccaagtctggaatgtaaatgcctctttagtgggtgaagcgactgttttagaaaagatctatgaacttctgccccacataacttttaaagcagtattttataaacgtaagtgcttcatttccagttattactttctagcttactctatcatacttttaaagatagaaactgttttgcaaatgtggtgaaggcagatttacttgaaatttgataattcagaaaataattcaacaaaatacatttaagttttttttttttttaaaaaaaacaagcttagtctcagaaattaaagtaagattttattcttgcctaactgcgtggatcagaaaacgaaataacaaatattgtatttgttatttcaaaaatttgtacctgaactcaaatttgtaattctcagaaaaaaaattacattctattggaaacaacaataacaaaaatgtcattatatgaactggcaggtagatattcaatcatcccttcataaacaggaatttataatgtataacatctgtatttgcagaagaaatgcattctgagcacaggcgtgattgaatgttctactgaaatgctaatacttcctcattatgaatgactatgacacagaactgagggagaattcacgcctagtggtgaaatgttaacagtatgaataggtgtgtggacccattgttttccatcatgattcattttcattgcttttgtgtgctcttttgaaaaagtcttctttttcataatgaaaacatcttagtgctattaaaccaatgtttggtagatcagactgcaggtcacacatttaacagagttagagaaaaggacgacagccctacacatgtatgataaatttcctatatccaaaactgttcctggagtcagtaacccattttttaactaccgtatttcattgaatctaagatgctcttgaagataaaatgctccattattttagtattactgaaaaagaaaaataaaaggctcccaattaaactgtaacacattattggtaccagaggtcttcaaatatatgtgtggtagttgtgaggagtgcgtcttagaattgctgaaatacatttcattattgcttcactttttccaactctttgccaaaaaaggataaaaaaatcaaattttgttttgtgagtatcctagtatgacaggggatattaacactaaggcctccctgtaaggaatcatataattacaggccaaatgacctagatgttaagcagtgggactgatctggcactacagatattctgaattttaaatggaagtttaaaagagacagaaaaatggcactgcagaagttgcttattggctgcgtggtgtagaagttgccaatttgccgatgccatttttattctttagggatactttaattgtattttcaccccagatattaattgaaaggtcatcaagggttttttctttttttttatttcacaagactagcagaaactctatagacggaagtgtatttcattggcatttatgtatggggctaaaacattttttcccacctttgaaccagctccacacttgactctaaagaggagaacaccaatttggggtcgttaagtcaggcactttaggtttttgtcccacttcaccagtgtgaccttgagcaagtcacaacttctcatcctttacctttctcatctgagtatcgaggaggttggtcttagatgatctccaaggttccttctactgcaaaattctatgattaagtttccaggtagcacattggttagcagcaggctcaacacagataataagatatctgttttatcagataataaggccacaaagtggttaggctagtttttagggccatggcaataatcagataagattgtcaaagggcaggatgattcactgcttagctgttgtgatggctctgggaaagaaaaaagccaaacaaggggaaagaaaactgcaacttggccagttaaatcaaatagatacctaaaggtaggggccattgcaaagtatgtaatacagaactgaggaagggtctcagcagaaattcatactttaagggcataaattggcatttaaaaactcaaagattgttcaaataaaaatctgaatttgaaaaaaaacaagcagttttctttattgtaaacaaagcaggcagtcctttactcagcagggtatacactacttgctgcagaagtaatttggaaaaataagatttgggctgaaatctttttcacagcagggtaagctaagttagaaatggccaatgtatgcttttactctggtttggttaataggatcctagtgtaagtattcccaagtttacataagccaggtgactgtagattttccatgtagaaagaacccaagcatattcagtcatggcctctagcgggtagatgggcattgggccattgataacttacatttgatatggatacacattatttgactgagaaactcacaatgcacagactccactcactgaccagccccaccctggccaattctgctaagttcttcagaacagctgagtgacaaaggtcttttctggtgtgagaattgtttacagcaggaagctggagcccaaatctgccctctgtgttaccctctccgctctcctgtttctgtataggtatagctgagaatgctttttacatttttcagtggttggaaaaaaaagaaaaagtatattttgtaacacatgaaaattatatgaatatcaaattttagtgtccataaataaagttttatcagcatagagcaatacccatttgtttccgtattacctatagctgctttagtgctacaatggcagagttagtaattgatacagaggtcaggcatggtggctcacgcctgtaatcccagcactttgggaggccgaggcaggcagatcatctgaggtcaggagttaaagaccagcctggccaacatggcgaaaccccatctctactaaaaatataaaaagctagccaggcgtggtggcaggtgcctataatcccagctacttgggagactgaggcaggagaattgtttgaacccaggaggtgaaggttgcagtgagccaggatcacaccattgcactctagcctgggcgacaagagaaaaactctgtctcaaaaacaacaacaacaaataataataattgggacagagaccatatggtcataaagacaaacatttattctcttccttttcctgaaaatgtttgccaactccaggcttagagcaattctataatccctttctacccaaggtaacctaaggctgacagtacacctgttcactaggcactcccaattctgaatgttctgttgtactgtctctttaacccatcaacattgtagtttgcaactatgaccaccccagactgcccctcacacctagaagtaacacagatctttggatagtctgtatatctggatttattgtttggaaaccaggtcactgtagttctatggtacctctacttgaccctgaagcatagtgtaatttccttgcagatcaaagcgtgttttcttcgatatcttccctaaatatctttcttaaaaagaaaacacacacacacacacacacacacacacacacacactcaatgtgaaatatttgcaaagttaaagctgtgagaaatgttctattaaattagttcagatttcaggctgcccttaggagtatggccaacctgaggtgacctgggaggtataaagtgcatctctcccagtgtttcatccaagtgcggagtaggttggggtgaacgtccaagatgatgttgaagggaaaataggcccgttccatccaccccctcagcaatagtctgaagaatttagtccttatgaaaaacacagaggccaggtacagtggttcatgcctgtaatcccagcactttgggagtctgaggccggtggatcgcttgagctcaggagttcgagaccagcctgggcaacatggcaaaaccctgtctctatcaatcaaaaagacaaaagttagccgggcatggtggcacatacctgtaatcccagctactcaggagactgaagtgagaggattgcttgagcccgggaagtcaaggctgcagtgagccgagtagcatgatgctactgcactccaacctgggtgacagagcagcaagacccagtcttaaaaaacaaaaagaaaaataaaacagaactggaaggggcttaaaaggtgaaatgggccagcccatctgcctccctagaaccccattcactgctaagtgtgggtagcgtgttggggatcaaagcacccagagtcctgaatcaccccacctttatcagacgttgcttcctggtaatggttaaccagatccgggaggtagattgtcacactcagtcttttgccttagagaaaatgttatgtatttcgtaggtctccctgtggcatcttctactttaaaaaacgttaagtgtttgaaaatatttttggtagcataatttttttaaattcctgagttccggctgggcctggtggctcacgcctataatcccactactttgggaggctgaggcaggtggttcacttgaggtcaggagttccagaccagcctgtccaacatggtgagacccccatctctaccaaaaatacaaaaattagctggacgtggtggcacacgcctgtatcccagctactccagaggctgaggctggagaattgcttgaacctgggaggcagaggaggttgcagtgagccaagattgcgccactgcactccagcctgggctacagagcaaaactacgtctcaaaaaaatatatatatattctagagttcctaattaaaattagtaattttgcaagccagatgataggtctgaatatctattggcagggggaaacttgatttggaaaaataaaacttagcaattttatgaaacttcatttcccatggagagtgttgagaggtagggagcaggggcacctagatataattgctgtcaccctggtgtggttctttgttttgttttatttttagtttatttttaaagataggcttgtaagcggctctgtcttgggttgtgtcaggcaccccctctccccaccccctgcaatgcattttgtggggcacattttcccctgcggcatttgcttgcagcccaacatactctcttcatcggcttgctgagatgactcatcctcccaggcacagcaagaagaaacaggcagcatgcccattgcttgtttattccttgttttaattttcattattacgtttctcaggaaatgcacgccttagctaacagttactggcaaaaaaataaataaataaataaggtgtttgagttcttgccaacatttggggaagctgaatgagatgcctagaggagggttggcccatcctttgcttaaagttttctttcctttttttcttttttgttttttttctgtcctttagcccatgaagagcatcatgcttttgaaggtggacgtggaaaacactaattgcactctgtaaagaattctttgtcctttgctgattggttttggaaacggtcttaacaggagggagagtgaagagaagacttgccgaagccgatgctggtcaatttagagtgggtttctgtccttgcagatgggcaattaggactcaaagtggcaggtggggtggggggagattgtgtgggtttctaccgtcacattacttgctttttaaaaaaaacacacacaaaaaactttttttttggctttctaaattctctgttcttttcactctgatttttttttttttttgccgtttaaaattccttattcagcctaattattgttttctacactcccctttcattgaggcacaagaaatgggtttccctttaagtagctctgctgtacctagttaatgagaatatgcataatcgtgacaatactgcttttgaataccacactgtacaaggaggaacactagcttggagaaatctgtcttctgattatttgttgtgacacattcctatgtactgtgagctgggcattgtttttttctgtcccagggaaaagaaaaaccatacttaatgtgattttgcactgacagcacacaaatctttaattttcctttttaaaacatttttttttagtgataaaaggaaaataatagttggattgcataacatgaaaactataatcacaattcagtatcaggatataaatcaagctctaagtctttggaccctctgtggaaacatttctaacccgaattttaatttggccttttcaaccaaaggcttagagtggtagcaagggatttcttccaataggaaacctgatgtttctgatttaaagagaaggtgatattttaattgtttgaattaagctccttgcaaagttcgggtgtgtttacccacttagggctttctttcccagtcaacgctaacacattttgttaaatgatccctttccctgctcacattgtgtgtcatttctcatcatcagtagtcctccagcctgggcagctgtccccaccctttttcatgtaggtgcaggaagttaaatctcatttccaggatgcatgtgaacatttacaaagttgaactttgagtgcattctgctcatatgaattattgggattgttgatatatattgtattatgctaccaaagaaatattggttttattagaaggaaatggtcatcctctggaccatggagactagctcagaatacgctgatttccctctcctgactttgccaagcctttggctgcttttgcctgataaagggcagggccatctgaagacacttcccccagtcggctttggagtcacgggagctagtgcctgctcacacatttttcaaaagggcagtgcactcagaacttcactgtacctgggatttttaattcctcttgcagtgttgaccagcagagagacttgaggctactttaagcctccactatgtgtttgtagataaaattctccattcaaacattttaaaggactttgaacattatctgcttatggaagttgtgcccttcacttggttagtaaccacctcagccataatacttaccatcataggtttcttaaaatgctttttttttttccctaaacttgagtttccttagtgatttcaaaatgaagtataagaatatcagatccagttagcaaaagcctaggacttgtttctccaaacattgtactaacattcaacttgttttaaaattatgactcaagaattttaaaaaattattctggacatgaattaaaacttttttataatataagtatttttctgattgaaaaaaggatataattgacttcactctaattgtcatgtatatttccataagtaaatggattttgaagtatttttattttttgaactttatttaaagcatttgtgatgacatgttcaacttttgcatgtatgtagcctttgaagtaaaaataaataggaatgttaggctcac

SEQ ID NO: 159 - DNA, 20304 bp, Homo sapiens
gggatctcggactccctggaccctccctccagcccagcctcgctagctccgcctgcggtacgtgctcccgcctccgactcaagtgagtaggggcggtggggcggttccgcggcgccgccaaccccggggcgggagttgcagggggtttccaccgcctcccggggtcgtgctgtcgcccggccggcgcgccccggtctcctccgacatccccatcccggtccgcatttgtgcccctgccagccttctcatccctgcgccccagattttctctctcttatcccccaaacacacctgcccttgtccccgaggccgtccaggccatgccctgggatcccaggcccgcggggcaggtaaataatcttatatgacctttaatttctccatactggtttctctgggagagaggcgggttgtgagtttcgcgtttctgctaatccgcctcttagcagccgtcggtcccctcgtccagcggcaggctctctctggggtgggggtcggagtctcagggccccctctgcccggagtgtggtgagcaccgagggcgaccttactgggttctgtcccctaggggtggaatggggcttctacatccccccgagcccagggtactgctcctgccgccgtaccgggctcctggcatccccattgtttggtggtgtctgcccacccagcaccgaacccctctatgttgaaggaacagcagggaatgtcaatcacttactcctagctttttccagaactttctacgattcaggtacaaagaagaatgcaagaatgcttggttgtgaaattatgcgacaggtcctgcgaatcacattctgggttctccagagccagattcaggagctccacgtaggcaccccctgggggcgggggcgggctttctaaaccggcggatccctttcccccttctaagccaggacatttgttaaacgatttttacttaaatggctacccaaaatgtttaacctgttttatttgcagtctgcaaaccaagcacattttccctttataaatgcttttcggtacagaattttttttggggggtgggggggtggggcgggggcagttagtaattttttaacccgggcagcgaaaatcgtcgtatttagttcttgacttttccaattaacctgttttaaaactctcctcataaaatgccaagaattcaaataggacagccacaaagttggctgtactttgactcacgtttttcaagaaagaattgggtgatagattttgaaagggagaatctaacatagtttcagaactgcatgccaagctacaaagaatgttgtgaagtactaagtggtctcccccagtactcctggggtcatcgctctcgtccattgtcactgatactttgtcagtatttctctgggtcctttctcctctgcattgtagttttctttgctcttttggttctgtgttacctttgagaccagacctgcatcacatgagtctttgaaactcacagtgcttgcttgggtaccttggacaattgactgaaagaaggagcgaataaggttgtgattatagggaacaaaaatataatttgactcacacaataggtatttgtttgcagatttgatctaaagttcgtatcataaatttttaatgcatttctccgaatgtatttaacaaatattgattgatactggtataggctaagtactgtgctgaaagcagtacttgctggaggcctgtcctgatgaaattgcaaaatcacttggatttgggggagattgaattttatcctaaaacagcaagaatgttggtgtagagtagaggacagcaataaatgaggagttttagaagcctgagtccagaggcaactctgacactaaattgctatagtgatctgggtctctaggttttcttctttgtcaaaagtgaggtgaatcaaatgaaccccaaaagggagccccctatgggagaggaggcatggctgaaagggggaggaacgaagccaggcaggaccaaattcacacctcaactccagtacccattggtttgatgcccttgggcaaattaactttactctttggcctcaatacttcatcatgtaaaatgggtgtagtggcacatgccttgcagggttgtcataaggcctgttgatacttgtacaaagcccagcccagcctgggagtagttccttgtaattagacaaagttgtgcacttggttgaatatatgtgggaaaaggctatcagtgaaagtctgtttcaggagagagctggctcacacctgaagagcgtttcctagaccttgcctggaggccagctttcttctctgtgcagatgttcacaggtttcctcaaggcaccttaccctgactgccagcatgccatcccttgggttctgttgggtggggatccccagacacctctggatctttgattacctaggtggggtttctgactttttatatcatggcactcctgtgaggcctccagaccccttctcaaaatgacgtaacataaagtatgtggtaccaagttccccaacccccagaattaaaaggaattgtggcctttgggttaagaatcctgaattaagggaatatttctcagtctggatagtggagaagctgggcacaatttcttttttttatattttttccttttcaaattcctttttaccacaggcacaatttctgattgttaaaaattttattgttgtaagtcacagaggaagaactaatagaagtacatggtgaatgatctggaaaggatatcaggttccttgtttttttgtttacaatcttattgtgccaacaatactattgtcttcgactaataagaacagacaccatgtaatacattagggccaaattacttcccagttcactataggaaagagggcttcatggtggtttcacagtacttccaaaagaaaataagcagagagaattgaatcctcatccagcacacggcagtgcaggaactactcagcttaagaagaacctatgccatagccatggaggtcggtactacatctgtattgctaccaggggtttagtttagcaaaacatcagtgaaataattttgaattggaattttattggtattcatttttaagttgaattgataattttattttggtttcacagttatgagtcatttaatagctctatgcctcagtttccccactcataaaatgagaatagtggtagtgcttactttagttgttatgaggattaaatgaggtaatataaacataagtaaagcatatattaagctttatagaagtatttgtaattattacctgtcatgtggcagacactattctaggtgttttgcatatattgtttaatctaaaaactgccttattgtataaataagcattgtccccatttttaaaatgagaaaactagcagatcaaatgaacaacctgtgatcatttggcaaataaacaagagtctcagcatatatatctaggtctgattccatgaaaaaatcgtgcaaatattaaattgtttgaataattaaataacttgtagttttgcacagattgtggattgctatggcagatgttggggatcagggttactgagcttatagcatagttgcattttaattacaatatgggatttggcagatagtgattcaaatctgtgtcgaattttgctgcactctaagttgaagacacgagtggtagcagaatacagaagtagtaagaatggtgaggctgaggtacacacaggagtgttcactagattagaagagagttttccttcagtggggttagatttaggttagcagagaggggtaataaaaagctttttggttgaaagtagcagtttgggtgtgagagtggtgcacagagaccacttactgaccgctagttggatggagaggaaggtgtgtaatttgtgtgtgtaatttggtaactcaaggattgagaattctcaggtcatttgaatagtctcaacccttaatgttctgtgcctgtcagatatgggagttttgaggaaagcttgtggttctggaatcaaaacatgagcctgatttgtttctttggagatctgtgacctcagcaagtcacccaactcatcagtccccatcctttttggcaccagggaccagttttgtggaagacagttttttcatggatggtgggtggatggttttggcatgaaattttgggatgaaactgttccatctcagatcaccaggcattagattctcgtaacgagtgggcacctagatccctcacctacacaattcacaatagcgttcccgctcctatgagaatctaatgcctctgccgatctgacaggaagcagagctcaggtggtaatgctcgcttaccctccactcacctcctgctgtgcagcctggttcctagcaggccacagaccagtagcaagtagcctgaacacaaaacacagccatcggtctgtggcctgggggttggaacccttgacctaacggactgaacttggtatattcaggccccgagtgctcctaaaggaaaaggaagcccgcccatttgtggagtacaggctctttgccaggtactttacaaactttatctcattaaatctttacaaccgcctataagatagttctcatccatttccaagttacctctgaggaagttaaggctcagaggttaaggaaatttggccaggatcacatagctgataactagctttgacaaccagcttgtgtctatctgattctaagctccgcactgtttcttttatatctggcatgtctaaaaggtggcatgtgtactgcggtatttccatggcaaaaataattaatcacagttctcttgattgtagaacctggactgaatttcagaatctttctcaacgtagttccaggaatccactctcagtggatctgcaagatgaaactgttttgtcatgcctgtgaaagtaaatggtgcagaccttcaaaagccctttttgcatgcctctgtgtcatttattatattgctattgtttgtccacatgtttttaccacctcagtagaactctgtgcaaaacgggcctttccttatgacccatttatcctcagccccctaacccagtacctggcttatgaaatactgttgaattaatacatttatatgagagcttcataaacagtaaagcattatgcagtgcttataagctgcctctaccctagaaaaattacttgagatacagaaatgaagttagctggatggaacggaggtaaggcagttgccttgatggggagggtttgggggataaggaaggaatagatatgtgagatggtagggcaagatgagtattgataacaaaggttagaacattgctaaatattgatactatcatttgagtccccactatgcaagcgttacctcatctataactctataaagatggtactgttcttaactctctaaaaaaggtactgttgccctaagtttacggatgagagaaatgacacttcgtggactccaaacgcgtgttcttactttgcccttatgctgaactgacttaaaggccaggttgaggatttggcttcagtaggaggagccaaatggagtacggagctgatcactaagacatgaagagttcatccttggttcagtggtattcacttccgtaagagaagtagactaagtgggtagttggggtaacagaagaaaaaatttgtagaacaggcatcaactgaaagcttaatttccaattaactacagctgtcaaatcctggtcttgctaaaaagtcatcgtaacgggacagtgctactaacttacattctttaacaagtgactccccctggatgtggctcaagatgagactgtattttataataaattctcctttaggggaaattggattatagtcaggttctagtgtaataacaaggccctacatgtagtaataaaatgtcaaagcttctggaggcatttagaatctgggcaaatatagaatatagactaattcaatccaaacttttagtttcagggcagataacttaaactttaaatggtaacatatagatttgaatttcatagattcaagtcattctgattctaaagtaagacagtaaatgcggcactaatggtatgagaatggcccaggtagtcagctcttgattatcatacggctctgatgagtgcaggaacacaagggttcttgatcctgccgccggtttagataaaacaacacggacacacgtggagtggttttaaggagcggagagtttaatgagcaagaaggaagggagaagacagaaggaagaagctccccggtacagagacacagggaggggggctccaaagcccaaagaggaggtccccacctgcaatggataccagcctggtatatatgcaaagactggaggaggcgatgtctgatttacatagggcttaggggattggtttgaccaggcatgtcattcacgtagcccaagaaaaagctggccctcacaccctagctttttagtatgcaaatgcagggcgccatgatgttccacacacgtggggatatgtggaggctgccctgtcaccaggcacaggtggggcatttgcatggcccacatggcctgcatttgcatatcaaaggttgctggcctggctctaagagccagggctttacaagaaacttttccagagatgctttaaaaaatgaaaacttcccaaggaccccttttcctctctatctgcctaaaataatttcgtaataactcctaccacagttatctagagagtgagctaactgtaccataagacgactcagacttagactatatcagtttttccgcatgggtgagtcttatgaattttggtggcatcttaggctaagaagaggtagcaaggagaaattgcacataggtgttcagatataaatcacgttgtaacatgtaatacagtggataaatcctagtgctggaactctttcagacactgaaaaacaaggaacaagactgagaaacagaatttgccctattttatcacatgtaaagtgggattttatttttgcttttaccattctgtaaattaatgcctaggatttgggaaaggcatgcagcccagattgcttagtgcaaatccagtttgctgtgattaatggcagctgtagtggagtagtacggccaaaggcttgtaagaaaaatgaagacttgcttttttttttttttatgcacagcaatgccaagagtgacagaaatggaagatcatcatacttcttccagccaaattcaggaaatgtccattagaggttcagcctaaaagtgcaaatttgaacttcgtttcttttcttttttttttttttttgagtcggagtcttgcagtttcacccaggcgggactgcagtggcactatctcggctcactgcaagctccacctcctgggttcacgccattctcctgcctcagcctcccgagtagctgggactacaggcacctgccaccgcgcccggctaagtatttttagtagagacggggtttcaccgtgttagccaggatggtcttgatctcctgacctcgtgatctgcccgccttggcctcccaaagtgctgggattacaggcgtgagccaccgcatccggcttgaactttgtttcttagacagtcaccaccatatgtggaactgttgctttactttggagtgcattttaatgtccccaaaaaagaaggtttatagtgaccaatcagctcagttttgtccttaccttgtttgttgctctgcagctatgttctaggtgctggttggtgggttttcctactagagtactgatagcaggctggatagagtgagatgtcccctctgtcttcaagctgacagctactggattcctgccaaggcatttgcttaccttatcttgccttcacaatatttctgtgggtagagagagctacctatccccatttttagcttgagaaaatgaagcccaaggttgcgcagctattataacggtggagttaatccaggtgtgtttaaaccagtcaatcaacttcctctccctccttccattatgaaatagttcagacatacaaagtagagaacaatataaggaatattcaactatcaccatccactttttttttttttttttttttttttgagacagggtcatcttgctctgttgcccaggctggagtgcagtggtgcaatcatagctcactgtagccttgacattcccagcacaagcaatcctcccacttcagcctcccaagtagctgggaccagaggtgtgtgccaccatgcctggctaatttctttttaaatttgttttaaatataggtaatatagcgtctccctaaattccaaattccaaagtgttgggattacaggcatgagctaccacacctggctccctaaccatcttaaaaaaaaaaaaatgtaaatccaactgaagctttctgacaatgttcttttgttacatcatttccctctatcacagaaaaggttattcagaaatccttaggaaagcccttaagctggatagaactgcaatattttgatatatgcaaatactctgatagatggtgtggagaatacagagatgtggtccccaccatcaagggaccagaaacttattgcacagtaagttgaatgttgtggaactttgataggtatttcctgaaaagctgacacatttacgtttggctggtgcagttaacttagaataagtaagtttaaagaaaccctgaattacataaagaaagggaagatattccttctttcttaaaaatccaggctgttcttcaatggtatggaagagaataacaaggttattagttgggttttccttttaatgtatttttaagtgttattcaaagacagcctagtctagcctcagtcgtgatagcaatctggctccttactggtgattgctccaaagtaaatatgtgtgaaaatgaaaaataccaagttggtattaacagttcactttctaatatgagaaatgtttcaatgatagaaatgcctcgacaacaacaaagtattttaagaaccagttgataacttgggatccaatataagtaattgtagtgtcattacctggaggcctggatttggcctttggttctgcaggaatcatgagggaacttccagcagatgtctgttgcatccatgagcattcagaatacaggtagctttggaggcaaggggcaaggtcagtttctctaactgtactacaaacacgggtcagtgcaggctgttggagccaaggctttatgtcttaggttttaccgccaggcttatgtttcactctggatttcaacaatggagtgcctgtctccagggaggagaataaaagatttatgcagctacaaaaggaaagcttgtaaacatgtcctattgtcgcaagatactgatcctatatggatgccttcacggtaagcctggtaacatttgtggacccttggaatgactttgttcctgtctggttaagagaagttggctttttgcaaattcagacttacattttagtgataacaagccataccagtcaggggtgtgtgtgtgtgtgtgtgtgtgtgtgtgtgtgtgtgtgtgtgtgtgtgttgtttgttttaaggaacaggagctccaattccaaatgacttaagaagggaatttattggctcataactgaggcatgcaggataagataaggcacagttgattggccgtgactgagtcacatgcccagccttggagttgggggttgctatggtttgagtgtttttgtcccctctgagaatcatgttaaaacttaattcccaatgcaacaacgttgggagttgggcctaatgggagatgtttaggtcatgagggatccactctcttgaatggattagtaccaccataaaaaggcctggtgggagcgggttcaccctcctctgctcttctgccatgtaaggtacagtgttcctggcctccagaggatgctgcattggaggcaccattttgcagcagagatggggcccttagcagacactaaacctgccataccttgatcttggacttcccagccttcaaatatttatattctcagtctgttctttataaattacctagtctctggtatactgttatagcaacacgaaacagactaagataggggtagagtcagtaccatctaaaaccagtgcttttcttttttttttttttttttcttttgaggcggagtctcgctctgtcgcccaggctggcgtgcagtggcacaatctcggctcactgcaagctccgcctcccgggttcacgctattctcctgcctcagcctcctgagtagctgggactacaggcccccaccaccgtgcccggctaattttttgtatttttagtagagacggggtttcaccgtggtctcaatctcctgacctcatgatccgcctgcctcggcctcccaaagtgctgggatcacaggcttgagccaccgcacctggccaaaccagtgcttttcaaatcatctatggtaaatgtattagtctgttgtcacgctgctaataaagacatacctgagactgggtaatttataaaggaaagaggtttaattgactcacagttccacatgattggggagacctcacaattatggcagaaggtgaatgagaagcaaagtcacatctcacatggcagcaggcaagagagcttgtgcaggggaactcccctttataaaaccatcagatcttgtgagacttattcactatcatgagaccagcacgcgaaagactcgccccaggattcagttacctcccaccctgtccgtcccacaacacatgggaattatgggagctacaattcaagatgagatttcggtggggacacagccaaaccatatcagtaaaggactgttatttttaatttccaagtacagactgatgactctgttcaacaggatgagttcactgatcttctcttagtttttgtggcataaaagtttctaaatgcttacctgaagtttgtctcaaattggtaacaagaatagtggcccatccatcaccaggagaccacattttaataagcacttctctaaaccacatggtctaagaaagagatggctgctttcccggaagacagtctagggaaggtaccaccagaagagaggcaagagaatactgagtgctggaaagttccccaccgcaatgatcaactccattaatctttcttttggagaggcctcatctttgtgttcaggaaattgtcaggttctggatcaccttaatggggtaagatgagaatttcccacatcccttttgattttaaggattggagactctttaatcttttctacttagtagcactctgtttcccttctctttctagccaggtttgggttagtaagaggcctcggccttattagccacctatttcctagagaggcaagcagtctatctaaggagacctaacaggcaagggctgcaaatgccactctacagaaggaagctcaaaaaagatgatggggaaaggggaatcaatcgcttgtgtttttagataccactcagggcagggcagacataacatgtcttcttagcagaacaactttctgtactggttaaggcatctgaggaagctggccattcagaaccaggcttttttcttttcgtcagagtctcgctctgtcgcccaggctggagtgcagtggtacaatcttcgctcagtgcaacctccgcttcctggttcaagcaattctcctgcctcagcctcccaagtagctgggattgcaggcatctgccaccacacccggctaatcttttttttttttttttttttttttttaaatttagcagagacggggtttcgctatgttggtcaggctggtctcaaactcctgacctcaggtgatccacccacctcggcctccgaaagtgctgggattacaggcgtgagccaccatgcccagccagaaccaggcattttaaagtggtcgaggcagactaatttgttgagaagggagacgagaaaatgttggccctacatgacagtgagacaccctaggatctgtacttccagcttgccctttacagcaggccatactattcagaggctattcctgcatgctcagcaaacagttcaactggtaggaagggaacttgtagcagattctgtatggcctgactgacttgccaaagaggaaaacccaactgctggctgcactagtgggccttggggttagtgaagcatagaaacttaagccggagccatctggatgggcgtttgttgtggttacggcaaaagttccgtgcatgcagttgtacgagtcacagacacagctatttatgctacaatcgtgtaatttcagcaaacaaatataaaacttgttcttgcagggcaacacactttgttccctagaaagcgtgttatagcttatatatgttaaacgttaagaatttagtgttgttacaattaattaaacatgtaatgaaaacctccacccaagggtaagatcttcagctgagttcaaaaaaatatgtttattaaaaatgggcatattagggagggggacaaggcttgcctttcccctccccacgcttctttcttaactcctgtggattctaatggcatagcttgttttgtgcctggtgacctgtactattgtactgaatgcaggtcctttgtctggcaggaaaaaaaaaaaatcttgtgcacgacaagccagtttcctaatgaaagagttgttatttgggagaggagatgaggttattttggaggaacgcaggcctttgaaagatgtggttagagaggttcataaagaaacgaaaatctgcagctgtccctgggcttaaatagccctctagggagccgtacgaccagcacagggacattctaatgaatcctttattccttcagaatgcctgtctggggaggtggaaacaagtgtggggcctgtgggaggaccgtgtaccacgcagaagaggtgcagtgtgatggcaggagcttccaccgctgctgctttctctgcagtaagtagctctccatgctccacctttgacggaatttgtatgtacagagcttcaatatgtctatttaaggaaaaattgtggttttgccaacaaagatcattttgaaagcacgaatggtttttacctgtcttcttagatgttgtaaatgccaagcctagcagcgaagacaggaggggtggcccaagacacccagcctccctttgtgtccccatagcttttggcctccattttggcctttattttgttaacacatctgcctcccccacctcactgagtgctgggtgtcacttatgtggtctggcacctagcacagtttctggcacattacaagggcttagctcccatttttgagtaaatgattgctcctcatccaccccagctttctctttctcaggttccctttaatgacaacaaagtcttcggttttaaaactgtagagtagcaacttaaagcacttcattaatcatcttctgatttaatgacagaattttctttaatgaatgattatgtcaggtaaacccacccatacgggcagatgtttgccttatcaatagtattgtacagggaaaattcctacagaaaaccataggttaaaaataggttacattgagaaataatcttcaggaaaagacttctttctcaaatttgaattgtccttttccctcattggagccagcattcaaggtatctggacctctttaatagcataactaaactgctttgcagacaaccagaagcagacaacagaaagttgcagttacaaaaaaataaaaatactacataggaatgttcactatgtatgccttcctcagaagacttggtttaaccattgcttttagaagttacttttttaaaaaaggaatctatttttcagcaggcttgtaaccaagaaagtatggaaacagaatgcaaatactttagaaattgctctcagtttcatctgtctaggttaagccacaatgtctacaccatagtaacatatgcgtgtatgctgttgacatttgttttactaaatgtcaagttctctactggtcatttctacgaatcctttctaatatctgtctctgctgactaatgccttttaaggaaataattcagagtagtttgcagacctatgagaattttactgcagagaacagcatgaggactggggaagaaaggggtggttatatagtaacactttcatatacctacacttgttttggttcatacaggtttttcaaaacagtatttacatttattctctctgttaagggtagttgtccttcagcagtgcatggtgttaggttaactatggtttaagatatagttatctttaggcacatgtatttcagcacttgagcctcaacagttagattccagagtagatgccatttcattctaccatagaagactttagtttaagataatagactaaattttaaaccagccagctagtcctgcttccctcccctcctctttgctgtccttccttttgtcctccttcctttttattcaacccccccccttttatttttcttacttttaatttttatgggtacatagtaggtatatatatttatggggtacatgagatgttttgctacaggcatacaatgtatgttaatcacatcatcttaaatggggtatccattacctcaagcatttattatttttttgttaccaacattccagttaatactgtcttatttttaaatgtacaatgattgttgacagtaatcatcctgttgtgctatcaaatactagatcttattcattctaactatatttttacacccattaactctcctcacttccttcccgacaccctacccttccgagcttctggtaaccatcattctactctgaatcatcatacaattgtcttttaaataaggggaagaaattctgatctttgatttccagctgccagattgtgctaccagtgagtttcctcacaatttacttttttctcaagcttaattgaagttttagaaaatgaaataatgtctggatgaaactcgatgacatttggcagttttatgaagtgggacacgtggaaatgtcctgtggcaagagatccatcaagaaagaatgcattctcctttgggacagaagggaaaacaaatgcagactttaaagcacttgacgattttcaggcagactcatcactgctggagaagctgctggggagaggaaagtgtgatacttcccagtctagactagtgatgaaaactagaattcaggatttaaaactattattatcccaggaggtgcttttgggggaggaaaggctacagaggcaagtccccgaaggcactgagcttcccttctgttctgtattaggttgtgatttaacagtacttggttaagagaaggctgaaaagattaagagtgttgagggttgggagcaaggtggtgttttattccttttgtttaagcatttttatagccacctttgaaacttttctcccttaatatgatctcccagaaagggaaatcatagtaagagtttgatcagcaccacaggaaagggaataaaaaataaacgaaacaaactaaaaataaagcttgaggcttctggatgttatattctgatacatttctgaagcaactgtcatatccatggaggaatgtaaataatcctcgaatgtagctggccagtccagatgctgtctcatggcttttgggaagccacaggataaaccaggaatgtgagggagcctcagccttcaccatttgtaggccatgtgtctgtgccaccattgttctaaggaaaaaggcatctttggaacatgtgtaaagtctaactttttcccctgcagtggtttgcaggaaaaatttagatagcacaacagtggcaattcacgatgaagagatctactgcaaatcctgctacggaaagaagtatgggccaaaaggctacggttatggccagggcgctggcacgcttaacatggaccgtggcgagaggctgggcatcaaaccagagaggtgagttgggagaccgttggttaccttcagaaatgagttgcgacagttagtgccgcttgctgaacaggaacctggcagtctccagatttttagttgaaactaagcaaataaaatgggactctgattttctaatgtcaactagttcaaaatattgagttttggacctaacaaagttcttattaataattccagtgatttctacttctggctttatagcattccaagctgtatcaaggagtcgtgttctcaaaagcaagtgatttgtatttacttcaatttcacagcaccttggagaccggatgtcatgaaattaaatggtagagaaatgtgctgtgtgaatcatgagaggtgtttctcatgtgcaatgtaagcagccaatgaaaattcctaagtcactccttctatgtaaacatttttcatcaagaaatcacttttctctaacttaaaattttttacttaaaaatggaaattacttcttatttttgattctttgagagagtagtgttaaactttaaaggctttgttgccaacgtatcaaggtgctaaatttgtgaaagttcacttagtatttcatattcaggttaaataacttatttgtttagaattccccccacacacttttttttttcttttttgtcacagaatctcactctgtcacccaagctggagtgcactggcacaatctcggctcactgcaacctctgcctcccaggttcaagtgattctcttgtctcagcctcctgagtagctgggattacaggcgtgcaccaccacaccgggctaatttttgtatttttggtagaggcggggtctcaccatattggccaggctggtcctgaactcctggcctcaagtgatctacttatctcggcctcccaaagtgcatggaataacaggcatgagccaccgtgcccaacctggaatttcctcctaactcctacttttaacccagtgattccactatttgaacttcacattttcacatccattttatattgagaagtccaaaattggtgtaatagtccaacaaaatggcctttggacaagaccataaaccatgccagccaccgtgcagcattagcatatgttaactcgtgtaatcctcacaacagtcctacaacatagggcttcctctctttcttcagaacagatgaagacaagaaaaattaagtaaaaactttgcccaaagtcacactgttagttaattgtagagcctggaacttaacctagtctaactccaaaccttatgacctgaatgaaacgtggtgcttggcttggctaaaataataattaccatgtattgagtccctgttgtctgttgaacatttatcttcattctgtataatccttagagtaactctgaggtatactttgtccatttatagatgacgacactaagagtcgggtcacacaaataagtgagggagccaggatttgaatcaatgtccatttggttccaaaatctgttctcttcctactgcagtatgtactacattgaggctcacctctgtgttctttgagcttcttccaccctcagagtttctgggccatgatgcccagcttacctttttatctttgttaaaatttattttacttgttctgctctccttttccatcttgttacatctatttttgtgttttaaaggttttgttgaaaacctttcaaaatccatatcccctcactcaacctgcatctccctcaatccaaaccagatttatccatgaccccaaaagtaagtcagtgactatggccatagttttaaagcacaaagaccagtgaaccctcctttttttaaaaaaaaaaaaaaatatatatatatatatatagacagggtcttgctatgttgcctaggctggcctcgaactcctgagttcaagttatccttccacattggcctcccaaagtgctaggaagacattgtttttccagtaggaaaaattaacagttgtggagtgctatcattttatctgctcagctaatttataaggttctaagagggcttaaaaaaaaaaaagtcttctcaaagcccgagaatgttctgcacatactaggtacaccttactgaatggaaacagttcctactgatagcaagaaatatggtttactcagtgatctgtaaatagtgacaaaaataccacccttaccagagaaaaatgaaagataaacagattgcatagtaataatcaaaatttataaaatatttttccatgaagaaagttggctattcacactttcctttattcaagatatactgggagactaagtaatctataaaacatgcttaaatttcttagttacagaccaaagttaacttacctatttgtggaatttttaaactacttaatagtggtttttccgactcctgtgaagtaaaaagctaggtatgattccagtgatattattctggagtaaaaatatatgctctggtaagtttttataaaccgtaacataattgcttagtggagaggccaacactgaggagtaaatgaattctgtttagactcagagggacagatctttacgtttgggtccctatctggttttttgaaataataatgagcccatagataggttcaagtagtaactctggctggcacctgagtcacttcttctttattccctcccctgtgctggcctgcaaaggcttccagctttgaggcagtgtagcggttaagtcccagagttctattgttcctgccttgtgtacttaaaagggccctgtggaaactcttgcctactttttttttcctcttttcacaagtgttcagcctcacaggcctacaacaaatccaaacacttctaaatttgctcagaaatatggaggtgctgagaagtgttccagatgtggggattctgtatatgctgccgagaagataattggagctggaaaggtaaagtgctatttggaattaataacagcaaatgacttctctctgctccctttctcccctaacccttccacattccttgcttgggtgatgtcttacaaatcactgtcttatatgaaacttttctttaaatgcatttccatcagaatcattaacttttttgaagtgattcccttatttgacaagtcatttttctgtttaaaagaacttgttttcatagggggcactcctgaaggttaaactttaaaaggccagactgtaagggaatctccaggttattcagtatagtgaaaaaagcaggaatccgagtcaggacacctgatgcgaattcagtgtgtggatttggaaaagttaccagctaacctctttgagctgcgctgttcttggccagaaaaaagatggtctctttaaaggagcagactgggcttgtggttaggactgaggctgctcttagggaaacagcctttctgtgggtgatcaagagtgcagatactgaggactggtttcagccttctcattggagctgaaccacagaagtcaggagcttgctttgagatgatcatcctgagccacttcttgccatacatctaaattgaactgtaggaaacaggcctctcaaacatgctgacacattcatctcttccagccctggcacaaaaactgtttccgatgtgcaaagtgtgggaagagtcttgaatcaacaactctgactgaaaaagaaggtgaaatctattgtaaaggtaaaattcatttcagttactgctgtccatatgaatattccacactggttcttgtttaatgaaatgtcactggcattaaaaaaaaaaaaagaaaagtatgccactattttctgaaaataaaatatcccaagatgcttatagatgacagagaaccacagttaagttcctgatcatttaaaactccccaccagataaaaacaccacaaatagccatcttttgccttcatgtcttgagcaaagcgtaagtatatggaagaaaacagacaaatacataccttacctggcctgactcatgcttgcaactcagcaggaccacgctgaacactatagggccagaatgtgtggacttgtctttgcagctttaagatatttagtacatgacacatttaacatcttaaataagttgagctcttttacacagcagtttaatttatgggggtttgttgagtgggtcttaagcagtgctagcaaagcttaatggacttgcactaactatccttcctccctttcctttgtaggatgctatgcaaagaactttgggcccaagggatttggctatggccaaggagcaggggctcttgttcatgcccagtaagatgtaaaccctgaactaaacatcacacactgagaatctcttcataatctaggcacagataatctttaacactaaactactgtgaaattctaccagcattaagtactgtatatcgccctgtacttggataggctggctaactcgtaggaagagagcactgtatggtatccttttgctttattcaccagcattttgggggaacatttcttttacattttaaataaaacttcagcttg

SEQ ID NO: 160 - DNA, 71470 bp, Homo sapiens
gaagccagttgagggaagttctccatgaatgtacgtcacaatgatgatgaccgaccaaatccctctggaactgccaccattgctgaacggagaggtagccatgatgccccacttggtgaatggagatgcagctcagcaggttggtgtaggaagagggaaatttaagtcaaattgtctaagtgggaaacagtaacacagtatttgatttattttgggattcaaaggtttgtgatttcaaaccttagcatttctagaggtaagtgtttttgttgtagaaatactgtatcgttttttaaaatgtgattttagagaacaaaatcttccctcattcagtttgtattcttgaagtattgaaaaatggatgacttctgaagtgagtcattttcagactgcataaaagtcttcgaaataaaatgactgtttattcatgctgtattgtgcttgactagtttgcttggttggccagagctgcatgctcagagggtcaggttttggcttcacacaggagtgatctcgacaagacacgtagggcagtgtgaacccacccttgctcctggaatagtccttccaaatgtgtagctcataaaatcacggtacttattttctctgaatctcctttgtcactagtcactgaacattgtggaatagagttatttgtgaactcagtcaagtagcacttgggggaaacaatttagacagtaagtgaaactttaacaaattattagggattgaactattatctctaacattaattaaaaatttttattgcaacagttgggcttgcacagttttacaactagatattttatctttgtacatccttcagaagcataaaagcgaatttttattttgtgaaaagtagaattgggagcaattgcttggaaaatacccaaaatatactaataattcaaataagttaatcatttatttgatgtcagtacatgccccctgctctaatctatcatacagtatatccaacctctgtctatcgtagtatattctttgcatatacttggttggagctgaccttgctgcttaataatttatattattttctcctgcattgtactatcaacctcttaagaacaaaaaatatataataggtgctcagtaaatgtttgttagttgaatgcatttcatgtcttctcaccactgatgcagataactcccttcctgattcctcagtctcttcctctgctggattacttccaccaacatacagtagtatcttttatcttaaaaacgtaaacacctgcacctctccccacccaataaaacaaaacctcctcagttgattccacatccccttccagttgctaccttctgtccctttttccctctttggcagtatttctccacttcctctccttccttaccgcccactttacagtcttcactctgtgttctcatcttcctcttcagtctttagcatgttctgttggctttatctcaggagtgtgtgctgaatccatactctgccgtatccacttcacttccactaccactgctggaccccgtgccgtcatctcactagggtaggacaggacaacccttctcgctggtctctctgctttcccttttgccccaccagaaagcagtctccacatagatcctgaggggtcttttccaaataaaaactttctgatgtcattggcctacctcaggccacgttcttacacctggagtgaaatccagtcatgctgcctggctgccagccttccgtgttagtgctggcctctctctctgtcattctctgcctgctcttctgctcactgtgctcaagtagttcatgggaaggttgcagagtgttgtggatggtttcaagatgcagtgtttggtctcccaattaaaagaattactaatacaaagaaaaaaaaaagacaaggtatttagtcaaatgtgagtaaacttggaaaatgacttaggtctctcagatgtggtcacctcattcccatttgcctgtgtagccaagagacctgaggccacccatccatgttgttgtacaccatgtttatgttttgttgatttctcccacatgtctgtaattcagcttgcccagcaggctacgtggcatttccctaccttgcatatcttacctcaactctaagcagaagctgcttaacaattttggttaataaaaccatattttcaaagctggatgaggtggtgcatgcctgtaatcctagctactcaggaggctgaagtaggagaatcccttgagcccaggagtttgagaccagcctgggcaacaaagtgagaccccatctctaaaaagaaaacaaaaacaaaaacccgcatttttattaaatctttttttaatcttattaaagctttctctaaagctaataagaagaatctgttaatgtatctgttttataaatagtcaaaatactcaagctttatgaaaaagtgggggtacacttaaaaaatctcacaagaaggaactgttttgtctttttaattagtaaatatgtttgtgttagaagcattaacatccttggttccaagctattacttggcattaactctaacttttccttaatgggcaaaattgttaagtgggtaaagtgtgttagaaatgtccctctcagcaggaccagcccaagatttaccatgctttgtcattgcctctacatcactggggctcagcctaggcagtggcctctgtgcttgacatttttcttcctcattctgctcccagagtctccatcctgtgtctcctcattctttcaagcctcagttctttcctttgggttctaacatttagcattggcctaggtgtgcgtggtagaggcttggggcctgtgggttgaacccaggtgaaggcacaaggggaagacagagtgaaggagaaggaaaaccaaaagtggcagagaaacacaagaggatgtagggaaaggggagagatagagggccattcaaaagaagaaagaacaaaggtgagtctccaagacaggatcccagagtgtggggctgcatgagttttgaatgcttgctttgggcacctgctgatgtttgctgcctgcccttaagagcctgcgtaatgtggtgctcaggtggttccatgttaaaggatcaggctacagcagacataccagagaaagtgatctatatgaatgttttctgaggcttttactgtgctttctcactgaagcaacaccttttcatcttaataagaaccttttgcaggcacaggattgactctaggggtggacattgcaggcactgtacaacagaccctcggcggtggcatcctaaggtatgtggcacctcagccacctctcacatcatacagttgttaagagccatcccctggccataggattctgcctctgaatatctgttaggagtgtgtatggtgaagcttaccttgtatgtatttacagcgttcttaatactttgcagctgtgcaaaggacattctaaacatttctatatatgcaaaagaactaccacagttatgagaaagctctgcagttcccacagccctcctccttctgatttctgttctgctggttctggatgtaattaggactagttcttggcaggattctctgttgcgttctggctctctaaataagacacactgttaattttcattatttgaagtcaaattaagtttgaaaccttggcttgtcattttgcgcaggtaggagggaaagggcaagagtgaaaaggatgattattttcttaaaaagaaaagtcatcctcattacgaatgaagcttttaaaagcattatcaactaaaaataaataacaagaaacaatgtgaacagaagcagcttacacagttttccttatttaacagctttactgaggtataattcacatgtcataccattcacccactgaaagtatacaatcattggaatctggtatattcacagaattgtacaaccttaactacaattaattttagaacatttttatcactctaaaaagaaccctagagggatcactccctatttcctgtttctctctcccttccccccgtcctaggtaaccactaattcacttattttctgtctctgtaggtagatattgcctattctggaatttcatataaataaaattacataacatttggtcttttgtgtctggcatctttcacccaacatctttgttttttttttgagatggagtctcgctctgttgcccaggctggagtgcaatggcacgatctctgctcactgcaacatccaccttccgggttcaagcaattctcctgcctcagccttccgagtagctgggattacaggcatatgccaccacgcctggctaatttttgtatttttagtagagatggcatttcaccatgttggccaggatggtcttgaactcctgacctcaagtgatctgcccgccttggcctcccagagtgctgggattacatgtgtgagccaccacgcccggttcactcaacacatttctaaggttcattcatattgcagcatgtgtcagtactgtattccttttttattgccaaatattttactgcatggatctaccacattttattaatccactcatgatctgatagacatctgagttattttcactttttggctgttatgaataatgctgctatgcacagattcttgtgtggacatgttttttatttctcttgtatatataaccgtatatataaccaaaagtgaaattgagtagctttattttgaagtattattttccaaataaagttatctctgctttgtatcaccattaatttctcccacctctgaataactacagcctagcttagctaaataaagtttgcttcccttaatatgcctaattgtatactattgttgagttataaaaatcaggtttcaacctgagtttttaatgtgtggctattataaatgatgatgaatgcccttcaataatcagaaaattgatgcctttgttgacattttcagaagcttgtggtatattaacttacctgtgtttgttatggacttctgcattttagcgattttaaaatgtagcagccagttttgcgcacaaaagaataaacatcagcccaaattctgactttttattgatttaatattttaataatttctgaagaattatagcagctaccagttaaaccattagattaaaaacagaagtgtcgacatagggtggcagagtttactgatttgttaatttaacgtgatacttataagggtatctgtgacctgcatgagagtagtgtgccactttatattatattcttagtgactttgcttaaatatgtattcactgagggtcaattcctagtggaactggattggattagatacctctttgacctgactagcatttagcatatggaggacatcgagtaaatgatttgtcatactattcttcttctctcttgcctcttttaattcttctattcttctagaatattgctgagtgtttttaatgcttcttcttcagaaagtagaactccttaaacatatacagaaaactcgcttctcctgctagctcaggataatttatcatctacttgccctggaaggcagaaggcaattgcctcaatcatgtccaattctcttgactttgcctattcctgttgatcagcacttagcatgtcatttcatggagagagtttttttccctcttttgtttcttcttttgaaagcccttgtttcctctaggcagaatatgtaaccagagttttttcctggagtgttcttttgaatacacatttccagacagtatgttcaacatattaaagctttccaccctcagatggtgctcatcatcagcatgtcttttccatcaaatgtgcccctcctcctaatccagtgaccttttctgttctggttgatatcttcttaataactttcttcttgatggcttccgtcttgcattcagtagttcaaatcctgtcacctcacaggtttactccttaaatatactgatagccacggtgtcgggggacccgtgaagagttttgcttacataacagagtttgtctactcctcagaaatcccaacagaaaggaagttttgtaatcagtatattgtagaaaaatgaataaacaactcttgagacgattacccaggagaaagaaggatattcagatgagaatgggagtgacagttaaaaaagagactgcagctattattgctaaataacattatagaagagctccttttgtggcagaatcctgttatgggctgggacttgagctagaaagtagaaagaggctggtcatatgttgggtatggaaaaccaagtatggggaagctcggtcttggatcacattcttcagcatcaagatgcgtgagaaatgcacaacctgtgcaaatacttaaatgaaattattattgctgactgccgttcatgcttcctctaccactcaaatttataaagccctctggagtcaagataccgtcagcctctctcctttgaaatttggggtggaaaagaatgagaggataggctggcatgttggctcatgcctgtaatcccagcactttgggaggctgaggcgggcggatcacgaggtcaggagatcaagaccatcctgactaacatggtgaaaccccgtctctactaaaaatacaaaaaaaattagccaggcgtggtggtgggcgcctgtagtcccagctacttgggaggctgagacaggagaatggcgtgaacctgggaggcggagcttgcagtgagccgacattgaaccactgcactccagcctgggtgacacagtgagactctgccttaaaaaaaaaaaaaaaaaaaaaaagaatgagaggataggatttatgactaaatttaggagtgactgaataatagatttgttcattttaataagtatttatcaaatgtcttatatgctggcagtgtattaggtgctggtgacagaaagatgaataaggcactgttcttgccctaaaggaatgagcagtctagttgaggagcaaaatgtggcctaccaaaaaaaaaaaaaaaggctgtatttacacatacgtgaaatcacaggagagtgcttggattgcagagtgtcacagtgcttaggagttcagaggaggaattgaggattgggataagtgggcaggaaaacagaccaggctaggaaaagtatctgtggggaggctgagcctgggtcagatcagatctaagatgaagtgaaggctagaactatccagactttgtacatcaagtaatccgtttctgttttattaaaggagaatacattatagggattacatatgcagtggagagctattaggggcactacaaacaaaccttatctgcatagtcggtgatctctttgcttgaacttctgctacttagtgtctttgttagtgaatgtatttgtcctctgattctccagtccgaaggtccacccgtccgcttgatgcctgttgctcagaattactgactccacagtggggcagatcacaagcaccccccacaaccagatccacttttccagctgcggaggcagcaacccttgctttgagggcctccttttaactataaaaaaaaggtgtgattttatccagatctgtggtctgacttttcagatctctctgagttagttttgccaattttgctcactacaaaagcttccaaaaaggcatagcctatgcagaatctcagtcttacaaaggaaaatgttgatgccatgttatcagagggtgttgttatatgtggcacccccaataattagaacataggacatataattatggcagctctgagctgtctgggttgagagacacttcagaatttaattagccaaaggcaataataataagatataagatgtagtcagtatccttcaaatgctagaaattgagctgcccttaaaacaggaaggattaaggtaaaatactggcatggtagcattgcactgcagaataatggcaattttaaaatctaaggtgattttaacattatgattgttttcaaattattgcaatttttggctgtctgatttccttgttaactcagggtgggtagggactgtccctctcttgttcatgctgtgcctggcatctgaagtaacattcagtaaatctttttgaatggatgaaggatgaaggcaatgaacagatttaattcatctatatcagggcttgaaaagtagcttattgcctttgtcatacaggcatgggggggggtgtgtgtgttgtttttgtttttgtttttttacctttagtttaaaagaaaaagatttcagtaccaatattaaaaatgggaagatttatataaaactctggatttttctgtttaattggaaaaaccagaagacatacgcctgtaatcccagcacttttgggaggccgaggcgggtggatcacctgaggtctagagttcaagaccagcctgaccaacacggtgaaaccccgtctctaccaaattgccgggcgtgatgctgcatgcctgtagtcccagctactcaggaggctgaggcaggagaatcgcttgaacccaggaggcggaggttgcagtgagccgagattgcgccattgcactccagcctgggcaacaagagcaaaactctgtctcaaaaaaaaaacaacaacaacaacccagaagatatgttaacactgggctggtccttcctacttggcaacaattggcacagaagttgcagccatttgctgttgatgcggaatgtcctcttcggtgcctactctgtccacttcacttagtttccgagcctgcctgaactctgtggtcatccgggtttggaatctggaaattgttaactttttaaactttaaattgcatcttgtgctcatgcatatcatattttaaatacagaaaaatgattaaaattttttcaggcatgtgcattgtgtatcaaactgataatgtgttttaaaatcttttagttatctacttgccccatgacttgtaaaatgaattaggctgggcgctggttcatgttgctttgtagaaggatttcaactttacctcttacatgttaggacccgtgtgggtttttttgttttgttttgttttttggcttttagtttttaggatttgaggcccccaataagtgccgcatggaacattcactaaagcatagacaggccaaaagaaacaatcctattccttagttttactgtttacagtctagttaggagacattaaacacagatgcaaggtaaaagcagtccaagcgcagagatgcaaatacttgtgtttatattcttttttacagtttccaagaattgagtctttaagtatttattgaaagagttgtttttaagggtaaacttttcctggtattacctagatgaggaatttttatttaaagcatttatgtatgtatgtatgtaagtatttaagacagggtctccttatgttgcccaggctggtcttgaactcctgggctcagaggatcctcctgccatggcttccaaaagtgctgggattacaggtgtgagccactatgcccggccataaagcatttccatattaacttttaaagacataagattaaattggatagatttccaaactctgatttctccttttcttgttttgaaaatgtgtatttgtcatgttgaatgtgatgtgatagctactgatgtatctcatagtacagtaaaagtagtctataaacacaggaagaaaagatgagacacttctgcatccagaatgtgttaagacgagacacttctgcatccagaatatgtttgcacataatcgttttcatgtaggcagactcttttcttttttagtccaaatgattgatttaaacatatgactatataaaatatatgcgttacactccaaacatgacagtagtaagcaagctgcgtaaaattcgtaacattaatctccaagttccaaatgcagatactcattctcgttctttttttttttctctctcctacatttccaaatgcaaaaataaacagcctgccaaggagccagttgctgaagtgctgtagtgttttatctaggtaatcttggatttagctgcctttagattatatttgttccctcatttaaattggcattggccagaactagatgcctcttagtcattttctggtcagctttaatgttacaataacttgaagctagacatggtgggtccccagaagaaacattatgcatgtgctgctttagtgttaatgcctacattggtatttcttccctgccctgggcctttttccttaacaggtgaccatcagatcagatcatctgttgagagggaatgtgttttacctgagcagcaggtgtgttcagcactttgatgaacaagaataatttggccctcccttcctgggtcttctctttcctgccccttccttgctccttacagcatagtagacaagcatttgaataaaatggacagtctgcatttagcaaattacccttccaagggcttctgctttgcaaataattgggcagttaagtggagacagcaaagatccagaggtaattgtggtctagttttgggtgcaggttgactagaaagtatatcagtaaacttgttactaaggttccatttctgttgtttaaaaaaatgcaaatcagttcttgttagccacaccttagatttgaagggacatggacttgtgttattgaccaattatgttacatgacttttagttttcaggaagggtcattaatatgttttgtttttgagactcactctgttccccaggctgtagtacagtgatacagtcccagctcactgcagcctcaaccttctgggctcaagctatcctctcacctcagcctcctgagtagctgggactataggcatgcaccagcatggcctggctacttatttttattttttgtagagatagtccccttatgttgcccaagctggtctcaaactcctggtttcaagccatcgtcctgcctagacctcccaaaatgtgggattacacaggtgtgaccctctgtgccaggccttaaccaaaccttttgttgttgttgttatattcatgcaatcagaagttgataattttttttttttgagttggggtctcatcttgtcacccaggctggaatatggtaaaatgtttttgtgttttctaagcagtagtcagaaacattaatcactgagcatgttactgtctcagaagtttctttggtctttatattggagtgttgagttgtcattctagttcaagggagaagctgtgacatacagaaggatgtgctttaattaatgatgttgtttggtagttaaataggccacagtaatgcagctaatttttaatttttgttttatattgccagaatggatctgtttagaacccatttaaactcttatcaccttggcaaaaaagtcacatggaaaacatctatatagaatggctatttctttataatttacttgatggctttagttatgactgaatgtaaaactataatataaaatattaataagaattacaaatgaatggcatccatatttttctcttagggtttgtgataggaaatcagatactaggtttatctatatgaataatatctgtctgttttcaggacacagggaatcaattgatggtggagttgggtgttaggagacattatcctttcatagatcggtgtccacatccagcttacttcccacggtctcttgctttctcatttttaaagtggtttactcgggatgagagtgctcctactttttattgactacttctgcacacttggaacttttttttttctctctagatgaagtcttgctctgtcgcccaggctggagtgcaatggcgcgatctcagctcactgcaacctctgcctccctggttcaagcaattctcctgcctgagcctcccaagtagctgggattacaggcacccactaccacaccctgtgaatttttaaatttttagtagagatgaggtttcaacacattggccagtctggtctcgaagtcccagcctcaagtgatcttcccgccttggcctcccaaagtgctgggatttcgggcgtgagccaccacgcctgggccaatcttggaactttaaagagcctccattaacaaggcagaaagataagtgtcacaccaggtgtgaatgctgtctttggagggggacagtgactcattttctaacaattactcttaaacctagagggaaatgtaggacaaaagatgctgtaaggttgactcttccagagatttccataccttagcaatctaaaaactgtatgaaaggtcagagttaggactttgaaagaatgctaagtgttaatttttggcatttacctcaaacttaagtgctactttggaagcctgctgattactagaatgcttttagtctcaatccaatctcaacttttacttgagtggttatctgtggacactaagttaaaattgttggaaacagtggcttttaatggatatttttatctctttcttcctgccgaggtggagggaaggattagtgactattggggagggcttacgaggtgctggggctggtgctgagcccttacacacattatttcatccagtaattacacacgctgtaaggcggcagtcatctttatagacaaaacccgaggcgagaaaggttgagtatttgcaactggcaaatcacagagctggaatttgaacccacttatctcctcttccaaaactcagatcctaccttctgggaaaggtggagctgcctggcttggactcacctctcttagtcttgttcaggtaaacagctggggagcgagatggcacttggtttttgcacagtagtaaattgtaaactttatagaggccattcctcttcattatcttacatgatctccacattaactccagaaggtggcagtgcctctggctccccagcttctgaaaattgaggactaagcagcagtggtagtgtcggaaggcctggaggtcaggcttgtgtttgcaaaaggagctgggagtgaaatcttccgaagccccagtccgggtcacagcagcggctcccttttttccttagggaatggttcttttcttgagattggcagtaggagggctgctccctcccgggtcagcagttgctgagagatggtggtggccagagaagggtagtagacggtagtagtaggtagagatagtagaggtagtagaggttcctcccccgtgggagtctcaccctggagttaggagagggccttttgcctaccttttcttcccaaaccccgtccttcatttccattaaaaaattgcatcaccctagatgcagctttgagactaaagaaatttaaaaccttgtaagatttgaacacattaggtggtttttcattctgagtttacagagtaatgccagaataaaagaaacaaagtgtatccttcaaaaggaaagaaaatggccacttcgcgtcacaggtatttcttaaatctctcgcttctacttttcctgttttctaaggggaatacagaattaagtgtcacgcagatttttactatgagcagtgataccgtaccgggttgctcatgagttcctcgttttctttgttttaggttgatgaaggactgcttggactttgactctcctgaagatgttaattatatgtttcaaaaatcatgtgttctgctaaaaatcacttatgcatagccttggaaaaagaactggaggcagggagttgcttcagggtgcagaatatcgttttggaggccttgggaaataaatcttgagttagttcatttaccaccaagacatatttagtcactgtatataaacaaaagaagtcacagtgtgcctggacattatttgtcccagatggagtttcaacttggctcattatactgcactgatgtcatggtacataaactggctccgaattcaacgtgcatagaatcggctgtgtgcttgtatgtgctgagggtgtgcgggaggaggggcggggctggctggaaaatctttgtcacatttttcctttgctctctgtagaggctagtgtcagtcttgaatttggacttggtgcagaatgagagaagaattggaataatctgttcatgtgtacaagtcagtgtgtgtatgtcctcaaagctgtagttcttccaagaccaagaatctaagtgtgcctggctttccaacagttgcttaacaaagctctagtaactcaaatctagaaaggaaaatcttaaaagcattacattttaaaagagcatttttagtgtgtttgccttgaagtcttaaatctggacagcttctttcaactttgtaatggtcttaagtatccagctgtaaaattctgttttcctggattgtatggtggacaacgtctcaaactagttgcttaaaagtatataaaaaggtggccgaatttaattcttcctgtgtgctttgagagggcagcttgtgggtcagaaaactgagccggagagggtcctttcctggacttctgagcccttaataggaaatttccacatactgtggtgttactttattactttttattgctggcttttgttatgataatcttaattagaagcatttccaagtaattcaaaccattttgtagatgtaaagggcttagatttcagaacttctgtgaatggattcctataggagtcactcttgttgccgggacacacagaagctgagcagacactggaatgtgaatgcattgggaggtgagcccttaaggagagcccaaatgtttaccaaagagaaaatctggtcagaggtgagaagtggctggttttagattttatcgagagcatgaaacatggcagatttggtaaaaaatttttcttgagactgtaattttacttaactgagagacttgttactggtaggaatttgaagaaaaagaagttgggggtagaaggctctgcttcagggaggaacacatatttcctagaagagaacttgtcctgcctttggggatgttcctttgacccagttaactgcattctcttattttagcagtcttgttgaattatctctgtattgaattgacatggtgaaaccacgcctagtagaggggagaagtggtggtgtggactagacgagtatacattttggtcagacatggctggattccagtcactttgtagttttgtgaccttggaaaagttgcttgtcttcttcaagcctcagtttccccacttgtaaaatctagttactatctacctggcagatgacagggattcaataagtagtagctgtttcttaatcattgtagaaaaaaaacctggaaaaaggagttgataaagtaccctgcatcatgccaaattaatcttacagacacatgtgatattgaggatacagcttttttttaaacaaagaacagcacatttttatttttaagttttatttattattattttgagacagtctcactgtgttgcccaggctggagtgccatggcaactgctgcctcccgagttcaagcgattctcatgcctcagcctccagagtagctgagactacaggcacccaccattacccccggctaatttttgtatttttagtagagacagggtgttggtcaggctggtctctaactcctgatgtcaagtgatccatctgcctcagcttcccaaagtgctgggattataggcgtgagccaccacacccggccgaggatacagcttttgaaccttctattctttgaagaaaacagtattaaaacttttggagtagtggatattcttgctccttattttgcatagtaagagtcctaaagcccaggaaaacatatttgccatgtatcctacgggttgtgttgagcaaggggagcttcacctacaatgtgtacccttggaccttgagttcccagtgtttgcttaggtccccttggaggcttcctgttattgtatattatttttcaatcagctttggattcaggcttcaggtagggcagtgagcaaaatgaggcaatggacacattcacatcttcttccaggatctttctagtttacttgcttatgtttttaatcctgggacattttctttgcatgtgttattaccacaaagataaatatttggcattcgcaccccatcgcttcccttttcctgatttggagaaaagagggggctcaaaacacaaatactgcttacttttcagttttgcctgaggccagctgtgttctatggcacacagactggggtctcaaaggtgtgtgtggatgaacagtttgggtatgggggcctgggaagagcttggagattgggaatcttgggggtggggctggggagtggggagttgggagtatgtgtgaccagaaaatagtagcatgaggaataggtggtagtactcttctcatgtagtcaaaggtcacttttgaagttattaggtattcctggctagaatccttagttgcgtggaactcctctgcagcttttagattgtatcattttcccccttaaagatacctgttggataatcataaatgtgggctccaagggagaagtattcatttatacatgaaaacaagctacacaaagtgtggccagtggaaaaaactctagaagtgaaatgggatctcctctctggtatggtttatatcttgattgtctgagggttggatttaacgcttaaaaatgctgcaagtgtactattttgtctttggtcagttggtactcttctcccaggaggagcttttttttgggagacagtcttgctctgttgtccgggctggagtgcagttggcaccgtcacggtttgctacagcctcgacctcctgggctcacgcgatcctcctgcctcaccctcctgagttgctagaactacaggaatgcaccaccatgtccggctaatttttacaattatttttgtagatatggagtctcactatgttgctggggttggtctggaactcctggtctcaagtgattctccccgtctcagcctcccaaagcactggaattacaggcatgagcctctgtacctggccagaagcttttttgatggactgatccattaccctgattgcttatttgagtgactggtaatttttttatttgaggcataaattagacatttgcctccaggagtagtcttagatactattggcacctggttaatcagccacccaaggtttaaattgcaaaagtagcctcccttttcctcttttaatgagtataaaacagagttaggtttagatttatacctgtaaaggaaagatattacaccttctttcagttctcctgttagacaaagaattcccatgatgctgtgtttactcaattgtattaattgcaactcttgttttattgtttctctggactttggaagagtggtcacttatttttcattaaactttgataaactgccttctgtttatttccagcttcttggttcatgtaacactaacggttttgaaacagatctgatgaagcaatagtagcttagaggatgctcccatgatttgattagcatggttcttcttaagatctctggagaaaaaaaatatctagttaaaatctttgtcttttttttcttcctctgaagacatggtgcagtatgaatcagtttaatgctgactttggaaaagtaggaaatgcttagtgagtagacaaaaaatgatgtggtttggacagcgatgttctgtatcgcattttatattaaggaggacttgtagcagttattatatttctgctttgtggttggggagagggagggagggagggggagagagagaaattgcccaacttgtatgataggaaaggttaagtgccgggagttggccaggttgtgactcatgctcctcggggctgcgtgatgcaagaccttttgccgccagctcattcatgtctgctgtcaggaccggtcattgggctggtgtgtgtcaaacttatttttatctctgctttattgacaatgaaaacagctaggtggtcagcctccctcagtataataaaatgctttcttttaaaatacctcagtgccaagatgaatatggtttgtttaaataatgacttctgctctactgagaaaaattgatattgggacacaggagacttgcctggtttctgaggtaacttggtagattataatctggttgctatggctactcagcagcagtgaaaattacatgaactaaacatttgaagggaggtattttcgtcggatgcttaaaagcccgttacctatcatctttctccctgaagaagtgggatgggggtcaggaattgaactcagtaagcagggggggaaggtataagtggaccttagaggctggatgcctctgcgtcgttctttgaagtttggcctggtgtcagtgaccactgaggaactgttacagacactttttgtgcaatatgataagcagataatgtgacgacagtccggacatgtcccaattcagaaatccgttttcttgcctgggactttccgtaatactggtgaattgtattttctgaaccggtattcagggcacattgtctgacaattatgagcgtggtagaagagagtatatgaatttgggattgtcagagaaaatctaggacatagagtcttggcatccattggttcccccctcccccagctaattaattccatgggcatatattacagttctatccctagagctttaaacacaaagcaaatggtttttgctttattacagtgatgctagaattggtctaaggacctttaaaaagacatggataattgtctgtattgaagtgtgattttcttccattgtagtttttatattgtatatttatgtaaaaataaatgattttcatgttaaagaaatgactttaaaagctccttttcaagaaaacaaatatttggcccggcgcagtggctcacgcctgtaatcccagcactttgggaggccgagacggacggatcacctgaggtcaggagttcgagaccagcttcaacatggagaaaccccatctctactaaaaatacaaaattagccaggcgtggtggtgcaggcctgtaatcccagctactggggaggctgaggcaggcgaattgcttgaacctgggaggcggaggttgcagtgagctgagatcgcgccattgcactccatcctgggcaacaagagcgaaactccgtctcaagaaaaaaaaaaaaaaaccaaatattttaatcattctagagatcttgaaggaatttccttttgagtttttgaaacagtacagtgtgcttacattggtgataatttaaatactgaaaactcaaagattatctacagttattatataggaaaaataaattgccttgaaataactgtcataattcaagataatgagaagcaccaagggtgaagcttagtctgagtttccctgaatgatcctgttttttccaggtaatgtattttctgatttaaaaaaatttagtattccagcagtatcatctggatgaattattagaagaggcaaaatacatggatattaaagattgagtatttaaagatgaaatggttttgatttcaaaagttttacaaaacaaattatagtgtatacagtaaataaagttgacttttaaattgcatcttatgaaagcttaatttctaagctgagataattatttgcaatagttttttttttaatgttttatgactttcattcattcagtgaaagtagttattgagcacataacttattctatgccaggcatggggctagatagctggatgttatccttatcatgcctagattaaagaaggaaaggcagacactaacataattgcttagttaattgattgcagttgtaaattctaggaagaagtagtagagcgggtatttttgtttgatttagaacacatagtgggggacttgacctgtcctgggagtcaaaacactgttatcacaagctgagaaggatgaatagacgttggttgaggatggaggaaggtaggtggtaagctaagatgaaggagtacaggaagagtatcacagacagaggaaacagtatgcttgacagtttcaagccagggaggaacagggcttgttccgataactgtaggatgaatgtgacactgacatcctgtcaatttctagaaattatatggtgatttttaaaatagtgttagccttgtacatggtggtttttaactatagtttttgtggtggtggtggttgtttttgagatggagtcttgctctgtcacctaggctggagtgcagtggtgtgatctaggcttgccacaacttccgcctcctgggttcaagccattttcttttctcagccttccaagtagctgggattataggcacctgccaccacgcctggttaatttttgtatttttagtagagaccaggtttcacccaggttggtcttgaactcctgacctcaagtgatccacctgcctcagcctcccaaagtgctgggattacaggcgtgagccaccgtgcccagcctaactatagttttttaagttgtattatgtcttttaacttgtatttagatatcaattagtgatttttttcctttgattatcctttgattagaactattaataaaactataaggctgttgacagaacgtactttgctattaccactcatggtctagtcttggaagttgtctaatattaaatatttatgttcatataagtaaaacattgactttaaacatttgggtatttggcggggcctatttataatatttatttaatactgttcattattgtcttaagatcctgtacacagataattctttttataaaaatttttcttgtaaatattttttgttgtcacacaatagaatcatataaccagatcagtaatagacacttgggaacagtatgcagcactgttaggtcaaaacctcattgctagatgcagctttcttctgtaagtatggtttctggtgttttttcttctgtaattgtagtttctaaatttgtgaaagcgaaaagggaattgtgcttttcaaagaaaagttttcttcaaatggagtttttaaagttagatagcatcataagcaacacaggagaattcacttagctaaatttgaatgcatgtactcctcctacccccatgcccccaattaagacttatactccaagttttgtgtttataaaagattttatgccacatgcttcctgtctagtatataaatttaggtaataacacttaacaaatcccagaggttccagtattaaactgaaattaatgtgttgttttggcaggttattctcgttcaagttaatccaggtgagactttcacaataagagcagaggatggaacacttcagtgcattcaaggtaaggacatttttggtaaatattctaatcaaagatttttttctttatttgaaggaagtaatgtttttctgtgtgtgtctgcatgtaattttctagaagtaaagtatatcttggatattcattttctttttttttctgtcgcatggtctcaaatatatattatgatgttatccaaaggacatttttagtggtaaaatctgtattgggtatctgttggttagttattgctaagtaacaaattactccaaaatttggtggcttataacaacatttattaactcacagggggctaatggtaggaagttttctacagttagttgttaagtgggcctctccatggagaagtggagggagcttatgttaccgcagctggcttcagagccaataactagagggcaagagggagctagtaggtccagcccagactcaagagaagaaattatgaaagggcgtgaataccaagaggcaggtcattgggggccatctcagaggctgcccaacacaggctactctttggcccccgatgattcatgttccttccaaatgcaaaatgccccgtcccaagatctccaaaagtcttatcccattataggattagctcagagttcagaaccttatcatctaaagttccaggtgtaggtaaggcttttgggtgtagttattttattacagctcctagcacacttctagtgtgtatactaatgcctcttctgtatagttcacttggaaataaatgatgtaggtactttgatccatatggagttctgtgtaggaagatcaacctagatctgatgttagctggtaaacactgtagtgttaaaaggcactgtttatgatagctctttttgacagtgactgggattatggggcaaatggtaaatggcatgcaattgagatcagtattaggttattaattgaactggaatctaatctgaggctttactattaatacctgaacttgcttaccaatatacaaacaaactgggggaaatgccctttagtttcggtttcccataataagctgtatagaaacagttttttttttccttgcgtaatagtagagcatgttgctttgtactttttttttgtatctataagaacaaaaacttagaaaatatttcttgagaaatgagtatatttttaaagattcaaggctaatgagttttaattgaagttaatatgaaattatttaatcacttttattaatgatttctactctgcatttctctgttgtgtcccagaaattgatctttggaattctaaatcatttaaaatcaaaacctagtcttagtcgatgcacaatatggggaaacttcaggtcaaggaagagaagaaatatttttaaatagtatggactatagagtctttcacctatttgtagtactataataaacagataccgtgaacaattaaaacctcagaatcctacaaccctgtatcttaaaaaaaaaaaaaaaatcacactagaaaaactagatgaaagtcacctatatgggatgaagctgaagtttccagttcagtaagaaagcaattaagcctctggttatggtaacattggcaccccattaattggctagtacataatgtccctctacaactgagtgtgtgtaatagaatctataaaagcaaatcacttagtggatgaacatgcattaaaatctctttcattccacctaagtttactttttggtgtctaaggagtgtgtgtatgtgtgtgtgtgtgtgtatatatgtgttttttgtgtgtatatatgtatgtaatttcactgagttggccgctcccccacttttttctttttttaatccatgttataactggtgcactttgcaggaaatgttgcaagtatattgctctcttcacaaagggagctttgtatttattcatgatgatacttggagataagtgacactaacactcctaacagtgatttcaaaaatgcctttgaccaaaacagaattgtggagccattatctttggctccctccaggcttcctattctttgttctcttctgaagtctcagatactatggttatcttcattttggggagtggtggtacctggcccaattaactgaaatgacacaggatggaatgaggactaggacctggatccaggtgctttactagggtttcggaagcactggggcaataggatgaactgcagaaactggaaggaaagtcagcccagcaggctgaaccccaaattcagactcattgactgccactaatgtataaaaggcagtcactcaggcaaaaaataagaaaccctttatatgagtcccagtatgagttcgtgaatacttcattccagttgggtagaatatagcaacataaaatgtggcaataggcagtgtatttgtaaattccaacacaagttgctgtgtcatcctcacagtcccagtgattaacatcatctctaccattgctaacatttattcatctcaggctgtgctatgcattctttcctttagtgagtgtgtagttacacataaggaagctgaggcctgtcgaaaagtcacaaagctagaaagaggcagagttgagttttcttccctgctatgtctgatgccctcagttccttgttctgtgcctttatgtcagggaggactccattctcttgacaacagcaaggttaagttcctgttcctggagtaacaggattctgagctggatagcaggatgactacttagatacccagaatgagacagatggtttgcagaacaaaagtggttggtggagactgagtcttgggaataagctaggggcgagcactttgttaatgaagtgagatctactggttgagcagtgactagcagacagtgtgatgcagggagtattggtttagaactcattaaattatttctgccccaaatcaggtttgagttcagatttggggtggctcagcttccaggtggggcttccagctccagctccagctgttgttgattggggccagggagggctccagctccaggacaatgggagaggacttgtaggtacagtgggaggcagttctttgtcatttaaaaacctattaggaaggaatctgaaaatggtcacattgtaatggaaatttctgaaagaaatatttgtattttgttagggatttaagagatcaaaactctacttatgttctttgaacactggccaacaggcgggagtgtttttgttttgtttgttttttgttttgagatggagtctcactctgtcgcccaggctggagtgcagtggcacaatctcggctcactgcaaccaccgcctcccgggttcaagcgactctcctgcctaagcctcctgagtagctgggactacaggcacacgccaccacacctgtctaatttttttgtatttttagcagtgacaggatttcactgtgttaaccaggatggtctcgatctcctgacctcagccttccaaagtgctgggattacaggcatgagccaccacatccggcggtgtttttctaaattgaggggaaggtgatgggtggtggtggccttcctggaaattttgaagtcatacccattgattatgccgtggttgaaactgtcagcctaataactttgctattttaacaccagccttcagattagggactgctttgtggggatttcaggtagggaatggagttggttgctgggccttcctggaaactttgaaatcacattgtatgaggtcagtcctctttacttgtaactgaatttattagcctgataattttatctgtaggacatttgtgacaccactagaaagacctcagaagctcattgtgatctcattaaaaggcagcttggaagttgaaagcaaattaatacagaagaatatgggctgagtagggaagctcacacctataatcccagcactttgggaggccaaggcagaagattgcttgaggccaggagttaaagactagcctgggcaacatagtgagacccatctctaccaaagaaagaaaaaattagtcaggtgtggtggtgcatgcctgtagtcccagctgctcagaaggctgaggtgggaggatcacttgagcacaggagtttgaggctgcagtgagctatggttgcaccactgcactctatcctgagaccccgtctattaaaaaagaaaaaaaaatgtgtttttatgggaatgtccttggtgataaggaagaaaacacaggaagcatacaatatgctgtgaacgcagattcatttctaatggaatatttctcaatatttcccatgaaacatgaatcataggtcttgaaggggccaaaaaaggtcatagtttattctcacttggggttagcctatacctatggcatcctagacaaaggatttattttctcttggccagatcaaagtgtataaagagctaattgttaggaaaaaagaatcttagcaatcagtatgaattttgcctttgcttcagttcaggaattaatagagggcacacttgggtctctcccattattttcatatctgtgtctgggctgaggtgctggcaatgcagccttccttcctgtctacacatgccatctctttatctgctccctgtaaaatcctccagccaaaacaaacatcatgcttcctttaagactttaggcctctttcttccaagagctctctcagaccactgcctgacttttccctgaattctggaggagcaggtagaggtagcactacacagtctggttatatgcgtaaacctttccttagctctcgaattagatgtgaattcagttgtgacaggaaacagtgtatcttcaccctgctccccagccacacagcttgagaataattactgactggattcctgagtggctctggtattacattcaagcatgatgatttttcttttaaattttactcttctgatggcagtttaaagaggtttagttacgtgcttatagcagtctctaaatctcaatagaagaactttgaaatactagattccattgataattgaagttaatgagtttcctttagagaaatatgtttaaattctaaagaacttttacaatgaccctacattattaatactgtaattttttatttaagactattagatataaattgtgaggctaaagaaaataggtgagtgtgatggtgataaaaaatactgattaaagtaaaattcttaggaagcaccattatgttagtaaacagtaatatttaaagatacttaattgctaatagtttttgtccaaaataatttaggaatcttttaccatagcagttaatctgctgacttgtgttaagtgaatagagacctcaaaatgactaaatgacaacagaatgcgtgcagaggggaattctaagagggcactactatgagatggctgtagctttgaagctattcgaatgtgaaactttttccgctcttgcttgttctccataagacttcttcagctctgtgtctaattctccccctgcctcagtgagtgtgggaactgtatcgttgatgaacatcatgctctgcccagtggctctgtgaatgacaccattgagagctgttcaccatttctgaatttcctcatttgtctcccatcccccgcccctccatgtatgagtcagcatccagaatgtcacagggaccttaatgttacttgtttttccttatgtgatacttttgggaccttaacgttgcttttttttccttatatgatactttaagtgcatttattagacttgtttggcacactaaaacactgacctgtcattctttctaagaattttatgacaggtcctagggaatttgggttgtctcttgctttgtttagtgtgaaatgacaagaatggtgtcatagcttggttttgcaaactgaggtagactaaaacttcaaaagcaaagcatgcatatggtctctccctttaatacatactttgcatataaatgagaaattcctgttttactagcttaaaacccaggaagaggacctgttgcaaatgaagcttgctttcaaagattgtagtgaatctctgtcttggctgaaatttgcaaccagttttttgattaaaaatatttgggtgatttgaaagtaaaattattgtaacatgaatgcattaaattctgaatctttgccaacttttattatattggatgaattgttatttgactatttgtaaaatgtctgtattataaatggaaatgtttcttcctattacaagattaggattttaggagcttgttttctacataagaaactgccttgaaaaccatttctttttttttttgttttttgagacagggtatcctgtctcaaaaacaaagacctggctctgagacagacttgctctgtcacccaggctgaagtgtagtggcacgatcagatcatagctcgttgcagccttgacctcctgagctcaagtgatcttcccaccttggcctcccaaattgctgggattacaggcatgagccagtgtgcctgtccgaaacccatttctttagtatttggtggatttgtgagggattgctaacaagctgaaatgttattgtgaacacttaggcctcacttggaaaatcttctagaattgaaaatagcaagtcatttgccaaggctagccctagtgtcatggccatctttctttctgattgatccaaagctgtatatggtgagagttaatcctcccaggaggctctaagccaagatagtctgaatttctaggaaaatctgaattactctaccaactctccagcttaccttatgatacttaaatgttagcttcaagaccaatcagtcttttacctgtgtgtgtctgtactacaaatatatatttacgtgtgtgtatatatatttgcttcattagacgatttttccattttccatgattggatttacatgaaatttggagaaagattgaagaaaaattactttcagctttgtggagtactcttgatctctgaaatgtttgggggctctattttgcacatgacagttagcaattcctctcaacatggactgatgcacagctatttgttacaagtagacattccatacgctgacctgagaaacccttttacagacagcagcttgctgctgagtaactggaagtttaccagcaggtggtttccaccagggccggaaaatactgacgggcccagagcagaaagtccaggttatggaaggaatgagagcaaaggctgtgattgtacgtgcaactgtcatcttgctgggattgtgtaatgtcatgaggctgggttacgtcaataccaaactatgttgctttcctaggaggttttaagtccctctcaagggaggtactcagggtatatgctgcttcctgcctttctccttcttcctgtctcagttatcttgatttttatgtttattcttatatttacataagaacggaatgttaaacccttagataaaactgtcacccaatgttgtgtcatcagacttaagatgaattggtgttgagttctcagagtacagctctgtagtgtgaatccctggtcatttcgtagctaatgcttaacctgttagccccaatttcctctcttaaaatgggaacaatgatagtacctatctgataggattgtgaggataatccattgtaagtgtcattattcttatcatcattatctagttgtatacacagctttactgatttttcccccccctaaatagatggcatgattgtgggcaatgacttcattttcctacttgtagaaatcagttgaaattctagtctccctttcattgcttatttatgatagacttgctttcatagggttgctggtgatggcaccagttcaaacattttagatgaaggtttataagaatgtgtatactgttcagatatggggttatagctaaaacaatgggtccagtgttccatgaatttaaagtaaattttgttgtagatttttagttgttggttttcttttgaataacagccgttcactcttgcaccacgcctgagcagctatattcagagaaggctgtatcctcttattttatccaacaaagcagtttttctaatgtgcctccttttacattttcattgaattccatacttctggctgggcatagtggctcacgcctgtaatcccgacactttgggaggccaaggtggggcagatcacctgaggtcaggagtttaagtccagcctggccaacatggtgaaaccccatctctatttccccctaaataccaaaatacaaaaattagctgggcttggtggttggcacctgtaatcccagctactcaggaggcttgagacaggaggatcacttgaacctgggagatggaggttgcagtgagctgagatcgtgccattgcactccagcctgggagacagagtgagactgcgtctcaaaaaaaaaaaacttgtttccatacttgttaaaatttttatttagtgcattctgtttcttaggcagtaccaagaagcagtcagggctatatattgggaagatcattatagattttggagtgagattgcctggctcaaaaatcccctgcacattagatgtatattgtaaaattagttccttaacttctctacacctcagtttccttatctgtagagctggaatagtaatttctctctggaaggattgctgtgattaaatgagttattgtgtacagagcactaagaacaatttctgagtcatagtaggggcccaataaataggagtgattactaagctttcgctctttattatgggtgggcattgacccccccttcattttttgttagctaatcatttttaaagcatttcagaaagcctatgcgaactggagttattaggattttttagatgtcttcacgtttaaattctaacacttcaaaataacatgtttaaaagttatgcaatcgcagtttaactcctcaacccttctgccctttaggcttgttaaacaatgattaaaatgtcatctctgaaggtaccactgcttagagttctttaaatgtcacagatctttgcatgtcagataattcagaaaagcgagcagtgtcgcattacctcagtggttggccacaggctatttcacagcttgtagtctttcagttcctgctttattctttctgtattttttactcttgttcttgcacttccaacctgaaatagaaaagttcatgttacaagtgtctttaaggaagactggattaagttcttcaagggcaagggtcaaagcttagtcatctttgtatcccagagcctatcctgcatgcaggaggcattcagactgaaggaaagtcatttcctgatacttgtcttagtctgtctgggctgctataacaaaaataccagagaccgggtggcttattaacaacggaaatctatttcctacagttctggaggctgggaaatccaagatcaagatactagcttctttggtgtttgaggaaggcctgctttctggttcatagatggcagtttctctctgtgtcctcacgtggctgaaaggcctaggggtcttcttgggcctcctttataaggacactaatccctcatgaatggggattagtgtccctcatgatccagtcaccccttctagtaccaccccttctaataccatcacctttggggttagaatttcaatgtatgaatttgcgctggggtaggggacacaaacattcagacagtgatagtactgctgaagataaaatgatggaaaaattctcttaggtaatttagagaagttatttatttttgttgttctgaaaaggtagttaaatttagttattttcactcttagttcctcaatttaagataatgaatacaggcatgagtgtgtttccaaaaacagtaattctgaaaaagtccaatatatggattagcttctcttacctgtaaaaatgcatgagggaatcattatattcatgcttttaataactttattttgggggagaataggatgggaataccttagaaaatgttaggctatttaatccttaaagatacatcaactttttcccaaactttgtatttatttttgtgttattaacaaatattttaggttactcgttaattttattaatattttatgttttcttgctgttggaaattatagcgtttatgtatagtaataaattctcggtaaactctgtgtcagacccaggaacaaattatgctttagtaaatgagggttggggcggtggctcatgcctataatcccagcactttgggaggccgaggcgggcggatcatgaggtcaagagattgagaccatcctggccaacatggtgaaaccttgtctcaactaaaaatacaaaaattagctgggcgtggtggcacacacctgtagtcccagctactctggaggctgagggaggagaatcgcttgaacctgggaggtgaaggttgcagtgagccgagatcgtgccactgcactccagtctggtgacagagtgagcctccatctcaaaataaataaataaataaataaataaataaataaataaataaatagtaaatgaggctcattcgtgcttgtcagtgtttgcattgatgtaaagaaatacttgagactgtgtagcttataaggaaaagaggtttaattgggtcatggttctgcaggatatataggaagcttggtgctgggatctgcttctcgtgagggcctcaaagaacttacaattatgacagaagacgaaggggagccagcgtgtcacatggcgagaggaggagtaagagagagaagggagaggtcccagactcttaaacaaccagatctcctgtgcactgaatgagaactcactcatcaccatggggatggtgctaggccattcctgagggacccatcctcacaatccagtcacctcccagcaggccccacctccaacgttgggagtcacatctcagtgtgagatttggaggggacagagatccaaatcatatcatttactgagttaaatgaaggtggcataatggtttttctctaccagcggtgtgattgaagagggcaggcaggcgtcgagcctgaaggagtgcattcgtggtgggatgtggaaggagaagcagatattacagacatttaggagatagtcatgacttgtgaccagtgagaacacactggatgaatgtttccctaaggtagatgaactacagtgtcttagaaaaatatttgtcttgtaacataattgagagcactaaacattttgtattctctgtctcttaattggacacacattaagagtaacaaatatgggtttaaaaggcaaactttttttttttttaagtgggtatttttttccttttcctcaacttgggtatttcctctctgaagagggttttcagtgtcttggaaggtaatttgcacactatttgtgaggcaagactgctgagttaatggggaatatgctttactacttcttttttggatccaatctaaatacggagaaaactggcctcagaattgcccacagaatgggggtttcctttatgattcctgcttttgagttctttgaattagcttcacatttcttgtgtggttggatagaccctcctccccctaccacttttttttttttctatttgaagagaaaagattatttcccccctaagtattcaagtctttttgtgcctgaattaaggtcgaagcattccataatttaaatataatacctttttggatgctttatatattgcattgtggagccagttttaaacacctgttttgttatctttctagctataggagtgtccacatcttcactttatttaaaaagctcccgggtatgtattagcagattattatttctgttccaaattgataagaagaggagggaggtgtagcatcaagggagaagtctttgggagtaaaaaaaagagtggaaacttaaatcaaaatataagtccttttcttgctctgtcttctagtgaaaatgttattctgtgttagagaaatgaccagatgaattgtgtttcctgtttcgttttgcagttctcattaaagtgggtatacgcatacacttatctcatgtaaatgtcaaactgtttgttcttgaagtgctgagtcttcaacagttctccttggttggattttgaacatcatttcagaatgtcttatgctagatccagcaatgtcagtttttgcctgctgcactgtggtaccttgtgaataaagcaagtataaatggtccagatttataatggtttaagatttttcaactttacgattgtttcattgggacgtaactcggtcacaggttaaagagcatctgtacttaggcaatgctagaactgagcttgtgttctgttgaggaagagtaatctttgcagatagtataaattgtctttgagtgtaaacttgaaataggtttctttctttttttttttttttttttgagatggagtttcactcttgttgcccaggctggagtgcaatggtgtgatctcggctcactgcaacctccgccacccgggtttaagcgattctcctgcctcagcctcctgagtagctgggattacaggcatgcgccaccacgccccgttagttttgtacttttagcagagaggaggtttctccatgttggtcaggctgatcttgagctcccatcctcaggtgatttgcccgcctcggcctcccagagtgctgggattacaggcgtgagccaccgtgcctggcggaaatagttttttaaaaacattaataaaatatataaaaaaaagcatggcactatcatcccatgagttagaaatcaagatctaggattaaattggttaatttattcttagttaatagtcacgacagttcttattctgtgagtcaagcgctcacctgttgagtgacatagttcttgaatcatatgcccaaggaaaaggacatgtctaacatctcagaattttaaaactgtgtgtattaacagtggcttatatccttttgcacatcagaattacctgggaacttaaaaaaaaagtttaaaagttgatatgtaggctagttgtagggaagtgtcacattgtctgagcccaggggaattgtcagattgtaggggaattgtcagattgtaagggttggggactgggcatgagtggttttgaaaagctcccgggccatttgaatatgtagtgaggttgagaagctctggttaacgtaaccctcaggacagctcaagaaattcttgcactgtgctttcccacgtacatttcagtgtacaggctgtgtacctgtggctgtttatcaggttcatcttctttagcaagtttggcagttttgtaaagtgtctaaagatcttttatcttgtattcttatacatattaagtaaaatctatgtggtagttggctttactgaacctattaaaattgctttttagctttggttataagcttctaagtaataaacaagaaccatcagacagaaatatgagttactgctttcggcagagtacagatttactttatacttacttagatgtaaacacaatagttcacgtatgtttaacgaaattcaaagttcacctatgtttaatgaaattcaaagttgattggaacaggtatgattatgcagagtggacagactttaaaaagtgagatgagaaggccaggcgtggtgcctcacgcctgtaatcagcaccgtgggaggccaaggcaggggaatcatttgaggtcaggagtttgagaccagccaggccaacatagcaaaaccctgtctctactgaaaatacaaaaattagccaggtgtggtggtgcatgcctgtaatcccagctactcgggaggcttgtggcaggagaattgcctaaacccaggagatggaggttgcagtgagctgagattgcaacattgtactcgagcctggcgacagagtgagaccctgtctccaaacaaaaaaaaaaaaaaagtgaggtgagaaaataaccatcttacaacttgccacttttcagaagctgataagctgctgtgagccctgttttcgcatgcctttatgaaatgattggactgggacttttgcttccctctttgttcccttcctaatctagctcgaatggtgtaggtccctaggaatcattttgttgcttgacttgggtgggtggtccctatagtatatgaattcagtatatgacatctatgtcagaccctaaagattatcaacaggtagtctcggttctcaaaatgtagcataaaccagaatcacctggagggcctgttaaaacacagttgctggttctacccccagggtttctgattcaggtctggggtgggtggggccagaaaatttgtatttctgagatgttcagggtgttactgatgttcttggttcaggagttctgagactcatggaggtggagatcgtcggggttggtgacatttgtaagagaagggtatttacagaagttgtacccttaaattaaaaagaaggctctcagaattaagtctggtcacccaatggacaaaagggaaaaaaattccatctagatgcagaaaaataagaaaaattgacttaaaagattattatttataagctcaaagatagaatttttttctttttgaaaaatttttcctcccttttctacagttttaatgaattgaggtttgaacccgggactctaattttcaaaggatttgtttgtagtctttcagtttccatctcctaattcagttgctaattttattaagttcctaattttattaggaacttgtttttcttcactgtgcctcagtttccccataataagaataaatatgattgccagagatatcgttaggttattttaaagtctaatgaataatattatgtagtatttggagatcatcaagttaggaaacttataaaaaatatgaaaaatattctaaacatctaaataagggatgtacttattcaagcaataagtacatccctttttcccagtcaactgggccacggtaaaagaagcagccaatgtggagggtaaaaaaaatagtgggccaatatggaagttggcttcattttgtaaagtactatacaaaaatgggaaaattttaaagcatgaaactggtgagaaaggaagtgactcagaattcaaaatagataggactccacaccagtaatgatctggaactgaggaacattgcctacagaagagagaagccatgagagacagttgaggtgagtgaattggctccatagtaacatggaaaatggaattacacatttcttttttttctcacgtggacagagactattgtagcaatttagaacttcgggccctgtttaaaaaaatctatttcaagcgtcaaattattgattgccagactgagtattattagtaattacagttacagcactgaggagttttctcatagtgtctgagttctgctcctgttcagtggttgagttcattgatcatttttctactcctcattgcacctgtcatgctggtatcagcaattaacattcctcagaagcgaatagaatgccaggctccatctcagatgtaactcaagaacaacaggtgcattctacctattcttggctatagacagagtagttagaaggcaagtaattaaccatagagcagactttgaagaaaatgagattctttagaatttgagacaaagtgctgaaaagtagctctggataatgtatttaggagacataggaaatggctcaacaggaagggtgaaatagccttaccagtctggcctctttaaatttgtttcaagcctgtttcccttcactgatacaaatcttactaactctgcaccttccacagaccctttgttatgtgcagctgtttttgtttgtttttatgaaattcacttgaaaagtcattggacttgaatttatacagtaaaaaatcaattaactagattcttaaattttctcttccactttaaatgaagacacctaacggtttgaaaccttctggctctgagaagaggaagagggtccccagatacaggtttcaattccttaccatttagtctggttccattgatcaggggttcagttttctcaccttaaaataagaggattagaacagataatttctaaaattatttttaccaccccttttctcttttctttctttaattcctgtggcgttctctgcagtttatatgtccctaatttttatgaaaatacttaaagctttacttaaataggttcaagtgtgggcagatttcaagagcttaattatctaggattttctacttgaaagtgagattttaaattatcattgagaccttactttaggtcctacataaatttctctaaaattttataagcatatgttactcttgactagtaacaacaggaaagaaaattaatccagtgtgatttctcttgttttaataattgctactttaaaaaagcttgtgtataccttttgtatgttgggtgttttttttttttttttttttttttttttttgagacagagtcttgctctgtcacccaggctggagtacagtggcatgatctcagctcactgcaacctccgcttcccaggttcaagcgattctcgagcctcagcctctcgagtagctgggacttcaggtgcccgtcaccgtgcccagctaatttttgtatttttagtagagacagggtttcaccatattggccaggctggtctcgaactcctgaccttgtgatccacccaccttggcctccaaaagtgctgggattacaggtgtgagccaccacgcccagccatgtcgggtgctttctctcactggttgttaaacttggctgcatgtttgaatagctagagatttttaaaaaatactgatgcttgggcctcaccttcagagatttagatacaattattgggtcccagaatatttttaaagatagtattgtcataagtatttagtttacgttgcacttcaaaaaaaattgtagatttaacttttatgtctaatatttaaggttttgaattatttgtgaatgaaaaaactctaaaacagagaagtggtaccttttcattttaggtgtactgcctcagctaaaggatgtgtgtgtgtcttgactccccatcccccatgcgtacacctcttatctgctgagctagatgggatggcctttctgcttgtctctcatctatggggcattacacatagttgtccttttccagttggttttttaggattatttggtgtcattttgtcaaatctatgccattggtttttaaatgcatcattctttttttttaaatgtctctacaaaagagataacaccaccgattaagttgacttcctttttcaggagatgtgaaaatgtgaaaaaggtacttggaatcggtgaaatatgcttataattttttatttaaaaaaagtttgtgggtacatagtaagtgtatatatttatggggtacctgagatgttttgatacaggcatgcaatgtgaaataagcacatcatcgagaatggggtgtccatccgctcaagtgtttatccttcaagtttcaaataatccataaaatacactactctttatttttctcatctaggtattttttaaaaaataacaaatctacataggttttttttctaagtttgtgtttgcataatcattttgtgtgtatgaaaaaattgagatagctttctattcaatctccttagttgtagaaatatgactaatttgtttaaacatcattgcttctaaatatgccctggaggacttacatacaagtcataatcttgtgatattctttgttagtttgtctcattatgcggaaagccttatttattttttgtgtgtgcatatgtatgcatatttgtgtgtactcatacagacacacacactctgtatgtgtgagtgtatatttgccagtgctaccacttccgtgtgttctgctttgtctaaccttttggtaaagtctacactttgggttttaaataattttaaggtttccattgttcacgtgtttgctgttgtagcattatcctattaaaaactacataacccagttcagcaatctaaatgtgcttctaactttatatggaaactatttagctttctttacttaccgtctccccgactccactccccactcccccaacctctttttttttcctacagtgttaaccaagagagatatattacctttggatctagcccatctacctctagatacttcacttgcataataactaatttaaatttattccagatgtacaagaagtatttgagatttggtagttttaattttggaaatgcttttaaaatgttatcctagattagtaggtgatttttcttccatgaaaatgtatatttatttaaaacctgcggtagctaattaaacttgaaataccctaagtcctcatgtaatgttgtggataggttcttggaaactgtaagtgaaacatataacaggtccttgagttgcgttgtttccttcgatgtggatttgttacagcattgatgaggggaaaaacggttatgcgttatttcactcaaagttgcagcttccaggaacctgtggatgacgttatgtgagggcttactgtatttctctggttttcagtaagttaaaaggtagcagaatctaatattttcattctccccatcagtagaggagctggtgatatccacttgtggatactcagtccctgtctgatcaccaggtttgatgaattggccgctcactttagagggtctgtcaggcttcttcatgttcacaaatgactggaaataaaaaggaataccttttacatcaccaactctctaagtacctatataacatttcggtttgttttggctgccaattcctcttcacaaaaatcgctggttttgcagccataggtggcctcctggctctgtgtggttttctccctttactggctcactcttcatgcccatattgctgtagacctctcttagaagcctcaccccttcactccccactccttttgcatttgggtttctgtgtgtatgtatggggtacttaacgccttctaagtagtagcgcagtgcctggcaaaattgtcagaatcaggatcagaatcagactgcctttgctgtgtttccacgggtgtgttgcattgcttcctgtccgttctccatccattgcccattctccgtacccttcatgtcctcaactactccctgtcttcacctcctgtttcctgttttttctcctgtttctgccactcacattctccatgggaagggcttttttttttttttttcttcaaacctggtatttttggagagaaggttttgacattggggctgtcttttaagagcccttcccctgatagcagaggggaacgtgctcaacttacaaagtttctgaaaaaaatcacacttcttcttttcacgggacccctgtttgaaatttgcaacaaattaaatgcttaggaatccaggtgcctaggagccctgctatttcagctctttccccttaatcatgttggtttacatgaggattgattttggactcactgggccagctacgtgaaatgtggtattgtcattgtctctttgcacagaacaattcatttgctgcttgtcgtgaatccatcctgtgaggtattatgatgacatctggcatggcttctttgtttactgtgtttaccgtatgtgtttagaaggaaaaaggcctgtagtgaccacttttctgtgtcggcccctgggtcaggttttccatcctgactcatgggtgtcgggaccgctgagattggttgatggggtgtgcagaatttcctctgtcgggcttgggagccagaaagccacgatgaagtttgatttggcttgtggcagccttttccaaatgtgaatttggatacagtacagtaagccctctaagaaaaggagaagaagagaaaataataactctagagctgggaatatctggggaacattgaaaaacggggaaagtctcaaagatagtattctgtgtctcccctgagctggtgttgctgtagtgctcagaggccagcctttttttccaagccgagtgctccctgcacttgggagaaaccacagaggcggcctctgtcctgcatgtgctgcacgctgccttgctccagactgtcttgaatgtgacctggcagccagtgctgtttcctgctgacgtggcctcccacaactgagcagaacagagccacctcagtgtactgaggaaggagcaggctgggggcatgaatcaccagcgggatacggaacaaattcagaggggaaagcgcctaactattcaggtttcctggtagatatacttaaaagacacctttcttataggaaggaaggaggaggaagaaaaacaggagtgaagaatgcctcaagagtcaaacagtgatttgtttggccctaggaaggatttcttatcagcaggagttaccttctggggtaagccccagtctgtctcaaacatctgagaggatgctttgaggaggccagactggactgcagccttcacagccacactgttgcacaggttggtggcgatgtgagctcttagccctatcctgcagacaggtagtaaagaaacaaaaacctaaaccaaaagactagagtttgtgtcttggtggaaaaagttccctcaacttggtaggaactggagaaaaggactctgagaaactgctcaggagcaaatcctgtggcctagttttcccttcagtgctgtcagcttcccgcttgatgctcgataagcgcttgtttcagccactactgaatattttttgagtttgcttatttgaaggcatccaggacagctccttgttactgtcttctaataggccccccaaaagtcatagtatcacagaattttagagtgagatgggactttaattgtaatctgatcgagaccgttaatggtttctttttttttgagacagagtcttgctctgtcaccaggctggagtgcaatgttgcaatcttggtgcactgcaacctccaccttctgggttcaagccattctcctgcctcagcctcccgagtagctgggactacaggtgcgtgccaccatgcccagctaatttttgtatttttagtagagacggggtttcaccatgttggccaggatggtcctgacctcgtgatccgccgtcctccgcctcccaaagtgctgggattacagtcatgagccaccgtgcccaggctatggtttcttctaagaagtgatcgtagaactttgtcttcagttactcccacctgaaagcccactgtacaaaacgtgcaggtggagctgactgagggcagagaggccggagcccagctgctcatctttcttttagtagtggccctggaaactcttcccctgaccattccacactcccgcatacttaattgagaaaccactgatgaaatctacaaccttaattttataggtgagggaattttacctttggtagggtcacggtgttaggtcattatgataactttcaaggtgcctgggaataaaagttttataactttaatctgtctcctgcttttgagccttcgtgatctctccaggagctgctgtaatggcttcccaccctgcgtgggaacaagtggggtgctggtgggacaagtcgggggctggtgatgtactctatgtgtttgtaggtcagagctggaaaccacagagaacagcccaggtggtttcattagtctaggtgtgaggtcactggggggcggcagtaggattggagatggagggaagctttgaaaggaagagcccttagcattttaaagtatggttaagtttttaagttacagaaactggatatggaaaattaccaagagaacttagtcaaagatgatcctcaaatacccagccaaagtcatagggagaatgtggagactgtctgacttagatagtggaaaatctttctcagttttctttgtttaagcttcagtaagtccctctcgtggaggattcttctttggagataggaaagcagtttgattccctgattctctttacagctgtggcatcccaatctgattgttggatgagttttggtatatggtgtaacccttagttcctggtgtgtcagttgtctacacaattcacttgcatttgttttctggattgttcagcctagattatggaacagaaccaaggcagattcaggtctgtcatactgacctcattcctggttcagcactgactttcctgcatagcctcaagtctagtaggtaggtggacttgtgattacaaacagattttggaaatcatttacattggccaggttttccagtgttttcccctttcctggaagccattttctcctattgctcgcctctaactcagtcaacagaagcctctgcccagggcaaacaattttgtaagaaaagagagcaaaataggagtgaatggagaggatgggatattaaatatgtaataggcctatttccattttcagtaaagtcacttgatttcctttaaagaggctctgattttcttgaaccatgccttggtggaattagaaagttacccacatcatttatggtattttgttgttactgttgtaggctggatttgtacttggtccgggactagaaggggagaaacagccttatctgttaatccgttgcagtggcagaagagctgtatatgtaactatatgcttttttcctcaacttatactggaaaaagaaaaaaaattgcccagagactctttttctaaatggttttggtaaatgtattcttcaaatacaactgcgagtaggaggccatgtcagtggggggtgatcattcttttgtgtgatggtaatgagataatttctgcattacagattttcaggagactctttgtttaaatgaaacttcagagccctcacaaagcctcacaagtctctttgccttattaaaaaaagtttttattaatctcatgtgttttgccatcatcaattgcataaacaaataaaattgttttgagcaatagaactaaggctgtcatttgtttggcatcctgtcctctctcctttttctcaaatacaatttgacaaaatctggctccgagttgctgttgttcccaccattagccatcggctccaagtggccattccctctggtcttggatggaggcaagaggaagtgtgcgcaagacatagccaggcaggttgctgcctgaaggctggcagccgctttcacatgggctggcagggatctgcagccagcaagtgactggcacaggaatttccgttgcgttgcaagaaggaaccaggtaggcctgagggtgtcaagttgctagccaagatcttcaacgtttctttgtatgtatcctttgctaattgaacctggaaaacctaaccatgaaagggatctacagagaaaagtggctagtgctgagttttgaagttttttttttttttttttccccactgtctgctctctaaagcaaccagtatttatttggttaaaaagcagctaattaatctgtttgatcttgatgtggaaatgaaccgtatcgaattccaggtcaaatcacttatccttgtagaatgtttttttaaccttttgaggtgtgtttcatcagattacggactatcagaagtttacttgtcctcaatattccggtctgcatggtgacatggctattgttctaataacagtgcttttaagtataaacctaatattgtctacaaaaagaaaagtcacatttatcaatggactgtgaaaagttgtaaggggattgtgtaacttaattatacaagcagtgtcatatatgatactattcttgaaaaataccttgccatctggtcccatttatctgagatgagatctgttgttatttttctttttctcttcttaagtttcgctaagctgccagcaaatattattttccttattttaaacatgaagaaacaaaggtccagataggccaactaacttatccaaagtagtggtagagccagaacatgaacccaagatggtaccaaagctcctggtattttttttttcaaacttttattttgaaataatcatgaatttttaaggagtggcaaaaaatgtgcagggaagttccatgtatctttcacttagttttgcctcatggtaacatcttgcataactatattttaatataaaaatcaggaatagacatgagtacagtccacggaactcattcagatttgtaataatcactaccataattaaaatatggagtggttctagcaccaaaaggctctcttgtgctagcccattatagccactcccctttcttcctgctatccctaactcctagtaaccacccatctgttctccatctctaaattatttcaatagtgtcatgtaaatgaaatctcacaggatataagtttttgagattggctgttttctcagcctaatttctttgagatccatttgttttgtgtatcaatagcttatttcttatattgctgagcaggatttcatcatatacatgaatcagtgtaacctgttgaaggacatttgatagttctggctttgcttgaacatgacttttagttttttgggataaatgccttctgaggtctgaatgtttgtgttcccccagaatgcataggttaaaacttaacctccaacgtgatggtattaagaggtggggcctttgggggctgattttatcatgaggactcagcccttattaatgggattagtgccatgattaaagagaccagagggacctttttcactccttctaccctgtgtggacacatggaggggtgccatctatgaggaacgggctttcaccaggcattgaatctgctggtgccttgatcttggatttcccagtctccagaaccatgagcaatacatttctatcatctctaaattaccttgtctatggtagtcttgttacagcagcctgaatggactaagacagtacccaagagtacactgctatagcctattattataattgaatgtttcgttttataagaaactgacaaaattttccagagtggttgtactattttatgtttctatcagccatgtacaagtgatcccgattctcttcatccttgtcagcatttggtctgatgtttttaatggtcactgtggccttgatttacatttcttcaatggctagtaatcttgagcatctttcaatgtgcttatttgccttccgtatctcctctttgatgaaatgtccttgtttttcacccattttctaataggattgtttgaattttttttttaactgctgagttttgagagttcattatatattctagacacaaggccttttttggatatgtaatttgcaaatactttcttgtctttccctcctttaacaggttcttctgcagggaaaaagtttttcattttgatgacatccaatttgacaatttttcctcttatggttttggtgtgaagtctaaagacctttgtctactcccagactccaaagatttttttcctttttgttttccctacaagttttatagttttacatggaagtctatgattaattgtgagtaaatttttgtataatgtgtgaggtttaggttgaaaggctcttcttctctttctcctcctccttccctcccctcttcctctccctcctcccttatcttcctttcccacctcctctatcaatgtccagttgctctagcaatattttagaaaatactgttttcctcccttgcatcacttttcacctctgttaaaaatcatctggggccgggcatggtggctcacgcctgtaatcccagcatttgggagaccaaggtgggcagatcacaaggtcaggagttcgagaccagcttgaacaacatggtgaaaccccctctctactaaaaatataaaaattagctgggcgtggtggcacatgcctgtaatcccagctactcaggaggctgaggcaggagaatcccttgaacctgggaggcggaggttgcagtgagccaggatcgcaccattgcactccagcctgggcaacaagatcgaaaccctgtctcaaaaaagaaaattatttgggtatattggtgtgtgtctgtttccaggtcctctgttcctggcttggttgaactgtgtgatcactgtatccctcctcccacaccacattgtcttgattactgtagctacatagtaagtcttaacattgcatcctattcactctaaagtgaattttatctgagatatttaggtaaataaggacccaagagagagatgccagctctccgtaaactagtgcctataaccaagagttatttaggagctttgggtcatctccaacttattctgagaaaatcagtaggaaaaccacaaagtaaatattcagaaaagtgaatatgagttaagtaatttggtttgtaagtctaaagttctgtacagctgtctctgaagcctggattgataatgaagtctagatctttgggtttgtttgggtttgtcagtaatagctattgatgatcaaaaaagccatatgagcaaaaggttttgagaaaaaagttaggttctggattcattttaaaaagttagccactcgtttgtgtattttaagaaatctcatctgctgtactgaagccttatatatgttcctttatcttaagataacatagatagtacaccattttagacttagagaggtggtagaggtcaattcatttaaccatcacattttacaggtaggaaaatcaggacccttttataaatgggctggcacatctgcagattgtcctgggtcactgggaaggtgggggaggccggcaggggctgaccagaatcagcctcaccagtggatactctgtcagccttctcgcctgcctgtaaacctgttttcactctttttcatctggcatggtcctgaagccaagggcagcagtgggcattactattacacagtactacacactatacaaaactatgcctccttccagctccctggaataggaacctctgttcatagacctttgcctggaattagactgaaataggctgtgctcactgggccttgcctgttgtggattttggcttcccacttacaggggcggagctgcctcttgtgcctcccagggactgactttgcatttcccttggctccctctctgtggctttgttcctcattttcatcaccagcctgctactaggactggtccctgctgtggttatgttaacatcttctagggtttacaccccaaccctaagaagtcatgtgaaatcttacagaagagctgctaacaatcaagggcatgaatactgctttccgaatttcactaatattggccagctccttttagagttgccctggaacagagaaatttacagccaactgtaaatcagaaatgtcagtttgggctagggggccatgatccaatagtggagcaagattaatagaataatctatacgtattttaaagtatactcatctataaagaatagaattaaacttttattgttataatattggcctttggttatttttatcaggttttaaaaataaagatgctgcataatagcaaattattactaaacatttatattggccacaactgtcataaatccagagtaatggaaggaattcctatttttgcctttggattttattttatttttttgtcccgaatttgccgttgaaagaatttttgtgaactttccaatgtgcatagtatatatcaagatacaataaattcaaaagaaataaaagagaaacagcataagattaccaaaaaaggagggaaccaggagtaattttgaattttacttttagaaagtttgttttttaatcttatttttgtcagtgactattcttggtatgttatttctgtaatttcttagttgtgttcattattaactgttatatagaactgtcattagaagcaggattgaaccccattggaagtgttttaatttcacatctgaatttgagcaggctgttgaatattggtgggatggaatgtgaaccgactgatcgcttttccaatcctgttattttccagtgtggtttggaaaaaaatctctacatatgaagtcaagaaagcacaatgaagccttctggttaatgaatttagtgagtttcagattttcctctcatggagagtcctggaaaatcacttcagaaaagagtgctgtgggtcacttgtagaagaaactgctttgcatgcatatatgatttagagcattctaaaggctaacatggattctggcccagcctctgatgaatagaatcaaaacctattgattaccagaccaagaattggaaacaaagccatttgatacagcttttaggtttatgactagccagtcagatctctctcagctgctgaatgtagaagttcactggacacatgcgtgtatttaccgaagcctgacaatgtctgacactgttgtgccttgactgtggtagtgatcacctgtaatgcaatttttcataacaattttgttgagatataattcacataccatacaattcacctatttaagcatacagttcagtggtttcatatattgtgtatccatcactacagtcagttttggagcattttcatcacctacaaaactccattcccattagcagttacccctgattcccctacatccccagcactaggccaccagtaatgtaccttctatctttagagagttgcttattctgtctggacatttcagtggaatcatatagtatgtggtattttgtgattgtcctcttaggataatttttttttttttggggggggacagagtctctctctgttacccaggctggagggcagtggtgtgatctcggctcactgcaacctccgcctcccagattcaagcgatttctcctttctcagcctcctgagtagctgggaccacaggcaatgcgccaccatgcccagccagtttctgtatttttagtagagacggggcttcaccctgttggccaggctgttctcaaattcctgacctcaggtgatccacccacttcggcttcccaaagtgttgggattataggcatgagccaccgcgcccggcctcttagcataatttttaagggtacttgtagcatgtgtcagttcttcatttttttattgccagataatattccagcatatggatgtatcacactgtattaatccattcatcaactgataaacatttgggttgtttcccctttttggctattaataccgtggctatgagcatttatgtgcaagtttttgggtgaatatatatttttattactcttgggtatatacctaggagtggaattgctgggccttatggtaactgtatttaaccatttgaggaatggccagactgtttccaaagcagctgtaccactttatcttcccaccagcagtgtatgagggttcccgatttcttcacattcttgtcaacacttgttattacctggttttttttttttttttggtctgtaatacaattttatgtgttttttaattcctttgcattgttgatgtttttcctgccagggatcggcattcacatacttaaggaagtagggtatggttagctatgatatggctctgagctgtaatgaaattctgtgctaggaccagcttgtctatttgtctcttaccttgacttctgatcatagcactaaccaaaccaccatgataccacagaaataattgttttagaagctcaaatctaatcttttaaatcttgagatgtgtcacacatacataagaatgcataaaatatatgtataaggaataattaatagctgggcatggtggttcatgcctgtaattccatcgctttgggaggctgaggcaggaagattgcttgaagccaggagtttgagaccagcctgggcaacgactctgtctatacaaaaatttttttaaaaaaattaactgggcatgatggtgcacacctgtagtcctagctacttgggaggctgagatgagaagattacttgagcccaggagtttgaggctgcagtgagttatggtcgtgccactgcactccagcctgggcaacagagcaagactatatctcatataaggaaaaaaaaaaatagaattataaagcaaacacccatataacccacccacatcatagagtagaaatttacagttctaagtaacagttaataatgaacatgactgaaaatatgttagcattgtaaacattaataatcattaacaaattaaatcactttttgatgattttccttttctttgtatcattttgtttttctttatagttttactgtatgtacaaacacacacacatgcacgcacacatgcatccaacaccgctaccccaaaacatgagcttgaagttgcctgtttttgaacttcacataaatggaaacatactatatgtattcttcagtgacttcttttgcttaacatttcaaagatattgtgggtagctgttcgttcattttttttcttttttgctactgtgtagttttctagcttctgtgttctcctgatgaacctttaggttggttctgatatttgggtattatgagcagggctgctatgaatattcttgtggatatttcaggtctgtaagagtttcttcaaaatagttaccaaggagtagaattactgctttcctagataatgccagagtctttttaaaaatgttgtaatcttttctcccacagcattaccagcctttggtacattcagacttttagcagttttgacagtctgttggttgcttctgtagcagtatctcattgtggtttaaatttaatctcgcttgagttttattattacttttaccttttcacccagtgcatttgcagttatagatttttttattttctcaaagaaaagtggacattgggctacctgaaaatcatatttgggctagtgaaaattcattgagctagtagcattctttaggttattctgactgagaacttgatcacttagatgatgagtactgtcagattatttttgatcctatggttttatctggccttacacatttttgtataataaaatttaaaatttatggaattgcttatttagtttaccaacttgatatgctacaagcaataagtctgtagtttgctcatattgattctaagcccaatatataaattgtcatttatttatggtgaattaagtatttatccctaagaggaatttacaacatctagttcaaagtattctcaatattaggaagtaatacctatatgtgtgtgtgcatgagtgtgtcagagtgtacatgtgggccaaagtgctgaaagatgtggcattttttgccagaggaagaagtttactgaggaaaactcaatattctaaaacttaaaaaaacttaatagtaatgtaaaacaaatcttgcttaatttaatgagaacaaataagattatttaagtgcgaagaaatggggtgaaagcagaattttatttgtatgagattaagaattgaccgaatactcagcatatgacttctatgagagcaaagtttcataatatgtagtgcattctcactggagcttttgctgttttgtttggttgtttgttttttaacttaaaagaaataactacaagtaatatatcatcctgtcaggtgattcgtgtactgtgttagaaagaaaaggtaacaaattactgtgtttatttccagttcctgaatgtagatgaatttaagtttgttatagggggaaatattttctgtctcattgcaagtgttctattatggctttcagttagcaacacgtgctcaccttactcttaagtattatatatttttcaagatatcttaggaatagttatggttttatttgtttgtttggacatagaggttttactctgtggcccaggctggagtgcagtggcacgatcatggctcactgcagtttcaacctcctgggctcaagtaatcctcctgcctcaggctccggagtagctgggactacaggcatgcgccaccatggctgagttttgtatcttttttagagatgggatttcaccatgttgcccaggctggtctcaaacttctgacctcaagcaatcctcccacctcagcctcccaaagtgctaggattacaggtgtgagccaccacatctagccaggaatatttatgttctacctgctgtaagaaaagcctacccaaaagtcaattctgtatgtcaattaatttttttgttgatggagagggagtagtttcaaggaaaagtgaattcagcagattctttactgacactgggaatctaaatgggactgctgaatagctttccatttttttgttttggttgtgtgattgaatatgttttataccaaaatatagtttattgttccatgaatatatttaataattgcaatatcttataatctcactctagattgaattttcatactgtagattgaactttcatactgtactatacagagtagaagtgagttttcatttttaactacatgaaatctcagttctaaggtcaataaatttttcttctgtttcccacaagtaagatcccattatataaaccatctcagaagatgtccacattagagaataatgtttacaagtagttaccaaaatgagaaactgccaggcattatttacttacatgacacgaatgttcactctcttgaattttcctataatattcataataattacattagattcagaaattcaggaatattttaacatacatatgtactaaaaaataccttagttatcagaagggagtgtttcattttgttcttttaacaaatggttgcttttattcttttgagaatatttgtttcctaggtgaatgagagctaatcttttatgcatgaagggcctaaagtgctctgatttatattaataaatatattgacaatttaggaaacatagaatcctttagacctttcctatagagaagaagagtagtctttgcaaatttgctttacattggtgaaaaaagtcatcatttcgaagccactcatttcatcggaattgggaaggccaccatcttatagctgggcttgtgaacctttgacttttcccagtatatattggactattttgatcactgctatatgcttctagttcctcaatcagtatctgccacagaggaggccctctaaattttttgtggaattacttaatgaaatgaatgagtgattattcgccttcacaggattgtgtgagaccatataaggtgtgtagagcggtttgacctcccaccattgaaatgctccttaccattagcatctaaagtgattcacttgagaaatgtgtgtgctctcgtgacagtctgcttgttccagccttgctggaatctagatccacgagaatcctgtgttcatttttctctaaagaataattacgaccatctaaggtaatagctaaagaatcgagacctgtaagaactcttagccaggtacagtggcctgtgcctgtagtcccagctactcaggaggctaaggtgggaggattgcttgaacccaggagtttgaggctgcagtgccctatgattgtgtctgtgaatagccactgcattacagcctgggcaacatagggagaccttgcctctggaaaaacaaacaactcttggtagtctcctaataacctattcaaagagttcagaatttggcgggtgggtggggggaggggggtccatttatctctgttcctcttcatatctttgccagagaagataattttaaaaaagaaaatattgttgtcatttgcttttctacgaaagaagcacatttagatagtgaaggaaaagtgaaaaatgttctttatgccgtttacattgtctcatttaattatcccagtagcactgcaaggttggaatagtgactagcctattttatagataaggaaaccagagctcttaaatattgcgttgtttgtactctagaatatacacttaagggccgggtacattggctcacgcctataatccaagcactttgggaggctgaggcgggcggatcacctgaggtcaggagtttaagaccagtctggccaacatggcgaaaccccatctttattaaaaataaaaaagttagctgggtatgttggtgcacacctgtagtcctagctactcgggaggctgaggcacgagaatcgcttgaacccaggaggcagaggttgcagtgagccaagacggcaccactgcgctccagcctgggcaataaaatgagactgtctcaaaaagaatatagactccaagagggttgcagtttcactggttctgcctggttcacccttgtgtcttcagtataaaccatggtgccctggcacgtggatatactggttggttttacttttgcctaagataacatcgctagttaatggaatctactgagatttgcatgtagtttttatgctttccacagcctatgagctcttttcactgcagtacttttaagttttctaagaccggggtccccaagccctgggccatggatggtacctgtctgtggcatgttaggaaccaggccacacagcaggaggtgagtggcaggcaaacgagcattaccacctgagctctgcctcctgtcagatcagcagtggcattagactctcataggagcacgaaccctattgtgaactgcgcatgtgaaggatctaggttgcgtactccttataagaatctaatgcctgataatctgaggtggaacaatttcatcccaaagccctgccaccgcatcacatccatgggacaaattgtcttccacaaaacctgtccttggtgccaaaaaggttggggaccactgttgtgagatcatttcgagttacacctctctgaaaaagtggacatattccagtggtgtttacctggcagctgttgtaatgctatgatgtaggtcttttctctatacagaacatgctgatgctgatgactgtattctttggcagctcatagtatgagcatataataaatcttatgtatgcactttttaccctcacttttcaaattgttatatttagtcagtgaaagcaactagaaaaaagtaaaactgataccagctgttatacatattgccatatcccagcatgatttgctcctgtaagcctggtggtcacatacagcagtctgcctttcctgctctcctactcatcttataaaaagactctaccagattagccctcttttcttttattctgattcctgctattttgaagttgtgggaaccagagaaggagttcatatttctctaccattctatggcacctttgccctagtaggatggagtagtactgagctgacatgtcagtggtatgctggtgatagcttctatcacatgcgagaactgacagttaaattttcagacattctatgagcggttgttaaacatagtcattgttaaatgttaaaatatacaagcttacaagttaaattatatttaataactgataatatatactcatcacttcctgttatttcaagtgttgctatatatctatgcttttaaagtttctatcatgtctgtgtgatggaaatactgtgctgctgtgtatctttttcttttactttttttttttttttgagatggagtctctgccactcaggctggagtgcagtggcgcgatctcggctcactgcaacctccgcttcccgggttcaagtgattctcctgtctcagcctcccgagtagctgggactacaggcggcgccaccactcccggctaatttttgttatttttgctagagacggggtttcaccatgttggccaggctgatcttgaactcctgacctcagatgatctgcctgcctcggcctcccaaagtgctgggattacaggcgcgagccactgtgcccagcttggctcactgttgtaagagctaagctagattgctcaagtgtttttccctctcctaccttgacataaaagttttgtctgtgtcagacattcgtattttcagccacaccccagagtgcatcactgatgtttgaggttcttcaccagcaagcccacgtcagcactcggtcatgtctgtccaaaaggtgctttgaacccttggaggatgtggaatgccatgtcgacctcagtgccaccaggggcatactcgagcccaccaaaggagcaagtgaaggggttgcctgagcggcgctccggaatgtgctgcagccttctgcagaatgatctttgctgagtgaggcctgcctgtaggagctaactggtatgtttggtagtggaggcatcggacagtgtagtcagtaacaagatactaagataaatgcaggggttaaatgcttcctagagtgatgttttttaagctggctagttttgtttattgcaggaattaggtaactttgttggagagcaaccttgaagagcagtggagatgagtcagacttcctggctacttagccagtatcaagtaattaaaaaccactccatggatggggccacgccggcagagaaaccttcttacagggaatgactttatgatacccacacttttcaaagagtgggctgcattgagctggtctcattgggaagcatgttacctacgagtgagtgagaaaagctgcacaggtgcctagcagttgctctgctcatttcacttccactggatgagttactttgttccccattccaaaagctgactgttcctattcccatttaaacggcactttataaaattctcatgtgtctttacattttatgcttgccacaaagaaggaaattcattgcttgattaaacttaaaataggattttttaaactaagggaacctaaaagccactcttgactccaacatatcaatttaagccactgcagctgcggtttctgtcccgtcctctgctgttttacacagaactggcttctagtggagctcctaacattccaatctattttttttgtttgtttaaatttcgttatctatgttatttaaaaggtatattaaaaatataagcaaagttgttttcttcctcccctctagcttttattgaaaatataaatgtaagcccagaggggaaaattatttcctaattctgtaaagattcctgcaacattttccttccaaggaactggcagtatctcctctgttactctcagttgaatatagaatatttgggattgtggacaggtcatatgtttgtttctctccttcccccgtgttccgctttgcccaagtcaacaagccatggttgccaggaggctcttcttgggccaaagcagataccaggacttcaccttgctgtgacagtggttggggaccaggaagatgagcaagaatgaatttgtaagcaactgaatttgcaagcaatgtattgattgtaaatgaattatttcgtacatccctgtagttgtccccagtctccattccaataggatccctggagctgattgggagagaagaaaaagagatacctgattggtacccctcctagctgttccagtagccaggtgggcttggcagagactatgaaagaggcaagctacaagtggattgagactgtggggaatcttacaaagaaatagggttgtatattgtttcgactccttttgcgtggttgtcttctccaagctgcctagataagtcagcagaagggctcagatgaaacatgttttgtaaatgtaactttcaggtaatgaaacagtaccttcccattattgagctctttttttaaatagctagttttgagttgaaaccaagacaatagatattcattatgcaaacctttgagccacctttatggtattactgtcttagtattgctctaatgttaaatgtcttctctgtttactgtaagataaaacctttgtgttcagtcagaaaataaagggactccttggaggactttgccaggggctgcatgaagatatgtggctgagacctatatacaaaggccttctgtgcagggtctatgtggctctacaaaagtggtaagctgagctgagaggagaagcctacagaaatggaaagtggaggttcctgtgtccattatttcaaactgaagttgctcctttatttagaaaacaaagcaacatgccagacaagtacataaacatttcatgtaattatattaagataggcttggaaagtgctgatggagactttaaaaacacctggttcaaaagcatgtatttatcttctctgaaattaactggtgttttatgtcatttacagtctagtgtgcacacttcttatttagcaaaaaataccacttcattttcattttttccttgttgtagatgtggcacatattactactggaaacttcgatgcccagtatttttttctctattctttttattaaagaatggggtatctttttaaaactctctttgcacactggcatgaacagggaacacagtattggtggagatggggttgggggaggtttagagggaggaattgcattcttttggcattcctgagaggaaaacagctgtattaacttttttttttttttttttggaaagtgcagaggcatctcccctgactctcagaattccagttctttacagctgagcaaaaacagcatggcatattatttatgcctggagtcagcatgcatgaatgttgctgttctgattattagccaagagaaaacagctgtatacattactaataaaaggactttgaaatgaaaaaaaaaaaaatccaatagtggggttttcccctataaacagcagatgtgtacagggttttaccccatgtctgccctgtactttagcaccactgtcctgggaggtaaatggaagccagcatgagaggtggaagtatggtgaaagtagatatgtttgtagcaaaataggtatgctgtggttgactagagacattttaaggtttattattttaagagagcagttgtgcctagccatcattccattcctcctccttcgcctctcataaaaagaaaatattgtgtacctgcaaacatatgctctgctatcagcattcagacacccaaacaccgaaatcatttagcagctcttactgctgtcagtaagcagatgatggcgtaaggggtttagaatttgatatgtgttttctaaagcatctctcaaaataggcattgtctatttcttgtttgttgcttgtgggaaatttttcgtcaagtgtacctgtacctaacccatgactaaaacttacctagatcttaatttctagatttaaaaagaagaaaaaagggatcaagtaaggaacagcgaagtaaagaatatctaagattaaaagtaggaatagctacaattacctagatttcaatttctgggttatttttagtgtgacaaagtaaagagtgtccaaaattacaaatctgagggataattcaaagatccttttttgttgtcattgttcctgggggaatatgtttcctgggggaaggagcatatctgactggtcccagggaagaaatgaagtagaactggtattgaagagatatctttctatgggaatccagcaaaaatactgggttccaagaacttgcttgcctggggaactcccagattctttaaaaaccttacatgtgaaatagcttaacataaatatataggtttagacatactgattgatgtttcagtgcctatttttatatgcatttatatcgctcaggtcatctattttccacttgttctattaagtcatggttttgcaaatggtcaccatttaaatataagggacctattttgcttctttcatattcttcgacatttcctcaatgaaagaataaggaaagtttaggagtgagttacttagggtgtattctactctgaggatttcagttttactatagctgtatttaatcttatattaattgggcacttatattaatttagtgcctgtataatgttggcactgaaatggttctttagtgtgttgtgagaaaatttcaatgaagtcatttatagaaaactgtttttctcaagggaatttccctttccccttttcagaagtcagaggaaaaaaaaactggaattagagtatagagttagagataaagcgaaacgatggcagaatatgctgagacatttgctcaggggttaaaagacagggagtttatagaactcccttttctgcttgtcataaggttatctgttccttcttttggacatctctctagaggtgttcccaagctttgtatcacagattcttttatcgtgggggtcctaaactttaaccatttaaaaataaaaaccaagggttaccaaacaccttaatagagacttctctatgaagttacaagaagtaaacaaccatatggaagaatttgatgtgttctttgaagtcactgcttgtaagagaagacaacgtgtaatttttgagttactgtatgactcacgttggaaatgtttaaagccttctgtaggcatggtgtggtggctcacacctgtaataccagcactttgggaggccgaggcgggaggatcacttgcacttaggagtttgagaccagcctgggcaacataatgagactttgtctctacaaaaaaaaaaaaaaattaaaaaaattaaaaataaaaaaaattagccaggcatagtggtgcatacctgtagtcccagctactcaggaggctgaggtgggaggatctcttgagcctgggatgtcaaggctgtttgagttgtgattgtggcactgtgttcctgcttgggcaacagagcaagaccctgtctgggggaggggtggggcgcggggtgggaagcctcccgatgtcctaggaatagaaggcttttgctgttgcaggagtactgaaatggaatagtaggagctgccagtgaaactcattcagtgttgatgtagcatgttttaagaatgtgttatttacggggaaaactctcgagttcgtcagcgaactgagaatccattcatgggtgcagaaaaagatgcccattgcgggaaatgtgtctgtactctgtggcacctccttaggtgggaggaatgtggtgggggctgtgaagactgtgccactttcacacctctgcatgcagaatgactctcattctcttttaccaaagagcgaattcattattgaacctgttaggatccaaggcattcaagcatatttggggaagactactcttgttctctagagagacaggtctaaatgattaagtttccaaatactgagcttattccagaaataatttggtttctgcatgctttgttttctacagcatggtgagactgccacttagttagactgagtcttgtgaattgaagcctgtttacaagaagtctgacatacacactattatttttagcctgaacaacatgaaaaccatctatttaaaactcccaaatctgaatgacagtctcatcttgcttaaaattccttctagtactttttaagccaacagaaaggaacatataaacaatttgttaattgcaacagctggtccctgagtatctttatgttaatgtttggaatctttgaatttgaaagacttttagaaagagcatctggattaatgtagtgctattcagacttcagtcttgagaagtggaatcgacctcatcaagacaaacaaacaggggccttatacagattgggagggcgacagcaaaggcatggtgaaatttctttaaaaatcttagtagagaatgaagacaaatggtctcggtttggttgtgggtgaatagcctcttatttaatttagtatgatgtttatctagctgctgtggtaaatgaggtgaaatcttttgtgtatacagttaattcccaattattcatacatgctttagccaaattgctgattctctgtggactttggagaccttccccccgccacccccccccccccaatacaatttgctgtccatccggtcccatgtcctagtttcctctctggccatgctttctcacaggggttcccagttgctctcctcatttccatctttgctccctgaccaggcccctgctgcttttgctttctcgctgcttttgctttctctgctgcattccctggatttgtctgacagtccagggttcttgtctccttgccgttgtctctctcagtcatctcagagtggtaatagagaagctagttgatggccagggaaaagctacagagagctaatgtctgctgctccttgcttctcttcctgtcacctttgggcctttgttgaatgaacaagtggagagtaagtagagaaaggggtttcctgaaacatttccagcctgttcttttaagtgctttttttcctcaggattttatagtcctatacgtggtaggtaggcggatgggcgggtggtgggggaggtattacagcaaaatgcttacatattcttttcacctcttgttttcttttttgttctcaactgggacctactattctcctccccattgctgaaaggcaaattcttagaaaggggccatttagagtatgtgtagctgaagaacctcaaatagttcttcatttagcaaatatttaatttcttgagttctttttatgttttgaatattcttagagatacgaaaatgaatttgatgtagattctgcccttaaaggggtttaagtaaaatctagaagcagaatttacacagacaaccacacagaaaaccctaaatctaaagccgatatgtaaacacatgattaccatagtaagtgagaaccttgtaccgcgttggagaagtgtgaagggtctccccagaagacattgtttttcctggggaggggatcacagtagtacagatgtgaaaaatctgccctaatattttttgtttgcactatgtggatggaaatgaaaacttacctgtaacaaacagttttatctatagaatgttttataagcctatttttgttccttttctattatatgtctacacagaatataaatttaccccatcaggtgaaagctcagcataggtgtgcaagccccacttggctaaaatattggttagagcaataaaatcctgtgttccattcccaaaccagttccaagccaggtaatgggttgaaaaggcctttgattagttggatttcctataaaccaactctgaagtacgcatgcattgattgaattaatagaagagcccttcattcccttgccagagcctggtgttgcttaatcttttagtagttccactaaagcttttggtttctaagcccaaatgagattacaaccagcaaattttaaagaagtggagctaagagagacgagtatagtaataacaagtctgaaaaactgcaagaggacacaagaattctgagtgagcctggtagtttctagtgagatttccatttaaagttttgatagttaaccttccatggactatctcagatcattctttggattcataaagtatttttgttagtttccttgccatagccaaataaaaataatctctgaattgagttaggaaatttagttcctgctacaactgcagatttcatgtacaggaagaggaaggggtgggcaattacagaggattagggaacatccctttagagttcttcctgggatgacaatggtcgaatgagataatgtgagagtgctttgcagttggaaagtgctgtaggaaccctgaattcatctgaaactgtagcttagtgtttaaatgatgtctgttattacttttttgaatagtctggagtgcttgttaaagaaaaaattattctgtgatatttgttgaatgaagcacagtgaggaagactttactcagggcccttgtaatagctatagggaccactgcaatagggtcttgcagtgggggagagagaataggctcaattctgaatacatcatcatgggcaagtgggaatttatagccaaggagcagtgtggggatcagtggatggaaaattactaagacaaaacctaaggggtaagggggcttctgactcaattgccctaataagattcttggtgaagacaggccagggtgttgagacattacctggggagatggtggaggatgaggaacttgatcagatattggagatgatcagaaattgaggatggagggttctgaaactgacttaacaggattctttgctaaaaccagattctacaaggaaatacacatatgggcctagcggaagatacagaaccctaactgaagtttggctgaccaaaaagaatctttgttactgttaagtattcggattcctgggcctaatgccaggtctactgaatcaagatctctgaagacaaagatgtcagaatctacattttaacagactccttgggcacttcttttacccattacgttagagctgcttagatagaagttgcaacttttttggagtctgagtttgtagttgtaaaactttgctttttgatagaaggtgagtatgaatgtggtagctcaatcagagtgggccacattgtaactaagtgaagggattctcaaacatctgtcttggagatagagatggaaagattcatgtcttgaaagcttatactgtattatatttaatttccttatatgataaaatttaccaaatagctctgaggaaggaatcatttttaccaccatctttttttttttttttttttttgcacaggggcaaattgaagcttagaaaggaactttttcttttcttttataaaattttactttaagttccaggatacatgtgcagaacgtgcaggtttattacataggtaaatgtgtactatggtggtttgctgcaccttaacccatcgcctaggtattaagccctgcatgcattagttatttgtcctgatgctctccctcccctcacccctgtccctgacaggccccagtgtgtgttgttcccctccctgtgtccttgtgttctcattgttcaactcccacttatgagtgagaacatgcagtgttcggttgtctgttcctctgttagtttgctgaggatgatgcttccagcttcatccatgtccctgcagaggacgtgatctcatttctttttgtggctgcatagtattccatggtgtctgtgtaccacatttagaaaggaactttcttaggaccatacaactggttgtggaaggagcagaaattgaacactggcctgtctgggtctgaagcccaagctctcagcctccatgcactctgaattgcctagtgctgatggccacagtcatcagggaatagaggttaagggaggagaggcaggcagaggctaaagtgtcactccagctgtgggctaaaggatgctgacctgtggacattagcccaaaccccagcaaacccattaggcatgatacactactatgtaaatttaaggcctaggagacatttgtagcaagctggttgctgtcaccgagagctcatatattgactttgtcaagcaagagtgagaagagaagatcacatgttttacttaacattgcctgtaaacttttcacaagacttttcaaatcaatacttatgctttttctttccatattgtaagacactcagactggtaagtgaagggactttaaagcttggcattggtttagggctgtagctatgggggtagcaggaaaagatgggaggagggaaaagcgaaagagctggacacatgtggacactcagccggggcatccctgggaccccacattcttgagattttattatgtcttgagaccaaatatatgtggagggagtgatggtaaaggtgataaaagtgcaagttataatagaatttcatagatagggaaaattgaaagaaggataatatagtttatgggtaaaaagcctgtgccacattctgagagcttcagggtctttttcttccacactacccccttcagcgcctccacatacccagggggtaagctctagtatttttgattttcatatttctgccttgtgattaaatatgaataccatattgactagaaaattggtttgtctttaaattatggttttgaaaaggtttactctcttttgctattccatagaggttagtaggccatagggcccctttatcttatttatttatttatttgttcatttatttagggacagagtcttgctttattgcccaggctggagtgcggtggtgcaatcttagcccactgcaaagtccgcctcccaggttcaagcgattctcctgcctcagcctcccgaatagctgggattacaggcacgcgccaccatgcctggctaatgtttgtatttttagtagagacgggttttcaccatgttggccaggctggtctcgaactcctgacctcaggtgatctgcccgccttggcctcccaaagtgctgagattacaggtttgagctgccgtgcctggccgggcctgtttataactattatgctcaaggtaaatgtagaatgtagaaattaaggtgaataaaacattcatattaaaagcaaaacattaattttgtatgttcaggatatatggtatgagctgggacacctgggctttgagccacaacttcactgtctacaacacacacaaacttcctccctcccccactgtatcccctcccccaccacctccgacctccaccccaactgtaaaagttgaagctgagcatggtggctcccggctgtaattccaatacttcgataagttaaggtgggaggaccacttgagcccaggagtttgatgttagcctgggcaacatggcaagactccgtctctacaaaaaatacaaaaagttagctgggcatggtggcgactgcctgtagactgagctacttgggatgctgaggtaggaggatcatttgagcccagatgacatcactgcactccagcccaggcaacagagtgaggccctgtctccaaaaaaaaaaaaaaaaaaaaaaaaaaagagtgtaaacaggtaattttactgggccttagtttcgtttcttcatctctctgatgaggggtgtggctgaatgacctctttggggtttttacatttcacagttgtcaatcataattttctgtgaccctgaccaagcctcactctgacctaatgactcatacaaacatttctcttcttctcttcatgtttgcgtattttgattgcacatgtaccttggacttagtggggtcactggcaaagcaagtgtattttctgaaatacaccagagaagtgggtgtgcacagtgttttcccttgggtcgagccatgcttctgctgtccttccagctggaatctgtcagatgtggactgtggatctcctgagtgcttagtaaaaatgcagaatcctgggccccttgcagacctgttgagggggagtctctggaagtaaggctctgggctctgcattttaataagcccctaagtgatccccaggctcactactgtttgagaacatgaatgattctcctctaagtatgcactgtggtctttagatagaacccatggttccctcaaggcaggggtcatgctgtgtgtgtgtttataaatgaaacttctcaggataaattgtgatcatctagtttattcactcatgaaacaaatacttgcatccttcttttatacaaagtcctgtgttagttgtgggaatggagagaagagaatgtatctaaggaggcagagcagacagattttggcaactgattagatatgagggatgtgggagaggtcaaagttagctagcgggtttgatccggagtgtggaactctagttgtgccagtacagaaatgggcagacagtcattggaacagttttgagaagaaagatgcccatataggaaagagcccatagaatggttataaaatatgcctggatttgtggaaccagttctaaagctggcattactttcagattcttagtatcttagaggtgggtgtgatcttgtagatcctgtttcagtctcctcagaagcgggaaaaattggtatcatttggaggctattgtttaggttggggcaaaaaaatataatggggggagacattatatataaaggtgatatttacttcttagacttgagagaagctggctttcttaataatctctaactgattttgaacctctattagaataagccctggaaataatattggaaatgatataggcattctaagtagatatattctaagatgacagcctggtgtggtggctcatgcctgtaatccctgtactttgggaggccgaggcaggtggatggatctcttgagcccagcagttcgagaccagcctggataccacgatgaaaccctgtctctaccaaaaatacaaaaattggctgggtgtggtggcgtgtggtcccagctactcaggaggctgaggtgggaggatcactggaacctgggaagtcaagggtgcagtgagctatgattacaccactgtactccagagctgggtgccagagtgagactctgtctccaaaaaaaaaaaaaaaaaaacaaaaaaaaacacctttagaatttactgtcttgtggtcaagtagaatgttggcccgtcttcttcaaagacagcctttctctcctgatttcccttaaactaaggaggagggaagtaattaagattttcagtgggaagccaggcgtggtggctcatgcctgtaatcccggcactttgggaagcctaggtgggcatatcacgaggtcacaagattgagacctgcctgaccaacatggtgaaaccccatctctactaaaaatacaaaaattagctaggtgtggtggcacacacctgtagtgccagctacttgggaggctgaggctggagaattgcttgaacccaggaagcagaggttgcagtgagccgagatcacgccactgcactccagcctggtgacagagcaagactccatctcaaaaaaaaaaaaaaaaaaaaaaaagattttcagtgggagcacagactgctgctcactcactgagtggatttcattatgtagtctcagtgtttcccagactgcttgacaaatgaaggatgtacgttattgctttttccttactttggcctgagaatgatgcaaagcaggcctgttgcattaccaagcatcttgggatgctgcactgagtaataggcttttagtatgtgttaccttgtcaacagcagtgactgctatgcccaggacatcagcattgagttgtttttgcacttgtgggggtgacttcctattgtcctaccagaatcagcaaggtaagttgggagaaatcctttgtcagcaggatgagaagcagcaagtgaaggctgggctcagtggaggagaacaattctaggagctggcgtggtcacaggaaggatagagaacacggaggtcaggaggaagcatgagtcaggctggtggctgtccggggtcttctcacattagcagctggagagccagggctgaaggttgagtcgtaagtggccagccttgtgaatgtggtatgctagacaccaacagaacttcctggagctgggagtttcctggggtcttcctgatgtgtaagaactgatgatcaggaccttacaggttatgtgtctattttggttgtccgctctgacagggcagtggtgttgtggtagatacacttttgctggaggcatttgctaggtgagtgggcaagatgtgatttgtattgggtgtaatactcaatccagcagtgcttctctgctgcagtcaagtccagactgcaagaacctgttaaacgcagggaattccaacatagaatcttaagaagtttctctactttgaatgtatcctccatgtttttcgtgtcgacagaagtaaaagtgcagtgatacatgagtaaattttcagctctcttatcataggatttgtttaatttggtaccaggatgtaatgaacttgaggtgtgtgaatgagaaatggagatgaagtgttttattagtttagaaaagggagtaaaaggaactctgagtgtaggcacgaagctttcagctctgaaacttcacctttttgccacactagcagcagagaaattacggaaagctgattgtgttgtctatttggcaagtcaaagcaagatacagcaagctaaaagatgagtcttctagattgctttcaccttctgtgacatgaaatttctaaaaataagaaataaggagcccctgggcagttgctctttagaatttgtgtggacagatccaggtcatccttgttcttctttgtgttttttatgaagtgagactttctgattagtgagccagaaatttaatctgacagcttttaagtttgatgatttaaaaacacaattggttataaaaattttaaatttataatttccagtaaagtaggaaatgaaaattacccttttgctcccaatttcacttccagaggtttatatttaccatgtactaaaacctatcatttctcatctactttataaatgtatgaaaaactctgattttatacctcttttgctgtgtgtcattaacatgatttgcttaacttaattttatgtccagtatggctcttgagagagggaactgtgtcagaatgtgtgtatcattttaacccatttctggttgttgttggaaacacagttaagttgcttactggtcttactgctggtttgctttataagaaaattcaatccgttttgtcttcaggtaacactacatttctttcagtcttctgagacatttcatggtttcacttatccaggtgttgctaatcttacatagcagtttatatgccttgtctattcttcttaactaagataacctgttgaagtattattaaattcaactatattataaaattattaaactgtaggcgggatgtgttttcttcctttctcacgtagcttcccttccactctggaaatggaaggtttgacatcccatcatttgataggtctgatgactttccagtattttaagcagtaatattgagactagggcttcttgttcctcctatccttaagttttggcataatgatttgcattaatattacta

SEQ ID NO: 161 - DNA, 283260 bp, Homo sapiens
gggggggggcggcggccgaacgatgtgcgagaactgcgcagacctggtggaggtgttaaatgaaagtaagtagccgcggtagcggcctgtcggggtgcacggtttggggtcctcgcgcagctctctggcctccccgggctgccgcggcctgcgggaggcgacggccgggccgggcggcgtgcgggcctagcgccccgggaaggtgcgcggtggcgcggccgccgcggcgcctcgggcccagcccggccgggttacctgggcgcccgagaggcggccgccgcggagctccggctcggcctggcccgggcgctctgggctctcggaaagtttcctcattacaggtgtcaattaatgaaggcagtaatgaacccctcgccgccttcgcctccttcgccctgccgggaaggtgcggggaggtggggtcggaggacgaggctttcctccgcagtccaaatcctccggccgccctctttgatttccagcgtgctgccgaggcctctcttacctgctaattttcattaaactcccgggagcagggtggtggtttttccctcccttgcgggtttgtgggtgtcttaaacacttcagccagaccttaaatagctgaaaacgaactgtgatagtgatgattggaaccttcatacctatttttaaaataaatttgttaatgatgtttcttagtgtagcattcaccgctttaatggtacattctgttaagcagagcactgtactacacataccatcccgggatagttatggcctatctctcttggaaggaaaggccttttacctggtactttactttttattattaaaaagggtacgttgatcttttctggcctttttattttattctcgacccttgcaagatggtatttcagcttatagaagatatattgcaaatcaactacttctgggcgtaaaggcctagttggcagaggtgaattagatgaagggatcaatttacaaaaagttgattgttgaaaaaatgctcacttatgaacagtttatgtgggttttggatttgtattctgtttgtgatatttccacagactttcagactatctaattttgtaatacaattcgctaaaacagttgatttataaaatgtaccatggtatttgtgtttgactgtcactttaatgaccaaagacaataataaaagtggaagggttctaacttaatttcaactccgtatttacttcctgataggtggaataggcttttgcacatattccaactagaggttccagtatttgtgtcaccctaaattatcctagaattttaagattatttgtgtgtattttgagatacttttatttctggcgcaggcggtttacgatatgataaacttaaatcctcaatacttactgtgttttatatctcacatacaagtcgtgtgattatgattgttacgctcaacttggaaagttaatcgttttgcaatgtaatatgaggaacaagtacttaattttgttggtgattttaaatatcttttttttttcttgagacagagttttgctcttgttgcccaagctggagggcaatggcatgatctcggctcactgcaaactctgcctcccaggttcaagcgattctcctgcctcagcctcccaagtagctggaaatgtaggttccccacaccatgcccggctgatttttgtatttttggtagagacggggtttcaccatgttggtcaggctggtcttgagctcctgaccttgtgatccgcctgcctcggcctcccaaagtgctgggattacaggcgtgagccactgcgcctggctgattttaaaatatcttaaacttggaaaattttaaacaaaacatctaaagaaagtaaagttggtttatcttttgaaaagaggtggcatcttgatcataatgaaaggtcttatttaagattatctgggaaacccctagaactttggttagaagcactgaaaaatgcagtgcatttatggagtgttagaaatgtggagaattgaaatagaatttagcttttattacctttaagcaaatacagttagttcaaccagcttctcaaaatctggtcatgtgcaccctctaagaaacctgttctaatgaacaagtaaggattttctatttgtgtgtaagccagtggactctaaaaatacttagtttcttaatattgcctttgaggctcaatttaaaagtttaactcttaaacaataatctcacagtgatgcttcctttttaaaaaaatttacggccaggcgcagtggctcacgcctgtaatcccaacactttgcgaggccaaggttggcggatcacctgaggttgggagttcaagaccagcctgactaacatggagaaaccccgtctctactcaaaatacaaaattagctgagcgtggtggcacatgcttgtaatcccagctactggggaggctgaccaggagaattgcttgaacccggaggcggaggttgcagtgagccgagattgtgccattgcactccagcctgggcaacaagagcgaaactttgtctcaaaaaacattttttttacttcaacaattacatgtgtagtttataccacactattaaaagttgtttttttttctgtagttctttgcttatccgtggctatgatggagcatgataatgaacatgagtggttggagcttgataaaacttgttgaagtagattatatgtgtttcttgtgatctcatttgcagtaattacctataaagtctgcccttttcccgcctgtaccttgtacaaagatgagcatcagttcaacgttgatttagaaattcagagttggccgggcaactctgaatacagctcacgcctgtattcccaacactttgggaggccgaggtgggcggatcacaaggtcaggagctcgagaccagcctggccaatatggtgaaaccccatctctactaaaaattcaccaattagccgggtgtggtggtgtaggcatctgtagtcccagctacttgggaggctgaggcaggagaattgcttgaaccctggtaggcggaggttgcagtgagccgagatcatgccactgcactccagcctcggccacagaacaagactccatctcaaaaaaaaaaaaaaaaaaaacaaagttacagtcctcccaaaatgtgctcagaattcatctttaaatacgacaccctgtaacagtttagccagctgagagaagcaataaaattgtgcatatttttgggtggtgtgtttccaggtcatgctgaaaaatacgtaattagtattaaagcaacctcacaaaacagtcagacgtggtggtgcgcccctgtaatcccgcctcggcaggaggctgaggcaggaggattgtttgaggccaggagttcgagaccagcgtgggcaacatagtaagactgctttttttattattattatttttttattttttatttggagacagaatctcgctgtgtcacccaggctggagtgcagtggcacggtttcggctcactacaacctctgcctccctgggttcagcaattctcctgcctcagcctcccaagtggctgggattacaggcacacgtcaccatgcccagctaatttttgtatttttagtagaaacggggtttcaccatattggccaggctggtctgaactccttaccgtgtgatctacccgcttccgtctcccaaaatgctaggattacaggcgtgagccaccgcgcctggccaagactgctgtcttgaaaaaacaaaccaaaaacactgtttcttgtgaaattaacaaacagtgatcacacttagagaaggctacctgggcaaacgagtgtaataaatttttttttttttttttgacacggagtctaactctcacccaggctggaatgcagtgtcggctagctgcaacctccacctcccggattcaagtgattcttctgcctcagcctcctgagtaactgagactacaggcacccgcctccttgcctggctaatttttgtatttttagtagaggtgggattttgccatgttggccaggcttgtctcaaactcctgacctcaggggatctgcctgcctgtacctcccaaagtgctgcaattacaggagtgagccagcatgcctggcctaaaaattttgtttaaaaaatttttagttgataaataataattttacatattcatggtgtacatagtgatgtttcaatacataaaacgtatagtgatcagttgaagttaattagtatatccatctcaaacatttagcatttgctttgggaacattcagtatcctcctagctatttgaaactgtatcatatattattgtttttttgagatagggtttctttcccattgcccaggctggagtgcagtggtatgctcttgggtcactacagcctccgcttcctgggcttaagcaatcctcctgccacatcctcccaagtagctgggactacaggcatgtgccaccaagcccggctaatttttgtatttttagtagagatggggtttcaccacgttggccaggctggtcttgaactcttgaactcaagtgatctgcccgccttggcctcccaaagtgctgggattataggcatgagccaccatgcccggcttgtatcatatattattgttaaccgtagtcattctgtagtagtacttattccttctatctcactgtaattttatattctttaacaaatctctccctatccctcccctccctctaccattcccagcaaattttgttgtgtttttgtttattttattttatttttttttgagacagagtcttgttctgtcacccaggctggagtgcagtggcgccatctctgctcactgcaagctccgcctcccgggttcacgccattctcctgactcagcttcccgaggagctggaactacaggcgcccgctaccacgcccggctaattttttgtatatttagtagagatggggtttcaccatgttggccaggatggtctcgatctcttgacctcgtgatccacctgcctcggcctcccaaagtgctggcattacaggcgtgagccaccgtgcctagccgtgtttttgtttattaatagagacagggccttgcattgttgcccaggctggtctcaaactcctggtctgaagccattctcctgcctcagcctccccaagtactggaattacaggcatgagctaccatgcctggccagttaattgtgttttaaatgaaagggtagacacaagtgtgggtagtatagctttgtattagatatgcacagactttttgataagagtaaggacttaatgtggaatgtttaaagtttggcagaatgcagtatcgttaaaagtaacagattatgaacagttcgttttgtcatcagtttttggtgagagtattaatattattagttatacctctagtcctgagaatctgaagctgtaaactttcactgtggaaacatgcagaggcatacagacacagaattgtgcttacaggttgaggacccgttgaagtttgttcctggaaccagactaaggatcctatcataagtacccttgccccaccacacccaccctttttaaatataatcttgacacatatcataaaagttgaaactacatttcaaaatcatatttggctttagtgttagaataaccaatcccaacaatactaaaatactggacttgccattttcttttcatgcttcattttaaaaacatttaaaaagcttggatgtattgagtaaattttgctgttatcattttgtgggattacattctgtttaggataaattttaaatttctgttcctctgcttgttctgttgagtttgtctgataactgcttttgtagttacttttgtgaaccagtttacaaaggccaaagcatttctagatcttggtgaggagttggaggcttaaaattacatgctttaggccatcaccatagcaaactcactagtaaactgaggttatttacctcgtaaggtaaatttctctgaaagcagagtgaaaattacatagtacctctttttttttttttttttttttttgagacggagtctcgctctttcgcccaggctggagtgcagtggtgcgatcttgggctcactgcaacctccgcctcctgggactacaggcgtgagccaccacgcctggtgtacgtcattgttttaaaccacttatgtgttgtagattttactctgtgtattcgtttggtgggttatagtttaccaagttgtccaaaatggataattcatgtgagataggcaagagcaagtgttgtatcccaataccatttggtgaaaaagttgaacttcagaaaggataagtagtttgccaagatcacctgtcaacctgcatagtcaaatttgagatggaactcagctactccaatatctgtatttgcagaataattctgttgtgtttattttgttggtggtggtgtttttgagacggagtctcactctgttgcccaggctgcagtgcaatggcacgatctcagctcactgcaacttccacctccttgcttcaagtgattctcctgcctcatcctcctgagtagctggaattagaggcgcctgccaccacgcccagctaatgtttgtatttttagtcgagactaattttcaccagtttggccacactggtcttgaactaatgatgtcaggtgatccacctgcctcggcctttcagtgtgttttatttttaaagcagattactttattgaatagtttgtgttgggtacttaagtactttacatgctttgcatgctgctgatttaatcagttctttgagggaggtactctgtcatccttttcagatgagggaactaaggtttagagaatttatgtgacttgcttagggtcacatgtgactgtttggtggaaccacaggacttaatcccagattaggctaagagttttttttttttttgaaaaggaattttgttcctgttgcccaggctggtgtgcaatggcatgatctcggctcattgcaacctccgcctcctgggttcaagcgattctcctgcctcagcctcctgagtagctgggattacaggcatgcaccaccatgcctggctaatttttgtaattttagtcgatgtggggtttcaccatgttggccaggatggtcttgaattcctgaccccaggtaatccgcctcccttggcctcccaaagtgttgggtttaggggtgtgagccatcctgcctggcctaaaagttcttactagttaacattgtataaattttatgatgatctatctgaatcaccactgttcagttggcaaagtgaaaattactgaccgtgttttatgtatcttcaaaaattcagacaaatttctgtgataattgtagtaggaattcaaaagtggtaataagtatagctgaataagaatctttttcattgaataaaatttcaaattttttgatttttgattattttttaagagacagtgtatcacccatgctggggtgcagtggcccaattatagctcactgcagcctcaagctcctgggctcaagtgatgctcctgcctcagcctcccaaagtgttggggtatgctgtacccggctgagaatctttcttaatactgttattctgcagtgaaccgtttaataaaactacatgtttccagagctttttagatactatgagtatataggtacgaaatcaattagtaacataactttttcagtagacatttaatctaaagttggaatttttttcccccctttggagatggagtcttattctgtcatccaggctggagtgcaatgaagtgattattgcttactataacttgacctcctgggctcaagtgattttcctgtctcaccctcctgagtagcagggactataggtgtgtataccagcacacctggctgcctttttttttttttttttgggaaacagtttccctctgtctcccaggctggagtgcattggtacagtctcggctcactgcaccctctgccttggggggctcaagcagttcttgtgcctcaccctcccaagtagctgggattataggcatgtgccatcatgccgggctaatttttgtatatttagtagagatggggtttcgccatgttggtcaggctggtctcaaactcctggcctcaagtgatccgcttgcctcagcctcccagagtgctgggattacagggtgtgagctactttgtccggttctcctgaattgattttttttttttttttggagacggagtcttactctgtggcccaggctggagtgcagtggcatgatcttggctcacttcaacctcctcttcctgggttcaagcaattctcctgcctcagcttcccaagtagctgggattacaggtgcgtaccaccatgcccagctaatatttgtgttttttgtaggaatggggcttcactgttttgcccaggctgttctcaaactcctagcctcaagtgattcacccacctcggcctcccaaactgctgggattacaggcatgagccaccacgcctggctgattttcttttttttttttttccccctgagatggagtcttgttctgttgccccaggctggagtgcgatggcctgatcttggctcactgcaacctccgcctcccgggttcaagcgattttcctgcctcaacctcctgggtagctgtgattacaggcaactgccaccatgcctgactaatttttgttacgtttagtagagatgaggtttcaccatgttggccaggctggtcttgaactcctgacctcatgatctgcccacctcggccccctaaaatgctgtgactacaggtgtgagccaccgcgtctggctgaaaacatgtttttgtataagatttcattttatataaaatttaatatatctgtttccagttctcccatattatgaataatgccgcaaatgtacatctttctacttaaatcttttatctacatccctggttcttttagatttctagacgtgagtttactgtgtcaaaaaatataaacatttttcattattttcatactgtttgcttgccagaaaggatatattgatcttttagtcgtagtcgtgcctgtgtaagggcactttcacctgtcttgaatattatcctttagaaagtgttattttagcagggcatggtgatgtgtgcctgtagtattcccagctactcaggaggctgaggtgggaggatcacttgagccctggaattcaaggctagcctgggcaacatagcaagacttcatctcttaaaataaaagttattttggtagagaatgtattaagcaattactagtaaatttaaccattcatatttttgttatttaatgaattgtatgtttttttttctgtatttcagatttcagtgttttgggtttttttttttatttttttgaggcggaatttcgctcttgttcactagggtggagtgcaatggtgccatctcggctcactgcaacctctgcctcccaggttcaagtgattctcctgcctcagactcccgagtagctgggattacaggggcctgccaccatgcctggctaattcttttgcatttttagtagagacagggtttcatcctgttggccaggctggtcttgaactcctgagctcaagtcatccacctgcctcagcctcccaaaatgctgagattacagttgtgagccaccctgcccggcccctcttaccttctttcaaaattcaaagctcgctttttttctaacttgtaagttttattaataagaatgaaataacaacaacaacaaaaagctcacctttacctgttttttttttctttttttttttttgagatggagtctcgccctgttgccagggtggagtgcagtggcgcgatcttggcttcctggacctccacctcccaggttcaagtgattgtcctgcctcagcctctcgagtacctgggactacaggcgtgcgtcactatgcccagctaatttttatgtttttagtagagacagagtttctccatgttggccaggatggtctcgatctcctgaactcgtgatccacttgcctcggcctcccaaagtactgggattacaggcatgagctgccacacccggccttctacctgttttatgaatcgaaattctatgtaagatttcttttgaggagaaaaagggtatacagtattccccccttatccaagtggaatgtgttctgagacttccagtggatacctcaaaccacagatagtgctgtaccctatatactgttttttttctcattattttaagaactttcaccttttcacttcaaataagcttttctttggcatatctgaattactagtatcgctgctcttgcactttggggccattattgggtaaagtaagggttacttgaatacaagcattgtgtagtgccacagtggatctgataaccaggacagctacttagtgacttaatgggtaggttgcatgtgcagcctggatatgctggacaaaaggatgattcacatcctagacgggacggcacaagatttcatcatgccactcggaatggcaatttaaaacttatgaattgtttatttctggaattttccatttaatatttttggaccatagtgactgtggttaactatggaaagcaaaaccaaagataataagggagactattgtaatttcttaataagcttggaaactaagtaatatgtgggtgctcaaaaaaagccaacataaaactgttttcaagtatcttttttctgagatggagtcttgctctgtcgctcaggctggagtgcagtggtgcgatctcggctcactgcaagttctgcttcctgggttgacgccattctcctccctcagccacccgagtggctgggactacaggcgtccgccaccatgtccagctaatttttttgtatttttagtagagatggggttttaccgtgttaatcaggatggtcttgatctcctgacctcaggtgatctgcccaccttggcctcccaaagtgctacgattacaggtgtgagtcactgtgcctggcctttttttttttttggctctgtagcccaggctggagtgcagtggcttaatatcagctcactgcagccttcgcctcccgggttcaagcgattctcctgcctcagcctcctgagtagctgggattacaggtgcctgccaccacgctcggctaattcttttgtatttttagtagagacggggtttcaccgtgttggccaggctggtttcgaactcttgacctgaagtgatccgcccgtcttggcctcccaaactgctaggattatgggtgtgagccaccgtgcctggcctgttttcaagtatcttaattgtgcccaaattttaggaggtggtgtcatgcttatgaagttggaatactatgatgaattatatttaacacagtgatgataatacacttctgtagctatttgaacactgaaatttcttatacagtgttttccttgaaggtacttcctttgtaagagtcatgagaaatagaaagatttgtctaaggtcacacagcaaagaagtagcaggggtaggactagaatttagttgtgcttatttcttctctgtacttttcactaaccaagctatctttttttatttttattttttaatttttaagaggaccctgactgtggaagttgggaaactcataagaaaccattaaaggaactgtggagagatttatttgggctaaagtggattaggcaagatttgtttttattttttcccgagatggagtcttgatttgtcacccaggttggattgcagtggcgcagtctcggctcactgcaacttccacctcccgggttcaagcaattctcctgcctcagcctcccaagtagctgggattgtaggcgcccaccactgtgcccggctcatttttgtaaatttagtaggaatggggtttcaccatgttgaccaggctggtcttgaactcctgacctcaccatccacctgccttggcctcccaaagtgctgggattacaggcgtgagccactgtgccccgccaagattttaaggaagatggaagattcaagtgggccctgtttgaaatagttgctgggaatgagaggagtgaaatatggcctaccttgacttgtgaaggctctgcatgacttagcctctgctagcttcattcccttgttctctttgcctttttttttttttttttcctttttgccttctttcattgatgacactgagcctttatacatacctttttttttttttttctgagacagtttcactcttgttgcccaggctggagtgcaatggtgtgatcttggctcactgcaacctctgcttcctgggttcaaatgattctcctgcctcagcctcccgagtagctgggattacaggcacccgccaccacgcccggctaatttttgtatttttagtagagacagggtttcaccatgttggccaggcttctcttgaactcctgacctcaggtgatttgcctgcctctgcctcccaaagtgctgggattacaggtgtgaacccccgtgcctggcctgtatataccttcttatgcttttaagttttgactgaaatgatttttttcgagaagtctttcctgaactccaagtctgaagtagctctggttctttttattcatagcatttaccacaatttagaattatgtatttctatgtttacaactgtaatttttttattctatgagactatcagttctatgattgcaactgttactactgttttacagtgcctgcatgtggtaggatcagtgtttatttaaaatatctgaaaaatcgtaagatcactgtgggttgataatagaagggaaaacaagggtaggctagatgtggtgtttcctgttttctcggatatatcaagtactgtcagtccttgcttttgtgatgtcttgcttgccaccctcttcataaaatggtactttttgttgttgctgctgctgtttgtttttggagacagggtctcactctgtcactcaggctggagtacagtgatatgatcctagctcactgcagccttgacctcctgggctcaaaagagcctcccaagtagctgggactacaggtgctcatgatgacacccaacttgcttgcttatttatttgggaatgggtttcactatatttcccaagctgctcttgaacttctggcctcaagtgattctcccgcctcagcctcccaaagtgctgggattacaggcgtgaggcaccacacacaacactttactagttcgtgatattagtacctgtgggttaaatttaaggttgagaattattattctttttaaactaggtaggattctgtctcaaggaccagaaaaaaccgtttctttggcagaaacagagtttttctttaaaagctataagtaggccgtctaggtgtatattcaggtgtgctttacttttaatcattgggtttataacataatcaggactttatttctctgtggcttgctgggcttccttggttttgacctcagtttggcccttcctatggtaacagaaatggctactgcaccttatttatttgacaggtcttgctctgtcgcccagtctagagtgcagtggcacgatcacggctcactgtagtcttgacctcccaggctcaagagatcctcccacctcagccacctgagtagctgggactataagcctgtgccatcacacctggctaatttttgtaatttttgtagaggcagggtttcaccatgttacccaggctggtcttgaactcctgggctcaaaccatccttctgttccagcctcttaaagtgctggggttacaggtgtgagcagtcaccactggtctgtttagttttttcagacagagtcttgctctgttgcccaggctggagtacagtggctcagtcatggctaactgcagcctcaacgtcccaggtgggccaagctatcctcctgcctcagcttccatagtagctgggactacatgcctgtgccaccacacccagctaattttcgttttggtgttttttatttttactctgttagtaaattgagatggggtcccactgtgttgcccaggctggtcgtgaactcctgggctcaaactatcctcctgcctcagcctcccaaaatgttgggattataggcgtgaaccaccatgcctggccatttttttttatttttagtagagatggggtttcaccatgtttcccaggctggtctccaactcctgggctcaagtgatctccctactttggcttcctaaagtgctgggattgcaagtgtgagccactgtgcccagcactactgcaccatttttataccacatcttcataccacagtgtttggacatcacgtacttaaactatgcggagaaaaagagtgaatcttttctggaacttactgtacaagaacaagaaggctgctttttccaaaaccttcctgacaaatgtcatttcatatattattgactctgttcctgaaatagagttcaaagaggatggactttgattggtttaaactaatcaggacctattcttgaagctgatctcacccaaatctcataactaagagtgtgcttctggaaaagaaatctggcacgttgttaccatgaaagaggtgaaattgcttctgggcagtaagcccacggatatctaatacactgaaaaccatttcttaatattgtatttactgagttgtgtttcaccttaactctgtttaaatatttgtttttttaaaaacataaacacttgtgtaaagcattctcctgtatgctggtaggtatagaaatacatttagctgtgtattttctcttaaggaaggttccagagtacagatgaggcagtaggatgatacttgagtgagtgatctttggaacctggtagacctgagttcaaatcttgctcctgtcatttattaagtctctgactttggctaagttcccttacctcttaatgccttgtttcttatttggagatgaggatattcttaatacatgtctcatagggattttgtgaggagtgaataagataatgcatatcaacatttaacgcagtgctagcataagaaatatgcaaaacaacagcatgaaaaataaaaatggtaaattttgtgaaatagttttagttgaagtgcagtgggaggagtttagttttgggatgatgggagaaaactttgtggacttgatataatttaagttggtctacgtggtatatatgcatataagtttttgagatgggggtcttggtatgctgcctgggctggtcttgaacttccaggctcaaatgatcctcctgactcagattcatgttacctgggattacaggcacacaccactgcacctggctatctttgagtgattgaaaaacaaaaacaaaaaaaccctgtaatcctagcactttgggaggccaaggctggtggattgcctgagctcaggagttcgagaccagcctgggcaacatggtgaaattctgtctctattataatacaaaaactagttgggcatggtggcacacatctataatcctagctacccaggaggctgaggcatgagaattgcttgaacccgggaggcggaggttgcagtgagctgagatcgtaccactgcactccaggttgggtgacagacggagactctgtctcaaaaacaaacaaaaggctggggtgtggcggcccacacctgtaatcccagcattttgggaggccaaggtaggcatatcaccacaggtcaggagttcaataccagactggccaacatggtgaaaccctgtccctactaaaaatacaaaaattagcttagcattgtggcgtgtgcctgtaatcccagctgcttgccaggctgaggcgggagaatcgcttcaacttgggaggtggaggttgcagtgagccaagatggcaccactgcactccatccagtctgggcgactagtgagactcatctcaaataaacaaccaaaaaaaaaaaaaaagaaaaaaaaaaccccactatatttgctgggtgtggcggctatgcctataatcccagcactttgggaggcctaggcgggcggatcacgtgaggtcaggagttcgagaccagcctggtcaacatggtgaaacccatgtctactaaaaataaaaaaataagctgggtgtggtggtgggcccctgtaatcttggctactcgggaggctgaggcaggagaatcacttgaacttgggaggcggaggttgaagtgagtagaggttgtgtcacttcactgtagtctgggcgacagagggagactccatctcaaaacaagaacactatattgacacagtcaccagggacctgttgtttatgaaagtacacagagaagttttctctataactccatggatccagtgctttccctttgggaaaaacaaaaacaaaaacaaaacaacaaacaaaaaactggctgggcgcagtggctcatgcctgtaatcccagcactttgggaggccaaggcaggtggatcacttgaggtcaggagttcaataccagcctggccaacatggtaaaaccctatctctactaaaaacaaaacctagctgagcatgatggcacacgcctgtaatccccagctacttgggaggcagaggcaggagaatcacttgaacctgggaggtggaggttgcaggtagctgagatcacacccctgggtgacagagggagactccttctcgaaaaaccccaaaccctctcttttcctgcctataatttaatcactgtagaaatctgtagaaaatactgaagaaatacaaaccttgtgattgttaaaattttggtttatataaatctagctgtcttctgtgaatatgtataaactgagtttatacttacctactgttttttatgagcattttcttataaaatgctcataaaaaacatgagcgaacatgatgaaaccctgtttctacccaaaatacaagtatctgagaacagaatttaatggcagcctacttttagtcttttgaatgtgacacatatttaactaatgttttcctgtttaaaaaaatatgaaaatatttttaagcatagaaatctgggtcatgtcccaggtcaagatgtaaatttggtgttttttggtttttttcttcttcctttttttttttttttttttttgagatggaatgtcactctgttgcttgggctggagtgcagtggtgtggtggaatcttggctcagtgcaacctgcgcctccttggttcaagtgattctcctgcctcagcctcctgagtagctgggattacaggcacgcaccaccatgcctggctaatttttgtatttttagtagagatggggtttcaccatattggcgaggctggtcttgaactcctgacctcaagtgattcaccctcctgggcctcccaaagtgctgggattacaggcacaagccactgcacctggcttgttttctttttttgagacagggtcttactctgtcgtctatgctggagtacagtggcgtgaccatggctcactgcaaacgctactttccaggcttaagcagtcctcccatcttagcctcctgagtagctgggattataggcgcaggccaccacacttggctaatgtttttggtatttttagtacagatggggtttcaccatgttgcccaggctggtctcgaactcatgggctctagcaatccacccgcttcggcctccctaagtgctgggattataggcatgagccacagtgcccagcctagatgtaattatttaagggttctgattttcagttaccttctagaaaggttgtattaatttattgcctaaaagctttatatgagagtgcctttttttttaaaaatattagatattctatttttaagaatctgtatgatagggtgtcctaacatgataggatgtcttaaactactatatttgttcctgcaaagttgtgggtgttttttttttttttttttttttggttgtggggtgggtcatcatagtgtcttggtctgtctctaagggctggagtgtagtgagtggcgtgatcaagactgactgcagccttgacctctgaggctcaagcgatcctcttatgtcagcctcctgactgcaggtgtgtgctggcaagcccagctaattcttaacttttgtttttttttttggtggagacagggcctctttgtgtttcccaggtgggtctcgaactcctggtttcaagtaaccctcctgtcttggccttccaaagtgctggggattacaggccagcacggtggctgacgcctgtaatgccagcactttggcgggaggctgaggcgggtggatcaccacctgaggtcaggagaccagcctgaccaacatggtgaaaccctgtctctacccaaaatacaaaaattagtagggtgtggtgatgcatgcctataatcccagccacttgggaggctgaggcacgagaatctcttgaaccccggaggtcgaggttgcaatgagctgagatcgcgccactacactctagcctgggtgacagagtgagactctgtctcaaaaaaaaaaaaaaaaaaaaaaaagtgccgggaattataggcacgagccacttcacttggcatggttcttgagttttaatggcaagtagtcttttgttatttagaaaggtcattcccactcaagattagatactcaattaagtctttttctttctttttttttttttttgagacggagtctcgctctgtcgcccaggctggagtgcagtggcatgatctcggctcactgcaagctccgcctcctgggttcacaccattctcctgcctcagcctcccgagtagctgggactacaggcgcccgccaccacgcccggctaattttttgtatttttagtagagacgggtttcaccgtgttagccaggatggtctcgatctcctgacctcgtgatccgcccgcctcagcctcccaaagtgctgggattccaggcgtgagccactgcgcccggctttcaattaagtctttttctagcttttatggatttgttaaatttaattttttattcatctggaatttattttggtatcaagtatgaagtaggatctaacattaatttttctgaacaatgacttagtgattttagcaaatttgaatttctctcttttccattgatttgaaatgccaggtctgtctggttttttgtttttttgtttttttttttgaggcggggtttcgctcttgttgcccaggttggagtgcaatggcatgatcttggctcaccacaacctccgtctcccaggttgaaacgattctcctgcctcaaccttccgagtagctgggattgcaggcatgtgccaccatgcccggttaagtttgcatttttagtagagacggggtttctctcttggtcaggctggtcgtgagctgccaacctcagatgatccgcccaccttggcctcccgaagtgctgggattacaggcgtgagccaccgcacccagcaccatgtctgtcttgtacagaatttatgagtatattcttggaggcctatttttaagctgtttattatttcatcatctagttttaatttagtcactttataatttatctttgtgcctggtgccgttaaaccaaataggttgtgaaaagttattcatttctttttttttttttttttttttttttgagatgaagcctcacactgtcacctgggctggagtgcagtggcatgatctcggctcactgcaacttccacctctcgggttcaagtgattctcctgtctcagcgtcccgagtagctggaattataggcgcctaccaccatgcccagccaattttttttacatttttagtagagatggggtttcaccatgttgaccaggctggtcttgaactcttgacctcgtgatccgcctgccttggcctcccaaagtgctgggattacaggtgtgagccaccgtgcctggccaagttactcatttgttaagatgaaactttagaatcctttttttttttttttgcatctcctccgtttctattggaatttttattgaaattggattatgtttataagtggggtaagagttgacatcttacggtgtctttcccgaaaggaaataatgtatcttcccatttttacataatttttgtttctttttgacgttttatatttttcccctttatgtaggttctgcgtatttctttttacatgtactcctggatatttttgtttgttgttcccaattaaaatggtatatttgcacatctttatcatttattttactttattatttatttggtatttttagtagagacaggatttcaccatgttggccgggctggtctcaaactcctgccctcaagtgatctccctacctcagcctcccatactttataatttttttaacagctatagtgaactattgggttggtgcgaaaataattggggttttgccacttgtaaaccacaattacttttgtaccaatctaataaattcacataccttactggcacccgactgattcagagttgtgcaaccatcaccacaaacaagtctagaacactttatcacctcaataggattcccctaccttttagcaatcagtcaccctaagctacttcccatttcagtagcacgaagcaacaaccaatatgcattcttaatatatttgcctattctgaacctttcgtgtatatggaatactaatatttgttttttttgtgactgcctactttcacttagcataatgctttccagttttgtccatgttgtagcatatgccagtacttcagtcctttttttttgtttaagactttttgtatttttatttttattttttgagacagagtcttggtttgttgcccaggctggagtgcagtggcatgaactttgttcactgcaggctctgcctcctgggttcaagtgattctccagcctcagcctcccgagtagctgggactacaggcgtgcgccaccatgcccagcttatttttgtatttttagtagagacggggtttcaccatattggccaggctggtctcgcactcctgacttcgtgatccacccacctcagcctcccaaagtgctgggattacaggcgtgagccaccgcgccggctgatacaacttcattcttttgcatgaggctgttcagttgtccaagcttcatttttagaaaaatctattctttctgttgcatggtcttggcatccttgtttgaaagtcatttgcctgtacatatatagggtttttttctgtactctgtattctgtttcattgatctgtatgtctatccttacgccagtactacactgtcttgattgctgtggctttgtaataagattggaagtcagaaagtgtaaatctttgttttttttttgtttttgttttttttttcaaaattatgttggctcttcagggtcccttgagtttccttctgagttttaggatcaacttgaaaacttctacaaagatgccagctggaattctggtagagattgtagtgaatctgtgtatcaagttgaggattattactatcttaacaatattaagtctcctgatccatgaacatgggatatctttctatttatttaggttgtctataatgctttaaacaatattttgtagtttcctacttttttttttttttttaagagggagtctcactgtcatccaggctgcagtacagtggcatgacttctgccttccaggttcgagcgctcctcttgtccctcctgtccctcccgtccctccattccctccttcctgttgcccaggctggagtgcagtggcacgatcttggctcaccgcaacatccacctcccaggttcaagcagttctcctgcctcagcctccagagtagctgggatgattacaggcatgcgccaccacaccttgctaatttttatatttttagtagagacaggtttttccatgttggccaggctggtctcgaactcccaacctcaggtgatccacctgccttggcctcccagagtgctgagattacaggcatgagccactgtatccggcctctggcctgcactttttgttattcaatacattttgggcaaagaataagaatcttattctttctgatgctattgtaaaattgtttttctagattttacatctgaattgttcattgctaatatatagaaatatggttgatttggtaccttgatcttgtatcctgcaaccttgaactcatttgtaaattgtttagtggatcccttaggacttttttatgtatgtcatctatggatggaaacagtttctttattctttccatttgggatgacttttacttcatatactcattattaaaaatatatcttcatttggcttgatcagtggttatcaaagtatgatctgtcaaccatggaggtcccagagagcctgtcaaagagttgtcaagataagatattctttgcattttttttccccgtccttgagacagggcctcactcactctgtttcctgggccagagtgtggtgctattatcagcttactacagacttgaacccctcagctaaggtgatcctcctgggactgcaggcatgtgccaccacaccaggctaaatttttttatttttgtagagacagatctcactgtgttgcccagtctggtcttgaactcctggcctgaagcagtcctcctgccttggccgcccaaagtactgggattatagacatgggcattcatgcctggccagtttgtgtttttcattgtgttgacattttcattgatagtgcaaaagtgtcatggataaaactactggccactttgtatgaagaaagacagtggcattaagtagatgttgtattccttactcccaaacatttgttatttaaaataaattttgacttgatgttcaattttattaaatttcacagatccttggctcttgcctgtaatcccagtattttgggaggccaaggcaggtggatcacctgaggtcaggagttcaagaacagcctggccaacatggtgaaaccttgtctctactaaaaatacaaaaattagtttggtgtggtggcgcgcacctgcaatcccaactacttgggaggctgaggcaggagaatggcttgatcccagtaggcggaggttgcagcaagccgagattgcaccactgcactccagcctaggcgacagagtgagactgtctcaaataaataaataaataaaagaaaaaacccaaaactaaaaaaaccaatttcacagatcttgtattcatgtctttttatattctgtgatgaaatgagttcatataaagcatttcttctctccttagtgcagtaagatggttaatttgagaaaatggacaagtggtttgagttgtgagctgagctagctgcttttttcataaaacatctgtttgaaagtgtgatggactcatgcaaagttatccagattttttatatttaacaagcattttcttgaaaaaccaagcatgtcacttcaaggaagactgataatgttaattgccagtgataaaatttgagctttgatagaaaaattaaaattttagaaaacttgaacctgacaccatgaacttgaaaggtgcccaatacttaacagatttttctgatgagatcagtggaattatatatgttttctggttttttttttttttttttttttttttttggaagacagtttcactctgttgcccaggctggagtgcagtggtgcgttctctgctcactgcaacctctgccttctgggttcaaatgattcgggtgcctcagcctcccgagtagctgagactgcaggtgcatgccacgatgccaggctaatttttttatttttagtagagacagtgtttcaccatgttagctacgctggtcttgaactcctgacctcaggtgatctgcttgccttggcctcccaaaatgctgggattacaggcatgagccaccacgcccggcctaatgttattttctgatgctgtgtaatgaaatgtgtcaacattggaaagatgatgtacataacttagtggaccaatattttccagatcaccagtatattatgttataaaattatgcatgggcaaagtatctactcagagggtaaagtagatcagtggaattttttttttttttttttgatgtggagtcttgctctgttgcccaggctgcagtgtagtggcacgatctcggctcattgcaacctctgcctctcaggttctagggattctctcacctcagcctcctgagtagctgagattacaggcacataccactacacctggctaatttttgtatttttagtagagatggggcttcaccatgttggccaggctggtctcgagctcctgactttaagtgatctgcccgccttggcttctcaaagggctagaattacaggcgtgagctaccacgcccagcctacatcactggattttaatgtaacagacagtacttacatgatttcagttttcatattacaactcattttaagaaattaccattgagttttggtgtaatattgaagaagaaaatatttaagacaaagctgttaaaatattcctactttcaactttagatcatttcaggatggatcttcatatacttcaatcaggacagtatatgatggagtacagaagcacttagaaggatacagccatcttctattaagctagaccctagattttcaaaaatatataacagttccacttgtctcactggtgttttttggtggaaaatatggaatgaagtatttataaatgaatgaataaatatgtagacatttctaagttttagtttagtttttttttttttttttttttgagacagagtctgactctgtcacccagactggagtgcagtggtgcaatcctggctcactgtaatctctgccttcctgggttcaggtgattctcctgcctcagcctcctgagtggctgggattacaggtgcccaccaagttacagactaattactttttttttttttgaaacagagtctcactgtgttgcccaggctggagtgcagtggcacgatcgcagctcactgcaacctctgcctttcaggttcaagcgatacttctgcctcaggctcccgagtagctggtattacacgtgcatagcaccacgcctggcaaattttttgtatttttaaaaatagagactgggtgtcaggctggtcttgaactcctgacctcgtgatccgcttgccttggcctcccaaagtgctgggattacaggcagagccactgtgcctggcctgtaagacattattattattttatacagtttatgttaatttagatttacccacatttactctttctgttgctcttcttttttgtgtctcttggctttcatccgggatcatttttctcttagcaattttttttttttttttttgagacggagtctcgatctgttgcccaggctggagtgcagtggcgcaatctcggctcactgcaaactctgcctcccgggttcatgccattctcctgcctcagcctcctgagtagctgggactacaggtgcttgccaccacgccccgctaactttttgtatttttcgtagagatggggtttcactgtgttagccaggatggtcttgatctcctgaccttgtgatccgcccgcctcggcctcccaaagtgctgggattacaggtgtgagccaccgggcccggccagcatttttttttttttttttttttttttttagtgtggttctgctgttgacagttttttctcttagcatttttttgtgtgtgtgtgtttagtgtggttctgctgttgacaaatttttttttcagtgtttgcttgttttctaaagttcatttttaggctaacactgaagtaggataatgaattacaagttggcagttactattgcttcttcaaaccaatcattccattgtcccctggcttccattgtttatacagagaaatcacctatcggttttactgttacttctttgaagataagttttttcctcacttgctcagtttttttttttttttggtgttaaggaacagagtttaataggcaagaaagaaacgataaggcagaaggaagaggctcccctgtacagagacggagggggtgctccaaagccaaaaaaggaggtctccacgtgcggtggacacctgccaggtatatatgcagaggctggaggaggcaatgtctgatttgcatagggctcaggggatttgtttgactaggcatgtcattcaggtagcccgtgaaaaagctggccctcccaccctagccctttaatgtgcatcatttgctcagttttaagattttctttgtttttgtcttcagtagttaactatgacaagtccgcatctgattttgtatttattgggattcatagtgcttcttgaatgtgagttttttaaaaatttattttagaagtacttagccattattttttcaaatgtagtcactgcctcagtctgtctttcatcaccttttgatcttccttctctcttttgctttcttctatatttttatccttttggcttttgtgtcttcatactgcagtctggatattttctttgacccatcttcctttttcgatttctcagtcttgtttaatctgtattaaagccatctatcaattttaatttctgttattgtatattttaattcttaggcttttgagttttttctttttaatagattttatttttgggacagggttttgctctgtcacccaggctggagtgcagtggcagaatcttgtcaccttgaccttctgggcccaagtgatcctcccacctcagcctcctgagtagctgggactacaggcatgcatgccccaccatacctacaattttatttatttatatttttagcaatgaagtctccgtatgttgcccatgctgaagcagtcctgctttcgcctcccagagtgctagggttacaggcatgagccaccttgcctggtcagcattatttttttacagcagtttttagttcacaccaaaattgagcataaggtgcagatatttccggtatgccacctgactccccacacacgaagcctcctccattatcaacatctgacaccagagtgagtggtacatttgttacacttggtgaatctacgttaacatatcattatgactcaaagtccatagtccacattagggttcactgttggggtttgacaaatgtgtaataacatatccaccagtacagtgtcgtacaaagtagtttcactaccctaaaatcctgtgtgccctacccattcattccttcctccccactaatcactggcaactgctgatctttttactgtctccatagttctgcctttcctactacatcacatagttgaaatcatacagtatgttgccagttaagattggtttctttcatttagtaataggaatttaaatgttctttatgtattttcatgtcttgatagtttttttttttttaacacatctgctggcaggaagatagctttttaaaaaatttattttaattgacgtaataattgtacgtgtttatgggatatgtagtgatttttttatgcaaaatttcatcatatagtgatgtgttgatacatatatagtgatcagatcagggtaattagtgtattcatctcaaacatttatcccttttttgcattgggaaccttctgtggcctctttgtagctatttgaatctatataatgtattattgttaactgtagtcatttcacagttatgtagaacactggaacttattcctcctatctagctgtaatttttatcctttcacaaatctctccctattcttccctttcccctgtcctttccaccttcttgtatcctctgttctactttttacttacatgagatgaacctttttttagcttccacatgagtaagaacttatggtgtttaactttctgctcctggcttatttcacataagataatgtcctccagttccatgtatgttgctgcaaatgacaggatttcattatttttaatggatgtataatattcctctgtgtgtgtgtgtgtgtgtgtgtgtgtgtgtgtgtgtacacacatcacattttgtttatccattcatctatcgttgaacacgtaggttgattttgtatcttggctactgtgaatagtgctgtaatcgtgggaatgcagacgtctctgatacagtgttttcctttcctttggataaatgcctagcagtgggattgctggattatatggtagtcgtgtttgtagttttttgaggagctttgatactgttctctatagtggctgtgctagtttacgttcccactaacactgtataagagttcccttttctgtgcatccttgccagcatttgttattttttgtgtttttgataatagctatcctaactggggtaagatacttcattgtggttttgatttgcattttcctgatggttagtgatgttgaacatttttttcacatatttgttggccatttgtatataatctttgagaaatgtctattcacattgtgtgtgcatttttaattggattttttctttttttttttttttgctgttaagatgtttgagttccttgtaaattcttgatgttaatcccctcagatgagtaatttgcgtatagtttgtctcattctgtaggttgtctttttttactctgttgatttttgcctttgctatacagaagttttgtagtttgacataattccatttgttgtttgttgcctgtgcttttgaagtctttattcataaaatcttttcccagaccgatgtcctgaagcatttcccctgttttgttctagtagtcttatagttttgttagttctttgagccattttgagttgattgtttatgtagaggagtgagggtatagtttcattgttgtgcctatggatgtccagttttcctagcaccattcattggagagactgtcctttccccagtgaacattcttggcacctttgtcaaaaatcagttgactgtagatacgtgtattaacttctgggcactctgttctgttccgttggtttatgtatctgttcttatgtcagtaccatgctgttttggttactacagctttcaatatatatttttaggtcttttcttttttcttccttttttttttttcttttcttttcttttttctttttttttttttgtaatgcagtctctctctctgttgcccaggctgtagttcagtggtaccatcacagctcactgcagccttgacctgagcacagttgattctcccacctcaccctctcaagtatctgggactacaggcatgcatcaagatgcctggttaatttttttttttggcacttacgcatttctgtgcctgttgagtggtggcaggagcagccctaggctgggcagccgagtggccgagcagaagttacagggacacaggggcacctctagccccagagagggagactggggctttgggagctgtgtggccctgggctccagaggaggcctcctgacatctcttcccccaaccagctctagtctctctgcagccaccttttcaggaagggcagggactccataaagctccaaaatttactgcctttctcattacaggggctgggaggtggggcgcagaaagtataagaggtttaacctgcctgggtgactttaattccaaagggcagagcctgggtgtggtgggacccatgtgtggtcccagtgctttgggaggccgaggcaggaggatcacttgagcctaggagtttgaggctacagtgagctatgatcgcaagtacactctagcctgggccacagagcaagactctgagtccaaaaaaaaaaaaaaatttttttttttttttgaggcggctctcactcagttgtccaggctggagtgcagtggcgcgatctcagctcactgcaagctccgcctcccagtttcatgccattctcctgcctcagcctcccgagtagctgggactacaggcacctgccatcacgcccagctaatttttttgtatttttagtagagacggggtttcaccgtgttagccaggatggtctcgatctcctgacctcatgatccacccgtctcggcctcccatagtgctgagattacaggcgtgagccactgcacccgaaattttttttttttttaaattaaaaaagtaggccgggtgtggtgccttacgcctgtaatcccagcactttgggaggccaaggcaggcggattgcctgaggtcaggagtttgagaccagcctggccaacatggcgaaaccccatctctactaaaaatacaaaaagtagccgggtatggtggtgggcgcctttaatcccagctacttggtaggctgaggcaggagaatggcttgaacccaggaggaggaggttgcagtgagcggagattgtgccactgcattccagcctggacgagaagagcaaaactccatctcaaaaaaaaaaaaaaaatttaaaaagggcaactttttcaagaagaatggaggggaaaaggcatgaagagaaattccctctgcagcagagcaagttccttccatggaggaacaggaagccgcaatcactgtttgcagctgggcacagctgccatgacatttcatacagcagccattgacctgcttcctcctgatgtcctgtctgggcacatcctccagcaggaccaccagggaggcagggatggcagcccttgcaacttccctttgacctcagggaatttgagaaattgaggtgtgggatggcagagtggtggtgtttggaggccaggaggaagaggctgatgtccgcaaccccacaggactcaagcagcccaccctgatgccctagatgagtgctcgggagggacggccatgctgctggctttctgtgtagcactcaggcaggtgcctcagtgagccctcagaaccggggaggagaaggttgcaaagcaacagcctgatgcccagggccttgcagcttgtcttggggagctcacactgcccctcctgtggtccctgcactaggctaggatgcccctgtcctcccacatcctccgctccctgtaccctgttggcccagcagcagtccctgtcctaatggcacagtgcagccatccacagaatccacacccagacacctctctgggccacacatcatgaggtctccacccagctgtgtgtgacccacatagtgacagggtatggctgagcaggtctccaggcccaccctttgcccacagcctcctgcctccctgcggtgagacacaggcaagggtcacaggtcagcaagtctgttctcttagaaacatgccaaggtcaggtgtgggccacttgtgctccacgggggctgccatgctgccttcttggagcacacaggagtccccgtcagatatcctaacctgagtacccacagctgcttgtggtgagggctgactgtgggtgctcactgactgcctgctcagcacacagctggatggtgctgggcactgggccttccaagaaatggaaacggccccttccctcccagtgctcacatacagcaggggagacaggatggccggacagaatggtgccaagtgtgagtgctgcaagcagatcctcgtggagggagccagggccaggctggaggggtgacatcagagctgtgcacatacctgagtgttcttgccagcacagggcatgagggtcaagtggctctacacagctgaggcacagcaggaggagggggcacataacctggctaattttttgtagagacacggttttgccctgttacccaggctggtttcgaactgctgagctcaagtaatcgtcccaactcagcctcccaaagtgttgggattacaggcgtgagccaccatgcccagctgtttttaggtctttcacttcctttgttaaatttattcctgttagacttttttcctagctattgtaaatgaaattgccttcttgatttcttttcaggtagtgtattgtttgtatatggaaacatcactgattttttttaaatagtgattttgtatcctgcaactttactgaattttttagctctgaggtgtgtgtttttagtggagcataggttttactatatataaggtcatgtcatctgcagctgcaaacacagggacagtttgacttcttcatttccaatttggatgcccagaactactttgtcttgttctggctaggacttgcagtagtatgttgggtaagagcagtgagagtgagatccttgtccaggtacagttactggaggaaaagcttttatctttctcttgttgagtaagatgatagctgtgggtttgtcatatatggcctttattatgttggtgtactttccttttatacctaatttattgagagtgttttttttttgtttttgtttttgttttgtttttgagatggagtctcactcttgtcgcccaggctggagtgcagtggcgtgatcttggttcactgcaacctctgcctcccaggttcaagcagttctcctgcctcagcctcccgagtagctaggattacagcttgtggctaatttttgtagttttggtagaaacggggtttcaccatgttggccaggctggtctcgaactcctgacctcaagtgatccgcctgccttggcctcccaaagtgctgggattacaggcgttgagccaccacgcctggcctagagttttttttttaatcacgaatggatgttgaattttatcaaatgctttttccgattctattgagatgatcctatggtttttgtccttcattctattgctaagatgtatgacatccattgatttgcgtatgttaaattatccttgtattcctgggttgaatcccagttcatcatggttattacattttgatgtgttgttggatttggtttgccagaattctgttcagaatttttgtgtctatgtttatcaaggacactggcatgtagttttcttttttgtttgtttttccttttctggttttggtatcagggttatactggccttgtagagtgagttcagaagaattaactttgcttcaattttttggaataccttgagaagaattggtattcattcttctgtaaatatttggtagatttcagcagtgaacccatcagtcctgcactttccttgggagactttttgttactgattcaatctcattacttgtttttggtctgttcaggttttttatttatttatttatttatttatttatttatttatttatttttgagacggagtctcgctctgttgcccaggctggagtgcagtggtacaatctgggctcactgcaagctccgcctcccgtgttcaagccattctcctgcctcagcctcccgactagctgggactgcaggtgcctgccaccatgcctggctaattttttgtatttttattagagacggggtttcaccatattggccaggctggtcttgaactcctgacctcgtgatctgcctacctcagcctgccaaagtgctgggattacaggcatgagccaccgtgcctggcaggttttttatttcttattggttcaatcttagtagattgtatgtgttcaggaatttgttcatttcctctaggtttttaaatttattgctgcgtagttggtcagcagtctctaatgatcctttgtacttctgtggtatccgttatgatgtctccttttttgtttctgatttcttttatttgggtcttgtctcttttttccttagtctagctaaaggtttgttgattttgtttatcttttcaaatgaccagcttttttctgatctttgatctcctgtaatttgttttagtctcaattttgtttatttcagctctgatctttattgatcttcgttgtctaattttggttttgttctttttggttccttgagatgcatcattggttgtttgaaatctttccagtttcttggcataggcatttattactataaacttccctcttagcagtgcaccgcttttgctgtatcccacaggctttgacgtgttgtatttgcattttcatttgtttcaagacattattttatttccatcttaataccttcattgacccagtggtcattcaggagcatgttgtttaatttccatgtattggtatagtttccagcatttctcttgtattgatttctatttttattccattgtggtctgagaagatagctgacatgattttttcagttattttaaaatttggttgagacttgttttatgtcctaaaatatggtcaattctggagaatgtttcatgtgctgctataaaaatgtgtattctgctgctattaggtgaaatgttctgtaaatagctgttggttttatttggtctatgatgcagttgaaaactatgtttctttgttatattctgtctagatgatctgtccagtgctgttgaagtccccaactattattatgttgaggtctgtctctcccgttagatctaattatgttgtatatctgggtcctctggtgttggttgcgtgtgtatttacaattcttatatccccttactgaattgatgcctttattatatagtgtccttctttgtctccttttacaacttttggcttgaagtctgttttgtctgatatatgtaaagctaccccagctcacttttggtttctgtttacatggaatgtcttttcccgtcctttcacttttagtctatgtgtgtctttattttgttgggacagagttgtgctctgttgcacaggctggcacaatcttgactcactgcaacctcttcctcccaggttcaagcgattcttttgcctcaaattcccaagtagctgagattacagcatgagccactgtgcccagccaatttttttgtatttttagtacagacatggttttgtcatgttggccaggctctgtgggtgactttaaagatgaagttagtatcttgttgacagcatattgttgaatttttttgttgttgttcagtctataacttctattttttatatatattttttgagatggtgtctcactttgtcacccaagctggagtgcaatggggtgatcttggtttactgcagcctccgcctcccaggttcaagcgattctcctgcctaagcctcctgagtagctgggattacaggcgcactccaccatgcccggctcatttttgtattttagtagagatgaggttttactatattggccaggctggtctcgaactcctgacctcaagtgatctgcccgtcgtggcctcccaaagtgctgggattacaggcatgagccactgcgcatggccagtgtataacttttaaatgggggaatttaaatcatttgtgctcaaggtattattgataggtgaggacttactcctgccattttattgattgttttttagttactacattatatatcctttgttccttgcttgctcttccatatatgaaattcttgagcatttcttataaggcaatctactgatgagtatttcctcagtttttctttgtttgtgaaggtttatttctcctgcgtttctgcaggacagctttgctgggtataatcttgataagctgtttttttgttttttttttagtactttaactctgttaatcccattcactccttgcctgtaaggattctgctgagaaatctgttagtctggtggagatacttttatttgtgacttgatgcttttcttttgctgcttttagagttcttttttttttttttttttttttgaaacaaggtctcactctgttgcccaggctagatagaatacagtggcgcaattaaagcttattgcagccttgacttcctggactcaggtgattctcccacctcagcctctgagtagctgggactataagcattcaccaccatgtccagctaatttttatatttttttgtagagatggggtctcaccacgttgcccaggctggttttgaattcctggccttaagcaatccacctgccttggcctcccaaagtgctgagattataggtgtgaggtgctgtgcttggcctctttgttgaatttctcattaaaatcatgaattattttccttatttcattaaagttcttacctgtattcccttgtacctcctgagtttccttaagatcgttattttgagttctttttctggcattttatatatttctttatgattggggtctattacaggagaattatactgtttgcctttgaagatgtcatgtttcttttttctctgttgatttctctacattgtttctacacattgttggaaccccccccctttcaattttatggagtaaattttatagggaaagacttaatttatataagtggatcttagatcagtggagtgtgttggccttggttctgtgtggacacagtaatgtagtttcttcatctgtaatctgtactagtgacatttgagagtttctcagcagcctaggatgaggaagtgtgtggtgcagctttgccaggggggttggctcattgggctgtttctcaagtcagggacacatgtatgcatatggtgagttggccaacttggggtctggcttgctggggttgaagccacaggactgttactctggccaggagcacaggcatgtggttgctcaattggcttggtgttgtgcctggcaggagtggcccatggtttctcaggtctaggacacaggtgcacaactgctcagccagcctagatgtgtctgtcaggtgttgcccattgggctgtttcttaggactgggatgtgggctcttggctgcctggctggcctggggggatgcccatcagggacgacctgtggtaatgtttctgaggcccttattgggggcgcagggctgttcgggaggccagaagcatgtctacatggggcagaggtgctaggagcctttttcttaggcactgagtaagggtgcatggctgcttcactaaccttggggtgtatcacatgctctttggcttgcgggcctccactactttggagagagcttatagtggcttggttggcttatgggcaggtttgtcctggatgggactgtcagactgttcctttggcttgaagtgtggtctggttgtgggagttggttttccctgctgtgcgggaccaaagttgcagctatagttgtggcattcattcacctgtgtggccttggtgtaatgaagatggagctgaagtgctgcagaggtgcagtggctactggcccccagagggtgcactccagaggtggctctggtttcaagatggtgttgcactgccacagcttgtttcactgggggtaggtgggggttggggagcacattccttgtgctcctaatttgggcagtgcagctgtatggatttccagcagttgtctaaattgggctcagggcttgcaaggactgtgggattctcctttttattttatttatagtttttgagatggagtcttactctgttgcccaggctggagtgcagtggcacgatcttggttcactgcaacctctgcctcctgggttcaagtgattctcctgcctcagcctcctcagtagttgggattacaggcacccaccaccacgcccggctaatttttatatttttagtagagatggggtttcaccttcttggccagggtggtcttgaactcatgacctcaagtgatccgcctgcctcagctcctcaaagtgctgggattacaggcatgagccaccgcacctggccgattcgccacttgtaaggagtgtaggtgtttgtggtggtaatgggagtgctggtgagggatcttctgcttactttttccctgcatcaggaagtccctgctgactgcaggcaaatcccatctgggtgaggggagatggggctgcagaggctggatgcttccatactgccttcctggactttgtcaccaacaggtgtgtctccattccccaactgcactcagatggtctctctgacacacctgtcagatcttagctgtttatttgttaacctttgtcctttcttgtgtgtaggatgaatgctaggtgtctttagtcagtctccctgattctttttttaatattcttcataactttgctggaattcttcagcttatctaatatcttgaatgtattacctattgtaactaatatcttaatcttctgttttattgttctcttattttcacccttgtttctggctatgtggtatgtggtcttggtttttggttctctggtcattgtagaaagttttagatatctagagtcatgtgcagaaatgggaaagtttatgggcagtgaacacttatgtacccatcacccagtcaacatttaccaactcatgggtagttttttttttcaccttaccttatccattgtctctctcccacccactggattagcttgaagtaaatccaggtgttatatattatctgtatatatttaaatatattaaaataaccatttagcatttaaaaattttaaagatggggtcttgctgtgttgcccaggctggcctagaactcttgagctcaaacagtcctctcacctcagcctcctgaatagttggaactagagacacacaccactgtgtccagctttgtttgtttacgtatttatgagacagggtctcactctgtcacccaggctggagtgcagtggcatgctcctggttcactgcagccttgacctcctggggctcaagctgtctgcccacctcagcttcctgagtagctaagactgtaggtacgggatattatgcccagctaatttttgtcttttttttgtagagatggggttttgccatgttatccaggctggtcttgaacgcctgaattcaagccatctgcccaccttggccactcaaagtgctaggattacaggaaaatgtcactacattccattttttttttttaattgaaaaacggtgggttctgtctaagttgcccaggctggtctcaaacacctgggcccaagcaaatcttgccttggcctcccaaagtgctgtgattacaggcgtgagctgctacccctggccatggtctgttttttgttattttaaattcatacgtaattcttatacatatttatagggtacagcatgctatttcaatacctttatatgatgtgtaatgatcaaattggggtaattattgttatctcaagcatttatcattctttgtgttgggaacattcaaaatcctctctgctatttatttatcttttatttatttatttttttgagatggagtcttgctcttgttgcccaggctggaatgcagtggtgcgatttcagctcactgcaacctccgcctcccgggttcaagtgattctcctgccgcgggtctcaagtagctgggattacaggcgcctaacaccatgcccggctaagtttttgaattttagtagagatggggtttcaccagattggccaggctggtctcgaactcctaacctcaggtattccacccacttggcctcccagagtgctgggattacaggtgtgagccaccacgcccggccagcctctgctagctaaaatgtcagattattaactatagtaatcctaaagccaggatcagtgactcatgtctgtaatcccagtgctttgggtggctgaggcagaaggatcacttgaggccaggagttagtgaccagtgtgggcaacacagcaagactccatctctacaaaaagtttaattaataattagttgagtgtggtgaaatgcacctgtagtctcagctacttgggaggctgaggcaagtggattgtttgagcccaggaggtccaggctgcagtaagctgtgattgtgccactgcattccagcctgagtgacagagctaaatctcttctctaaacaaacaaaaacctgataaagctccaaagaacaacaaaaacaaaaaaatagtcatcctgcagtactataaaacactagaatgtattcctcctggctaggtataattctctgttcattaaccaatctctccctacattcctcttctctaacctttccagtgtctagttgtgtaaatttctttagttttcgtttcatttcatttcgtttcatttcttttctatttttctttttttaaagaataggggtcttgttgcccaggcttcagtgcaggggcgcacgatcatagctcactatgagcctcaaactcccaggctcaagtgatcctctcttctcagcctcccaagtagctgagattacaggcttgcactaccatgcccagttaattattttattttttgtagcgaaggggttgcccagggtggtcttgaactcctggcctcaagggatctcttgcctcggtctcccaagagtaatttcttaatacgaaatagcattcaatttcccttatattctcagttttaaaaaattctaccttttccttcacaatttgaatcaagattcacatgagacctattagaattgctgattttaaaaattaactaaattgttatataatttacatacaataaggttagtctattgtaagggtatgtgtttattcattttgacaaatgtatacactcatataagaaccacaattgaacatttccatcacccagttattcctcattcctgtttgtaatcagccccaccaccaactctgcattgtcgtaactgctgatgtgctttgtcacctaagctttatttttaaatgtattttattattattattttttgagacagtcttgctctgccacccaggccggagtgcaatggcacgatcctggctcattgcaacctctgcctcctgggttcaagtgattctcctgcctcagcctactgagtagctgggattatgggcatgtgccagcacgcctggctaatttttgtattttttttttcttttcttttttttttttttttgtgacgaagactcgctctgtcgcccaggcgggagtgcagtggcacgatcttggctcactgaaagttccgcctctcgggtccacgccattctcctgcctcagcctctcgagtagctgggactacaggtgcccaccaccacgcgcggctaattttttgtatttttagtagagacggggggtttcaccgtgttagccaggatggtctcgatctcctgacctcgtgatccacccgcctcggcctcccaaagtgctgggattacaggcgtgagccaccgcgcccagcctaatttttgtacttttacaaatacaaaattttagtggagacagggtgtcaccatgttggccagactggtctcgaactcctgacctcaggtgatctgcccgcctcggcctcccaaagtgctgggattataggcaggagccactgtgtccagctagaaataaactttatgtactacttacatctggttggtattctttttacttagcatacggttagaagtcatccatgttgcttgttggtgcatcagtagtcggtttctttttattgctgaatagaattccgtatgttggcatatatatgataactttttttttttgaggtagtcttgccctgttacctgtcatgtggtgccattatagctcactgcaacctcgactgcctgtgcttaagcaactcattcacctcagcctcctgggtagctaggactacaggtgcatgctaccacacccagctaattttattttattttatcttattttattttttgagacggagtctcgctctgttgcccaggctggagtgcagtggtgcaatcttggctcactgcaaggtctgcctcctgggttcatgccattctcctgcctcagcctcccaagtagctgggactacaggtgcccaccaccatgcctggcttaatttttgtatttttagtagagacggggtttcaccttgttagccaggatggtctcgatctcctgacctcgtgatccgcctgcctcggcctcccaaagtgctgggattacaggcgtgagccactgtgcctggccaaacctagctaattttaaaatttgtttagtagagatagtgtcttgtactgttgcccaggctggtctagaactcctagccttaagcaatcctccctccttttcttcccaaagcgcatcctttttatttattttattttttttatttttaaactcaatccactctaatggaaatttggtttgtttctagtgtgagtaaagttattattttgttttgctctttgtgttttgtttgttggctacctgtgtggactaattctgtgaattctggctgccctgtagtttgtagccattgatatctctgttggttattgttactgtttcaatacataattcttttctctctttattttcaaacctcacttcctaggagttacctctgaatcggcatagctaatttttttcctaagtctgttgtaatttctaggttcccctctttctttttatttgttgcagaaactgctcgttccgtggcttgcttagtgcatacgatttcccatctggattttgcagattttatccttgtgtaattattatgctttgtcttttgtatttccatacttttattgctagatctagaggcttgatcagattcaggttaaatttcttggcaagactgttttataggttgtgttgtgttcttccatggggttggttggagtgccacttaatgtcatagttagcaagcagccattgcctaaggcttttattacattaacagctacaaaactaatcctgtcacttttttctttgattaggtggactatctgtatcaggagaaacttgcttttattacctgtttcattacttttatttgctatttctacgtgaaagtcaggatgaatggctgatttctccctttgttaaccagttttcaatgactgatttaacatttgcaaaggtgatcactttttttttttttttttgagaatcattagaaactcatactcagaaataacatttttgcctttgtttaagatttggaagttttttttttttttttgtgacggagttttgctcttgttgctcaggctggagggcagtggcgcaatcttggttcactgcaacccctgcctcccgggttcaagcgattcttctgcctcagcctcccaagtagctgggactacaggcacacgccaccatgcccggctagtttttttgtgtttttagtagagacggggtttcaccatgttggccaggctggtctcaaactcctgacttcaggtgatctgcctccctcagccatccaaagtgctgggattacaggtgtgagccactgtgcctggccaccaaaaactctttagatttgcccttttgaggctattttctagatcccgtaggcatgcttcatttttagaaattccgttttcttttttctcctgacttgggtgttttcaaatagtctgtgtttgaactcactaattcttacttctctgccatcaattctgctgcaaaagactaatacattctttagtatgccaattgcgtttttcagctccagaatttctgctggagtcttcttacatgttttaatctttgttaaagttatctgatagaattctgtattccttctgtgttatcttgaatttctttgagtttcctcaacacggctattttgaattccttatctgaaaggtcacatatctctgtttctccaggattggtccctgatgccttatttagttcatttggtgaggtcatgttttcctggatggcgttgatgctagtagatgttcttgagtggcattgaagagttaggtatttattgtagtcttcactgtctggccttatttgaagctgtccttcttgggaaggctttctagatatttgaaagaacttggggccgggcacggtggctcatgcctgtaatcccagcactttgggaggccaaggcgggtggatcacgaggtcaggagatcgagactatcctggctaacatggtgaaaccctgtctctactaaaaatacaaaaaaattagccgggcgtggtggcgggcacctgtagtcccagctactcgggaggctgaggcaggagaatggtgtgaacctgggaggcagagcttgcagtaagccgagatcgtgccactgcactccagcctgggcaactccatgtcaaaaagaaaaaaacttgggtattgtgatctaagctgtatctgctttaggggtaccccaagcccagtaattctgtggttcttgcagactcatacaggtaccaccttgatggatttggacaagatctggataatttgtggattaccaggtggagactcttgttctctttccttactttctcccaaacacacggtctcgctgtcctgagccacctaaagctggggttggagtgagtgacacaagcacccctgtggccaccatgactgtgctgggtcagtcttgaaattaggactatgctgggtctcacccaaggcctgctgtaactgcactctggctacctcccatgtttgctgaaggccctggtgctgtgcaatcagcagttggcaaagccagccagacctgcatccttccttcagggcagcaagatctctagaccccaggtgggtccagaagtgttgtctgggagttaagatactagagcaatactttttgtattgtggctgagctggcattcaaaccacaggactggtacttctcactctttttcccatttccacctcacctcgtagccaccgccacccccaggccacaaggggtactgccagactcaccgatgtttctctaaggcccagtgtctctgaagtcagcttgtcatgaacgctctgttacctgggactcacccttcagggcagtgggctcccctgtggcccagggcaggtccagaaatgccatttaagagtcaggtcttagaattagggacacccaagaatcaactggtgctctaccctgctgtgtttgtgctggtacctaagctgtaagacaaagttctctttactctttccctcagcttttctcaagtaggagttttgccccatagccaccacagctggtaatgtgctgaatctcactgaagccagcaagtctcagaggctcaactgaggccctcaatgtagtacttggatatcgctactggttattcagggcccaagggctcctcagttaggtgatgaatgctgtcagctcctgtcttctggcccagggtgtgtgtagaaatgtctgggagttagggccctgaacaggggacctcatgactctgagcggtgccctgtcttgctgtggctgagctggtatccaagatgcaagagagtcccccccactcttccttctctcctcaaacagaaggaaggcatctttcttggagccctgagctgtgcagcctgtcgaggggaaggggtgatgccagcactccattggctgccccgcctggtgtctcagtatgtctcattccctgcttcctgtcccccttcccaccacctctactgtcttggtgcccagttcattcattactaagaatcggttaagagttgtagtccttacggctcagactgccaaaaagtttacttggaaacatggagtgctgtagccctccatggtgaggctggtgggaactcaagttgggactcctgggatcggcagttgccctccgctttagggctggtttaaatgctccctccctgggtgggagtcacctgggtttgatctggttttcttttctgctctcacaggacagcactgagttcagtggcttgcagttgctgtgttgtccctccctcagcaccgagaggctctaggcaccaggccttttgctgctggctgggggaacaggaagtgtgcgtagttgctaattgaggactgttgtttctcccttcagtgatacgcagttaaaaccaggtactatgagtactcacctgatttttgttttttatgaaggtgtttcagttaaaaccaggtactatgagtactcacctgatttttgttttttatgaaggtgttttttctatgtagatcttaatttggtatccttgttggcgggggcatgggcatgatcagtggagccttctatgcttgctctgcctcccacctgttttcagtctaaaaaatcagtggcagctgggcgcagtgggccacacctgtaatcccaggaggccaaggcaggtggatcatgaggtcaggagtttgagaccagcctggccaacgtggtgaaaccctgtctctactaaaaatacaaaaattagccgggcgtggtggtacatgcctgtaattccagctactcagcaggagaatcacttgaacctgggaggcggaggttgcagtgagccgatattgcaccattgcactctaccctggcggacagagtgagactccctctcaaaaaaaattcagtggcttccattaaactacagtttggatttcctgaactcctttaaaaaataattgcaaaaatttttaattgtggtaaaaaaaaatatagaacataaaatttactgttggtctttttttcttaaatagagagggggtctcgccatgttgcctgggctggtgttgaactcttgggctcaagtgatcctcttgccttggcctcgcaaagtgttgggattacagacatgagcgaaacatttcttttcttgatcattttttatgtatatagttgagtagtgttagaaatgttaacattctcgtgcaacaaatctctacaactttttcatgtgacaaaactgaaacgcatttctgggcaaccacccttctcctttgtttctgtgaatttggctactttaaatacctcataccagttgaattgtacaagtacagtcatgcaccgagtaacgatgttttggtcaatgatggacctagtgtaggacagtggtcgtaaggttataatttttactgtaccttttctatacttaaatatgtttagatatgcaaatacttacattgtattatggttgcctagagtattcagtacagttacatgccatacaggtttgtagcctaggagcaatgggatatttatacaccgtatagtagaggtccaagagagcaaagatctcttggagatggtgctttcaattcatttcagtatatatgctcacgagtgggattgctggatcatatggtaattgtgtttctgatttttcaaggaactgtcatactgttttccacagcagctgtaacattttatattcccagcaagagtacacaatggttccagttccacataacttgtgaacatttattttatttattttgttgtttgttttttaagagacaggatcttgccctgttactcatgctggagtcagtggcatgatcatatctcactatagcgttgaacttctggactcaagccattctcccacgttatccttagtgtcctgagtagctagaactataggcatgtgccaccgtgcctggctaatttttaaaaatatacatatttttagagatggtaccttgctgtgttgcccaggctggtcttgaattcctggcctcaagcagtcttcctgcctcaacctaccaaagcactaggatcggaggtgtgagctgttgggcctcactggggattttgatagtgattgcttttaattcataaatcaatttgggtggtgtcgatatttaacaatataatgtcttccaaccagtgaatgtgggatttcttcccatttatttacatcttctttaattccttttagcaacattttgtagttttcattgttaacaagtcttttcctccttgtttcatttttctttttgatgctgatgcaaatggattttttttaatatttcctttttaaattgttcattgttagtgtattagaaatgcatctgacctgtaatcccagcactttgggaggctgaggcgggcatatcacttatgatcaggagttcgagagcagcctggccatcatggtgaaactccctctctacaaaatacaaaaactagccaggcgtgatggtgggcacctgtaatcccagctactcaggaggctgaggcaggagaatcgcttgaacctgggaggcagaggttgcagtgagccaagattgtgccactgcactccagcctgggcaaaagagtgagactgtctcaaaaaaccaaaaatttaaaaagacaaaagtatatctgatttttgtgttttgaatttgtatcctgtaactttgttgaattcacttattttttgtttgtttgtttttgagagggggtctcactctgttacccaggttggaatgctgaaatgcaaactgcagtttaatggaagccactgatttttttcggctcacttcagccttaaccttccaggttcgagtgatccttccacctcagcctcctcagtagctgggaccagaggtgtgcaccaccatgcctggctaattgtttatatttttcgtagagatggggtttcactatgctgctcaggctggtcttgacctcctaagctcaagtgatctgcccgccttggccttccaaagtgctgggattaccggctgttagttctaacagttcttcttgtgtaatccttagggttttctgttggttcatgttatctgtggacagaagtgacttgatttctttccattttcttcctcattgaattgctctgactagaatttctaatactgtgttgaatagaaattgtgaaagtgaccaccttatcttggtcctaatcttagaggaaaagcttttgggctttcacctttgagtatgatgatagctgtgtgtttggagaactctactctgatgaaatgtccttcacttgcctttctggttctgggttggatggaatgagttggaaagtttttgttggttagcagctaggctgtcaggcgggcctctggtgaggatggttttctggccacacaaactttttttcagaatgtgtgccgtgtgtgttttttgttagagtaggatatgatggttgtagccactcttccctctgtttttaggcactgttatggctggggaaggaaaactggcatggcgtactgtgatcccttcttcaccttgttgaaatcatacaatgcaagaggttgtttttagtggttgcttcatcttaggccccaactatatcttattctgtcctagttgctaagctttgttgcccaggtcttctccctgatggtcagtagtgtcttcggcttccagggcctcagatgtgatctaggtcccaaaagcctggtcttgggtgtaggtgttactaccttgtgactgttttacatgtattttggccttacgccgtttccttttctccttgaccaaggtaatttttttttaaacccctttttggttaatcagtattaccagagaggaatcttccaacctcctagttcagcttaccagcatttctggagctgagttgaggaagtgtgctgtaagtctcaacattgtgtatgtagtctgattaagtagaaggtgcgcgcgcgcgcgtgtgtgtgtgtgtgtgtgtgtgttttaaatgtaaactaacctcatatatatttggtacaggaaacttactggtatagtaggacatattactgcttcataggggatttcccctcctcacgttaatgtgatacagtgatccaggcaagatttcttgggattaaagagaagacactagcaatatataaagaaacagtaagaaagctgataagcctcaaaaatgctttcttgtacatacataataattggtttagtggcttcaaagacccttatgttttctactttgtaaagctgtgtggaccagccaaagaaggtaaaagccattaaaatgatggaattataagaatggttatgttcaatttttattattttgggaaatggtcttttaatgagaactgaatgttctcaagcttcctcatatcaaaagaggaacgccgtgtgaaggaagctgtgacttcaaggaaggtatgctctgtggctactgctgatacctctgagaggagtaccatgagactggttcttggaatactaagctggaggctggaatcagtgctgctgctttcagatatagcaagctgacaagtctttggtctctcctcctgccttcttcttctagtaccctataggcactggagaacaagatcttaacaggaagacagctggaaatgaaaaatgtagattgcatggtcccagcctcagcatcacaacggaaggctggttttggagatgagagataatcccagaataagtggcaaagtctcactgccccccccaccccttacatctgtcaaaaatctgttcttaagtccatatgagttattaattaaaagtagacttattttctttggaagcaaaagaatgattatctgaaatgtttgcatttgtagctcttggctttattttgaactgttggctttaatactggtttagcattattcataattttaaaatttcttttttatttcagtatcagatgtagaaggtggtgatggactgcagctcagaaaggaacatactctcaaaatatttacttatatcaattcctggacacagaggtatgcatctttaggtatttcgaagactaatttttgtgagttgtgttataagttgcgatttttattgtcacattttctttttagggtgttgggttagataccattagttactaaatgacagtttgtcaatatttattaaatctttactcatgaggtcgatcatgattctgtttttaaaacatgggcataaatatcagtttctttctttgacccctgcttatttagggatatgagagtcacagaaattctgaaaagtaactattttgagagattaaataatttttatggtatagctaaaggcttgtaacaatcttaatccttaaaaaagaaaagtcattgtggtaggggatacttttaagccacttaatatctgttccgtttctataattatgtgtattagaccaatttctaaataatacatatattgagactataggaaataaaattttaggaaaacatgttaatataatcaaagtttataaaaaggattcctgttcctcaatgtgattttaactagtctttgctaataatttttttcccttgaataaaccaatgaaaataaaaattactttaacttaaacttagtccttctaaaaaattttatgggtaagaatgtttgaagcattgtgtgcagtagccaatgaacatgttaaatgcagtgatacataaatgaatgttctgaggtatacagtctagctgaacatagagtttagctgagtagtttaacttcaaataacatttgctctatggtaatatccttttttcctctctcagtagagttggcagatatacttgttgcaaaagactttgtagattttatttatgtaaacattctgtaccatcattattgacatttcttttctgagtctcactgaatttcagtaagtttaggagtggttgctgttgcattagggatggactagatgaatattgcataatactaatatgtttatgattgaagatgaactttaatagtccacaatgatttgctgagaaatgttgtgtctgagtcataatcttgagttttaattattgtaactacagctaggtggcaacatgttatactaggaaaaaaatctacacttctgatttcaggatctataagtttgccactgaataaaatgaaatccagagaaacaaaatcattctcctaaaatctcatcactagttattggtagagatggggtgggagttatatgttcccattcctaatacacttgtattctagcttatttttaatccctgtattaagaatttttaaccaagagtctgtggatgggaatgaaattataaaggagattttcatatgtgcagttttaggcagtaattcttaggtctcatcagaatatcaaagtgtttgcctccaaaccaccgagagcctgtggtttatctcatgttgccctagaatgtagtggttaagaagagtgtggcctggccgggtgtggtggctcatgcctctcacttttgagaggctgaggtggaggatcacttgagcctaggagttcgagaccagcctgggctacagggcgagaccccatctctatttaaaaaaaaaaagtggccttggatctagatagacatggattctagtcctgcttcatcacctgtgaacgagtgatgatgacaaatgagttaagttctgtaaactctcatttcctcattggtggaaatagaataataataaagctactactgtcttaatgagattgtaagaaaacaaagtgcttagcactgtatttgctaaaaggacttaataaacacatattttaattaaaattgttaaaatttgttttggaaaatgaaatataaattaaaagatgtaagctaaagtatgaaagctaagctggagaacattgaataatttgtaattttgttcacctgtcagtaagtatgaacagttgttagctcgtagtaataaaagtggaatgttatactcttaattgtgcatactcttaattgtgctgatagaagggagaacaggtaaaaatagttagatcacagtgccttgtagtgaaaatttgtctatttccatcttcctctcttcctcccctaaattattttcttgagcttcagaaaatattgtggcctagattaagattgtcgttctaattagcggataaacaggtactaataaagcatggataatctgcaaaatgcattcttaacttggggcccgtggaccaagtgagtccataagtgaaccttagcgtggagataaactcatgatatttcatacaacatgttatttataagtttcctagagggaaaaagctttcgtaagattattagtggtcataaattgtttttgtagtgtattatctacagtataggtaatggagaatgtttacttcaaaaatagtatggtaggccaagcgtggttgctcatgcatgtaatcccagcactttgagaggccaacgtgggtggatcacctgaggtcaggagttcgagaccagcctgaccaacatggtgaaaccccatctctactaaaaatacaaaaattagccaggcgtggtggtgtgtaccagtaatcccagctactcgggaggctgaggcatcagaattgtttgaacctgggaggcggaggttgcagtgagctgagatttgtgccactgcattccagcctggaatagagtgagactccatcttaaaaaaaaaaaagtatgttaacaagaatttaatatttataagcattataaagattttaggcccagggtaatggctcatgcctgtaatcccagcactttgggaggcccagggaggtggatcacttgagttcaggagtttgagaccagcctggtcaacacggtgaaaccctgtctctactaaaaatacaaaaattagccaggcgtggggtgctcatgtgtaaccccagctactcgggagcctgaggaaggagaatcatttgaacccgggaggcagaggttgcagtgagctgagatcacgccactgtactccagcctggggatagagcaagactttgtctaaaaaaaaaaaaaaaaagaaaagaaaaaaagaaaaaaaaaaagattttagtattttatatatatattttttcttatttaaatgatacagtcattgtagggaaaaaaaaacaactttgagaaactacagagaattgaagttaaaaacaaaaacatgccaccattcagagcgacagcttacaacttcttttgtatatccatggtgtgagactgagaacagtacagttttaaattttacaaaaattatacttcatggtctgatttctcaggtacagttaactatggtcagtctctgtgtgatcaagtattatctgtgtcatcatttttaagtgctgtttaacagtcatatagctgtcacaactttggctgtaagattacggaggtcctgcagccaattaagctgactgaattcctttccttatgggggtccagtgtgcaatggctgtaaacagcagcttccttggtagtgtatgcggcctgtttgttgtataggttgctctaagggaccttggagacaggcctttcagatgtatgttcgtgtttctgaccttgcactaccccagtgtagggtccaaacaggcatgtgaggtgcctttggaaagccccagggcactgtggccagggttcacattggccaagttatgtccatccataccaagctgcagaacaaggcgcatgtgattgaggtcctgctcagggccaagttcaagttccccggctgccagaagatccacatctggaagaagtggggcttcaccaagttcaatgccgatgaatttgaagatatggtggctgagaagcggctcatcccagatggctgtggggtcaagtatgtcgccattcatggccctctggacaagtggctggccctgcactcatgagggcttccactgtgctgccccctcttaataccaatacattctacttcctgtccccccccccaaaaaaaaaaagattagggaggttaataacacatgtttgtttaccagattatcatcattttattaatttaatgattgggaatagaataggaggaaaactaactcagaaaatgggaagagaaaggaataggagaataaattcaagactaaattagggaaagggaatatacggatctgcaaaggaatatcatgtatgacaagcaccgataccacagagcataattcttcatgttgttaagtgttgattttttttctttttctttgcttgttttaagcttattacaaaactgagttaggtttatatcttggaaattccacgttccttaacaggtatttaaagctctttgctgtctcctacctatcaactttttaactttatttcaggaatttcttctatataagaactctggacgccagccagggtgaggttctctgtcaggtttccaggctaaaagtagtatcttttatatttgtcatttgtgcttaatgtttgaagcttttacttttattttttcattgttttaataaattttgttttttagaatagttttagaagccgttgcttttaaataggttaaatgtatgtggttcactctttaaggctctgccttttattttggcatcaagaaatttgttggaccaatggactgttgatattgaccagtgtttaaagtagttcttttcataaattagctcatacataaaacaatttttggtgaggttgaatactgtggagtaatagtcctttcattctttcagcagaattgggctagggaaatgatattggacccactggaatatttgttgctagatggaattctaaaacctaacctggaaagaattttattttgacatgtagattcctcatgaatgtttacttagtattacttttaaaattaaagctacatactttatatgaggcatttagaaatttttatcattgcattttaaaaacataagtgcattttatttaggtgggcagcatataattctacttagataattttgtcaggctggaaataacggtaaaactgagaagaaaataagagaagctcagatggtgggaggatatgtatgatattggtgtaccaacataagtaatacagagtttaaaaaaattaattggcagggaaatgcctataataaagtccctgtgtcccctgtctcctcaccctcctttctgttgtcagctttttgagatgttggttttgatattaacctctatacagtattctgaaacactcttcttatattgctgttgcttcatctatcaattttaggtgtaacctatgaacttccagttatgatatataaggatttcattcttttaccctccccagttctctcagtatagttacatcaattcttagggtagttctaaaaataaaaatgttgctcagcaatgagccaaaaaagttctctagttcattttatatcttgcatgttctctctttcttggtgtactgtcttttcattcagttaattttctatgtgtggatcacttaattctctcaaacgctcataaactatgcatcattaggtgatcttttatccccccacccctggtcataaccctagagtattgattactttctagagttactaccttctcttcagatctcatccttataattcattttgcttgtctctgaggcaggagaaccttagggtctggaggcagggaacctaaggccaattcacgctgacttcctagaattaaaaggaaaaccctaagattccacgccctgagtaacaaaaggaccggaggctaccccgctttgcaacctccccacacatttttgtgtggcaggtgaaaaattgaaattacctctaattggtcccctcctgcaactaatcatgccggtggcagtccaagtcttcatctgcataggagtataactttgtaacttcagcctctgactggtcccactttccataaccaatcagatgtttgcatagggtgtaactttgtaacttcagactgatcatgggccactacttcatttaggtagggtgtataccaagtaaccaataggaaacctctagagggtatttaaaccccagaaaattctgtaactgggtccttgactcccttgctctgactgttcccaccctgtggaatatactttcattttcagtaaatctctgcttttgttgttttattctttcctcgctttgtttgtgcttttgtcctattctttgttcaaagcgccaagaacctgggcgcctccactggtaacatctcctatcttggatctccaagtttcctggattccattttgtcatctttttagctcacttccttgttgtagaggacatcttttctgagagaggatacaaggggagataaatgtgtattagaccttccaggcctgaaatgtctatcctacccttatacttattgatagatcttattggatacagaattggaaaattgcttgcagaatttcagaagtattgatcagttgtattctaggttccagtattgctttggagaagcagtagcccttgttatttttgtgcttttccttcatactctttttttttttaaagttatttatttatttattttatagagatggagtctccctctgtagcccaggctggagtgcagtggcatgatctcggcatcctctgcctcctgggtccaagcagttctcctgcctcagcctcccgagtagctgggactacaggtgcacgctgcccggctaatttcttttgtattttagtagagacagggtttccccatgttgcccaggctggtctcgagctcctgagctcaggcagtccacccgccttggcctcccaaagtgctaggattacaggtgtgagccactcactcggcctcttttgtttttttatttttaatttttttaatttttttaatttttttgagactgagtctcactgtatcgccaggatggagtgcaatggcgcgatcttggctcactgcagcctccgccttccaggttcaggcaattctcctgcctcagcctcctgagtatctagtagagacggggtttccccatgttgcccaggctgggctcgagctcctgagctcaggcaatccacccgccttggcctcccaaagtgctaggattacaggcgtgagccactcactcggcctcttttgtttttttattttttatttttttaatttttttgagactgagtctcactgtattgccaggatggagtgcaatggcgtgatcgtggctcactgcagcctctgccttccaggttcaggcaattctcctgcctcagcctcctgagtatctagtagagacggggtttccccatgttgcccaggctggtctcgagctcctgagctcaggcagtccacccgccttggcctcccaaagtgctaggattacaggcgtgagccactcactcggcctcttttgtttttttatttttttattttaatttttttgagactgagtctcactgtattgccaggatggagtgcaatggcgcgatcttggctcactgcagcctccgccttccaggttcaggcaattctgcctcagcctcctgagtatctggagctacaggcacatgccaccacacccagctaatttttgtatttttagtagagtcagggtttcaccgtgttggccaggatggtctcaatctcctgacctcctgatctgcccgcctcagccttccaaagtgctgggattacaggcatgagccaccgcgcccggcctccttgatactcttaattactctccctgaaagcttttagaatctttatccctcctcagcttcagaaattttgtctgttttggtgggccttttggttgtgaaaattttatttcataatttccttacctccatatttattgctctcacttcttggaactatgttagtcagatattgtacccttcttgattacttccttttcatattctctcttttttttttttttttttgagatgggattgctgtgttgctaaggttggagtgcagtggcgttatgatggctcactgcggcctcgacttcctgggctcaagtgattctcccacctctgcctcccaagtagctgggaccacaggcatgtgccactatgctcagctaatatatttttttattgtagaaaggaggtctcgcgatgttgcccaggttggtcttgaactcctgggttcaagcagtcatcccaccttagcctactaaagtgctgggattacaggtgtgagccactgcaccaggccttttctctccattattaatatttttttctattttgtgggagatttcatttttcccttttgtggaccttttgttgaattttacaaattgctataattttaattggtttttaaactgtaaatgatatatatacaaaaggtatatgatatgtatttgcatacattacagtgctctgaattttgttattgttattttggctccctggccaaaaaatgccctgttgtgtaatctgaatttatattttcataacatttcattcttatttcagtaacgtaatattttatatctctcaggatataaattacagctaaaatctttttttcctttttgtattttgtctgtttcctctaaatttcttttttcttttcttttctttctgtttctttcttttcttccttttcttttttttttttttttttgagatggagtttcgctcttgttgcccaggctggagtgcagtggcatgatctcggctcactgcagcctctgcctcctgggttcaagtggttctcctgcctcagcctcccaagtatctgggattataggcatgtgccaccaggcccaactgattttgtatttttagtggagacggggtttctccatgttggtcaggctgatctcaaacttctgacctcaggtgatccacccgcctcagcctcccaaagtgctgggatttacaggcatgagccaccacgcccgcccttactgtttgtttttatctgccttcaatgatccaaaggcagataaaatttttctcgcatatcttattattgttatcctttcatggtaataagaggggtactaaaaagtgaatttgaaggcctctgtggtcagggcatctcagatgttggccactactgtatgatggttaaatggtgagtaggctttcttgttggggctaaacgggctttttctattccaaaccccaccacaaatacactaaactaagaacactctagaaggacagaaatcatgggacaaaagatgacagctatcagcatagtttggatgacagaaaagggacaaatagtaactcggagtgaaagaaataaacttggtaagagctataaaaagacatttaaaagaagtatatttcaatctttcgctttgagatatgttagtctggtggttgggttaccagataggaagggtacttgaggaggtttaccatttaagtcatatatttcacttatcttgctttcagtttttttttcttttttttttttttgagacaggatcttgatctgtcacctgggctggagtacagtggcatagtctagctcactgcaaccttgacctcctagagtcaagcaatcctcttatctttgcctcctgtgtagctgggattacgggcgtatggcaccttgcctgcctaactttgtttttttttgagacgaggtctcactatgttgcctagaccagtcttgaattcctgggcttaagcgatcctcctgcctctgccccccaaagtgctgggattacaggcatgagttgctttcattttcttgatcacacttgccttctttggtatctggtgttcctgagtttatcttgttcattatgtatagaaaaaacttgttttcatgggtgatacaggaataatattttgttttttttaggatgggaacctgcaggttttaattgtacctttcattagtcgtcttattttctgcctcaggcttcatccctgcctttagagatatcttatgttcttaagtcctgagcctttccagtgttctgtggggttgatttttctttttctttgtaaatccatttcatagctagttggaagtttatttccttcactctgaattacttactatttttcccttttctgtcactcaaaatatgttgatagctgtcatcttctgtttcattatttctgtttttctagagtgttctttagtatatttgtagtaggatttcgaatagagaacaagtaaagtttatgtgtaaaatcaagctggttttggtgaagcttgtagctaaaaaaaattcaagctggttttgactgaaagtgatatttttatttaaaacaccttttccgccttgcattatggatgcaatgtacagcaagggtccccagcccctgggccacagactggtacccaattaggaaccaggccacacagcaggagctgaagggcagatgagtgagtgaagtttcatctgtatttacagccattccccattgctcacattaccacctgaactccacctcctgtcagatcagtggcagcatcagattctcacaggagcatgaatcatgttgtgaactgtgcatgtgagggatctaggttgcacacttttcatgagaatataatgcttgatgatctatcgctgtctcctatcacccccagatggtaccgtctagttgtaggaaaacaagctcagggctcccactaattctacattatggtgagttgtagaattatttcattatatattacagtgtgatactataacgtgcacaatagatgtaatgtgtttgaatcatcccaaagtcctctgggtccttggagaaattgtcttccacaaaacaggtccctgttgccaaaaaggttgggaaccattgatacacagagggaaacgccgtattgagaattcatatacctagacttctcagaattgaatgtaatagaataaaaagtattatttatgtaatatacaattatttaaaaaatacatatatttgtgtacgtgtgtgttcccctgttagactcacagccctttttgaacttgtgtattttggatctggaaggacccagacccagtttcttctgttactttgttcacataatttttgtctttgaagatcatcagtttcttaggtccattatcaagcagtttaatgctcattttctaacacttattttatttatttatttactttttgagatggagtcttgatctgtcgcccaggctggagtgcagtggcgcagtcttggctcactgcaacctctgcttcctgggttcaaacaattctcctgtctctgcctcctgagtagctggaattacaggcacccgccaccatggctggctaatttttgtatttttagtagagatggggtttcacgatgttggccaggctggtctcgaactcctgacctcaagtgatccacctgccttggcctcccaaagtgctggggttacagacatgagccaccgtgtccggccctaacacttattttaaaagtaagtttggctgaatctttggctttcttcatccaaatctgacttcaagttcgttttctgggttttcagattccatttttagtaaatgatctgcctgcctcagcctcccaaagtgctgggattacaggcgtgagccaccacacccggcctgacctcttactttgaacctgatttttctaagttttttatgttttttgagacagtctccctctatcaccgaggctagagtgcagtggtgcaatcttggctgactgcaccttccacctcccgagttcaagcaattcttgtgcctcagcctcctgagtaggtgggattacaggtgtgtgccaccatgcccagctaatttttgtatttttaatagagacgaggttttgctgtattggtcaggctggtcttgaactcctggcctctagtcatctgcccactttggcctcccaaagtggtgggattacaggctgagacagcgcaccccccgacactcaagtttatgacctcactttgtttttgtttgtttttttgagagggagtgtctcactctgtctcccaggctggagtgcagggggcgtgatctcggctcactgcaacctccgcctcccaagttcaagtgactctcctgcctcagcctcctcagtatctgggattacaggtagaccaccaagcccgtctaattttttatttttagtagagaagaggtttcaccatgttggccaggctggtgtcaaacccctgaccttaagtgatctgcttgcctcagcctcccaaagtgctgtgatgacaggtgtgagccaccacacccagcctgacctcttactttaaacctgatttttcctaaacatcaaaggaaaaagctgttaatcagaagaattgtaggagaaatgtgtttatttttcttcttgtgggagttgtgatactatagaattgtaaagctggaggaggccttggaggtaaaaattaaaaccctttcattttgccacagataaaaaagatgtgatgcattatttatatatatttataattatatatttctgtgtgacaaaaatactccaaaagtagtactatatcttaaaacagcagtaaacatttattatcctcaaagtttcaatgggacaggaatttgggagtcctttagctgtttggttctgggtcgggtttcctataatgttttagtcaaggtgttggccaggtcatagtcatgtaaaaagctcatgtggggctggaggatatacttccaagttggcttgctttagatagtgaccaagttagtgctggttgtttattttatttattttttatttttttgtgacagaatcttgctttgtcacccaggctgcagtgcagtggcatgatctcggctcactgcaatctttgtttccccggttcaagtgattctcctgccttagcatcccaagtagctgggattacaggtgcccaccaccacgcctggctaatttttgtatttttagtagagatggggtttcaccatgttgaccaggctgatctcgaaatcctgaattcaggtgatccatgcacctcggcctcccaaagtgctgggattacaggcatgagccaccacacccagcctcagtgctggttgttaatgagaggtcttggtactttctcatgtggtctcctctttaggctgcttgagtgtttttcagtgataggtggcttcctctagagtaagtgatccaaaaaagagcaaggcagaagtgacaatgtcttttatgacctagtctcagatgtcacacattgtcacttccaccactttctattcactagaagtgagttccgtctacacagaagaatatcaagtaatttgtggctgtacttcaaattcacacttggagaaataagattatttccacatgatcatacagggcattggtgatctatttggactacaatatagttgttttgatctgatgctattactgggtgcagattataaattatagttgcttagctgtcatctggtacaagtattattagaaccaggtacttgcgtatgtattaattgcctattgattcaccagaccgttccctgcctttttttgagacatggttttgctctgtcactcaggcatgatcagggttcactgctgtctcagcctcctgggctcaagcctctcgaatagctgggactacaggcacaagccacgatgcctagctgattctttaatttttatgtttttgtagagatgggcctcattatgttgccctgggttgtcttgagctcctggacttaagcgatcctcccaccttggtctcccaaagtgttgggattacaggtgtgaaccactgcacctggctgagatccttttaattatctacatatgccaggcattgtgctactaactgaacatgtctaaggagaactggatttgtttgtaatactttttttttgagactgcgttttggtcttgttgcccaggctggagtgcagtggtgtaatcttggctcactacagcctccgcctcccgggttcaagtgattctcctacctcagcctcccaagtagctgggattacaggtgcccaccaccatacccagctatttttttttttgcatttttagtagagacagggtttcaccatgttggtcaggctggtttcgaactcctgacctcaaatgatccacctgcctcagcctcccaacgtgctgggattacaggcgtgagccactgcgcctggccaatattttttttttttttttaaatacacatatatttttttttacaggagcttgggggggagagagagagagaaagagagagtgtgtgtgtgttgttcctaaacacttttgatttgccagatagcgtcagagcacccctcccaagtagccttcaaggacattaatctaaaaatgtggctgttttattagttgacaacaaaattccttatattaaataaccagctggctttactaataagatattttgttataagtttcctaataacttgctaaacatatattgagtacttgacactggagaaacaaaatgtcacaattcttgtttttaaatagttccatgtgtagaaggacagacaaatccatacgtaaaactgaagataatagctgtaaacctaacatgatgactttacactaactaaaatatcagttgttgttgcgatgctatctttatgttattaaggtgtaccccagcaggaaggaaaaaataaaaacaagtctagaaataacttagtatttgcttacttgtttttttatattattaaaaaatacagctgctgctttattactaatttattcaattttttttctcttataggcaatgtctatgctgcttcaaggaatataagcatttggagatttttaatcaagtagtgtgtgcacttattaacttagtgattgcccaagttcaagtgctccgggaccagctttgtaaacattgtactaccattaacatagattccacgtggcaagatgagagtaatcaagcagaagaaccactgaatatagatagagagtgtaatgaaggaagtacagaaagacaaaaatcaatagaaaaaaaatcaaactctacaagaatttgtaatctgactgaggaggaatcttcaaagagttctgatccttttagtttatggagtacagatgagaaggaaaaactcttactatgtgtggcaaaaatttttcaaattcagtttcccttatatactgcttacaagcataatactcaccctactattgaggtatgtaaaataggtggtgtgaattttaagtaataccaagtcttaacttcgcagtctgtttcttactgataaatatgaagacagttttctgctggcggaaaatcattattgtcaccagaattatttaatgtttctccagagcatttcttcagcagtttgtgctgaaaatttgctcggcatagttcatcctatcaaggaaagatctatacattgaactcagaaattaatctggtagtgatctaaacattttactgctatagatctatgcttattttatgactcttaataaataatagttgagggaaaagaaacacatggaattttaaatttcattcttagaaacagtctacagatcagaatttgcttttatcaagaaaaaaaagcttagcaaattatctgtgattagtagtttcaaataatagtatttccttttctttctttctttctttctttttttttttttttttttttttttgagatggagtctctctctgttgcccaggctggaatgcagtggtgtgatctcggttcactgcaagctccgcctcctgggttcatgccattctcttgcctcagcctcccaagtagttgggattacaggtgcctgccaccacacctggctaagtttaaaaagaattttctttagtagagacggggtttcaccgtgttagccaggatggtctcgatctcctgacctcatgatctgcccacctcggcctcccaaagtgctgggattacagacgtgagccaccacccctggctaagtaatagtattttcttttgtaagttaagatgcttgactctattagtgatgtttttgcaagcatttctaagtatgtagtaacctatcttagacttaactcagataatatgattgatttctaggcatagtgggaattgagacaattatgtggtaatatattaatgacttaacagtggtttattattcctcatgattctcacaggcagttccttagctagttttgtgtaggctgagttatgcaggtgaatttactttgagaactggatgggtaaggtctgggtcgcacttgtgtgtgtggcagttggtagtggctgttatctggggctccttgtattttctccacatggcttattttccactagggtagattggcttccttaaatagtagtcttagcagtgctccaggaaggcaaaagtaggagctgtaagacttcttatgatacagcctttgaaatgtcacagtataattctgccatattctattgtgctgctttctgttacttgaagcggttcacaagggcagcccagattcaaaggggtagtgaagtagactccattgctggggggaggagaggtaaaatttcattttatatcttatacattgtttcctgtgcatcctggaatatgaagaattatggccattagagaatctatgacattttttttgtttgttttttatctgtctcttttctctagcttatttgttctgtaacctttatacctctctttcttcatctgggaaataatagtcctttactgggatattttcatgtcgaatggagacttatttgaaaacatagcttgagggcagatattttccctgttagaattcttcgtaagaatattttaaatcaggcacacaagtcacctacttggccctcttccaagttgtactttctgtccttctttccttactgttctaaagcttttttttttttttttttttttttttgagatagagtcttgatctgtcgcccaggctggagtgcagtggtgtgatctcggctcactgcaagctccgcctcccgggttcacgtcattctcctgcctcagcctcctgagtagctgggagtacaggtgcccgccaccatgcccggctaatttttttctttgtattttttagtagagatggggcttcaccctgttagccaggatggtctcgatctcctggccttgtgatccgcccgcttctgcctcccaaagtgctgggattacaggcgtgagccgctgcgcccagcctctaaagctttttgataaactttcactcactcctgctctgggtgggggagaaagagtgtttaaaagcagattgtgctctgttttctaaaaatcttagcctgtgatcttccagtatagaaacttaaataatctcttacatgatataaaatatattaaatattctgaaaaagtaatcttttttcaacaaaagaaagtcccatcaggcaaacttgaaatatttaatctacataaacaccatctacatagtgctttaatatcttaacttggtaactgaaagatgctgaaaatagtttcgttagggacttagatatgtgaaattcacagaaattttttccaattaaaaatttcttaatgatatagaactatataagtaatactgagtctgctgcttctaaaataaacttgctcatcagtgttttttctttcctgttttcaaaaatggtaatctctaaatgtaggcatagttacactcctgtactttgttttaaagtactttgttattattattcgtgagtattttatgttactacttggttgaaagcagtggttttttgaggtcttcgaggaaaattctgacaaaaaatacccatagagataataaaggagttacctccttataccaaattctattaatatattagatatgtgcctctttaattttcttttcgtaatagttgtttccgaggtttctattatcttaataatgatctgttacaagtgctctaaaatttctagtttctatcccagtggccatttaattaaatgcggtaagggtcaactgtttcaaatggtcttagatcaaagacttggtagcatacatgttataaaattatatatatgtataaattttgtatgtatatacacacaattattttaaagcaaacaaattattatgaaatgtaatacagcttactagagatttttatcccacttttctttgaggaaattgtccatctagtcttttctttgtgctgctgtgctatcctttcttaagcctttgattttgatttttcgttaatattttttaaagaggcacaacttagccaaaattcttaggaggacaagattcaaaactcatgtgttagtattttgatagctgtgtctttagaaacctactcaacacttttattttatagaagaagcaactggcctacagaggttaaaagatttgattgggcatattgctgagaagagtcctagaatccgggtcttactctactgcactacttctaaatcattttgaactaattactgtattctaaataatatgggaacttggagccactccttctgtctcccttccttcttctctttcctattgtccccatcaaagctgatattttaaaaggttcggtaattggacataagtagtactaattcaggatcaaaagggggaatggcctagttttaatttttttccccttaagagacagggtcttgctctgtctcccaggctggagtgcggtggtgtgatcattggtcaccataaccttgaattcctgggctcaaacgatccacccacctcagcctcctgagtagcttggacactaggcattcactacagtgcctggctaagtttatttttattttattattacttttttaagagatggggtttatctgtgtttatggggtttatcgagaccagcctggtctcgaactcatggcctcaggtgatcctcctgccttgacctccaaagtgctgggattacaggcatgagccatagtgccttgccatgctagttgcattttttatcctgaataattatgtgtaattctgtgaaatcagataattgctctagtgttgtaagtttttttctaagtatagggaaaaagattataaaaatgggccgggcgcggtggctcatgcctgtaatcccagcacttttggaggctgaggcaggtggatcacaaggtcaggatatcgagaccatcctggctaacacggtaaaacgctgtctctactaaaaatacaaaaaaaaaaaaaaaattagcagggcgtggtagcgggtgcctgtagtcccagctactctggaggctgaggaaggagaatggcatgaacccaggaggcggagcttgcagtgagctgagatcgtgccactgcactccaccctaggtgacagagtgagactctgtctcaaaaaaaaaaaaaaaaaaaaaaaaaatagggccaggtacagtggctcacacctgtaatcccagcatttttggaagccaagacaagaggaccacttgaggccaggagtttaagtctaggctgggcaacatagcaagagctcatctttacaaaagaaaaaaaaattaactgggcgtagtggtgcacgcctgtagtcccagctacttgggaggctgaggcagaaggatcacttgagccaggaggtcaaagctgcagtgagttatgatcatgcctctgcatgacagagtgggaccctatctttaaaaaagtagaaaggagagaaaccactgcatttatgttaaatatacgtatggtataatcagacagatgaaatatatacatgaaggttttattttttaattttttttttttttttttttgagacagagtcttgcttggtcaccaggctagagtgcaatggcgcgatctcggctcactgcaacctctgcctcctgggttcaggcgattctcctgccttagcctcccaagtagctgggactacaggcgcgcacccaaaatgcccagctaatttttgtatttttagtagagacagggtttcaccatgttggccaggatggtctcaatcacttgatcttgtgacctgcctgtctcggcctcccaaaatgctgggattacaggcgtaagctaccgcacctggacttattttttaatttttgaatcagggtcttcctctgtcactcaggctggagtagtacactggcacaattatgattcattgtagccttgaactcctggactcaagtaacccttcaccttcagtgtcctaagtagctgggagtacaggtgcatgccaccatgcctagctagtttttcaatttttttgaggaggcagggtcttgctctgtttcctgggctggctttgagctcctggctttgggcaatcttcctgcctcagcctcccaaagtactgggattataagatgagctgccacgcccagtcaatttagtattttttagaataataccaacgttgtacaattatcactactaattccaacatcactgagttacttttaagcaaaaattttgagacattgagttcttcatggtttgatcatggagcagcattttcttaatttacatagaattgcctttcctctggccgggcgcggtggctcacacctgtaatcccagcactttgggaggccgaggcgggtggatcacaaggtcaggagatcaagaccatcttggctaacacagtgaaaccctgtctctactaaaaatagaaaaaattagccaagcgtggtggcgggtgcctgtagtcccagctactggggaggctgaggcgggagaatggcgtgaacccgggaggcggagcttgtaatgagccgggatggtgccgctgcactccagcctgggcaacagaatgcgactccatctccaaaaaaaaaaaaaaaattgcctttcctgtatagttactcatttatttctctctgttttctcttttaaaataaccaaatttctctgctataaataggatgggatcaactcatgtagtaaatgggaggtttttgaggaaaaaaaatgcaagactttaaaaatcattgataagtttattaaagcctttctcagcgattacctaaaataagaacttttgaaaaatactgttaatacagctttttttttttttttttgggagacagtgtctcgcactgttgccgaggctggagtgcagtggtgttatctcggctcactgcaacctctgcctctcaggttcaagcgattcaccggcctcagcgtcccgagtagttgggattacaggcgcccgccaccacgcctggctaatttttttgtgtttttagtagagacgaggtttcactgtgttggacagggtgatctccaactcttggcctcgtgatccgtctgcctcagcctcccaaagtgctgggaattacaggcatgagccaccgcgcccgggaccgttaattcgtcttttaatgagacttcctagtgttgttcttagtgttttttttaacctatagatgtgtgttaattttttatatactacttaaaaaatgagattataacattttaggatgctagctttatgtattcatattggaaatagagtggcaaaacagttcccctgaatcaccaaaatagatgtaatcaaatctgagtaacactgcataccaggatagaactcaatttttttttttttttttgagacggagttttgatcctgttgcccaggctggagtgcggtggcatgataacagctcactgcaaccttcgccttccgggattcaagcaattctcaggaggctgaaacctcctgagtagctgggattacaggcatgcgtcacgacacccagctaatttttgtagttttagtagagaccatgttaggctggtcttgaactcctgacctcgtgatccacctacctaggcctctcaaagtgttgggattacaggcatgagccactgcaccggccgttaggagattttttagctgtgcccatgttaggcactagaaatcgtggctctaagattctagcatggttcacctggtccatgattctgtatttaacaataccacaggaggtcttaaattctggactttttgaagaccatgaaaaagttcgttgagattaacataaagcttcacctctggccccggttgtcatagccaggagtggatttaggaggtttaacacttactttgagacttcatttctctaaggacattttttgtttattttgaaatgttctgagttctgtatgattgctttcaatccatgattttcagactttatttcagcagtgtaacttaaatatctaaaataggtgatggcaatgatgaatgggtttctttggtagcttttttcagatgaaagtttctagctagctttctgatcataaaagcagttattttctctctcctccctctttctccttcccttttctccctcccctttctccctcccccgactttcccctcttcccgcttccgcctccttcccccgcttccgcctccttccccgcttccgcctccttcccctgcttccgcctccttcccccgcttccgcctccttcccccgcttctccgtccttcccccactttcccctcctcctcccttaccctttcaccccccttctctccctctctttctgtcctcccccatctctctcctccttctctttcaccaggtctcactctgtcactcatgatcgagtgcagtggcatgaacatggctcattgcagcctagacctcccaagttcatgcaatcctcccgcctcagcctcctgagtatctgggacaacagacacgcaccaccatgcctggctaatttttaaaaatttttaatagagattgggtctcgcccgtgagtacgaggctagtcttgaactcctgggttcaagcagtcagcctcccacagtgctgggattataggtgtgagccactgcactcaacctaaaagcaatctttttttttggaggcggagtctcgctctgttgcccaagctagagtgcattggtacaatcttgactcactgcaacccccctcccccaagcgggttcaagtgattcttgtgccttagtctgctgagcagctgggattacaggcgtgtgccatcacccctggttaatttctttttttttttctttgagatgaagtcttgctttgtcacccagactggagttcagtggcacgatctcagctcactgcagcctccgtctcctgggttcaggcagttctactgcctcagcctcccgaggagctgggactacaggtgtgtgccaccacgcccagctaatttgtgtatttttaatagagatggggtttcaccatgttgtccaggatggtcttgatctcctgacatcatgatccgcccacctcggcctctgaaagtgctgggattacaggcgtgagccattgcacacagccagtttttgtatttttagtagagacgcggtttcaccatgttggccaggctggttttgaactcctgacctcaagtgattcgccggccttggcctcccaaagtgctgggattctaagtgtgagccaccgggcctggccaaaagcagtcttttcagcgtgaatttttttttttttttttttagatggagcctcattttgtctcccaggctggagtgcagtggtgcaatcgtgactcactgcgacctccacctcctgggttcaagcagttctcctgcatcagcctcccaagtagctgggattacaggtgcctaccatcacacctggctaatttttgtatttttagtagagacagggtttcagtatgttggccagactggtctagaactcttgacctcaaatgatctgcccaccttggcctcccaaagtgctgggattacatatgtgagccaccatgcccggcctcagtgtgaaaaattaaatacagaatatacaaaatacagactttgaaaggcctttgaacttctcttttttcttcattctcttctcaaaaaaagttgagatatttccaaacgtaaaaattatgaacatcagatcatgatcataaattttctttcagaaatgtaacaggtgttttgtctgtatgtaagattctaccttattttcagacagcattttaaagatgtaaccttaaaaatcacttgattaaagtatacagtttattttcagtagatttacagagttgtgcagccatcatcactttctaattttagagtatttccatcatcccccaaagatccctcatgcctttttcaccttattatttttaagagttaggactgggcgaggtggctcatgcctgtaatcccagcactttgggaggccgaggcgggtggatcatgaggtcaggagatcgagaccatcctggctaacacggtgaaaccctgtctctactaaaaatacaaaaaattagccgggcatggtggtgggcgcctgtaatcccggctactctggaggctgaggcaggagaatggcgtgaacccaggaggcagagcttgcagtgatccgagatcatgctcctgcactccagcctgagcgacagtgcgagactccgtctaaaaaaaaaaaaaaaattagctggaatggttatgccattcatttagccatcaaattgatggatgtcagttgtttctaattgtgggttaatgagcatcgttatgcgtatattttccagtactagtatgattagttccttagaacaaaaagctagaattgctgggtcaaaggcaatgtgtattttaaatattgaaggatattgccaaatagccttccaaaaagttcatacgaacttatactcaccaacaatggataactgtgcttttaggcagttgaaatcttatgcaatggaagcacgtgtaactcttcagtatacctctagggaattccaaagcagtttcaaaaatcatgaaaaagtttgttgagaaacttttcaaaacaaaaaccacttaactatcatgtatttttatcagaattaccttgagttttattttaaacctttttttttttttttgagacagttttgctctgtcacccaggatggagtgtaatggcgtgatttcagctcactgcaacctctgcctcccaggttcaagccattctcatgcctcagcctcctgagtattacaagtgcccaccaccacactgacaatttttttatttttcgtagagacaaggttttaccatgttggtcaggctgatcttgatctcctgacctcaggtgatccacccgcctcggcctcccaaagtgctgggattttttttttttttttttttttttttgagacggagtctcgttctgtcgcccaggcgggagtgctgtggcgcgatctccgctcactgcaagctccgccttccgggttcacgccattctcctgcctcagcctcccgagtagctgggactacaggcgcccgccactgcgcccggctaattttttgtatttttagtagagacggggtttcaccgtggtctcgatctcctgacctcgtgatccgcccgcctcggcctcccaaagtgctgggattacaggcgtgagccaccgcgtccggccgggattttaaacattgatttttttaaggcaagattacttaatgtttaataaggcaaaatagtgtgtagtatgtactgtggaatggcttctacttaaaggaggactaaaatacaccttagagctgaatcctattagcttcagttaggagtatcactgcttatcaggagtaattgcaaaataatctgtttattcggtttttataaaatcagtcttttatagaattgtattttttaaaggttagtagttgtaacctaattttacttgcttttttttttttaattaggatatatcaactcaagaaagtaacatattaggggcattctgtgatatgaatgtaagtgtttaccttttttattcttttatggaaaattttatttttttaacaaagcctcatccatatgttttattatttatatatgtcttttgagtttctcatcagtatctttccagtattgctaagataaaaattatttgtacgttttcaaataatgacatgttttctttattttcccaggatgtagaagtaccattgcatttgcttcgttatgtatgtttgttttgtgggaaaaatggcctttctctcatgaaggattgctttgaatatggaactcctgaaactttgccatttcttatagcacatgcgtttattacagttgtgtctaatgtaagtattgttttgaattgatcttaattttgggagcaatgtctagcatatcagtaacatgaattttatgctctgaaaaggaaggttttgaatgatttgcatgtgtaatttttttttattttgacaaaatgagtacagaaacgttttaacgatctttattattaagattagaatttgaataaaattaagttacctgttttaaagctaaaaggggtcatgactatctataattatctattttatctaagataggtgactgcataaaacttttgctaattttcattttttaacttatttttttttttttttttttttttttgagagagagggtctcactccgttgtttaggctgtagcttctacctcctgggctcaggtgatcctcccacctcaccctcctgagtagctgggactagaggtgtgcaccactgtgcctggctgaatttttgtactttttttagagacagagttttaccatgttgcccaggccattttaaacttgatcttcctgggattctgtcctgggaaatttttgactttttaggttattggttactttaaatgatgcttgcctaggttactattatagtatgcctgaattctcttacacatgaagattgtaacatttcttcttgcctttgaaaataaggtaattcttctgtatcctgtgagtatcagtttcactgtgaagcacagtggatatggaaagaaagatacttttatttatttttttgacacggagtctcactttgttccccaggctggagtgcagtggtgcagtctcagctcactgcaccctccgcctcctgggttcaagcgattcttctgcctcagcctcccaagtagctgggactacaggcacgaaccaccatgcccggctaatttctgtattttgagtacatgttggccaggctggtctcaaactcctgacctcatgatccacccaccttggcctcccaaagtgctgagattacaggcgtgagcgactgtgcccggcccggaaagaaagatacttttaaatacctgtatattaaaattcattctttaataacctattctggtcataatttaaaaaattggtaaagcaaaagttcagtgtacctttaccaaacactgaaatcttgtgtaatggaattaccttaattaatagctaatatcagatatttaaattatctataaaataaaaatattgggtgaaaagtgactcaaccaaatattttgttgcattgtttccaatgctgtgtgctttgcagtgatgcggtacattggaaacagcactgacattactaaaattggtaataaatgattactatcaaggtcatttttagttaaaaaattccacccattctgataggttgaaattattacatatagtagtagtgtagcatgtaggttaataatgttgcctttttttttttttttttagacggagtctggctctgttgcccaggctggagtgcagtggcatgatcttggctcactgcaacctccgtctcccagatttaagtgattctcctgcctcagcctcccgagtagttgggactacaggcgtatgccaccatgcctggttaatttttgtatttttaatagagattgggtttcaccatgttggctaggctggtctcaaactcctaacctcaggtgatcctcctgcctcagcctcctaaagtgctgggattacaggcgtgagccactttgcgtgatctgagccttaatttttttaatttgcaaaatgggaatgatgatgatatccatctactttagaggattgttttgaggtttaaaatgagaaagattttaaactcataatgtaacacttgacatataaagtgtgtagtaactggtggcttttactaacttcggttgttactaaatacctaagtgatcctgttattctgattgaacttatttgtttgatagaaagttttatgtactttggcattctctgagagaaagtatctcaatttagttaactggaatgctgggataacatttttatttcacactgtggtaattttggagagggcatataattttgaaacaccaaattatcaaagggtttacttaatcaggaatattacataaacctggattaaactgtttcttgaatttatttgtactaattcttgtttaacagtctagtatggaaagcttgttaaagactttattactatatctttaaaagttatcgtttacagggttttttcttccttactttatccgtttttttgagacagagtctcactccgtcacccaggctagagtgcagtggcaccatcttggctcactgcagcatccacctcctgggttcaagcagttgtcctgcctcagcctccctagtagctgggataactagtgcacgctaccacacccagctaatttttgtatttttagtagacccggggtttcgccatgttgtccaggctggtctcgaactcctgacctcctgtgatccgcccacctcggcctcccaaagtgctgggattacaggcttgcaggcttgagccaccgcacccggcctttgttttgtttttgtttttgagagagagttctgctgtgcggtagtagcagctgactgcagccttgatctcccaggctcaagcaaacctccctcccatgtcagcctcccaagtacctgggactaaaggtgcatgtcaccacgcctggctaaattaaaaattgtttttgtagagatggggttacgctgttgcccaacctgtgaagttatcctttactaaatacaaaggtttaggcttagattctgttttatctttctcttcagcccttttatgactgctaattggtgggctgttgtcaatctgcatagttttctttatcttgcaactcaactgaggccgttaaagcaaaattatactatttaaattaatatattttttgaacaccgtaatactataatactatataatctgtttgttaattttctgagaataataactcaatggagtaactctttaataggcatcttttccttataaaaaatattgtagattggctctctgcaagctaatttcttttatatggttaatattttagtgtacattaagagcttagagttctttttgtaatcaagcttgctacagaagctgtgctttatttatttcatagtaatttcctctagtgggtcattgtataaaccctgatcatttttgtatgtctattccttttcttgcgaagtgggcagcttgtttagccatggtgttttggcttcaatagggtgaggtctctatttgggaatctctgaatttcacaggaatgagtagaactatatttaacaatgaaaaaaatagtattagattttagggcagccgtttgtaaagaaaagaaaataactcataaatcacttttgtggcaggaaagatacggactaacgttactgaatacttctttttctctattatactaaatcacacattcagaagagaacatgtttatagcatttcctgggactcaggaaatgatcccattctgtttattttctagtatgatttcctcctcacttaaagaaaaagctatatatttattttgagactggctaatttttgtgtttctggtagaggtagtgtttcaccatgttccccaggctggtcttgaactcctgggctcaaatgatccgcccgccttggcctcctaaagtgctgggattacaggtgtgtgccattgcacctggctgatttcctcactcttactgaggcaaggtaactttgtcagatggtgagtgttattttttcgttttttttttgagctggagtctcgctctgtcaccaggctggagtgcagtggtatgatccctgctcacctcagcctccgcctcccagattcaagcgattctcctgccttagcttcccgagtagctgggactacaggcacgcaccaccatgcccagctaatttttgtatttttagtagagatggggtttcaccatgttggccaggatggtctcaatctcttgaccttgcgatgcccccacctcagcctcccagagtgctgggattacaggtgtgagccactgcgcctggctggtgagttttttttttcagaacctgaatctagaatcctgaaatttcatctcaggaaaactcactcttctctggatttgaattatcaacaaagaaaggaaattcttaccttatcagattaaggttcaaatctgataataacgtcaagcccatacatttgtttcaatctcaaaaactttagcagattcttaactagaacttcagcagttcttaactagctctgagttttaggagatttctcagtttgcacaaatattattccacctattatatggatccgttctttaataacagctgcacccacaagaaaacaacaaagatctttatgtagttttcttactttgcaaatgcagctttttatgtagttttcttactttgcgaatgcagcttactaacatttaacacagcttagagaaatagaacatggaggcatacaagtttctccactgagacccaaatggaagttaatctcacttttgttgagttacacttggttttagcttacagtatccttcctcagccctcagctctttgccagagtttgtcatttcatacataacaccttttattaatttataaagaatccaatagagacaaggggtttattttattatggagtagaaagaagtgcaaatgaggattaataaaaagaacttcacacaaaatatgctttagtcaaaggtataagcttgtagggcttaagtaacgtataggggaacacaatagcaatttctgaatgttcagtgtcctaagactgctttttacaaatatactagcaaagactgtttaatatcagaaactagggtaggattacatattttttgatatctctttactagataggagaataggaaattaagttttcatgatgccactttgcactttgtcagaactaggtttgatgcagaacgctgtttttctgcagttacagggagcaaggaactttttttttctttttttccctatttctgagagttttaacctaggttaaaaggttaggagggctgctagaattccattagcactaagcagggggtggggagaaggaaacctgaaaagctcaaaacttaaaaaaaaatgataaaggacacactgtaggattaatagcatatgcaatttggtttttatgatgttgggatctatagtagtgttaaagaatgctgatttttataatgatataatcctaggtttgaattgtacctctgttgcatagtatgtaattttgttttcattacttttataagcattacttttctcatttatcacaatgggaatattaaggacttagtaaatggtagatcttccttgtattaaaattttttcttgtattgacatttttcttcatttgctgttttttaattgaaatttttaatcacttgtgtctgtgtattctaaaataaaagatataactatgccctctgatgtatcttgtataaaataggatttttaaccttctgttaaaatttgaaaaataacattcataaagaaacgtacacaaagtgataacatgtggctcagtgatttatcaaagcaaatattcgtttaaccatcactcaaaccaagaaacagaacattgtcaactccccagaagcctaccttatgagtcctcaggccactaactattccatctcttctcctttaaaaataaacacaattcatcctttaatgctgatcattctcctgctttttttaaacaaagttttatcacctaatcttatatccctaaacactacaatttggttttgtctgttttcaccatgcagatggaatcacatactatgcattctttcatgcctggttgttttttttaaatgccgaaatttatattgcatgtatgttcatttttattgttgaattatcttttaaaatataccaatttattttactggtgatggacatttaggttattacagttcatatgggtgtcagcattcttctatgtgtgttttggtgaacatgtgtgtgcatttaatttggatgtatatctagaagtaaatgtcttatcagggtgtttgtgtgtgtgtgtgtgtacatatatatatatatatatattctttttctgagatggagtcttgctctgtcgcccaggctggagtgcagtggcgtgatctcagctcactgcaagctctgcctcgcgggttcacaccattctcttgcatcagcctcctgagtagctggggctacaggcgcccaccaccatgcctggctaattttttgtatttttagtagaggcagggtttcaccgtgttagctaggatggtctcgatctcctgacctcatgatccgcctgcatcggcctcccaaagtgctgaaattacaggtgtgagccaccatgcccaatcttttttttttttttttttaaactcccctgtacccccacatcccctcgagtatgcatattttcaaacttgggtgttaaacctatggtttccttaggtggttgtattaatttatacttctgtcaggtctgtgagagttcccctagttgcatatccttgccaagtgttgacttggttttttatagatttctaatggatttatagtagtagctcattgtgattttattattttttgagacagtgtcttactcttgtcacccaggccagagcgcattggggtgatctcaattcgttgcaacctccacttcctgggctcaggcgatcttcccacctcagcctcttgcatagctggtgtgtgccaccatgccccgctaagcagatgtggggttttgccatattgtcctggctgatctcaaactcctgagctcaagcatcctccatccttggccttccaaagtcctgggattacaggcatgagccactccacctggccttttttttatatttatatatatatatgtgtgtgtgtgtgtgtgtgtgtgtgtgtgtataaatatatttttacatatgcttatatataaaaatatatttttacatatgcgtatacgtaaaaatatatatttttacatgtgtgtatacgtaaaaatatatttttacatgtgtgtatacgtaaaatatatttttacatgtgtgtatacgtaaaaatatattttacatgtgtgtatacgtaaaaatatatttttacatgtgtgtatacgtaaaaatatatttttacatgtgtgtatatgtaaaaatatatttttacatgtgtgcatatgtaaaatatatatttttatatatgtgtgtatatgtaaaaatatatattttatatatgtgtgtatatataaatatatatattttatatatgtgtgtatatataaatatatatattttatatatgtgtgtatatataaatatatatacatacatacatatatatacactcacacacacacttttgttgttgtttttttgagatagagtcttgctctgttgcccaggatgtagtgcagtggtgcgatcttggctcactgcagtctccacctcctgggttcaagcgattctcctgcctcagctttccaagtagctgggattgcaggaacctactaccaagcctggctaaattttttgtacttttagtagagatgggatttcactatgtttggccagcttggtctcgaactcctgacctcaaagtgatctgactgcctcagcctcccaaagtgctttgattacaggggtgagccactgcacctggcctgttatatatttctaacgactaatgagaatcagcaccttttcataggcatattacttatttggattttttttgcgaagtacctgtttaaatctctcgcccatttgcaaaattggattgtctttttcttgctgatgtttagaatttccttgtgtgttttagatagacgtctttttaggtagaagtgttttgtttgatatatgtattgccaatatcttccactctcgtgttgcttttcactgttgtgttgaagaaatattattcatcaagcttcatgttgtacagtttgtcatttttctttatggttaaggttttcatttttggttgaaaaagtcatttttaactctaaggccatgaagatacttacaaagttttttttgtttgtttctttttagatggagtctcgctctgttgccaggctggagtgcagtggcttgatctcagctcactgcaacatccacctcctgggttcaagcgattctcctgcctcagtctcctaagtagccgagactgcaggcacttgccaccacgcccagctaattttttgtatttttagtatagatggggtttcaccatgttggccaggatggtctcgatctcctgagcttgtgatccatctgcctcggctccccaaagtgctgggattacaggtgtgagccaccgtgcccggccaaagttgttgttttttttgaaaaattttttcttgcttaccttgatcaggaaacaagtattattgctttacctttcatattttgatctattcaactgcaatacatttttatttatagtttcaggagggattaagattcattttctttttcatacagatatccagtgttcctaacactgtcacaaagacagtcatttcttctttgttctgtagttctacttttgttgcacaggttagtgttgaactcctggcctgaagtggcctgaagtgatccttccatcttggcctccaaaagtattggttacaggtgactcatgcctcatcactacaatgagccaaatcggatgtttttatgtgcatgggtttgggctctttggcatagtataccattctatttgcctaattttgtgctgttttgcctactgacttaattactgaagctttacaagaagtcttgctctctgggaaagcaagtactacctccctgtcatatttctttttttttttttttttggagacagagtctcactttgtcacctaggctggagtgcagtgggacgatctcagcttactgcaacctccacctcctggggttcaagtgattctcctgtctcagcatcccaagtagctgggattacaggtgcgcgtcaccacacctggctcatttgtttttgtgttttcagtagaaacagtttcaccatgttggccaagctggtcttgaactcctgacctcaggtgatctgcccacctcggcctcctgaagtgctaggattacaggcctgagtcactgcacccagcttctccttgtcgtatttctttttttttttttttttttttttgagacagagtcttgctttgttgcccaggctggagtgcagtggcatgatcttggctcactgcaagctccgcctcccaggttcacgccattctcctgcctcagcctcccaagtagctgggactacaggcgcccgccaccacgtccggctaagttttttgtatttttagtagagatggggtttcaccatgttagccaggatggtctcgatctcctgacctcgtgatccgcccgcctcggcctcccaaagtgagatgtgagccaccgcgcctggcctccttgtcgtatttcttagagagttttagctattcttggacctttgtgctttgaatgagtttcataagttctgcatgtaaacctttttggattgtactgaatctatagatgaatttcgggagaactattatcttcacaataaatatggcaaatgtctccttatttacatgttgtttaattgattattttccaactttttatgtagaggtgtgtatcttgttagattactcctagacacatgatatttttgatactgttcttaagggaatcgttttgaaaactgtattatttgttctcaggaacaaataataagaaaagaacatatatagggtgttgtgtgtatgtatagataggtgtgtgcatatttgtttatattaacctagcagcagttttgctaaactctttagtttcagtgtttatctgataattattttgggtttcctaattatataattatattatctcagagtattattttaaattcttctttctagtcctttgccttttatttagtttcttaacttatattgtctaggtccttcagttcaagtggaattgaggcttccttgtcttgttcctagtctcaggaggcaaagtttttaacatttcatcattaacgtagtatttactacagggtttttatagacgtcttttatttgattatagtgaatccctacattctgaattcccaaattcatgtattttattttttaattttttttgttttgagacatggtcttgctgtgttgtccagggtggagtacagtgacgcgatcctggctcactgagacttccacctcctgggttcaagcgaatctcccacctcaacctcccagagtgctgggactgcagacatgtgacaccatgcctggcttatttttgtatttttttggtagagatggggtttcagccatgttgcccaggctggtcttgaactcctgacctcaagtgatccacctgccacgatctcccagagtgctgggattataggcatgagccaccgcgcctgtccagattttttaatttgtatctcctgcctgtgtcaagactcagtatcagagttttttgtttgattggttgggttaggatttttattcttactatttttgaaaataaaactgttatataatgtattcacatttgatttataaatgttaaaatattgtgtagaaaaaatgaggaaatatatttattgtaacttttattataactcagtcgagctgtaagttacttatagtaaacttagtaagtacttgttgatattgtaatcagtgtgtgactgtaaaatatatttgcttcagatactgaaatgactagaaattatgggtaatttgaaatattttaggaaggaatgatgagatgattagttaaaaactaatacggtttattaaaaaactaatacagtgccttgtattggggatgctaccgtacaaagaggtatagagaattatttggtaaggaaatattactttgagagatggttttgtcttttcagcaagaagctaagattaatttttcagacagacttcatgtaaaataagatatataatatataggttaaatttcctgatacatgtgtaattctgttttgtactatactcttttcataattgataatatatgtaattatagaggcagcagaatactaaatgatcctcgtttttgttttgttttttatttgagacggagtctcgctccgttgcccaggctggagtgcagtggcacaatctcggctcaccacatcctcttccccccgccccccccgggggtgggggttcaagcgattctcctgcctcagcctctcaagtagctgggactacaggtgcgcgccaccatgcccggctaatttttgtgtttttagtagatacggggttttactgtgttggccaggctgatctcaaactcctgaccttcggatctgcccacctcagcctcccaaagtgctgggattacaggcgtgagcgaccgtgcctggccaatgctcttgtttttcattagtttagtgaaagatatatgtatttcacatattaggcattaatgttgtttttatgtttcttatatagattagaatatggctacatattcccgctgtcatgcagcacattataccttttaggacctatgttattaggtaagtttataaaatttctttacccccgattatcagtgtaatatatttaaacaatttataatatagaattatattgtttgaaagtcccctatagtcatatcctctagagaaaatttcaagtaacagtttggtatatagtgttttttatgcacatatatggatttatatttaatggttactttttagtaaattatgttggacttttttttacatgagtatgtaaagaattaaagagattaataatggttattccactgtatttagtcagcaaatacacagtaagtgtctgttacgttctaggcactgaggatatagcagagaagaaaacaaattgcaaaaatctctgctcttgtgcagtctgtttacaaaagaagtaaatgataatactacatcagaaagtgataagtattataggataaatagcagcaaaggtggcttgagagttctagggggtgggttacagtttatggggacaggaaaggtctcattgaacgagaggtgacatttgaattttataagtctcaacttaaaaaggaagcctaagaagatggagaaagggttgtactgattagaattaaagtatgaactgtcaggattctgcatattttatttcttgataacatttatgacagtattgtactttttttctcatttgcaaaggtttgagtgttccctttttcacagcactactcaacttttgggagacagtatcaggcaaagaatcagatagtgatgaatgctatgcaagtaagttagtgtgatacagagggagtatggggcctttctgaagggtgatatctgatggacgtgagtcagctattcaaatgattattagaaagacgtattgtagaaggaacatgtcagtataggctttgaagttggcatatgacacaaactagaagcagattggtgtggagaataatgtgtaaggggatatagttttgaaggtggagagataagcaggggcagattattcaggaccttgtaggccactgtaaggagtatggatttaattttttcaatgggagtctattgaagggtttttagcagatgtttcatgattttttaaaagttttatttggcttttaaatagatcataaatatagggtgactggaatagaagctaggaggagaccaattgaaaggtttatatattagtcctggaaggaaagtgatgattacttacagtaggattgttaatgatgattttgaaaattggatgaatgtaagtgaaaataaaatcaataatactggtcattatagggtataaagaaaagggtagcattgtggatgtggatgacattcagcaccccccctcctcaattttttttatttgtactgtggatatcattactgagatgtgaaaatctgggagaacttaaagacaagactttgagaggcctgtgggacttaaatggcactggcaaattgggagtatgaacttgtagttcagaacagttttcattaatgtaagagttgtgagtgtaaagatggtatttaaaaaccataggagtcacctgaggagagcatacaggaaaagagtagaggtgagtctaagatagagctctgtatgggttggttttgctgtgtaagaaaacatccctcaaaacttagtggcttacaacaatagccagccaggcatggtggctcatgcctgtaatcccagcacttttgggaggccgaggcgggaggatcacctgagcccaggagttcaagaccagtctgggcaacatagcgagactccatctctgtgcagaagaaaattaggtggtcgtggtggcatgcttctatagtcccagctaccagggaagctgaggtggaaggatcacttgagcccaggaggtcgaggctgcagtgagctctgattgagcaattgcactccagcgtgagtgacaaagcaagactttgttttataaaaaaagaaaaaatgaaacaacagccatttatcatttctcacagttctctggttagctaggtagttttgtgtgtgtgtgtgtgtgtgttttatttttttttagttttacattttttgtttattttttatttatttattttttttttttttattgatcattcttgggtgtttcttgcagagggggatttggcagggtcataggacaatagtggagggaaggtcagcagataaacaagtgaacaaaggtctctggttttcctaggcagaggatcctgcagccttccgcagtgtttgtgtccctgggtacttgagattagggagtggtgatgactcttaacgagcatgctagctaggtagttttgttgatctgtattgacttggctgaaactggatggtctaggttagccttgttcccacattctgtgattgccatgccgattggtcttgtggggtgagcgggaatctcatatatgtcttgtagttggcttcatgtcagttggagcatcaggcacttctctttcatccagcaggctaaccttggttccttgttttgttggtgattagagttcccagcaagagaaggcaagctcaaaggcttttctagcttccacttatgtcatgtctattaatatctcattggccaaagcaagttacatggcaaggcccagatttaaggtgtagaaatagattacaccttttgatgagaggaatagcaaagtcacattgcaaattcttgtacatataatgatgggaggaatttgtggccattttgtaatccattacaggccttgaggaagactaatgttgaaaggttggacagcagagaaggaatctgccaaagagattaggcagggcctgagaggaaaaccagaggtttgtgggttttggacacaaaaaatgttaatgcttacaatgtacattttaagttactgagtggtctttaaaaatgctttatgaatttttgtgtattttctatttctgaatcatttcaggtatttatgcaagctctcggatcaggagttacgacagagtgcagctcgtaacatggctgacttaatgtggagcacagtcaaagaaccattggatacaacattatgctttgataaagaaagcctagatcttgcatttaagtactttatgtcacctactttgactatgaggttggctggattgagtcagataacagtaagctgtatttgttttatttttggtcatcgtttatttgttttctggtctatcataatactacccactatttatggagcacttcatactaggcattgtgctaagtattttatgtggattactttatatggtcttcacaaataatttctgtgtttctcttattttaaataagtctgaagcttagatttatatggatttatactgtgggtccatttgatttccgggtccaactctttcatcattttgtttctgtctttttaaactatttaggtttttatgtttatagatgttttgagaaagaggaataattggagggctttataagcagttaattaattttccaggcagaaaccatagattattgggccgtaggccaaattttactaaatgtttgttttgaatagtcttaaatactgtttttaaataggacaaagtaacatgaaaatctgtattcttggcttctcttggtgagggggttggaagaaggcctggtattcttgggtctgtattcttgcataacaacagtctgttagaactaagtaattaactttatccctcagaatgaatatgctttctccggtttgttgcagtccccatttgctttactcctttacatttctgggtttttgttttgttttgttttgttttttggtttttcttggagatggagtcccattctgttgtgcaatggcatgatctcggcttactgcaacctccacctcctgggttcaagcgatgctcttgcctcagcctcctgagtagcagggactacaggtgtgcgccacaacacccagctaattttttgcatttttagtagagatgggtttttaccgtgttggccaggctggtctggaattcctgacctcaggtgatccacccgcctcatcctcccaaagtgttgggattacaggcgtgagccaccccacctggccacattactgtttttgttttgttttgttttggtagtgtagtcacactgaaaatgtgaaataggtggagtttacttgtgtaccgggtttcataaatataaaagatacttgttgatattgtcccagataaattaaatcttgagtggatttatctggggagtctttcctgaaactttgtctataatgacatattacttgctctcttgcgttaaattgttgtgtttttttacttactcagctttattttctccagtgcacttagtgtaataaagaatactatttgtggaatgaatttagtgttgttttttttttttttttttttttttcgtttttttgagatggactctcactctgtcgcccaggctggagtgcagtggcgcgatcttggctcactgcaacctctgcctcctgggttcaagtgattttcgtgcctcagcctctgagtagctcgcgttttaggcgcatgccaccatacccagctaattttgtatttttaatagagatggagatttactgtgttggtaaggctggtctcagagctcctgacctcaggtgatccacctgccttggcctcctaaagtgctgggattacaggtgtgagccgctgcgcctggccattatttagtattttaatataacagaaatagttttagtaattgggaagcgtgtgtctctgattatgtcttagattttataatattaatctagttattgtgatctacatatgtcaatcagtttaccatgttagtatttgctgacaaatgcaagaataattttggaaataaaaacccttaatttcttgtctttaatcatagaatcaactccataccttcaatgatgtgtgcaataatgaatcattagtatcggacacagaaacgtaagtaggagcattaatttatatataagtataccattttaatgtacagttgtttatatggtaaattctaatttttagatttaaaatttttactagaaattctttgccctttgacattgtgtacagttcttcatgaagctttcagaacattatgctgtctgtaacataactcactctccctcttttttttgagacagggtcttgctctgttgcccagggtggagtacagtggtgggaccatggctcactacagcctcaagttcccagggtcaggtgatcctcccacctcagcctcccggatagctgggaccataggcgcatgccagcatgcctggctaatttttgtgatatttgcagaggcagagttttgccatgttgctcagtctagtcttgtagactcaagccatccacttgcctcagtctcccaaagtgttgggattacaggcgtgagccactgtgtctggccacatttctctcttttaaaagcgtatgcgaacatatagtactatttgtcacagtatgaaagcatactgtttatactggagaatttagtcttgaaaaatatggtactgatagttttcagaaagtacactgtcttagtccaggctgctgtaacaaagtactgtagattggatgacttataaacaacagaaatttatttcccatagttctggaggctggaagtccgagatcaggttgttggcagcatcgtcaagttctggtggggtccttcttctggactgtagatggccattttcttttattttcgcatggtggaaagaggtagagaggtctctggggtcccttttattaggccactaatcccattcatgaaggctccaccttcatgacctaattatctcccaaaggccccatttccaataacatcacattgggagttaaaaaagtagtttttatagcttaaacttctttggttctgagaaatatatgtattccatttaattgttcatctagtatagaaatcagttttaaaaatctcaaacagtaggatagaatattttctggaacagagttggattggtttgttagaaaattcttgattatacatgtgagtcatactttagtgtaacttgatgttactactgctctaaggcgctaatcccagttgaacctaggtcttcatgaatttggaaaccagagactgtctcttgactcttttttcccttcaggctaaagagttcttattctcccagttgttctttatgtggtatggtttttggatttatcactatatgagttattcatctctggcaatattctttgtcagtgatccccttaaagtgtgttgcctagaatttttcattgctttataaattctggattatattagaagtgttgtttcacactgtcaagacattatgtagacgatatccagtgtatttataaagctacagctctgtgccaggcacagtggctcacgcctgtatcccagcactttgggaggctgaggcgggcagatcacttgaggccaggagttcaaggccagcctggccaacatggtgaaattccatctctactgtaaatacaaaaattaggtgtggtggcgcatgcctgtgattccagctatttgggtagctgaggcacgagaatcacttaaacccggagacagagattgcagtgacccgagatggtgccattttcactccaacctgggcgacagagcaagagtatgtctcagaaaaaaaccaaaacaaacaaaataaacctacagctctggattttcattttcatcctgtgtcccctcacccctccacctccgcgagaccgcttaaagagaaccttatgtaattgctaatgtgatattcatactcctctcatcccctgtgaaaaggacaaaaattgggaatgttcactgcagtaataacacattcaggctaggtgttgtgtgaaaacagtgaatgggggaataagaaggaattccaataacaaatgcaaggaatatacatcccaaagacatgtttaagagaatagggaggagaacaaaagtattgaggactggtggtaaagagttcaagatggcaagggagagtatgtgtacagtgtgagaaaattggagtaaacagaaaaagcatgtgataaatattgttggcggctgtgaattgggtatttttaagcagttttattaacatataaatacatataaaattcactttttaaaatatacaagtcaatgaattttataatagtaaattcttagagttgtgcagctgtcaccacagtccaattctagaacatttccatcacttaaaaaagatgtcttttgcccatttgtagccagtacctattatttccagcctcactaatctactttctgtctctgtagatttacccattttgagatatttcatttaaaaggaatcaaatgatagtagtcattttcttctggcttcttttcatttagtatactcttgttcgtttgtttgaggttcattgagattgtagtttgtctctgtactttattcctttttattgcttaatagtatcacattgtatagatataccacacttgatcaagtaccagttgatggatatttggattgtttctacttttttttttttttttttttttttttgagacagagtcttggtctgtcacccaggctggagtgcagtggcgcgatcttggctcactgcaagctccgcctcccagattcacgccattctcctgcttcagcctcccgagtagctgggactacaggcacccgccaccacttccggctaattttttgtatttttagtagagacggggtttcactgtgttagccaggatggactcgatctcctgacctcgtgatccgcctgccttggcctcccaaagtgctgggattacaggcgtgagccaccgcgccccgcctgtttctactttttgattaatataaataatgccattataaacatttatgtaaagtccttttgtgatcatatgttttcatttttcatggtagatacttaggattagaattgttgcttatatgattagtttacctttaactttcattggagctgtcaaactgttttccagtatacctgcattattttacatccccactagcattgtaggaggtttccagtttctccctattcttgccagcagttgttattatctagatttattattgccatttagggggtgtaaagtagcatttcatcatggttttaatttgcatttccctaattattaatgatgtagagcagctttttatgtggttatttgccataatgtttcttcattcacaatattgtccagtttttaattggattcttggttgtgttttatggcttaatgtggtctgtactacagactgttctgtgtgtgcctaagaagactgtacattctgctgttgtcgtatggggtattctgtggggtgttctatagatgtctattaggtcaaattggtttgtagtgttgttgtctgtttcctatattcttgttgcattttctgcctagttcttctctattattgaaagtaggagactgagtgcagtggctcatgcctgtaatcccagcactttgggaggccgaagctggtggatcacctgaggtcaggagttcaagactagcctgggcaacatggcgaaaccccgtctctactaaaaatacaaaaattagctgggcctggtggtgaatcacttgaacctgagaggtggagtttgcagtgagccgaagttgcgccactgcacttcggcctgggcaacagagcaagtagtctctcaaaaaaaaaaaagtattgaagtctccagatacatttgatcctgagtgtgtgcagatttggtcatctctgtatgagctctgaagcaagatgagagtgccaccttgtttgactttaggtgggaatgtgcatattggaaaattctaatctttcactgctatgtgcatgtctgtgagtgcctatgaaaatgccacaagtactgattttggagttacaaataaaatgcagcaaatggatgagttaacaaatatagaaaccatggaagagaagaaaaaatatttttcttcacaaatatggaatatggagatggaggtgctgaggggcagtgtggtggagtgtaagaagtcctggcgccacttggatgcggtttgaatcccaaccctaacacttgtttaggcataagggttggcctcaggcaaggcatctaaacacttctgaacctcattttctctgtttttttttttttttttttccctgagatggagtctcgctctattgcccaggctgaagtgcaatggcacgatctcggctcactgcaacctctgtctcctggcttcaagcgattgtgctgcctcagcctcctgagtaactgggattataggcacctgccaccacgcctggctaatttttgtatttttcattagagacagggtttcaccatgttggtcgggctggtcttaagctcctgacctcaagcagtccacccgtcttggcctcccaaagtgctgggattacaggtgtgagccaccgtacttggccacgccattttctcttttgtaaaatagagaaaatagagtcaaccagtatgagaggtttttcagattcaagatctgtgtatgatatctatattatgtacatatttcctgtagggccaagggttcagtattagctaattcagtgtttgcagtgactctgtagaatataactaatgcgagtaacaagaatcagctgtattgttgaattgtgtgtttctccttttaattctgtcatcagtttttgcttcatgtatttcaggaattcttttgttaggtccatatgtattcctggtaacttgatcctttttttcgttttaaatgtcctttgtctctttcagacattttttggcttagtctattttatttgttattggtataaccactgaacctttcttaagcttattgttggcatggcttatctttttccattcttttattttcagtctgcttgttttgaagctaaagtatgtcttgggggtagcatatagttggatctttaaaaaaaaaaactagtcatataatctctgccttgattagagttcttaattcactaataattttatatagcttgttttacatctcattttgctgttggttttctgtgtatctcatatcttgtttctctatttctcctttactatctatttttatagtatatatatatagattctagtgtgacattttaattgcattgatttaaaaaatatcttaattttcttagcgattttatgggttaaatatgcattcaacttcttgacattcatactgatttaactctaataaaataagataaaaaacatggctcctacgtagctccattactgtttgggataagaagttagctattaatcttattctggttcccttgtgtatgcttagttgtttttctcttactcctttaaatcatttgactacaatatgtgtagatgtggatttctttgtgtttatcctggagtttgttctacttcttggttgtgtagatgaatgtgtttcatcaactttgggaagtttggggtattgaaatattttttctggcacctcttcccactttgacccccattgcatgtatgttttcagacctccgaatagtggttattaatggtactgtccaattttatagttgcatcattattacgaaagtccctgggtctcccctttaaatttttgagacagtgtcttgctctgttgcccaagctggagtgcagcaacagcacgattatgccttactacagctctgacctggactcaaatgatcctcccacctcaacctccttagtaagtgagaccacaggcatgagccaccatgcctggcggaaacaggctttcattacgttgcccagcctggcctggaactcctaggctcaagcagtcccctcgacctcagtctcccaaagtgctaggattacaggtgtgaaccacagcaccagcctgggtcttctattaatgtcctttaatagacttaaataatagtggaattttttttagaaatgaattttgtttcttgaactattatgtaaatcagagggttgaattttatgtatcgtaacttcagtagggctactcagaaataggtaaaatatacctagttttatttttaatgttttaccctttgaggtccatatgtgtaagtcctagtggtttttttttaataaataaaaattgttagcataaaattctattatagaatgtaaattcttcattggatatgcaataagaaagtaaattacttaatctttccagtttatctgtatataatatagttgaaaaaattggggaccttttattatacaatttattttgaaacttattttcttccacccattttataatatagtcatatggtacttaatgacagggatacattctgagaaatgcatcatgaggtgacttcattgtacaaagttacacaaacctaggtggtataacctgttgctgcttgactccaagcctgtacagcatcttactgtacttaattctgtgggcatttgtaacactttgtaaatatttgtgtatctaaacatatctaactgtagaaaaaataatgtaaaaaacctgcaaaaaagataaaatagggtattgcctgtataggacgcttaccaagaatggagcttgcaggactggaagttgctctgggtgagttggtgagtgatcgctgagaagatgtgaaggcctaggatgtgactctacactactgtagactttgtaagcactgtacacttaggctatacaaattatttaaaaatttttttcttcactattaaattaaccttagcttactctaactttttatttacttttataaacttaaaattttttaacgttttgactcttataataacatttaaaacacaaacacgttgtatggctgtacaaaagtattttttctttatattcttattctgtgagctgttttctttcctttttttttttttaactttttaataatacacatggagctgtcatctcccatgctgactgtgcctttttttaaaaaaactagaaagagtatcctttaaagatgaaaagtataataaatacataaaccagcaacagtcatttattaagtattatatactgtatgtacatgctatacttttatatgactggcagtgcagtagatttgtttacatcagcatcaccacaaacctgtgagtaatgcattgctctatgacatggtggccacagtgacattaggtgataggaattgttcaagtcacttttaatcttatgggaccactgttgtatatttggtccatcctttggtctgccattgaccaaatcattattatgcagtacatgactgtctgttacttcacttttcatctattgaatcttcaatagtatcagccaggagacttacagtttggcttggggataattcttttgttgttcatccttttgacaacctattttcctgatattatctcattataaagggcatactgggaaacctttcctgagtgcttcaatacatactgtggaaattaaaaagtgggaaggcaaagacctcgagtaggataatacatcactaaatcagtgttacacttgtgtacttggtgttaatcgttaccttttcagttattcgttgcttgtttataaactcagggaatttgaatttataaattcagcatcatatttcattctagttatgctttgtagtattctataaaactgattgtatctaattctttataattcctataggaacaaatttaggttttcaattgactctaccttttagacatgagaaaagatgacaattttttttaatgtactattttcattgcttgactttaggtccattgcaaaagaacttgcagactggcttattagcaacaatgtggtggagcatatatttggaccaaatttacatattgaggtttgtggatgattacataacttctctgttctattgatagagaagaatatttttaaaaattgatattaagtttttcttttccagattatcaaacagtgccaagtgattttgaattttttggcagcagaagggcgactgagtactcaacatattgactgtatttgggctgcagcacaggtaatattaacagctcacatttattgagtgctttgcttatcatatgttctaagtgcttctctgtgaggtaaattctattatcctgttttatagctaaggagaccaagacatggacaagctgggactgaaatctggcttccgagtccatgtcttactatgttactggtagaatggaaggaaatcagagtcagtcagttggagcttcttcatgaaaccatcctggtttaataaagagacattttcctgttattctcatttatacagtctacccttctatcctgaattattgtattggtatgtttcttgtctgatgtactgtttttttttttttttttttaaataggcatatatccacatgattcaaaattccaaaagtaaatataaaaaatatattacatgtttttcctttctgccccatctctcaagcatgcagttattatcttctcaggtatatcagatttttttgtataaatagcgaactgtatacatttttcttcctctttctttttcacaaatgtagcataccaaccagatgtggctttgacttttttttttttctttcttaatttattctggagatttctcatcaatatatgaagtgctttttatcttcttgtaaaactgtatagtgtttaattattttttccctcagtcttttttttttttttttttttttttgagacggaatcttgctttgtagcccaggctggaatgccatggcgcagtcttggcttactgcaacctccgcctccccggttcaagtgattctcctgcctcacgctcctgaatagctaggactataggtatgcaccgccacgcccagctaatttttgtatttttagtagagataaggtttcgctatgttggtcaggctggtctcgaactcctgacctcatgatccgcccacctcggcctcccagtgtgctgggattacaggcatgagccaccactcctggccccccgagtcttttctgttacaaacaatgctgtaataagtaacttctaacacattcatttcatccttgtgtgaaacttttgtgtagctatgataaattcttacttacaagtagaattagaattactaggttaaagaatatgtgtggtttacttgtggtagatactggtacggcagtttcactttccccttaattttgtcagcacattaaattacatgatctttgccaacctgatgggtgaaaagtgatatcattggtattttaaatttgcgtttcttttatcatgagtgagtttgcaaatcttgtgtttaagagccattttgttgctttttctggaattgttcatattttttgctatttatcaattgtttttcttattttttttatttgtaggagttctttatgtgtcactgaagttgatcttttgtttgtgattacaacttattactgtatcctggtttgatgcctttttgctttgcttaaggtggtttttactgttcagtttcatatttgtggttgtagtttttatggtctgtagattttgtatcttggtttgaaatgccttctccattcacaacattataagagaattctcctttagtttctccctatacattttctattgcaattatatatcttaatctttgatccagctgggatttatgttggtttaaagtgttatgtatgtgtccaactttcctcccttttttgttgtgcaatttttccaattccatttgtttactaactcttctttctgacttgatataccaattttttcttgactgggtaattttttgaactttctagactgacctatttgtgtgtataattatgatctataccagggattggtaaacttatagtctgtgggccagctatctgtttttggaaattcttgctacacagacatgcccattcttcttttttttttttgagatggagtcttgctctgtcacccaggctggagtgcagtggcgtgatcttggctcacagcaacctctgcctcccgggttcaaaggattctcctgcctcagcctcctcactagctgggattacaggcacgcgccaccacgcccagctaatttttgtgtttttagtagagaccgggtttcaccatgttggccaagatggtctcaatctcttaacctcataatccttccgccttggcctcacaaagtgctggtattacaggcgtgagccaatgggcccggcctgacgtgcccattcttttacatattgtccatggtggcttccacagcacaacagcagagttcagtaatcataacagagaccctgtcacccataatcctaaaatatttactttccggttgtttaaggacatgttcatcgagtttatactaatttttttctttatttttacttgcctctttgtaatatttttaaatgcctgagacgactagtccttcctcattattgttataacttttctgtcttatttatttcttcatacgaattttagcattggggtaaaatattttcattgtgttaatgatgattaatttgagaactgaagttctgtcttcctgtccaaagtatgatactctttttcttttttcttttgcattattcacagtctcaaagttatttgtatatagatttttatttcgtgctatgcttaatctaaggaatttgttttttattgctattataaattgtgatttcttcaattatatttcttccattatgttgctatttcttttactatatttagtgatggagatatagagatatatataaaattaaaatatttttcattactaatgattgtgtgccttgagccttcactgaattcttaggttggttgtggtagattttcaatgtattttctttgacttcccatgtctaacattgtgtgcttgtttgtttgagatggagtctccagccctcacctaggctggagcgcagtggtgtaattagctcattgcagccttgaacttctgggctcaagtgagcctttcaagtagctgaaactacagacacgagccaccacctggcaaattgcatttgtgtgtgtgcgcgcgcgtgtgtgtgtgcgcgcgcactcgtgcttctaaacatatttaaattattgccttataagacagtgtcgcatactgctagcatgtgaagtcataactgtacttgagttacagtctggccactgcaatagccctttctatgttacgtttcataatttgaatcttagtccttctcgccctttcaggaactgttactaggagggattatttcttcctctgttacatattcatatctcttgtctgtactggattttttatgttgtgggtctcttcatatgcctttgctgtttgttctgttgccaaggctagagtacggtggtggagtcttgacttgctgcagcttctgcctcctgggctcaagttattgtcccacctcagcctcctaagtagctgggactacagatgcacaccaccatgcttggctaatttttgtgtttttttgcagagacgaggctttgccttgttgcccagactggtctcgaactcctgagctcaagcgatcctcctgcgttgcactcccaaagtgcaggggttatagctgtgagccaccacacccggccacattcatatttctaagagacaactacataaatgttgtatatactttggaatttcacatatttttctattagtgctgtctctcaaatggaactcttgtctggcaacttctcggggaatagtattggaggcataactactcgtacttttctcatttgtctcatcaagctttcatttcaggttgtaggactctaaatgagagaatgtacagtggtaccagtatctgtatttacatgcaattactttatgtagttttctcccccagggaagatctctggtggatgggttacctatatgttggctgctcgtgtttttctgactgacgggtggctgacagaaagaatcatactttatagaaaacttcatttaagtcccgtctccatctccatgtcttccttctgtccatcaaatctcttattctgagcccagaatctttctcagttatgttgggaagatcatctcacctacctcctctatagctttcttacaacttactctgagctacaactttctttacctattacattttaaaaaggtattcactgtctgggcgtggtggctcacgcctacaatcccagcactttgggaggccaacgtgggcggatcacaaagtcagcggttcaagaccagcctgaccaacatgatgaaaccctgtctctactaaaagtacaaaaattagccaggcatggcggcgcatgcctgtaatcccagctactcaggaggctgaggcagaggttgtagtaagctgagatcacgccattgtaccccagcctgggcagcagagtgagactgtgtctcaaataaataaataaataaataaataggtgttcccagtcattttagtctttcagaaatgtgtaagttttgtgtctgatgggaactttaattttctttgtggatttgttctttttattataaagtacagtaatgattttcttctctagaggatgatgaaattcaacaattttctcctttctcattttccacctcccagtttttattgttacttgtattttatcaaatattataacatttagattatatactataaccgtaattcccacagttgtttagtattatgctatatttaggtatgtgactctgacaaatcctttttcctcaactcctgtttttgtcattcctttcttccttactccagaattaattgtatttattcttatggatttcacagagtaggttttttttcctgaagagaaatttgtggatgttatattctggagttgtacacacttgaaatgtctcttttgtttattcttaaagaagagtttgagtgaatgttctcctcatttcctgctggcaaggtttttctctcatgtggtttgtctttttttaaagtgttcattgatcccatgagggtttttgtgttctgttttgttctgagtttttgaaggcatacatacatacatacatacatatatacacacacacacacacacatttataaataaacacacgtgtgtgtgtgtgtgtgtgtgtgtgtgtgtgtgtgtattttgaaatggagtcttgctctgttgcccaggctggagtgcaatggggcaatctcagcttactgcaacctctccctccctggttcaagcagttctcctgcctcagcctcctgagtagctgggattataggcgcgcacctccatgcctggctaatttttgtagttttagtagagacgggatttcaccatgttggtcaggctggtctcaaactcctaaccttgtgatctgcctgccttgatctcccaaattgctgggattataggcatgagccaccacacccagcctatttatttatttatttatttatatttttaaattatttttttgagacagagtcttgctctgttgcccaggctggagtacagtggtacgatcttggctcactgtaacctccgtctccggagctcaagcaatacttctaccttagcctcccgagtagctgggattacagacgtgcgcaccaccacattgtctaatttttgtatttttaatagtgacgaggtttcatcatgtcagctaggctggtctcaaactcctgacctgaagtgatctgcctgtctcgacctcccaaagtgctgggataatagacatgagccactgctcctggccttggttgaaggcttttaatatatatgtactttttcttgtattttccttttattttatagtgtcgtaaaatatgtataacataaaatttaccattttcaccatttatatgtgtacaagttaatgggatataagatattcataatgttgtgtaactatcaccactatctgtatgcaaaacattttcatcattaccagtaacaactttgtacctataaaataataactcttaatttccttcgtcctttcagcccctggtttcttctgttttacattccttttttggagacagcgtcttgctgtatcacttgggctggatgcagcagcacaattacagctcactgctgcagcctcaaaactcctgggctcaagtgaccctctggcctcagactcctgagtagctgggactaaagcatgcctacctaatttttgtattttttgtagagatggtgtcttgtattgctcaggctggtctccaatgtttgggctcaagccattcacctgccttggtctcccaaagtgcggggattttaggtgtgagccaccatgctcagctgttttacattctgtcatcttctgtctccatgagtttgcctattctaggtaccttctataagtggaatcataatatttgtccttctctgtgtggcttactttactaacataatgtttccaaagttgttattttataggtacaaagttgttattggtgatgatgaaaatgttttgcgtacagatagtggtgataatctatgtcatagcaaacattaaaatttcattccttttatgactaatactctactgtatgtatatactgcattttattcatccatcagtggacatttgggttgtttccaccttttggatattatgagtaatgctgctgtgaacatgggtttacaaatatctgttccatttcctgctttcagttattttgtatatacagtcatgtgttgtataaccatgtttcagtcaacaacacaccacatacatatacaacagtgttcccgtaagattataatggagcttattataatttgtatcacctcatgacattgtgataactgtcctagtatagtgcaacaaattactttttctgtgttatttaccgttgagttacagttgcctacagtattcagtacagtaacatgctatacaggagcagtaaactatagcatatagcctaggtgtgtagtagactctaccatcttttgtataagtatgctctgatgttcacaagagggcatttctcagaacgtatccctatcctgaagccacacaagatcgtgtacctaggagtaggatgtctggatcacatggtaattctgtgttaaactttttgagaaggcaccaaattgttttgcacaaaagctgcaccattttacattctcaccagtgataccagagggttctggtttctccacatccttgcctatacttgttacttccattttgaaaaaaaattcagctatcctagtaggtgtgaatttgtatctcattgtggtttttatttgcattttcctggtgattaattatattgaacatgctttcctgtgctcattggctatttgcatatttgcttcggagaaatgtctgttcatgtcttttgcccatttttgattgggttttgtttggttttcttttgagttttacaaaaaatattctggatgttaatttttaaaatcaggtatataatttgcatataatttctctaagtctgtttttctttttaaattgagatataataggcaaatactgagaaatactatacaaatataaaaattatgtatttaaggtgtacaacttgatgttttaatgtgcatagtgtgaaataatcactacagtcaagctaattcacatatctattacctcacatggttaccattttctttcaagtatgtaatacagtattgttaactgtagtcacattgctgtacatgagatctccagaatttactcattttggagaacttaaactttatactcttttactgatgtcaacttatttctctctcctcctgtactctccgcttctttgactactttaaattcatcatgtaagtgagactatgcagcatttatctctctttgtctggtttatttcacctagcataatctttactagggtcagtcatgttgtcaaaaatggaaggatttcctcctttttaaaagctgaataatatccctatgtgtgtatgtatatgtacaccacattttgtctattcatctgtggaaagatgtttagttttttttccatatcttggctcttgggaataatactgcagtgaatgtgagagtgaagatatctctgagatagtgatttcatttcctttggatatgtatccaaagtgggattgtggatcataacataagatagttctgtttaattttttgaggaacgtccatgttgctttcaaaaatgactgtaccagttttcattcccaccaacagtgtataaggattcccatttctccacatttcttgctaacatttatcttttgtctttttgataatagttgttacaacgtaggtgtgagatatgcttttgatttgcgtttctctgatgattagtgatattgagcagcttttatacctattggctatttgtttgtctttttttgagaaatgtctattttctttgccctacatagggttatttatttatttatttatttattatttttttgctattgagttgtatgagtttcttaaatattctggatattaacccctaatcaatacatggtttgtaaatattttattccattttgtaggttgctttttcactctgttgtttcctttgctgtgcagaagcttgttggtttgatgaaatctcaattgtatattttggcttatgttgcctatgctaatagttcctgtcaaaaaaattatttcctagaccattgtcaagaagctttttaacctgtgtcaccttctagtagttttacaatttcaggtcttaaatgtactttgaagtttttaatccattttgagttgatttttgtgtgtggtataagataaggatccagtttcattctgtatgtggatatcaggttttcccatcaccttttgttgaagagactgtcctttccctatcatatgttcttggcatccttctggaagatcagttgattgtagatgcatggatttgtttctggggtttttatttgttctatgggtccatatgtctgtttttatgccagtgccatatataatatgtatttttaatggacagggtcttgctctgttgtccaggttggagtgcagtggttcagtcacagctcattgcagcctcgacttcctgcactgaggtgatcttcctgcctcagcctttcaaaatagctaggactacaagagcatgccaccatgcccagctaacttttaatttttttaaattgttttgtagagactgggtcttgctgtattgcccaggcagatctcaaactcctggcctcaagcagtcctccttcctcagcctcccagattgttgagattacatgtgtgagccactgcacctggctcatattgttttgattactgtagtcatgtaatgtattttggaattaaaaagtgtgatacttccaactctattcttactcaagattgttttttgctatttggggccttttgtggttctgtatgaattttagggctgttttttctatttttgtaaggaatgccattgaggctgggtgtggtggcacacgcctattaatcccagcactttggggaggccaaggagctaacttctgatagcttgagctcagaagttcgagactagcctgagcaacatgctgaaaccctgtctgtaccaaaaatacaaaaaactagttggatgtggtggtacgtccctgtagtcccagctacttgggaggctgaggtggaggattgcttgagcccaggacgtcgaggctgcaatgagccaagatggtgccactgtactccagcttggctgacaaaatgagaccctgtctcaaaacaaaagactgccattgagattttgatagggattgcgttgactctgtagattttgggtggtatggacttttaatgatatttttccttcagtgcatgaatatggaatgtctttttatttatgtgtttcttctttaatttccttcagtgttttataattttcagtgtacaagtcttttacttctttggctaagtttatttctacatattgtaaaatacttttgttgctgtggtaaacgggactgttttcttaattgcgttttcagatagcctgcttgtacttagaaatgctgctgatttttttatattaacttggatccagcagctttactgtattcatttattagttctaacagttttctgttgttgtggagttgtaaggtttttctacatatatatgatcatttgtaaaaagataatttttctttcctgttttctatttggagtccttttattccttaagtcttctctcttggaatttcagtattaaattgaataggagtggtaatactggggcatccttgcctttcctggatcttagaggaaaagctttcagtttttccttactgatttatgctattatttgtgtgctttatatatgaaaaaaagctggccaggcatcccagcattttgggaagctgaggcgggtggatcgtgaggtcaggagttcaagaccagcctggccaacatagtgaaacctcgtttctactaaaaatagaaaaattagcctggtgtggtggtgggcgcctgtagtcccagctacttggcaggctgagacaggagaattgcttgaacctgggaggcagaggttgcagtgagccgagatcacccagccgagcactttaggctgggtgacagagtgagactgtctcaaaaaaaaaaaaaaaaaaaaaaacaactgtgggcttttcatatatggcctcttatgctgaggtaagttccttctatgcctgttcttttgagcgtttttatcatgaatggatgttgaattttgtcagatgctttattttttgctgtgtgatctatggtttattttcattcttctagtgtcctttgatgcacaaaagtttttaattttgatgaagtctaacatatctttgttgttgttgactatttttggcgtcatacccaagaaataattttcaaatccaatgtcatgaagattacaatccttatcttttccttctaagggtttttaaaaaaagatttttcttttaagtatttgatgtgttttgatttgttacatgtggtgtaaggtaaagattaaactttattctttttacatgtaaatattcagttttcctaacaccatttgttgaaaaaactgtccttcccccattaaatggccttggcaaccttggttgaaagtcagttgacctttttcatatgaaggtttatttttgggatctgcattcttctccactggcctacatgtgtgtccttatgtcagtaccatactatttaattactactgttgctttttgttttttcttttttttctttttgcaagtttcaaagtcatctttttcagactgttctggctatttacagtcccttgcaattctgtatgaatttgaagatcagcttttccagttttgtaaaaaagaatagatattgcattgactctgtggatcactttggaggcagtattaatatcttaacaaaataagtcttcctatccgttaacatgaatgtctttgtctttatttaggtttttaatttattttagcaatgttttgtagttttcagaatacaaaactttaccctctttggttagatttgttcctgagtattcttttacatgcttttgaaaattgtgttactttcttaattttcttttcggattgttcatttctagtgtatagaaatatagctgatttttgcattttgatcttgttccttgcaacttggtgaatttgcttctcagcttagtagttctcctgtggattctttaggattttctatatgtatatgattatgtcatttgcaattagagatagttttacatcttcctttctcatttggatgcctttcatatttttgtctagtagctctggctagtagttcattacagtgttgagtagcagtggtaaatatgggcatccttgtcttgttctgatcttagggggaaatatgttattcatcattgagtatgatattgcctgtgggtttttgataagtaccctttatcatgttgattttttttctcttttagttttctgagaatttttatcatgaaaggaatcttccaggttgtccaattttctcgtgtacaattataatatctcataatttttttagaactataagtttagtatgaatgccctcattttcattgcagctttgagttctttgtcttttttttccccatagtctagctaaagggttgtcatttataaaattctttaacaaaccgtcctttggttttgttagttttctctattaacattcttatttatttatttatttatttatttattttagatggaatctcgctctgtcttgcccaggctggagtgccgtggtgcaatcttggttcactgcagcctccgcctcccaggttcaagtgattctcctgtctcagcctcctgagtagctgggactacaggcatgtgccaccacacccagcaaattttttgtatttttagtagagatgggatttcgccatgtcggccaggctgatctcaaacttatgacctcatgtgatccacctgccttggcctcccaaagtgctgggattacagacgtgagccaccacgcccggcccattcttactgttttgtaaagagagaatttcttgctctgttgcccaagctggagtatgcagtgttgtaatcttaaccttctgggctcaggcagtccttctgccttagcctctcaagtagctaggactacaggcttgtgccaccactcctggctaatttttaaatattttttgtagagaaaggatttcaccgtgttgctcaggttggtattgaacttctgatgtaaagcagtctttcccccttggcctctcaaagtgagagtattacaacaggcatgaactgcatctgaccagctttctgtactattttcatattctttattttatttatctctaatcattttcttccttctactagctttaggtttgtttctcttgtagttccttccctaagttgtaaagtttagttgttgaattgagattttttttttaaattcacatttacatttgtaaacataagttttcatgcataaataaaattttcctctgaacattgttctttctgcattctattttttgttgtattttatctgtaaatattttctaatttcccttgtgatttcatttttgatcctttgactgtttgaatgtgttaatttctacatatttgtgcgttgtccagttttccttctggtactgattttcagcttcttcctgctgtgggtagagaaacattttagtatgattatctgtattttaatatctgttgagacttgtggtctagcatccagtctatcttggaacatgtcccacatgtacttgagaaaaatgtgttttctgctgctgttggagtgttctgtgtatgcctgctaggtctatttggcttattgtgttgttcagattctctatttccttgtttatgattattctctttattgaaaattggatattgaagtctccaactattattgtggaactttttatttctctatttcttccattctttcataatgtttatggtcatatcttcttggtattttgaatcttgtattactaaagtttatctttagtaaacttatgaaaacactttaaattgtggtttgaaaaaatgcagttgatcccctttaatcatttttaagtgtgtagttcactaatgttaagtctatttgcattgtgcaatagatctctagaacttatttatattgcaaaactgaaactctgtacccattgaacaacaactctcctcattttcccctctcatcaactttgggttgtaacctctattctactttctgtttccgtgattttgagtagtctaggtttctgatataagtggaatcattaaatatttgtccttttgtgactggcttatttcacttagcctaatctcttcaacattcatctgtgttgtggcatgtgtcagcattttcttcgtttttaaggatgaatagtattgcagtgtgtgtgtgtatgtgtgtgtgtgtgtgtgtgtgtgcgctttcacccaggctggagtgctgtggcacaattatggctcactgcaaccttgaccttccaggattaagccatcctcccacttcagcctctgaagtagctgggactatgggcacatgcccaccgtgcctgactaagttttgtattttttagtagagacagggttttgccatgttgacctggctagtcttgatttcctgggctcaagtgatccacccgccttggcctcccaaagtgctgggattacaggcatgagccactgtgcctggcctgtagcacttttttttttttttttttaaattcattcatctgttgatggacatttgggctgcttttacatcctggctgttaggaataacgctgtagtgatcatgggagtacagatacctctttgagatcttgctttgaattcttttagacatatacctaggagtcagattgctggattaaatggtaattccatttgtttttttctggtaacctttttaaaatttaaattgtatcttatttgatgttagtatagccaacccagctagcttttgcttgctatttgcgtggaatatctttttctgtcctttcacattaaacctttttgtgtctttggatataaagcaaacctcttatagacaattggatcaagttttaaaaaaataccaattctgtctttttcttttgattggagagttaaaccatttacatttaaaataattactcataaagagggacaaacttgtgttattttgccttttcttttctctatgtcttgtagtgtttttctgcctcatttcttccattactgccttttttgtatgtttagttgttttggtggtttgtgtttgtttgttgttgttgttgttgttgttgtttttgtagtgaaacagttcgatttccttttaattttcttctgtatttaacatggagattacatttaacttcctaaaggtataacaatctaatttcaatttataccagcttaacttcaatgccatgtaaaaactctgctcctaatgactccatctctccatttttattactactgtcacaaattgcaacttggtatgttgtgtgcctagtaaggcaggttaataattattctttgttttttaaatcatgtggaaaataaaaagtggagttacaaactgaaatttcagtattatctgtaataattgcctgtgtatttatcagagatctttcttatttcatttcaactggaaggactctttagcatttgtctcattttttttctctttgcaagacaatttatatttattcatcttgtaccctactcaaagaccaaattaaatcattccattattccccagaacttttgaagacatgaaaagggttcattccaacaattactaatgcatattcgtgctgggtttcatgctggtcactgagaacacagggataattcattgctgctgtccctttcctcggggagtgcctgtcttgcaggatagagacaagtgcctcatgggggatacagcaacaacagagggatgtggggctctgagattgggctggtcccagcaagcttgtatagcatggggtctggtacagtgcaccacaagagcaccaagtactcaatcaggagttggaggtgagcattgaagcattctggcaactacctgatcacccaagggtctgcctcagtgtgagcacctctgagccccagcctcacatttcctcaattcctgggcccaggctccaggctttcagttcctccacatgttgcccaacccaacatagtgaacactttttcctcaaacattctaggttttctgagtcatttggctggctgtgaaaaaaagctactcttttcggctcaggctagctgaggccaggtcatttcagccctggctgccccagtgctaaccaggtcattgagcagcgggaggctggaactagagtttgtggttgctaccatcttgtgtccccttctcccatttagtggctagaagcacactgggaaactgtcttttagcaatttttatggggcaggtgtaagtgtcacaaactccttcagcttttttctgcgaatgtcttaatttcaaccctaatttttgaaggacagttttgctgaatttagaattcttattgcaagatttttcttttagccccttgaatatatcagctcattgccttctggcctctaacgttttggatgagaaattcgctgataatcttatcgaggatctcttatatgtgacaagttacttgtggtttttgagattttcgtctttggcttcctacattctgattgcattgtgtatcgataggggtctttttgagtgtatcttccttggagtttgttgaacatcttggatttgtagattcatgtctttcatgaaattggttatttatttagttagttatttaagtattctgtctttccatttttctttgcattctgggatttccaaaatgaatgtgttgctctgcttcatggtatcccacaggtcccttaggctattcatttttcttcttttcctcagacttgataatttcagttgtcctacttacgggtatgctgattcttttttccgcttgctcagagctgcctttgaatccttgtgtagtgtattgttcatttcagttgttgtacctttcatttccataatttctttttggttcctttttataatttctgtccctttgctgatattctcattttgttcatgcattgttttcctgtctttactcttactatctttgagataaagttttttaaaatctttgtctagtggctgagtggtgagtcacacctgtaatcctagcactttgggaggccgaggcaggtggatcacttgaggtcagaagtttaagaccagcctggccaacatggcgaaaccctgtcttcactaaaaatacaaaaaaaacccaactaaacaaaaaaaacaaaaacaaaaacaaaactagctgggtgtggtggcacacacctgtggtcccagctacttgggaggctgaggcatgagaatcacttgaacctgggaggcacacgtggcagtgagctgagatcgcaccactgcactccagcctgggtgacagagcaagactgtctcaaaaaaaaaaaaaaaaacattcgtctaggaagtgcaacaggtggacttcaggtatattttctgtggactttttgttctttccttttttgttttgttccgcaaaaaaaaagtacaactctaagacctctagtaatcatttcagatggtttgtgttgaaacaatggcagccagcctctgtgcctgtacctcaccagtcagaattagcaatcagctagctgtcggaacagagaatcttgatgttcagggacgtggtccttactgcccacctgtctccagaagctgtaccagaaacctgtattgttgtctccgtagctgcctgtcattgcatgggcaggttgggagtgtgcgtgtcagaaatgggtagcagtagcagctatggcattggaggctgaaattgttaagtgtagaagttcagattgactctagagtttcaggatacttacatctgattcggctagtacattttttgtcttggtatagtaatggattcctggcgttttctgttctcccatcttccctgatatccttttctttttcgtcttcatcgtctttgttttcatcgtctttgtcctcttcgtcatctttgtttcttcatcctccttgtcctcctcctctttgtcctcttcctcctcctctgctgctgccaccaccacgcattcttaataatattttttgtgtactgtggaattaaataatgtacacatttgaaagagtgggttttttttttttttaatctcagttacaggattttatgattttttttctcaagggtcttgttacttaaaaataagctcagtggctcattcctgtaatttcagcactttgcgaggctgaggcaagaggatcacttgagcttaggcgttttaaaattagactgggcaatatcatgagacttcatctgtataaaacaaaacaaaaataaccaagtggcagattaataccctagaaaccccaacaaggtttcaataatatacttaattatcaaaattaagtatattatggaaatttcattatattaatggttaaattggcagaaaattggaagtttattatgtattacatatagtgtatagtttagtatatacatatactatatatataaacatgtatatatgtgtttttatcatattttaagtagaaaaaccatgtaagagttacttgttggcaaaaagtagagaaaactgttagtacaaattgagaattcctaatccaaaactctaaaatttgaactgctacaaagtttgagatctgagtgccaacatggtgctcaaagaagtactcattggaacatttaagattttggattattgaattagagatcttcaactggtaagtatataatgcagatactccaaagtgtggaaaaatccaaaacctgaaacacttctgcttccaagcatttcagataggggatacttaacttgcatattttaatctgtaatgttatttaatactatatttaaattaacattcttagtcaagacctgtaaaagtggtaaacttactgagtattcacttgtccttaaaatcaaatactgtttgtagtattgaagtactgccattgttttttaaatggatacttagtggtgttaaagtaaatagcagtagaagcagatagtgtaatttataagaagcctcaccaagatagaagaattcctgcagtattatgttttcttacatgtatttcaccttatatttcagtattaggttgtgcatatttaccctgaaagagaagcagcagaagagaattcatatgtgtatgcctacaaaatataaaaatcagtatttttgagtaaaatctatattttaatagatttttttatgtattaaaagtaggaaactttgcatttgacagccctcaaattgggaattacttgtctaatcttctgtttattaccctatcttgatttagtagttagcagcttcatggctgtaaaatacttttattttacatgacataatatttagtgtttatatcttcataaatattgtccctcatgaatttacatgtttgtgtttattataacaaagaagtctttgtatctcatggtttattattttatagatctttataagggtttctgttgtgtactccagtaaaataaaagcattatataaatactttataaagatttaataacaaatctggcacacctgtgataatttacttttttctcctaagcgtaatttattgtcttatttgtattttaatttactatttaacttatttttgtattatgacatgtaaattaattccattggaatcaagagatcttcccaccatagccgcctatgtagctgggaccacaggtgtgcacctcagcacccacctaattttaaaatgtattttttacagagatgaggtctcactatgttgcccagactgatctgaaactcctgggctcaagctgtgctgccaactcagcctctcaaagtattggaattacaggcatcagccaccacgcccagccttccctcttataattaggaaattcagcttgtcatttgtttggttaagtttcatttctgtttaggtgaatttgtttttactgttttatgcactgccattcatcatcttagataattagcattttaccgtcatattaaaaaatattagtgtactggccaactttttgactttcaaactgtttttatatcaggtaatctacatgtattgggcaattatttttgaccattctctctaacttgattttctagttgaaacattgtagtcggtatatacatgacttatttccttcactcatcaagaatttggatcccgtaccacttagacatctacttaatctggtctcagctcttgagccaagtgttcatactgaacaggtaatacattcaaaacatgatagttttttttttttcccgtgaagtgaaaatttccttgtgattcagataatttaactttcattttattgtcttggcatttcagtttgacaaaaaggatattaaatttgttagtgttgcctggaattctcaaactgaaatctctccctcttttttttagacactgtacttggcatccatgttaattaaagcactgtggaataacgcactagcagctaaggctcagttatctaaacagagttcttttgcatctttattaaatactaatattcccattggaaataagaaaggttagtaatgtcatgtattttgaagtaaattgttgagagcttctcactcagatttgaaatattttctgctaatacattcagttcaatctttattttaaaataagtgtgggatgggtagaagagtgcatataaaaggattaatactgtgattagttcgtgttttggtttaccttttaagtgaaggatagtgatgaagtctttgtagttactggattttctcagctttggttatcttttttttttaaacaaaagctttggagatttcattttgtaaacaaacaagttttgtttcagaaataattttaagagtagaacataatgattcagttatcttgttgtgttttctgcttcaaagttttctgccatgtcaggtgctttgtggggtttttttgttgttgttgttgttgttgttgttttttgagacggagcctcggtctgtcacccaagctggagtgcagtggtgctatcttggctcaatgcaagctgcgtctcccgggttcacgtcattctcctgcctcagcctcccgagtagctgggactacaggtgcccgccaccacgcccagctaatttttttgtatttttagtagagacggggtttcaccgtgttagccaggatggtctcgatctcctgatcttgtcatccatccgccttggcctcctaaaatgctggggttacaggcgtgacccactgcatctggccagtgggtattttttttaacatacatagctttcaagggctttctgaaacattagttgaactcagtttttgtctcctgacaacatatactacccctctcttaggcttttctgtgcaggcacccccaacaactactgtaggtggtggggacttaaccttattgcaggtttctccacttacatcttgttgattatgtaatatgaacaactgatacgctgtctcaaagaagctgagtcacttagaatgtttttctcctgttttttccttttccttcagaggaagaagagcttagaagaacagctccatcaccttgtaagttgagccttagaaattcatggcaacatgacttagttttttatagtggttttctagagttcattgattttacataataatatatttgtatcagtcataaagttcattttgaggagatgtaaacctttaacatattcgtgttacccatttttcttaaaatcttaaacatcttgacttttaattgaatcttacatcttctttagaaatcatgagcaaatgttaacatatttagagattttatttttggctacttagcataaagctttggtaactaggtcaaggaatcaaatgataatgtcattctgttaagtcaatgttaatataaattagaagtaaaaacaaaaaatgtattttatatagggtcacctgcagctagtcctcaaagcagtgataatagcgatacacatcaaagtggaggtagtgacattgaaatggatgagcaacttattaatagaaccaaacatgtgcaacaacgactttcagacacagaggtatgaaaataggtttttcttcttttataggcatttttggctttctggcgtgtttatcatttgaattgggtatatatacataattcatgtttgggcttgtcctctcctttacgtaatatttttgacatcctttgagtttttaattccattttgtattgttcaaaggagtataacaagactggcagcctttttaaaaagtacagtttattaatgttggttaccttttttcttactggtttaaatatttatttaaatctatttgtttcaaaatacaggaatccatgcagggaagttctgacgaaactgccaacagtggtgaagatggaagcagtggtcctggtagcagtagtgggcatagtgatggatctagcaatgaggttaattctagccacgcaagccagtcagctgggagccctggcagtgaggtacagtcagaagacattgcagatattgaagccctcaaagaggaagatgaagacgatgatcatggtcataatcctcccaaaagcagttgtggtacagatcttcggaatagaaagttagagagtcaagcaggcatttgcctgggggactcccaaggcatgtcagaaagaaatgggacaagcagcggaacaggaaaggacctggtttttaacactgaatcattgccatcagtagataatcgaatgcgaatgctggatgcttgttcacactctgaagacccagaacatgatatttcaggggaaatgaatgctactcatatagcacaagggtctcaggagtcttgtatcacacgaactggggacttccttggggagactattgggaatgaattatttaattgtcgacaatttattggtccacagcatcaccaccaccaccaccaccatcaccaccaccacgatgggtaagcctacttcaaaataaatattcagttcatatttcctttagggaagtattatatcctatattcaatttgcaatttattctgtattagtgctattcattagtagtatagtgcaaactataaatgtaagctacaaatagataatttcaagttttctattgggcacatttaaaaacacaaaatgaagcaggttgttggccatgcacagtggctcacacctataatcccagcactttgggaggccgaggcaggtggatcacttgaggtcaggagtttgagaccagcctgaacaacatggtgaaaccccatctctactaaaaatagaaaaattagccgggcatggtggtgcacgcctgtaatcccagctacttgggaggctgaggcaggagaatcacttgaacctgggaggtggaggttgcagtgagctgagatcacaccactgcactccatcctgggcaacagagtgagactcaaaagcaaaacgttgaacaacaacaataaaaaaccaggttgttaattttaatcatgttaaaccaataatatccacaatgccatttacacatgtaataagtataaaaattactaaggtatttccttcctttttttcttaccaagtcttcaatatttagtgcatattttatacttatagcacttttcaatttagaccagccaccctttaattctttaaaatatttattgatttatttgttttcttcttctttttttctttgagacagggtctcgctctgttgcccaggccggagtgcagtggcacgatctaggctcactgcaacctccacttcccaggctcaaacaattcttgtgcctcagcctcctgagtagctggaattacaagcacccaccaccatgcctggctacttttttagtatttttagtagagatggggtttcaccgtgttgaccaggctgatcttgaactcctgacctcagatgatctgcccgcctcggcctcccaaagtgctgggatcacaggtgtgagccaccaggcccggccttttttttttttttttttttttttgagttggaatctcactctgtcacccaggctggagtgcagtggcacaatcttggctcactgcaacctccgtctcccaggttcaagcgattcttctgcttcagcctactgagcagctgggactacaggtgccccccaccccccacccatgcctggctaatttttgtatttttagtaggatggggtttcaccatattggccaggctggtcttgaactcctgaccttatgattcggcctgccaaagtgctaggattgcaggcgtgagccactgcacctggccttttttttttttttttttttttttttaagagatagggtctcactttgtcacctaggctgtagtgcagtgatgtgatcatagctcaccgtagtctcaaactcttgggctcaagcaatcctcctgcctcagctttctgagcacttgagacttaaggtgtgtgttgccactcctagctaattcttaattttttttttttttttttatagagacagagtattgctatgttgcccaggctggtcttgaaccccagacctcagtgcttttgccgcagcctcccaaagctctgggattacaggcgtaagctacttatacccagcctagacctaccatgttttatgtgtgtaatggtcacatatggctagttggtattatattggataacacaggattagattttcaacatcttgtaataaatgcctaaaaaagatatgagtgcttatggaaactttcctaaattgtgattaagaaagggaaattttacacatctaattttagggtatttaaaagggtaagctccagcataaaactttttggttatctgtgaaatataccaaataatgtgattctgtcacttagtggtggtattatgatgggcaaaataattaatttttcttcattttttcaatctataaaatgggaacaataatcctagtgctttggaggctaaggcaggaggatcgtttgaggccaggagcttgagatcagcctgagcaacttagtggggccctgtctctacaaaaatattaaaaacactagccaggcatggtatcacacacctgtagttctagataattgggaggctgaggtggaaggatcgcttgagtccaggagatcaagactgcagtgagtggtgattgcaccactacacttcagcctgggcaatagaatgagactctgtctctaaaaataaaatgggcacaatagtatctatctcatggttttattgtgaggatttcctgggctaactaatgtgattggtgcacaataagtgctcgataagtgttagctgtatatttatcattgtcgttacgagtgatactatgtgagtttatggtgaatcatgggtatgccctttatcagattgagttttgctatactcgacaatttgccagatcttccagaatgcaattaagttgttagggtgaactctacatatctatacatattacttctttatttcctttgctttttaattcttagcactgatgcatctgagattaaggaagtgtttttcaagattggcattttgggccagataattacaattttttttttttttttaaacacagtcacactctgttgttcaggctggagtgcagtggcacgatcctggctcactgcagcctccaccttttgggttcaagtggttctcctgcctcagcctcccgagtagctgtgattatgggtatgcaccaccatgccccagctaatttttgtatttttagtagagacggggtttcaccatgttggccaggctggtcttgagctgctgacctcaaatgatccgcctgcctcggcctcccaaagtgctgggattacaggtgtgagccaccatgcccagccttgggccagaacattttttttttatttgaatgtatagcaatgctaatgttgccctgtgcattgcagaatgtttgccactatactgagccttatctctagattccactagcatctcctcagttttgacaaccaaaaatatctctagatatttccagatttcccccaggggcctaaattcacccctgattgggaaccactggctcactatcttgcattatagatacaaacattcacagttgtccccagcacagctcatgatgaagacaaagcagttaaaaaactgaggtgcaatatattcagtttggtacactgcaaatcttagttttgacacctatacccattccatacctcacaagacctaatgatttaatttttcattttagctcttttcatattctgtgtattaatggtactacttgtgagtctctaaatcaaccctgaacttcatgttatttttcgattttttaaatcattttgtctttatgtccggtaacaatgtgttttagaaatgaatacttaatttgggtttgtttggttagaagttccccagttaatattaagtccatcaagactgcagccttaaattgaaatgtttttttggtttgattctacagttgtaaaaaaccacactttttatggtttcacattttatagactttgagtataaaataatatgtaaacagtgagtattagtgatcttgcctaaaattgttctttgaatttgttttaatgaggtgtcttaataggcctggtaatatgactgtatattgtaaaattatttaataattctgacagtgtgaagttttcagtttcgtaaagctctcaacattccatattgttaataagcagatgtcggtttgtttctaagtgtatttgtaagtttaagagaggtattttttgtggttcacaaattagattcacattcgtaattactaactttgtgcttttctctgttttgtaggcatatggttgatgatatgctaagtgcagatgatgtcagttgtagtagctcccaggttagtgcaaaatcagaaaaaaatatggctgattttgatggtgaagaatctggatgtgaagaggagctagttcagattaattcacatgcggaactgacatctcacctccaacaacatcttcccaatttagcttccatttaccatgaacatcttagtcaaggtaagactctacagtaagtaaaatatattaccttcttcacaacaggaataatttatcttactttgttgaaaggactcaatagttaaggttatggtacttaaatgtttttgtcaaaataacttacatatggtagtttttttttttcccccaagggaattaaattattataaatagtccatcatgaatataaataagtcctgcagttctattgagatattcagcggggaaagaaaatatatagcaataatatgtaataattaaagctctatattttagaaaatatatggttgtattagaatttatactcagaaatcctaggacctaaaagtataggaaatcacaaaagataaaattgtatgattccatttatatgatatgtctagaataggcaaatctgcaggcagaaggttagtggttgcttggggttagggaagggtaggagggaataaggaggggcgagtgtgagaaatgattgttcaagtctaaatcactcttaaagtaataggacatgaccagacttgaaagaatggaggatggaggaaggtaaagagtagtagggaattaatgagtaaagcaagaaaaaataagaaagtgaaaaacagttttagaattggcagtttaaaggccttaaacctcttgtttggttggtatcatcaacatatgctggcctagtaaatgggttttggatagccagtacattataagtaaaccggatggattacgtttatgcaaagaggccataaacacacttagaaacacaacttgtggaccttggcaacaatttactgatttgtatgtgttttttgtacatgatctgtctaggttaagttactttgacttattttattgttgtgctgttgtggttgttgagaaaggaataggttagattgaggtcatctgactgaatgtgatgccatatttgtaaattgttaccattcttttctcaaattttcctttaatcaatattttacctattttttactgcgtggagttagaaattgaacaaaatggttttcttttcacaacccattgtagacagaataaaatgatagtatatgttaatgctttccaaatctaccttgttttacaatgtttttagtactagaagacctcctccaacagagtaagacagtcagtttaaaaatgggcaaaagtgttgatcagatactacataaaagatgatacatagaaatggtcaataagggctgggcatggtggctcacacctataatcccagcactttggaaggctgaggtgggcagatcacttgaggtcaggagttcgagactagtctagccaacgtggtgaaaccccatccctactaaaaatacaaaaaaaaaaaataaattagctgcgtatggtggtgctcacctgtagtcccagctacttgggaggctgaagcaggagaatcgcttgaacccaggctgtggaggttgcagtgagccgagatcacgccactgcactccagcctggatgacagagtgagactccgtcttaaaaaaaaaaaaaaaaaaaaaaggaaacggccagtaagtacactctcagtgtctcttgtcatctagtaaatataagttaaaaccacagtgaggcactactacatacctattgaaatgagtaaaattaaggactgatactatcaaggattgacattagaatgtggagctggaactgtcataacttgctgttgaacataaaatataatcactttggagaactgtgtgttagtccattattgtgttgctataaagaaatcgcctggtgcggtggctcacatctgtaatcccagaactttgggaggccgagacaggtggatcatctgaggtcagcatctcgaggccagcctggccaacatggtgaaaccccgttggtactaaaaatacaaaaatcagctgggtgtgatggcgggcacctgtcgtcccagctactcgggacgctgaggcaggagaatcacttgaacctgagaggcggggaggttgcagtgagccaagatcataccactccactccagcctgggcaacacagcgagactgcatctcaaaaaaaaaaaaaaaaaaaaaaagaaagacctgagtctgggtagtttataaacaaaagtggtttattttggctcacagttgtgcaggttgtgcaagaagcatagtgccagcatctgcttctggtgagggccacaggaagcttacaatcatggtagaatgtgaagggggagcaggggtctcatggcagaagtggaaacggggggttggaggggtgtcactctcttctaaacaaccagatcttatctgaactcaatgtaagaattcacactatggtgaggacagcatgaagacattcatgagggatctgctctcttgacccaaacgccttctactagactcacctccaacactggaggtcacatttcaacatgagatttggaggggacaaaacattcaaactgtatcaaactgctttatcacaaagttaaatatatacctaccatatgacccagcagtttttttgccttaggtttttactcaagagaagtgaaaacatgtctgtgaaaagatttgttcatgtgtgctgctttattcagaaggccttccaactggaattaactgataaattcacatagtggaattttgctcatcagtagaaaggaaagaactacagacacatccaacatcatggatgaatattgaaaacatcattctgagcaaaagaagctagaaatagaagaaagtacatactgtgtattacttatgtgcagttctagaacagtcaaaagtaatttgtaaggaaagaaagctcctcaatcattgcctagggcttgagggtggggactgattgtaaaggatcacaagggaacttcctagggtgatagaaacgttctccatcttgattatatatgtatttcgataaaattatgaaagcgaaataccaaaacagtccccccacccatccaaaaaaaaaaaaaaaagacaagccacagactagaagaaatatttgaaaattatatatctatgaaatggattgtatttggaatataaaataatttcataactcaatagtaagacaacccaattaaaagagtggcaaattacttatttcaccaaagaggtatacacatggctaataagcatacgaaaagattctcatcattagtcattagggaaatggaaattaaaaacctcaatgagattctaccacataccttaataggtatgtgaaattaaaaataggtatgtgaaattaagagtgacagtactacggtgttagggagaatatggaagaaagggactgatgctctcatacactgctgatgggaatgtaaaagggcacagcctctttggaaatcttttcagcagttttcttttaaacatacataataccttatgactcagtgatgtcaatcctagtatttacccaagagaaaggaaaggaaatgatgcaaaacttgttacacagatgtttatggtagttttgttaataatagcgtaaaactagaaactatccaaatgtcctataactggtgagtgtctaaacaaaatgtagtatttctataaaagagtcttttaatttgaatgttaagggtaaattatctccaataaaaatagtgttaagtttttttttaaatatagggattataaaagattatataggtcatttagaggtatgtctgtttaaataattatttcaaatatgttgtcttattcacacttagtttcaagtatttatgtacagttctcttgatgtgaaaatattaatcactatagatagcaaagagactgtagaaaggaaacgatttcactttagccttatcaaatctaaatggcactattcttctctcctcataagtattgtgccatgctgggtgcagtggcttacacttgtaatcccaacacttagggaggctgaggaaggagattactggaggccacaagttcaagaccagcctggccaacatagcgagactcagtctctatttaaaaaaaaaacaaaaacaaaacaaaacaaaatattgtgctaatgtgtttttattttatgatctgagaaaaatatcgtgtacttttctttggatttgctaaccatatgaatgctataatcagtcagctgcatttctctatagtgtgtcttttttttttttttctcttcaggacctgtagttcataaacatcaattcaacagtaatgctgttacagacattaatttggataatgtttgcaagaaaggaaatactttgttgtgggatatagtccaagatgaagatgcagtaagttatttaatagaaccagaagagtaagaaatttcagcaagatgcaattaggataaatagtaattttatatacattttttataggttaatctttctgaaggattaataaatgaagcagagaaacttctttgttcgttagtatgttggtttacagatagacaaattcgaatgagattcattgaaggttgccttgaaaacttgggaaacaacaggtaaagaggaatttaaaaatttttaatgcagtagtcaaagtatttgggtgtggggggacattcttgttgactaggtgtgatgtttttatactgtttcatatacctgtattaatctgttttttagtaattatagttttcatatgaaatttagaggtttcttcttaacatggttcatattttagcactcagtgttgctcttttcagcacctttcaccattctttgttagatccacccaacagaaacaaaaaaataacaatactatctttttgattctggggacaccttggtgattactctgttttcaaattgcagttaaatgttcttgaactgtctcataaaggatgctaaataagttaagtgaaattttacttaagctacaacataaacactttgatattagtattgttcttccatttagatgtatcttttaatgtctcagcatttgtagtgcataaaagactaggttagtaactcatcaagttgtatatattagatatgtacagttcttttgtcatacctcaaaagtctttttttgttttttggtttttgtttttaaacagattagtgtttttttctcttgtttgaattctgcctcatatttatgtacttctcattgggactcagttgatgacacatttcttggttttcagtgttcttccatggatacagtttcatgtttcccttgacctatactgctttgatagtgttccattctctaatgtagtgaaaacacaattctggtgtgtatgttgacagttcagttattaatatattgttttctgctcacatctgtgtaggcctgctatgattgtctaattttaccaaataagtgcttgaaaatatttttttcccctattgaattttaaaagtacatgctatattttattttctttttttggttctttaaagggcaatacgttgagcagttacagtagaaaaattcattgttcatgcacatataagaaaccactagtagaactttgtaaatgaatcagttgcctcctttggtattcattctttgtttttttggacatggagtcttgctccatcgcccaggctggagtccagtcgtgtgatcttggcttactgcaacctctgcctcccgcattcaagcgattctcccacctcagcctcctgagtagctgggattacaggcacctgccatcatggctggctaatttttgtactttcatagagatggagtttcaccatgttggccaggctggtcttcaactcctcacctcaggtgatcctcctgccttggcttctcaaagtgctgggattacaggcgtgagtcactgtgcctggccggtatatattctttgaaaataattcttttaatggctggatgatatgtcatcatttacataggttttataacagttaattgtaaaatgttaattttcttttaaaagtctttgtgaaaacacaaattttaataagtggttcaataatttgtactctccatatgtgcatctgcataccctctgacccagtaattcctcttctaagtatatgcctaacaaaatataccctggtgatcacccaaaggcagagtcaagaatgctaacagcagccctattgaaaataactaggccgggcgcagtagctaatggctgtaatcccagcactttgggaggccaaggtaggtggattgcatgagtccaggactgagaccagcatgggcaatgtggtaaaacctcgcctctacaaaaaatacaaataaaagtatccagatgtggtggtgtgtgcctgtagtcccagctacttgggaggctgaggtaggaggattgcttgtgcctggggaggttcaggctgcagtgagtcgtgatcacgtcactgcactccagccctgagcaacagagtgagaccttgtctctaaataaataaataaataacataacataactacgtattctttgcatagctattcaaatgcaaaaaaaaaaagtagaaaggataattgtggactattcattgaaatactatatagcagtaacattgaatgaacagtgaacaactacatggaacaacttggttgaatttcacaaacacaatgttgcaagaaagaagccagacacaaaaacattatgtatctctattattttatttatatcatgtaaaaacaggtgagttcttgtatttagtagactgggtaatagctaccctgagtggttggaatgggacacagtagaggctcctggaatgctgatactgattcgtttcttgatttggttgctggttacatagatgtgtttacctcagtattttgagctgtgcgcttagatctgtgccctcttttgtatgtatgtttattatacttcaatagaaagagaaaactgtatgaaagattaaatatcatgcagccattaagggtcctattttcaaagattatataatgatttaggcaaataattgcaggcctaaccgttaaaaagaaaagattgtaagaaataagtcagagtgtaatctctacaatgcagttatttttgggaggattgaggttttttgttttgctttttttttttttttttttttttgagatggagtctcagtcagtttctcaggctggagtgcagtgacatgatcttggctgacgacagcctctgcctcccgggttcaagtgattctcctgcctcaacctcccaagtagctgggaatgtaggtgtgcaccaccacgcccagctaacttttgtatttttaggtgagatggggttttgccacgttggccaggctggtctcgaactcccgacctcaagtgatctgcttgccctgacctctcaaagtgctgggattataggcgtgagccactgcacccagcttgaggttttttttttttctctttgtgcctatttgttactcagttttcctaaaatgagtacatacttcttttataggtaggaaaattaaaaagatccaaaagggaccaggtacagtgtctcacgcgtgtaagtccaacactttgagagggtgagatggggcatctattgagcccagtagtttgagaccagccttggaaacataggaagaccccatctctacagaaaaactttaaaattagctgggcatggtggcccgtacctgtagttacagctacttgggaggctgaggtgggaagtcaaggctgcagtgagccaagatcgcaccactgcactccagcctgagcaacacagtgagactttgtctcaaaaaaaaaaaaaaaattgtgcggacacacacacacacacacaatttgttttgcttccctagagactatattatatatggcatttcacgttaacttttgatatacgctgtaattttaaatgactattttgtagaatatacttctttaaaatatggagtcctagattaggcaaaatcatccatatgtaacttcagctgtgaagaccaacagtgaatgtctctgttctaagataacaaaaagctgccttagtaattcttacaggactaccacactgttgcatagtcataagcttttggttacaacacaaactcttggaataaatcaaacaactagtgcaattcagtataataggattattcttgagtctaaaattagtgtattattactctggatcattgaacctttatcttctctttgagacagtctcactgtgtcacccaggcccaagtgcagtggtgcaatctcagctcactgtaacctccgcctcccaggctcaagcgagtctcccacctcagcctgctgaggaggtgggactacaggcatgtgccatcatgggtggctaattttttgtatttttttgtggagaccgggtctcactgtgtttccctggctggtctcaaactcctgggctcagtctgctcaccttgacttcccaaagtgttgggattacaggcatgaaccattatgcgttggccattgagcctttgtggttgcccattgaatctttttatcttaaccacattgttgcctaggattatgtgttttggtatttgaaattttcagtcttgaaagaatttgtgaaatgtaagtttgactataacacttcccttttatgcttttgttagttttgtaagcatatcagtagtcagaactacttgggcaaaaaagttgataagtcattataacatctcatagtcattataggagaaattctacaatttaatctttattggaacgagttttatatttgattttgtaaagtttcctttttcattgaaacataaattattatcaccaggccaaaattatctttcccattctgtgttttattaatttatagtctaaaagcagtactttctgtcatttaaaaacaaattttatcagttttaataaaatgttttagtgctttgggatgactttgactctgtctggtcattatagcacttaaaatgtgtgtctttgttctttggaatttgattcttttaaatgggagaaaagttggaagtttttagataatcttaggaaaaactcttaaaaatctttagccatgtataatgtaattattcctcaataattcagcacttataaattctggagaaaagcattcctttagggtaggagtagaaggaagatgagtcttatttctacattcctacttttggtttgtgtctttcatgaaccacaccattattcactgaactcagtcaataaccacttaatgcctggcgtcttatttctctaacgtcaaacatatacttgcttccacattgcattttataaatgaaaacatgtttattgaagaaaattcaggaagtgaataaaatttacttcctaaatttgtgaaaaattttttcatgaagcagtattggcttctaagattaaaataagtttagttcttcattagaatttgttttgcctcttttaaggctcatgcagccaacctcctttcctacttccaggatttctatgtcagtatctgtcctgtacctgttcctttcagaggataggcagactcagatctacttgaagttttaaagtaatttcctttcccctttctgctccttatacttttgaggtatgtggtgtgcttccattagtgacgtggttcataaggtcatgattctcaatttgaatgcaaatcatattgagaatttaggagaaaatggtaatgacttatgaagaaatagtttcatttaagaaacatctttaaatgctcttcacttgcttttttacccagatatttatagtgtgttttaccttaaagatcttggattggaattttttaaacttgcagttcttgccctaatatgtaaaatgaatttatacttctgagaaaaaaagtttaatgtttgtgtaataatatgtctctatgcaagattcattaaatcttttagcatttaaaattttaaatggctgaatttctataaaaagaattactaaaattattttgtgaatgtttctgctgtttcagatcagtagtaatttcacttcgtcttcttccaaaactatttggtacttttcagcagtttgggagcagttacgatacacactggataacaatgtaagtaaataaaagaaaaaagtatttattttaaagatttttttctaattatagttatctaaaggttttgactaacctacaagcttttactctgtaccaggaaaatttgagtttcatgtggtttgttttcttagatttttctgccacttacccctgtagagattatatcctgatcagtaggaaaatctgtgttttgttttctttggagtttgagaacagtactttagcaattaatactctaattttagggagatttttagcgtatgcagctacagcagagtacttttgaagaagagccacactaaagtaaactctggcatgcctttaatttttcccatttctaggaattggctgtagacctaatgtcatgtttggggtaatcttgacactaccttattacaggttgagtatgcctaatctgaaaaatctaaaatctgaaatgctccataatccaacatttttggagcatcagtaggacactcaaaggaaatattcattggagcattttggaatttggatttttggattagttatgttcaactgctatgcattctgcgaatattacggaatctgaaaaaatttgaaacacttctggtctccagcattttggataagggatattcaactagttactccatttatggagaacttatgattaatgaatgttacaataattcttccagaggtagaacttttatgtgaaatcgaccccatgttttggtaataagtctagagaaagttgtctaccacaaacaatacattaagaagatgtgttgtatgctttattctaaataagcttttggagagatttcggagacatttgaattttagggaaaattcgacttgttgaaggattcatttgtgagatcaagttctcaattctaagcttaggtggtaagaacacttgcttgctttcacagtggagtatcacttttatagttcttggaagtctgcactataattccagattagatgaagttaattcttctgagtcatataccttgcttctaattgttcttttaaagggaatatgtttaatctggacctttattattatttagaagtatcttagtctctttctttggttaatactacagtaagaatccagtgaaggttctgtttttgcaaggaaggtccttcagcttccaaaaggaggggtaagggaaagcatttaacatcactgaagaacaagaatagtgtgagccatttttcattgcctctttctataatttttaagtggctgaatttcaaaattctaatgcagtaaaggcagtcatttggtgctaacacgggcgagcaggtgtcattatagtcagtggaggtggttcatattaaggagtaactttcttgtatagaaggggcagtctctgaatattcagttacttaatcaagtacccgaacctaaatatattgagttgaaactcttttagcttgttccttaaattaaatgtaaataagcttaattaaggaaaattcacagggtttccattaccacaagagattggtatcctaaatctcataaactacatcacttaaaagaactcctgtggttatttgacatcagtaacaacaaaagctgtcatttattgtgagtctagtatgtatagcagcacttaatatttagtacatattatctcttaaactcgttctaatggcccatagtttaaaattggaaacttacccttgattcttctaataaaccttcaagcaaacagacttccacaagacagcttacttgcctgaagctgtgttgtagcaagtgtattggagctgccttcaaacccaaagtctttttctttctaccacttgacctttatttagtgaatagcaaggtgaaagtaacttctgtttaaaatatggctataacagaaacacgatgtaaattacatggaacttagagaattttaatacttctacatctgtacattttagcagataaattgctaataggtgttatatgaaatacattatgttaattatggaagttatggaccctgggatctctgaatgtatatgccactatttgtgttttcattgtagtatttctacattattttggaactcagtgctgggtatttctttgatttttttaaaaaaaattttgttcaaaaatataagcaaattaatgacaaaagatatatgcagtaagtttattgtatgccttctgtatgccagatattgtgctaagtaatgaccaaagcacatagtatattcttatatgaaagggtatcatattacttttaatattaactcaaattagtcattgataatagtactttcacaggcattttgagattaaaaacttacaaaggtactttaaattcataaaaatgaaggaacattgctttatatcttttcaccattcaaatataaataaaacgtgtatatttttcgtaactaaaattttacatttgaagattttttttagatttgcatatttactgtcatagcatagatttattctcttaccctgcccactttaaaattattttttcttttatttgggccaggtgggcagaaaaagaactgaacatgatgaagcttttctttgataatttggtatactacattcaaactgtgagagaaggaagacaaaaacatgcactgtaagtacctctcaactgggttaaatacatttgtgtcgatgtctttcctttgaaagatgattttccagtgttttaactttttttcatataataagtaattgtaacagaaaactttatttgtataaaattatgaaaaggctgctagaactttttaagctgaaagattcttaggaggttactcttaaattcttaggtaaatgtagctggctcacttttgggggttggttaaccttcactattgagatttgttcaaagataactgtttttaaggaatcaaaagtaaatacattttttcagaaaccatagatatgcttgttttaacagtttagagcattgattctaaaatttgtaaatatttacttcaaaaataattaacagttaatttaaaacattttattataattgcatactagtattagaaagtttaggacgtgtggaaggttttaaaactggtggtatatcattaatattttctcattacatcaaaatattctctggatatattcaagtgatttgggacaagaattggtagaaatggattggtggtggtatagctgtatttgaagcttctttaaggagatgcataggagattcagaagatttctgctggtgagctgattgttatggaccgatgtccatgttgaggaaaccagttcaatgccactactggcatattaatgaagaagaggaggagtcacactgtgattgaaaaaatcacatagaaaacttccacaaaggtggaaactaagcagactgtagaagtgttcggaaaagtcatagacctttaaggcatgcatacttctaaaaataaatttacttatttccctgcacaaatcagttacttctctagattttatttttactgtgtcctttagggtgcagctatcctcccacttgcctaaaacttgagacttgaggcatttttgtactcttatttccaaacatgaataatgatgacgatgagaaaaaagccagtgttagttgatatttaccattgtgtcagatatcaactattttaagatatacaacaacccatttgagaccgttttactttagaaatgagtatactgaagctatatgatatgacaacttgtccaacgtcacacacaaagaatagagcgagcttctgtaccgacagtctgtttctgttatagaatttgtatttgtaaatgctacattatactgccattaatctctacctttttgttaaaatataccccatgtcttttcacaagttgacatttccgcaaacactacttttgtccttataaccacctctagtttagtctccttgcctcagtcttcccatatgctggttcattctttctatctgtcaaattaggaaggcagtatggtactgttgggaagcccatgggcttgagaatcatgcagacctagctctaggttattaatctattattttaaccttatttcaattatttacccttctaattccaattatttaccttataagtgtttataagaatttaatgaaatgatacaatgaattgtacctggcacataggttatctacaaattgtagttacctggttaaaacaaataatatagcatatgaaatatacaagaattctgtctcttaaccacatccagagattcttcatggcataaaaaataaaataccaatctcttcagcttagtattctggactgtctatgaactcaactcaacctttccagttttataattttttttgacagtttattctacaagcttatcaaattatttctggggtatttctatttactgtattccatagctttgcttacaaagttccctctatacaggatgtattattttaaaattatattaaaattctaactgttattccaagtcagtatccttcttttttcctattgaagcagagtttgacgataatggtggcctcttgaatccaaacattacatttatgctctataaaaatcataggatcaccaggcatggtggctcatggctgtaatcccaacactttgggaggctgaggcaggcagatcacctgaggttgggagttccggaccagcctgaccaacatggagaaacgtcgtctttactaaaaatacaaaaaaaaaaaaggcaggcgtggtggcgcatgcctgtaatctcagctactcaggcggctgaggcaggagaaccacttgaacccaggaggtggaggttgcagtgagccgagctcgcaccactgcacttcagcctgggcaacaagagtgaaactccgtctcaaaaacaaaacaaacaaaaatcataggatcaacaaagagcagaaataaaaccacacatggcccacatttttattaggagatggggagttaattacttgtcagcaaagaaataaacactaggttataaaagagctcccaccacagctgtaagcctgtggacttgaagagcaggacttgagaggcatagtgaaagggaaatggaagtcataaagtgaatcatcctcgtaaagagaaagtccaacgttaagtatcaaaaaggaacataggtctgagacttagttgttcactgcattgacaacagtgaagttactcactttgttagtggaatcagaggtgagcaaagcattgcttctgtggtgaaaaaggagtagggctccttggagatgtgtttttagggtatactagaataatctttccaacctttcaatctgccttgttggctgccatcctaggagaataaaactcttagaacagagagatgttgtctggactattttgatacaatttccctattccttcaggctgtaaaacaagtgtacatttgctactctttgttcatgcatacttatttcagtattttttttccagtggagattaaaataggaaagttctgaaatttttcaccgaggggggaaaaagattcttgtagcatgaaagatgatatttttattttttcattttgtaatttttgttttttgattttatattatttttttttcactttatttttttttttttgacggagtttttgctcttttgcccaggctggagtgcaatgtcgtgatctcagctcactgtaacctccacctcctgggtttaagtgattctcgtgcctcagcctcccgagtagctgggaatccaggtgcctgccactgcacccggctcgttttcgctttttagtagagacaaggtttcgccatgttggccaggctggtctcgaactcttgacctcaggcgatccacccgcctccgcctccgcctcccaaagtgctaggattacaggcatgagccactgcacctgtagtatgttcttaaaaggacatattacgtgtttcctgaatccagtgccctctagagaatatcttgtctgtggaggctacaaagagattttcttttaaggcagtaatctgttactaaagtttcatatctttggggagactgtttttgtcctgtatttcctgtgatgtcagaagccatggacaagcccatgagaatttgtcaatattgataccatctttgtctgacatcccaaggaatttttctcactggtggtttcagcagcccataggaccctgatggagcccacagagatctttgaagtgcagcatcggggctatactgtgggagtacaaagggactagacccatgccttcagggttattagtcccttattccgagatgcaagtataggggaagaattatttcagatgtaaaggcacttagtaaagggcaagactttattctccttttatgtttgattgatgtcccatagacaaggcaagaggatacagtaacgtaaaaccgcagaactgatgggtcatacaactcatttttgaatttgtactcaaggcctctgctacaaaatcccttgttgtttaacttaaaaagcctagaagcccttaagagctagctgttcttgaattttatctgggttgccttatagtctgagagttgcttatcagatttcctctcccctacatctcgtcatatgtattttcactttcacaaaggtgagtgcagcattaatgaggcaaaagttaatcttttctttgccagcattaataagagaccctaaagagcagcaaaggcatgtccagtgaactcagtcttcagaaaacttaagctttaaaacttcagtaatgaatttagtgcgattttgggaagctaattttgggatgctgttaaaattttgctcttacttgtggattacaggacattgaattaagatgcccaggctgtgcacagtggctcatgcctgaaatcccagcactttgggaggccaaggtgggtgggtcacctgaggtcaggagttagagaccagctggctaatgtggtgacaccatatttctactaaaaataaaaaaaaaatcagctgggtgtggaggcatgcacctgtaatcccagctcctcgggaggctgaggcaggagaatcgcttgaacccaggaggcggaggttgcagtgagctgagatcacgctactgcactccaacctgggcgagtgtgaaactccgtttcggcaaaaaaaaaaaaaaaaaaaaaaatgcccattgaccttctgcatgctaggttatagatcagagcatagaccagccactgttttatgttggcaaagcagtttgggcagttgatccacagtctgccttttgatctgtaaaacagcaataatagcttattattgacttagtttcattgagtgctcaagtacttgaactagaatgtgatattatagacacagttaaatatgcagttcactggggttgccaaaggaaaggaatccttttaaaatgcaaacctgggccggtcatgctgacacctgtaatcccagcactttgctaggccaaggcaggcagatcacttgaggtcaggagtttgagacagcctggccaacatggtgaaaccccgtctctactataataaaaataacaaaaattagccgggtgtggtggcgcacgcctagctgggattagcttgtaatcccagctactccggaggctaaggcacgagaatcacttgaacctggaaggcagaggttgcagtgagcggtgattctgtcactgcactccagcctagacaacagagtgagactctgccccccttccagccccaaatacacaaatttttaaaaaagcaaacctgatgattacctccaccccaaacatggtcccctcacccccactcaccagcactcttccctgacttccttttctatctcttctttctgactttggggccgaccacagtctgtctcttgttgatctattcagactcatctcctaccctacctcactaaaagttgcttctttaaaagtttcaaaagcaacttttttattaagcatcaaattttatgcatgtgaattataattatttagattggaaataacattcaaaaatacaaattttgtatcagctctacttttcatgaactagatttatggaaatattattttattagtgtttcttgggtacagaatatattatcactaaagggactatgatatgaagtatgtactttttagatagagatggtgttttttacttgttgcctattctaacttatgtgtgtgttacatacttttaaaatgacatacttcctctgcttcactgttgaatttttgtgtgctttcttatgtaatttgaaagtaaactttgttgtagttttgagatttgtgtaatttattaaatagtataaatttttttgttttgcctttatgaacttctttcgtgtaaccaaagatacttagttaaaataattatgaattattaaaacaatttttggtataagttatgcataggaccactaaatttttaaaagtaattaagaaataggatatttaattattttaatgacttttaaattataggtacagccatagtgctgaagttcaagttcgtcttcaattcttgacttgtgtattttcaactctgggatcacctgatcatttcagtaagttttttaatcagtactttttaaaaatctgttttgactattggaagaactaaatttacttttgcttctgatttctgcagtttttttttttttttagtttaatttaattttagagtcagtgggcacatgtatgtttgttacagggtattgtaacaaatccctaccagtattgcgtactggtagggattgggcttcttgtgtacccattactcaaatagtgaacattgtacccgatagtttatttttcatcccttatcctgttcctgccatatccccttttggagactccagtgtctgttagtttcatctgtatgtccatgtgtacccattgtttagctcctgcttacaagcaagaatgtacggtatttggttttctgtttctgagttagttcacttagaataatggccttcagttccatttatgttgctgcaaaggacatgatttcattcttttttcatggctgctgcagtgattattcttaatacatttataaattataccaacatttagataatttattaaagtaattgagattgtttgcactttaaataaattaaaaatttttttttagttctataagaccttttctctttcttttttgagacatggtctcacactgtctcccaggctggagttcagtgatgcgatcacagctcattgcagctgttgacctccccggctcaagcagtcatcccaccttagcctcctcagtaacgtgggactatgcaccaccatagccagctaatttttttaaaattttcatagagatagggtttcactgtgttgcccaggctggtctcaaactcatgggcccaaacagtcttcctgccttggcctcccaaagtgctaggattaccagtgtgtcactgcacctggctgactgcatcttttattatttttgcttgtagaatcttgctgtccctttggttggagataggtattatttatgtattattatcagggctaatcttttgaaaatcacttggctttatgggtgatggagacatttagaggccccagttttatttagtttgactttaaactcagtttcgttaacagttaattttttaaaagtagagcttggtctgttatattcaggttgtgtaccatatccaaatccatgtggttatagatggtctcacaagagaggaacgagcttgatttctgttagccaaagctcctttttccttcatatactgactgtcatcctttactctctacattcttctttttctgtgtgtcaatgtcaaaccttattttttagaaggacattgtctctttaactgtggttaatatattgtcagcctgatggctgtcttgctaggagtcgtcatgactcttttcaagtccatacctatgcttgagatatactgtgtttatcttgttatttaaagtctgtttcttttttcttttcaaactatttgtaacaaatgccagcaacactgggataacagatttcaaaaataagcgacctgattttggtaggaaatttctctttcgtgttattacgtcatttattgacccattatgactgataacattcaagaaataagtaaaatacagcaaaaccaatctatagggagaagtcaaactaaaacacatatagtcaacatagataccatgaacatttaagtttcatatttattatacacagtatagattctctgagaatttacaatagacaatagctactgtccagatagtatcaaatctaaaacttcacttctcccacatcatggctgttctccccaccacttcacctgccctccaagtgatcctcccacctcagtctccagagtagctgggaccataggtgcacatcaccatacctggctattttttttttttttttttttgaggcggagtcttgctctgttgcccaggctggagtgcagtggcacaatctcggctccctgcaagctctgcctcccaggttcacgccattctcttgcctcagcctcccaagtaagctgggactataggcgcccaccaccacacccagctaacttttttttgtatttttagtagagacggggtttcaccgtgttagccaggatggtctcgatctcctgacctcgtgatccgcccgcctcggcctcccaaagtggtgggattacaggcgtgagccgctgcgcccagcctaatttttaaattatttgtacagagtctcattatgttgcccagcctggtctgaaactcatggactcaagcgatcctcctgccttaccttcccaaagtgctaggattacaggcctcagactactgtgcatggctggttgtacttctcttattggcacagttcctgttacccataacgaagttacttcaaagttatatgtaattacatccaatattttaatactgattttcaatatgacaataactatagtcttttaaaaaataacaaaagtgtttaagttgctcattgaatgtggattggtgattcagccaattatggatatacttctgtttttttatttagttgactataattaacctggatactctttatcttgttctccttaattaatgtgtttaagttctgatatatactaaaattgttttgggtttatttatatttgcttctatgggcacaagttctcagaacaaataatctacacattaactgtttcagtgagaaactgataggataacttttttctgataaaactctttagactgatactgctactagggtgaatatttctgaggaatttttctgtattttgtcatttcatctacttttcccaataaaagaaatttcttttgatggtaccataccatcatgccccttctggttctagggcaccaccccagggtttggaacctcttaaaatgtacttcagaaatccctgggatgttttgttctaaccttttggactgtctaatttttttcatactcgtacttgtgattgcctataatgccttcccttttgttctgaatagttcgtctgtcttctgccacactggggcatcctttaataataattgggtacagtacagattttctctcattagcctgactccctagctgattatgtcctctgatatgttgctgttgtctgttttaggcagtttccttttgctttcttcatcataagggtccttttttctttttttctttgtctttgttttgttttgagacagagtcttgctcttgtcacacaggctggagtacattggcgtgatcttggctcaccgcaacctccacctccctggttcaagcgattctcctgcctcagcctcccgagtagctggtattataggcatgcgccaccacgcctagctaattttttgtatttttagtagagatggggtttcttcatgttggtcaggctggtctcgaactcccgacctcaggtgatccacccacctcggcctcccaaagtgatgggattacaggtgtgagccaccgtgcccggcctccttttttcatattttacaaaaataatgcttacttatttatctcctatatacagagaatgacctttgaacatggtatacactctatttataatactcaaaccttaaccactgattcctcaatttttaggattacctcccccaatcatttttactattatacggatgtgctcctattttagggagaagaattttcttcctaaatgggttctttgagaatacttcgtaagttgtgtatttttaggtgatttacatatgggttatcttaaactacattttaaaaacataaattatgtgaaaattcgtattaaatacttgtaaaaggctgtaagatatctcctttgtgtttctggctatattggtgtttctggtacattcatttagggccaaaatgttgtatgaatgtgattttaaattttacaaataggatgacataagaaatacttattgagatagttttgttttgttttttgttttgagacggagtcttactctgtcaccaggctggagagcagtggcgcaaatcttggctcactgcaacctccacctcccaggttcaagcaattctcttgcctcagcctcccgagcagctgggactacaggcatgtgccaccacacccagctaatttttgtatttttagtagagacagggtttcaccatgttggccaggatggtcttgatctcctgacctcatgatctgcctgcctcagcctcccaaagtgctgggattacaggcatgagccactgcgcctggccatttttttgtttttttttttaaagagacagtctcgctctgtcatccaggctgaagtgcatgatcatagttcagggcagccttgaactcctgggctcgaagagccttcccacctcagcctcccaagtagctaggactaaaggtgcgtgccaccctgcccagctacttttttgtttgtttttgacacggagtcttgctcttgtcgcacaggatggagtgcagtggtgaggcctcagctcactgcaacctccacctcccgggttccagcgattctcgtgccttatcctcccgagtagctgggattacaggcacccaccaccacgcctggctaatttttgtatttttagtagagacggggtttcaccatgttgactaggctggttctgaactcctgacctttggtgatccacccacctcgtcctcccgaagggctgggattacaggcgtgagccaccacgcccagcctacaaatttttgttttttaattttttgtaaagacaatgtcttcctatattgcccagaccggtctcaaactcatggccacaagtgattctcccacctcagcctcccaaagtgctggattacatgtgtaagccactgcgcctggatgagatagtaaatattttatacacttttatataaataaactacagtaggtcatcaaataatgttttaacattaatgaggaaaaaaactgattcctggcccgggccactgcctgtgcagaatttacacattctccccatgtctgcatgggttttctctgggtaccctggtttcctcccacatcccaaagacatgcactgtggattcattggcatgtctaaatgatcccaatctgaatgagtatgggtgtgtgtatgagggcaatctgcaatggaatggcttcctggtcaaggttagttactgccctgtccttaagatactagtccctgagatgctgggatacgatttggccacccacaaccctgaactggaataagcgagttggaaaatgagcaaatgaatgaatacaaattgtaacatagaaatttgtaagctctatcatattcgtagaaatgcatagccataaatgatgtggtacaaaagcgagcccactgaatttgttattgtttgtgtttaaactgtctggtggtaggaagtgctccttagtgtgtttaatttgtaaccatttagtccttgatttcatctaccaccaccgattcgccaaaaactggataaataactatcttagtggtttgtattaatctttcttaaatgtatatatagctcacatttattccagtgtttaatattcaaagtgttaacttctaaataagaaagtttagtgaattttttttggtttttttgagatggaatctcgcgctgttgccctggctggagtgcagtggccgatcttgtatcactgcaaccttcacctcccaggttcaagcaattctcctgtctcagcctcctgagtaactgagattacaggcacacgccaccatgcccagctaattttttgtattttaatagaggcagcgtttcaccatgttggccaggctggtctggatctcccaagctcaggcagtccacccacctcggcctcccaaagtgctaggattacagatgggagccacttcacctggctgctgtgattcttttttttttttttaatcataaatatgctgtaggaacataactcttatttatatcaattaacatatggtaaagttagtttcattatgcatcatttcaattaaaattgcaatttccaagaacctatctgtgttaagtgaggacttactgtacatacacatgcctaagagaagtttaatttttttgtatgtagttaataaagtataaaatttataatttttatctagggttaagtttagagcaagttgacatcttatggcattgtttagtagaagattctgaatgttatgatgatgcactccattggtttttaaatcaagttcgaagtaaagatcaacatgctatgggtatggaaacctacaaacatcttttcctggagaaggtaattacatttctctcagtttgttattatttttccatgttccctttttcatctcttgaaatacgaattctgtaatgcctttttttttttgacagtttttttaagtagccaaatgtaatgaattttagcagtcctaatataatttttggtcagattgtgctctaattttgttgtttacactgtttacctctaaattaatagtttatatttataaaaatgttctattagctacaataattcaacaattacaataacttttgaaggcagcactaattttcttagtgtttgtttttttgaaataatcagtaatattgtagtccaattttcaggggtggtgcccacacccacaagtgtgagagctgttttctgtgactcttcatgatttaaataactgtcattgcagtcagtcttttgggcaaagataagccattctccagatgtgtagattgtgggaaggcatattaagaagtgttgtcattatcgtaaagatgttccaatttttcttcttctttaccacatgccacagttcaggtgacatttttctgaatgaactattcccaattgaattttgaaactcagtgaaaataatgcagtaagacttttttatgcttatttttgagattatgaagtctctctgcaaagtgtgacgttatctccatgttggaactgagtatatatatgaatgagttttagtgtgtataaactaaatcacttaacagacccaagacagagctacaaatataacttttgccatcttaaatttcgacctctgactttaacaaaaactgtacttgtagctatacctctcataagtttgtttagtataggtatacaatgcatgatagttgtctttatttatgtcctctgatttgggtctatgtacatcttcaaaattgaagcctgtatcagacacatttcagttattacctgaataaaatgttcattaaatcacatatatattttcatttttttttttttttttgagatgggcttgctctgtctccaaggctggagtgcagtagtgtgatcacgtctcactgtagccttgacctcccaggctcaagcaattctcccactacagcctcccgagtagttgggactacagccacacaccaccatgcccggctgatttttgtagttttcatagagatgagatttcgccatgttgcccaggctggtctcaaaactcctgagctcaagcgatctgcctgccttggctttccaaagtactgagccaccgtgcccagcaaaattattatatatttttattttttaaaattatcactaaaaattcaaactgatctgtttccttctacagtgttttcagtaaagtttatttaaatttaataaaatctgtgaattaccacactaaattagctttgtgtttccccctacccttccaaagatgccccagctaaaacctgaaacaattagcatgactggcttaaacctgtttcagcatctctgtaacttggctcgattggctaccagtgcctatgatggttgttcaaattctgaggtatggatttagacttactttattaggcaactttattcctcaaattagattatcaaattcggtttccaaattatttttctacaaagtatagaatttactacctgtgcagtgcagttgggtttgttttgagatggagtctatctctgttgctcaggctgtagtgcagtggtgtgatctcagctcactgcaacctccacctcccagattcaagagattctctagcctcagcccccgaagtagctgggattacagacatttgccaccatgcctggctaatttttgtatttttggtagagacagggttttaccatgttactcaggctggtcttgcactcctgaccttaagtgatctgcctgccttggcctcccaaagtgctgggattacaggcatgagccaacgtgctcagcccaattctgttctctggtttcaaaagttttatgaagcaaatttatttttcagtatgaaagataacattgggtgtgcttaatgaaaatctattacatgtttcttgatttataaagaagtggccatgtcagtgttctttgagtctcctagacattcctagataatacagccaaatattttacttcaaataaaagattgatttgtctcagatatgatttttatgccatttggttcagcctgggcaacaaagcaagactccatctgaagaaaaaagaatacttgtatctcttagcaagtttggggaaatttttttaaaaaggaaaaagaattatttttaaaaatttttattattattattttttgagatggagtctggctctgtcacccaggccagagtgcagtggtgtgatctcagctcactgcaaccgccacctcccgggttctagcaattctcatgcctcagcttcccgaagtatctgggattacaggggtgcaccaccatgcctgactaatttttgtatttttagtataggtggggtttcaccatgttggcggggctggtctcgagctcctgacgtcaggtgatccacccgccttggcctcccgaactgctgggattacaggcatgagccactgcaccaggccattatgattattttttttgagatggtgtctggctctgtcgcccaggctggagtgcagtggcacagtctcagctcactgcaacctccacctcctgggttcaagcgattctcatgcctcagcctcttgagtagctgggacaacaggcatgcaccaccacgcccagctaatttttgtatttttagtagagttgggttttcaccacgttgaccagactagtctcgaactcctgacctcaagttttccacccgccttggcctcccaaagtgctgggattataggtacgagccaccacggctggccagaataattttaattgtatctaaaatgcttttattttattttcctactgccttcttttcttgtctgaataggttttttcagtttttttagtcctaacccttgcttcagtatcactctgataactgctggagtgcagtggcacaatcttggctcactgcaacctccgcctcccaggttcaaccaattctcttgcttcaacctcccgagtagctgggattataggcgcatgcctgcctggctaatttttttttttttttttttttaaagtagagacagggtttcaccgtgttggccaggctggtctcgaactcctgagctcaggcagtctgcctgcctcagcctcccaaagtgctgcaattagaggcgtgagccactccacacggcccactatgataattttcaatttggtaatttcagacaactgaagtagtcgtgctctgttatgaaataagtttacctttttaaagtaggtgacattaacactaaagttgtttagctgccaatttagaaggaaatctttctttactctgcccaacttttggaagcttccactcgccactttttctgtagtttttagtgaaaacattttttgttgtcatctcatggttgacatcataaatttgaatgaggctggacgcagtggctcacacctgtaattccacctctttgagaggctgaggcgggtggatcagctgaggttgggagttcgagaccagcctggccaacatggtgaaaccctgtctctactaaaatacaaaaaaattagccagatgttgtggcgcatgcctgtaatcccagctacttaggaggctaaggcatgagaatccttggaaacctgggaggcagaggttgcagtgagccaagattgcgccactgcactccagcctgggcaagtgagtgagactctgttctcaaaaaaaaaaaaaaattgggtgagaacttgagttagcatatgttgttaattttctgtgaatacaagaaagcagtggttttctcagtttaggttggatggattcattgaagcattgtgctcgttattgtgttggttttattcctttatagtatgtttttcaggactagaattttcgtactatgtagtcacaacttgtgagttaaacatgtatatattgttatctgctgtataaatattttttagaactagtacaggtgtatttcatcaattgaggaaatttttaaatcatttatttttattatttaatagctgaataataggagttgcctatgatttttacttttgatacttcagtcttaatgagttacatagtttgacaaacaaaatttagagataccatatttttctttcttagctgtgtggtatggaccaattttggggcattgctttaagagcacaatctggtgatgtcagtcgagcagctatccagtatattaactcctattatattaatggtaagtgatttgaaacattgtctgataggtaatttctatgtgagggtgttttgtgaaactaaaatttttctttgatatagctaaacaagaatataaggctaatatatgtgtctaaacatttggctttcaggtaaaacaggtttggagaaggagcaagaatttattagtaagtgcatggagagtcttatgatagcttctagcagtcttgaacaggaatcacactcaagtctcatggttatagaaagaggactccttatgctgaagacacatctggaagcgtttaggagaaggtaatttttaaaatatcacactgttagaatgaatttcatttttattcctgacatatccagaaatattcttaaagtgaatctaaagtttttgttggggtcaagtagaaagcataatttaccaaagtgaaggatcagtaacataagtaatttttattaagaatatataccattttgccttggaataggcaatacgggttcctgataaatattgcacacctttaataatagagtttgagcagatatgcatgaataagaattgttagacagaattccatctctaagataaagtattgactttgattaaaaaggcagaacaccactactaaaaaaagtttctctaaaactcttaccaagaacatcaaataatctcatagttgaatcaagttgagtcatatgtttcatttgctgttttttttttcttcctggactaggagacagtattttaattttgaatttccatttaccatggaaacatgaccaaaaaattctgttaatgaatatctgtataattaatttagacataacctgtgtaatacagaaataaagcaaattaatatttatgaatatatcgactgaaatgaaaggtgagtagatagttttaagaaattctatttgttaaaaattatgagcaaatgtaaaagtactaagaactgtgttgaaaaaaattgttaaagttagtaacttttttcaacttcagatcttagtttgatattgaagtgatacaagtgatatttattgacatttttaaaatatcaagaaagattgcatagtaaagatattttatacattccttataaataacatgcttccatgatttgaaacatttggacattacagaattctttaagattgcaattcatggaaattctgcttaaagaattccttgtgtttttaatgaatgtggaaaggaactcatttttttacacagaaacttcttactgccttataactttaaccacttaaaaaaataaaattttaaaaagagcaaatgtggtgtaacttattcaaattaattaatacgtattataaaattcagatattacactgtgatgtagaaaatgaaagtctgctataatttctgtcttcctcgtggagatactgttaatgatacccatacttctaaaattttttctatgctgtgggatcttcaacaaaccaacaaggtcctgttgattcacacccttagtccttgcacagcattaccaatgtctaaaataagtgcttattttaagtctttaaaaatgtatttgttttttgagcattcagtggtggttttataaatttaatgaatttaagtccaaaaattccttctcagatgtacaaatttttttctgttgtgaaaaaaaaaattgttatgtccttgatatctttttatttgttcatgttttatgctaaaagttaatgttgatgttaaatagtttatataaaaattttttgttactagtacaataactaggatatggataaaattgaagagtcacaaaactaagcagtagtttaaaaaaaatttacttaggtatttttcatgcaaaattttgttcttgatgtgcttagtgctattattaattgaaaattgcctaacatctgtagattgaaaatataattgttctttgtgttctgtgtattaagggaataaacaataatgtcttaatttgtttactttttaaaaagagataaagttataatcttaaacagtggttctcagccagaagtgtttttgtttcccaagacatagtacgtaatccctggagacacttctgataatcacagcaagagagcatgttattggtatctggtgagatgctgctgaacatcagagcatgagatacagcctccttcacccctattcttctgccttctgataacaacaaattattaattgggcttaaaatgtcagtagtgccactgtggagaaactctggtcttgaatatgtaacaggaaacattgttttaaggttactcttttgctcatacattggatcatgtggaaattagacaagttcattcattccctcactttttatccttctattccaaatttgctgattagttttagacttttttttttttttttaaactcaggtaccttggatcctgtcttccacatctgaaaattagaaaattgacacgtgtttagtgattatcatgctaggtgcctgtttcctttgaaatacaagtctttgtaattcactttataattttaacagccatgaattgactctcaaattctattaggctcgttagtatatatttaccagaatgtttctgtccctgaaaattttttcttaatatcttttttccttctgaatgcaggaatcacagcttgctatttcatttgctggattagttttttttttttaattcctcctatctctcctattaatatttctactctctttattaaaaaaataataaactggccttaaggagattttttttttcctcagtaatttctcgtggtgactattttgttaggagctcttagctgttattatgcagttacgtttgattcagtatgatgaatctgaacttaaatttgttgctgtagaatacattggaatgaacttagaacttcttttggacttttccagtctgtaagatgataaaaatttgcgtaacattaaaatggtttaaaatggtatcctttctatgtgttgtttgtgtcatgttttaggtttgcatatcatctgagacagtggcaaattgaaggcactggtattagtagtcatttgaaagcactgagtgacaaacagtctctgccgctaagggttgtatgccagccagctggacttcctgacaaggtacttacatagttttaatttcgaagttgataacatttcccaggtcaaatatctgttctttttgtatttttaaattggttgcatctcatatttcagatgactattgaaatgtatcctagtgaccaggtagcagatcttagggctgaagtaactcattggtatgaaaatttacagaaagaacaaataaatcaacaagctcagcttcaggagtttggtcaaagcaaccgaaaaggagagtttcctggtaagcctttcaattcaaattttctctttctctttctctctttctttctttttctctttctctttctcttttctcctttccttttcttttattctccttttcttttctttcttggttatatcatatagcaactgtcttggtttgtcttgtgttgctgtaacaatactacagactaggtaaagaacagaatttgggaagtccaagatcagggtaccagcatctggtgagggctcctctctgctttcaaagtggcaccttgaatgctgcctcctcacaggcagagggtggaagggtaaaaaatgaacagactccctccatcagacccttttataatggcattaattcattcatggcctctccaaagaccccacatctaaaacctgttgcattggagattaatgttcaacatgaattttcagagagaacaaaaaaattcaaaccatagcagcaactttgaacctttactttgaaggtccaccatccatgttcatggctcccttcaccctcccctccctttagtaccattgattcttaggtaagaagatgctgagagttgcttcagatgctatttgcaaaaaattcttcatttgtttctcaaaaaattctattttagacttttgatgtgaccataaaaaacttcttgaaatttatttcataagcaatttgggaatttttgataactttaaatttccatatactactcatccactttaacccaatagtttttttcatgtattacatttccattttttctgagaatataaaaataacacaccttcgtgtctcacctgtgcatctctccttgcctaccaaaagtatcttaagaaatttttcatgtaggcctaatatatatatatgtatatgtatatgtgtatatatatatttctgatatcttttataggtatatatctgatatttaatatatatgtttcttatctctttccagagataccaagatataatgtaagaatatatatacatatatatgtgctatatagatgtatatgtatatatatatttaaagcacaaatggtagaattctatttttactgttctgtttgcttgtagggcatatcattatcttagaaaacatttcatgttagttcatgtagaaagttacctcattctttttgagatctgcatagttcactatatagtaataacttgattcatttttcttgttctctattaatggacatttagattgttttcattattttgctattacaaacaatgtgacagagaatatctttgtctctacattatttcatgtatgttggataaatacctcattatggaatttctggatccaaatgtatctgctttggttaggttgaaatatattgtgcgtagagtgtatgaaaataataaagtgaaaatccacgtacctaccatccagattaagaactagaacactagtagaagctagtattgtgtcctacccaataacatcatttccacttctccttaacactgtcttgatttttgaatttgtttttttagtgttctttatagtcttacctccatgtatgtttttatttagttttgtgaaacagtttggcaaccacaaacctagtggataaagaaaaagggacatgtagctactattagataaaggattgcagaagatgacaagttataaaccttccctacagatgtatacagcctaatttggggatatcagtgggaaggttctcaagtgtatgtatcagcgcagttaagacacatcctattgctaaaatgttgataaaaatactggaatatccaacagtagtatcttcatagaatttgtattttctttttctaagctcttcatgatctaccataactctcaggagtagatcaaagcagaatttcttctttaggatgaaatggatgtcctctactgattcaagcagtaggacatggaggtgagagcaggaatctcactagcacttggtaaagacaatccaagtacaaataagaatctgggccagattcgtcgtccattcttttgtaacatagagaagatagtacagtggcagcaggggtcttggtcatgataaccctcaatgcatttttccaaagtcacactgatcttactaattgtcctcaaatttggtgcacagcagtgattgtgtgatatcttttatcatccttctggtaattctcttctctcctgtgttggatattctgtttccatgatccatacctttctcgttattggttgtctttgtgtgtgtgtttctggagtacagggagtgttctattcagtggtttcttgtgagaaaactgacagaggaatgttttttattccttgcatcattaaacatgtatctcatgttttcatacccaaatgataaattagctgggtaaagaattctaagttggaaataattttgttgcacaattttagaggtacttctccattgtttcttgctttcatcattgctgttgaattctgaattccgatactttttacatgcagtgtatcttttgttgttgttgttgttgttgttgttgtttttgagatagtctccctctgtcacccaggctggagtgcagtggcaggatcttggcttactgcaacgtccatgttcaagtgattctcccacctcagcctcctgagtagctggggctacaggtgggtgccaccatccctgggtaattttttgtatttttagtagagacagggtttcaccatgttgcctaggctcatctcaaactcttgagctcaagctttctgcccacttaggcctcccaaagtgctggtattacagacatgagccaccatgcccagccaacatgtagtattttttcttacagacattaatcagtcttcacttttttcttagtgttctgggcctgagtataggtcttttatcaatgattgtgatgggtgcttcagtatttacatgtttaggtatttagcactggaccctttcagtttggcacattatatttttcagtctggagaaattttcttgaaatggttcatagatttcttgtattgtattttatcattttctctccttatggaacatatccattatctagatgttttgcctgtaagactcttcctaatttatcttttctatgtttcttttttctttttaagttttaactcaagttcctgagagatgttctcaacattattttgcagtctttctactgagtttttcatttctactgtcatgcttttaatatctaagagctcttttttctctgaaaaaatatgcctatttttaaagttgaaatctttttgagattaacatttttcttaattgttgaattttgctttttttgttcattctgttggtgtctacattttagtgtttagattatttgcattcaatgtaaatattttctgtttgtcccatctcttcattttctcttttagcacatatttagcacttctgacacttttcattcctgtgcacagatctgagtttctattttgtttcttttccccctttctttctgttactttgtttttatttatttatttttttgagacagggtctcactctgtcacccaggctagagtgaagtggcataatcacagttcaccacagccttaacctcccgttctcaggtgatcctgccacctgagtctccggagtagctgggactacaggtgccggccatcatgcccagctgatttttgtattttttgtagagacagggttttgccatgttgcccaggctggttatttaactcctggtctcaagctatcctccccccttggccgtccaaagtccttggattacaggggtgacccactgcgcccggccttttcagacccttctttctaataaacttcctttaaagctttgtactctcggtcttctggtgacaaattttctcaagctttttttgtctagaaaaaagtttctctaaaaatgtttattttgccttcattgttgatggatattttcactggacatcaaattctaggtcatgaggttttttatcctctttcagaactttatttttttttttaattaacatccaagtcttataaactcttatttattaaaaaggaaatcatgagattgagtccttattaacatccaagtctcataaactctttttttttaaattaaagttctagggtacatgtgcacaacgcgcaggtttgttacaaatgtatacacgtaccacgttggtgtcctgcacccattaacttgtcatttacattaggtatatctcctaatgctatccctcccccctccccccaccccatgacaggccccggtgtgtgatgttccccttcttgtgtccaagtgttctcattgttcaattcccacctatgagtgagaacatgcggtgtttggatttttgtccttgtgatagtttgctgagaatgatggtttccagcttcatccatgtccctacaaaggacatggactcatccttttttatggctgcatagtattccatggtgtatatgtgccacattttcttaatccagtctatcattgatggacatttgggttggttccaagtctttgctcttgtgaatagtgccacaataaacatatgtgtgcatgtgtctttatagcagcatgatttataatcctttgggtatatacctagtaatgggatggctgggtcaaatggtatttctagttctagatccctgaggaatcgccacactgtcttccacaatggttgaactagtttacagtcccaccaactgggtaatagtgttcctatttctccacatcctctccagcagctgttgtttcctgactttttaatgatcgccattctaactggtgtgagatggtatctcattgtggttttgatttgcatttctctgatggccagtgatgatgagcattttttcatgtgtcttttggctgcataaatgtcttcttttgagaagtgtctggccatactgaccaaggtaatttatagatgcagtgccatcccctcaagctaccaatgactttcttcacagaattggactactttaaagttcatatgaaaccaaaaaagggcccgcattgccaagacaatcctaagccaaaagaacaaagctggaggcatcatgctacctgacttcaaactatactacaaggctatagtaaccaaaacagcatggtactggtaccaaaacagagatatagaccagtggaacagaacagaaccctcagaaataataccacacatctacaaccatctgttctttgacaaacctgacaaaaataagcaatggggaaaggattccctatttaataaatgatgctgggaaaactggctagccatatgtaggaagctgaaactggatcccttccttacaccttatacaaaaaataattcaagatggattaaagacttaagacctaaaaccataaaaaccctagaagaaaacctaggcaataccattcaggacataggcatgggcaaggacttcatgtccaaaacaccaaaagcaatggcaacaaagccaaaatagacaaatgggatctatttaaagagcttctgcacagcaaaagaaactaccatcagagtgaacaggcaacctacagaatgggaggaaatttttgcaatctgctcatctgacaaagggctaatatccagaatctacaaagaactcaaatttacaagaaaaaaacaaccccatcaaaaagtgggcaaaggatatgaacagacacttctgttttagaactttaaaattgttgttctgttattatttggcttgcaaagtttgtgacctgaattggtggttttccttatcttttgtcctttacagccaacgacggggaaaaaaaaaaggatataaagatttttctttaacagtgattttcagcattttgattatgagtctgcctttctttctgtttgagatctgggtttagtttaccttcttagatctgtgagattataacttttatcaaacttagaaaaggttagcaattatatagtgcttcatttttttctctttttcttctctccttaaccttttaatttctgagcctataatgtttctatgctattggttaaggtgttgctgatttctaaggcactgttccttttctttcttccttttgtttttttgtgtgtgagtgttagatgttgatcttactcttatgctaaatcattttgggatttatcttttttcggggcttgctgttcatcacaagtttattttgtggtcatcttgcatactttgttggtatgatctcttctttttttctccttgtcagtttatgtctgtaaatttttttttttcttgagtctcgcactgttgcccaggctggagtgcagtggcgtaatctcggctcagtgcaacctccgcctttggggtcaagcaatttttctgcctcagcctcccaagtagctgcgactacaggcgcactccaccacgcctggctaattgttgtatttttagtagaaacagggtttcatcatattggccaggctggtctcgagctcctgacctcatgatcggcccacctcggcctcccaaagtgctgggattacaggcgtgagccaccacacccgtcctacgtctgtaaaatttttaaaatttattttattggagttgtaaaggggaaaaatgacgtgtgttttcagtattcaattataaatcaagagttttttgagatttcattttgtcttgaaatgctattttttttaaaaggtagaaattctatttagaactgataaagaataagcagttattatgttaaaaagatcttctcaaaagtagtaaaagatagaaagcagctcaatgtattataaaatccagttcagccataatagtcaacattaatgtgttgtcattgtccatccagcgtgctatataaaactaccataaatggggtagcttataaacaaaagaaatttatttctcatggtctggaacctgggaattccaagatcaaggtgccagcagattcagtgtcaagtgacagctttctcatagatagtgctttattgctgtgtcttcatttggtagaaggctcaagcaagctcctttgagcctcttttgtagagacaccactcccattgatggaggactctgcctgatatctaataacctccaaaaggtcccacctccaaatatcatcaccttggtaattaggattcgacatacagatttggggaacacttatattcaaaccataacacttgtcattaacacatagaatattggcctatctcatatcaaatacaggccagtatgctaaataaattgctagtcattgcagttctcttttggaacaaagttatgcatgctttattagagtagcaattaatcatgactgagagtgttttaatattgcaaatatcaatcattacatttaattgtctcatcaagttagacatttaataaaaatctaccaaaatattgccaggcgtggtagctcatgcctgtaatcccaaggctttgaggccaaggcaggcggatcatttgcggtcaggaggtcgagaccagcctggccaacatgacgaaaccctgtctctactaaaaatacaaaaattagctgggcctggtggtgtgcacccgtaatcccagctacttggaaggctgaggcatgagaatcgcttaagcccaggaggtggaggtgttagtgagccgagatcatgccattgcactccagcctgggcgacagagcgagactcctcaaaacaaaacaaaacaaaaaaactaccaaagtattaatggctcacactgtaatcccagcactttgggaggccgaggcgggcagatcacgaggtcaggagataacaccatcctggctaacatggtgaaaccccatctctactaaaaatacaaaaaatgagccaggcgtggtggcaggcgcctgtagtcccagctacttgggaggctgaggcaggagaatggcgtgaacccaggaggcggagcttgcagtgagctgagattgtgccactgcactccagcgtgggcgacagagcgagactctgtctcaaaaaaaaaaaaagtttaatacagaatttctgtccatccagtagccaaagcttttcctaatgaatacgctgcttcataagcatttacttttcttctggttttgtataatacaaaatgatttgaataaagtaaaatacactataaaatggtatcgctattagattattcagttataatttgtgagcaacatgatgaataggacactaaatcaagtatataatagcaattttaagatgttacgatattctggctgggccgtggtggctcatggctgtaatcccagcactttggggggccgaggcaggcggatcaccggaggtcaagagttcaagaccagcctggccaacatggagaaacccgtctctactaaaaatacaaaaattagttaagtgtgatggtgcacgcctgtagtcccagctattcaggaggccgagactggagaattgcttgaacccaggaggcggaggttgcagtgagctgagattgagccactgcactccagcctgggtgacagagtgacactccgtctcaaaaaaaaaaacttacaataatatgaggtctttgtaaaatgtgagaataaaacttttggagataagcgaacatctgagtaaattgaaatagcatgtctctgtacagaatattgtaaagatgttaggtaaatttattttttaaaatgttctatcagtaattccaatgtaatttttgtttaaaatttgatgaaattactgtgaagttatctgtatgaataaactaagcaatattataagttctgggaggtcagtaaattggcactttatgaaaaaagaaaaaacaaaaaagtcctgggagaaaaattcaaaaggataatagaaagttgaacttccgtactagctgtataaacattaaaccataatttgattttggtatgggaattgttagttaaatgatatagaatggatactgaaaattagtcatatatgacttgttcagtttggggaaagaaaaacccctttttctaatatttaggatatgtttaaaatgttgtatctgtgttaacaatggtaggaaaatttagaagaaaataggattgaacgtttgtcaaaccattttgagggccaagattgagggctagaaataatgagaaagggaaagaatcatagatttagctacacaatgattagcaatttacttataaaaaaattgtgcttaaggcaaattgccaatatgactcgtcttggaagaaaaacatattccttctgtgtttgaaatatttttccacaaaccttttttattatgtgaagggaaaggtaattttaaaatgttatgtgtcattatgaaaagcgatagccttaccccactcatttttcttgaaagtaattgtttagtgtctgttcagtggagtttttctatattgaatgaagtttagcaatatttttaaagtttaaattattcatcagacatttaattttgcttaattttcctgctctaatcattttttttcccgaaaaagttgtacattatacaatacttaatttgaatgtcttctccattttagtgcctggcatgcatgtgtgaataaaacacctctgcccttgtggaactgggaatttgtcagtcttcctttccttttccctttcctttttttctttctttctttctttcctttttcctttccttccctctcttttttctcctcaccctcccatcccttcccagataacaaatatgaggtgttaacaagtgctttaaagaaagataaaggagagtaaagggttaatggtgaagtgaagcttttagattgggcggtaaggaaaaagctcccattggatgagagacttgaaagaggtgagaaaataagtatcttgaattcctggagagaaatcttagtccttgagttggtaatatacttgttattttcaagaaagggcaaggaggccagttggctgaacatagtgtgagatagggaagatggtgggaaatgaagttgaaggtgtaggcagctaaaaggacttaatgcattctagaaataactatcctcaatctactgagttttctgtctttaccttagattacatttaaacttaacatacagtgtgtttaattgctacaactacatattcttatcagcaagtaagttaattcttaaaaacaaattcatttccatgttttgctgtttttaaggaggcctcatgggacctgtcaggatgatttcatctggacacgagttaacaacagattatgatgaaaaagcacttcatgagcttggttttaaggatatgcaggtacatatataaaacgtggtttgagttttaatgatctgtttataatcatcagttgaatagtcgcagatgtagtttaaaaacagctcttattgctttgttatattaaaattttaagtgattctatacttcagatttaccgttttattaaactaaaagcttgatatgcataaattttttttcctgttttttatagatggtatttgtatctttgggtgcaccaaggagagagcggaaaggggaaggtgttcagctgccagcatcttgcctcccaccccctcagaaggacaacattccaatgcttttgcttttacaagagcctcatttaactactctttttgatttattagagatgcttgcatcatttaaaccaccctcaggaaaagtggcagtggatgatagtgaggtgactatgtttcattttcacaaatcttgttttgtgtctctgttgagaggatatagtaactttaataaaagtatagtttataaaacgttataaagtatataataattttctctccttttttttttttgttcattttttttttgttttctttttttgagacggcatctcactctgttgaccaggctggagtgcagtggtgcaatctcatctcactgcaagctccacctcccgggttcatgccattctcctgcctcagcctcccaagtagctgggattaccggcgtgtgcaaccacacctggctaatttttgcatttctagtagagatggggtttcactgtgttggtcaggctggtcttgaactcctgacctcatgatccacccatgtcagcctcccaaagtgctgggattacaggcatgagccaccgtgcctggccctcagtaatcttttaagagtagtaaaattgggccggggcggtggctcacgcctgtgatcccagcactttgggaggctgagatgggcagatcacgaggtcaggagttcaagagcagcctgaccaacatggtgaaaccccgtctctactaaaaatacaaaaattagctgggcatggtgccgtgtgctagctagaaaggagaatggggaagaggatgggagagtagaatgggaggaatgaaattggaaaggtaggcagagcgaaataatgtaaaccttttgcgtcatcgtgagtcatttccattttactcaaagtggacaacattaaaagattttaaacagaggataaacacatgttctgatttttgttttatacctaataagtttctttggagaaagtaacaaagtcagtaaagcatttgatatacgagtccaggaacaagttgccctgaaataggatggcagcagtggaaataaatcgacaacaggtcaaaacaacatcacttggtggtggtttgggttttaggagtagggaatgaagaggagaaggaagacagaaatggcactgggtttctggcctgtgcaactgggtggattccatttgagctgaaggatagatagatgcctgaggaacatcaaatagagatgtcaggtaatcacttggatatataagtatggagctcagaggaaaaggtatagtctagaaaaatggtttgtgggttatcactataaagatgccatttattttattattatttttatttttgtgagacatggtctcagtgtgtcacccaggctgcagtgcagtggtatgatcgtagctcagttgtagccttgatctctcaggttcaagtgatcctgctgcctcagcgtcctgaataggtggaactccaggtgcatgccaatgtgcctggctaattttttaatattttgtagacatggtctctctatgttgcccaggttggtttcaaactcctggcttcaagcgatcctcccacctcagcctcctaaagtgctgggatcgtaggcataagctgctgtgcccagcctgaagatggcattcagaggcaagagtatgtgtgatatcacctaaaggagccatattcaatccactaacttttaaaacaatgcctttaaatgggcttattctaagaccttttcatgtattcatgtagcttatgcagtgaatcacaattttgagattgagaggcaggtaaaatggtggtattttgatagttttccctgtgttaggctagtatgcttttctttcttccccaagattgttaagtgacttcttcccgtttccatgatgtgtttgataatggatgcagtgggctgccattgagccttctgtttcttatacctcagtttctcacgtgatggtacattcttaaattcccaagaaatacccattgttttttcaagcagaataatcattaataggtgcccatgaaacctctgttttctcacctagtgctggtgttctgttccatgtattaggggaataatgtgaggagggggacaaaaatttgcagaaggttttttcaaaagaggagttgttcaaattgggtccagctactgttaagagtgaagagaaaagcattacagattttcctcaataagaaagcaaatgccatgtttgaggacctgggaatactagcatagtgtaatttaaatactaggacagaaaggtagactgtaacttgtatcgcaaaaggacctaaatgattttttttttttaatccatcattatggctggttttaagcagcaaaatgagctcttttctgggcttttagaaacaaaatttagatgtttgtgtggaggatgtagtagagaaaaccaggaccagtgataagagatcctgggctgttatgttaataggctgttacgttagtctgagtagtgagacttaaaccaaagggaaagcatttcattgtttcagcagatttttttttttttttttttttttttttttttttttgagacagagtctcactctgtcctccaggctggagtgcagtgacaagttatcggctcactgcaacctccgcctcccaggttcaagtcattctcctgcctcagcctcctgagtagctgggactacaggcgcacgccaccacgcccagctagttttttttttttttttttttttttgtatttttgtagagacagggtttcactctgttagccagcatggtcttgatctcctgaccttgtgatccgcccacctctgcctcccaaagtgctaggattacaggtgggagccactgcacccagctgcagatattttattgaatcttatttttggcaggttgataacagggattttttgctgaataagataggtttggccctgatgagagttacacaaaaaagtaaaaataaagtatctttactgtgtatgtctcatgagactttcagtcattgcagaacatacttatgcacactttgaagatatttttccttctaatccttttttgcatagaattcaatatttctctttttaatggttatttacaacggaatgatgagttgttttattgaagaactgagtgccatttcctcaagtatagcgcaagtgttactcgagggttgcttctctttgttcatcaagcttgtgaaagaccaaatttaccttgaaactttctaagatttccttgacattggagaattgcttgaacccgggaggcggaggttgcagtgagctgagatcgtgccattgcactccagcctgggctacaagagcgaaactccatctcaaaaaaaaaataaagattttcttgccaccaaagtgcaccatgtttctgccattataccaaaagaactaagtttctttttataggcttatagaatatccctagaccatgttataccaaagaatcactgtgatagtagcagtagtaataaatttatactccgtggaaaataccaaaactgtcaattttagtttttactctttttacctctcagggtggtactttaaatttttgtttaattgcctatttcctaagtggtttttgaaacgttgtttagcttactcttgccttagcaagttttggaacttagcaagatttaacaaatgataatggaaaaaaataggtctctaaaattgtttgctttcttcttaacgtctgttcatctgagactggaaaatgaggtttagattagcaacataagagaaacaggctcttttcctaaatggaagttcaaggatttaattcacccagtctttattgtgcttagaatagtgacctgcaaaatggaaatagatgattgtcatattgaaatttgttagaattttctggcctttaaacagatgttttcacttttatttgaaaagtttcatgaggaacatgatcagtcttagaggaaagcttttctagaaaaatgttcagtaagaagttgaaaaaacactgcttggctattaattttctcaaatatgtatcatataacaaatgtttcatttctcacttttcaaaaagtgaggctaaaaactattagcaaatttgatcattactttatgcaaaaatttgaacttaaaactttttcttttctgatctgttttgataaagtagttgttcttatttgtgtagagcttacgatgtgaagaacttcatcttcatgcagaaaatctgtctaggcgggtctgggagctactgatgcttcttcctacatgtcctaatatgttgatggcattccagaatatctcagatgagcaggtgagcccacaaaatctctttactctcctagaggctgttaccagtttacattcctattgacagtgtagaagattgcctgttgatgtaccctcagtaaatctgaatatagtttttacccatatagtaggtaaaaagtgccactgcattttaatgttcatttgtttatttagtgagggtgaataatgggtgaataatgtatcagaggctaaatgtaagatgaagatgttttctaaaattattgacattttatattagtgttttttcatattacagtatgcttttaatattgttttttgttcttagtaacaaaaagtaatgtttagagaaaatacacagaggtgaaatgatgtgcatcagtgtttgttttgtgtgcttatacaaattaactgaccaaattggagaaaatgaggcaaataaatttaatatctgtgtgataattttttttccatatggacaccacctcacatgtgtgttgggtatctttgtaaagtctttaacattaaagactgttttaatttatttatttatttatttatttttgagataaggtataactctgttacccaggctggagtacagtggtgtggtctcagctcactgcaaccacaaccacgagggctcaagtgatccttcctcccccaaccttccccagtagctgagaccataggcgtgtgcaccatgcctggctcatttttgtatttttagtagagacagggtttcaccgttttggccaagttgatctataactcctgacttcaaatgatctgcccatctcagcctcccaaaatgctgggattataggcatgagccactgctcctggcttaaagattgtttttaaaatttgtataataagtagtttatttgaggacatctccgaaagaactctacaggatgaatgaaaaaataaatgtcctaatgttatactaattctaggatttggaacattatcatgtgattttgggagagccaatatctcacaagacttggaagtgaagaagatgggctcttcaaaatgccaaatgatgacttacagtagcactagtaatagcatttcaaagatgcacattaagtgtgaattacattatttcatgaattgacagtagaaaacagcagtgttcctgagttcatatatttgtatgacttttaaatatatagttgtaactattaagtacagacatttaattcatcaccatctttagaagtttacccactcaactagatcacaatgttgtttcttcttttaattgggaagattaacagttaattattttcccatgctgctgtttgtatatgaattttattgggtttattttcagaaaatttaatgcataattgatgttttaagcataccatttgtgccagttatatacctagtcttcatatgttttaatatgtttcaaagtatatataatattttgagtttttatgtagtgtcagtttgtttaaagtttttcttttttgtgttccctgagtaagttggcttgagaaacatgtttttctaatttaagagtaatgatggatttaattggaaagaacttctcaaaattaagagcgcccacaagctattgtatgctctggaaattattgaagcactgggaaaacctaatagaagaataaggagggagtctacggtaattgcatttccattattatcattaaatgtttgtattctctctggagcaaaattctataatgtattgtcttttccattctataataattctttcttccgccattctgccttactttttttgcctttctcatagggaagttacagtgatctttatccagattcagatgattcaagtgaagatcaagtggaaaatagtaaaaattcctggagttgcaaggtttgatcatatgtgtttttcaatgtattgataaaaataatttatcttcagtttttcaaaagtgggtaccataattcttcattgattttaaactaatatactattaaaataaagcatagtttaaaaatcatgtattactttaagttgcaataacgtaaactgagattatttaatgccttggtgctcctgcttttagctctgattttccctctattgaaatactgtgagagtcctggcatggtggctcacgcctgtgatccagccctttgggaggctgagacggatggatcacttgaggtcaggagtttgagatcagcctggccaacatggtaaaacccgtgtctctactaaaaatgcaaaaatgagctgggtgtggtagcatgctgcccataatcccagctacccaggtggctgaggcaggagaatcacttgaacccaggaggtggaggttgcagtgagctgagatcgcaccacagcactccagcctgggcagcaaaaaaaagatactgtgaggacatcccagtgtctaggactaaatggctaatggaatagaaagatgtttataggctttttcgtgtgtgtgtgtataaattttttttttttgaaatggagtctcgctctgtcacccaggctggattgcagcagcgcgatctctgcttgctgcaagctccgcctcccaggttcacgcgattctcctgcctcagcctctggagtagctggtactacaggcgcccgccaccacacccggctaatttttttgtatttttaatagagacggggtttcaccatgttagccaggatggtcttgatctgctgacctcgtgatccacccgcctcggcctcccaaagtgctgggattacaggcgtgagccaccgcgcctggcctcaagtgtatatttttttaaattcttgtttgttttattttgttttgtttaggacagggtctcaccttgtcacccaggctggattgcagtggcatgatcatggctgactgcagccttgacctcctgggttcgagtgatcctcctgcctcagcctccctagtagctgaaactataggcaccagccaccatacccggccaatttttttattttttgtagagatgaggtcttcctatgttgtctaggctggtctcaaagtcctaacctcaagccatcgtctggctttggcctcccaaagttctaggattacaggcatgaaccattgcacccacccttaaattcttgaaagtagcctttatcttattattttgtctagaaattattttggtaatttaaatgaatagtagtgtaaataaaagatacgtaatattttacatatccagttactgaatcaacaagcattattgcattatatatctgcttttctcttactattactttcacaattgcctacagtttgttgctgctggagggcttcaacagttattagaaatttttaattctggaattctagagcctaaagagcaggaatcatggactgtggtaagtgcatatttatggtttcaactagttacagtagttatcccatttgaaatacttccatttcatcagcaagtatagcttttgccatatagttccttataataaagtatggaatatagcagaaatgaatttaaaaatacagtttgataaactaattaggaataagtgtttttcatgttatcagtattaaaaaattcttctgataaaattaattactctaaactctggccagttcataaacatgtttcctttaggttgataaattatatattaatatttatataaagtttggttgctttttaaaaatttggtttacatcttagttttttcaaaaaactttttttgttttattttgttgtgatcatttcttcctttatagtagtaataattaaaaacgtgtttccagaccatgttgactggcttacattgagatggatatagaaattgagagtaagcctctagaaatttttatagcaattagacattgttgctgtattttataatactttacaaaagtattggtcctcaacaaaatggaatttttttttctgtgaacttgcataaaaaaatggaaattttaaaaaatgttaactttaccaccgtgatttgaagaagtactatatgaaaataaaattgcttatagaatatttaaatcttaataatgatatacaaaactgcccaggccagtttcaagctcattgtaaaggacattccattttcttccatcaaagcagtttagcattatcaaacattgaattcaagtattttcttagttcctgtggttttttgttttgttttgttttgctttttttgaattgcctttgaacctaggagtcaggtataatgatttgacatcaagtaatcttatgtctaaatttgttagctcatcagctatcgtcagtgttagtgtattttacatgtgggccaagacagttgttcttccagtgtggccagggaagccaaaagattggacacccccgtactaaaggttttctctgtttgtttttcttgaaattatgaatactttcctgaagtattactagtaacattttattgccaatatgtggcttattgtagctttataatgcccaagatgcaaagcatgtctaagatagaaattgctttcaggtcaactggtatttcctgtttatagtgcatctctcttaatattatgaaatacttctaagttcaggattgttcttgtttcttattttttttttccttttcaaatgagtttagttgaagtatacctttaaaactttttttgaaatatagttaacatgcaatcaatgtactcctccaaaatgtactgtttttactatattcacaaagttgtgggactatgaccagcatctaattccagaacagttgtatcccttcaaaagaaacctccccctaaacgctttagccctaggcaaccatcattatagtctcctttctgtttctgtggatttgcccattctggacatttcctataaatggaaccatacaatatatggtccatcgtgactggtttctttcacttagcctattttcgagattcatccttggaagtagcaagtatcaataattcatttttttataattatattacatgtttatccattcaccaattgagaagcatttgggttatttctacactgtgactgttgtgagcatttgtttatgagtttatgcatagataatacattttcacttctttttggcatatgcttaggagtggtataccttgccaatacttaagtggtattttattgtgatttctagcatttacattttcccaatgctaagaatcttgagcagcttttcatgtgtctgttgaccattcataagcatgtatgcatgtatgtgtgtgtgtacacatatatatgcacacacaaacacattcattcataaatctttggtgaaatgtttgttcagtcacagctgaatccagggagtggaagattgatcagtcggtgaacatctgcatcgtttccagtttggggctattatcaataatgttgttataaacagttgtgccttgggtatagagtgcagtttctgggtcctgtggtaacttctaactttttgaggaatttccaaacagtttaccaaagctgcaacattttacatttctaccagcaatgtgtgagggttccagtttctccacatcctttccaagacttgttagtgtctcttttattttagctatcctagtgtgtaaagtggtacctagttgtggttttgatttgcatttccttggtgactaatgaggttgaacatctttccatgtgcttattggccacttgtttatctttggagtaatgtcaattcacatccattgcccacttttaattgggttgtctttttgttgatttgttagaattccttatgtatttcagatactgattccttacagtgcatgtgatttacaaatattttctcccgttctatgggttgcctttttccctttcttgagagcaccctgtgatttacaaaaatttgtaattttgatgaagtctagtgtctctgttttcctttgtgcttgtccttttgatgttgtatctacaaaaccgttacctaatccccttacacagagattgatgactatgttttctgttaagaggtttctggttttagctctcacttttttaggtctttggtccattttaagttaatttttgcatatgatgtgaggttgcagtatacttttcatgtaataaataatgcactcattttaaagagtgagttttgaaaaatgtttatgtaacgctctaacatccaaacaaagaatatttccattacttaagaagttccgtcctgcagttttgctattaatttttcttcctccactttgtgttacaatagatgagattttcattttataaaatttcatgtaattggatcagtgcaatatgtaccattttgtatctggcttcttttattcagaatgctttttgaggttgttaaatgtttttcatcgctgagtaatatattcgttgtataggtataccacggttcatttatctgctcacctattgacatttgagtggcttacagttttgggttgttaaaataaagtttctgtaaacattcacatacaggtcatttggtatatgtatgtttttatctcttggattaataccaagtgatgaaattgctaaataatatggtaagtgtaagattaaccttataagaagatgccaaactgtttttcagaacagttatactatgcaacatacgagaatttcatttactccacatccttgccagaagttgatatgaacagggttttaaaatttgagctattctaatgggtatagtagtgttagctcacggtggcttcacttgtccttccttcattgctaatgatgtttagcattatgttgtgtgtttgttgattgtgtgtttatcttcttttgtgaaatgtcttagtatatagttgtgagatggtcttttcccttaaatattatggagaagtctttctctgatgtgtgtatggggacaagccccccacacatgctgtggcttactttttcattatactgacagcatcttttaggggagaggttttaattttaatgaaatttgtatccagtctacaaatatttgtaccaaggtcacaaagacttttctcctctgctttctgtaagttttatagtcttttcttttacgtttagatctgtaacaatacattttgagttttgtgtatgcaatattgaatttttttccttcttcatacggctatttggtttttatagcaccaatttgttgaaaagactttttttctctctgaattatcttgctgtctttctttcggttcagtaatatagtataggtattattgcaggaagaaagtaccatttctttctggtatgtttgtgtaggaatatatttggcagtggaatcaggagagcaggaggttaagaacttttgaagaaaaagctgtgaaactctcatcttgtacataagtgatattctaattaaagaaagtgaactgttattaaaattgagcttccagtcagctgtaaattttattttttatacatactaaacaatatttaaaacaactttttaaataaaataaatttatttttaatgtggttatggaaagtgcaagagtttcagttgaattattttctagaattactagcaattgctttggtccgtaagtattaagagtttgtgccactcgttgggagacacagcatataatactttgtttctcagttaattttattgataagtaatatccttgtcatcttaattttttaaaaaattataaattatgagcagtatgttttttcaaaaatctcatagctattacatatatttttatattgccttcattaaagaaatgaaagtgtcatttccatttcattaaatacatcttgtataccctctttatttctagatactttttcttcatttttataagattgaattggtactgaccataatatttgagcagcagaatttttatagtacatgattaagtactagctataattatttttattttctggtcttttaatttcaaaattgtattgtggccattctaaattaatgaaaatagggaattgactatttcttctcatttacagtggcagctagactgtcttgcttgcttgctgaagttaatatgccagtttgcagtagatccatccgatttggatttagcttatcatgatgtctttgcctggtctggtatagcggaaagccataggaaaagaacctggcctggcaaatcaaggaaggctgctggtgatcatgctaagggtcttcatataccacgattaacagaggtaaagtgcagaaattaatgtttaatgatgaattccatttatttttataaactgaagaaatatgctaatgcttaagaaatgtattctagattactgtgacttaacctgacagctgaactgacggcattgttttaaagcagtagtgattatgaagcagtattgcttttcatttcatcatccagaatgcagaaatgagtcgtgccattttaatatctgtgagactgaatttattatttgaactcagtaatttatatactttggggatgcatttatgaaaacagaagccatagttggtatttcaacataggaaatttaaaatagagaatcagttttacacgtatgtgttacaaggctttaaaaacaaaagggagtggtgaggtaagccagataaggagccatttatcacccctagatcttgtggaacattagggaagtggttgggttatcaggaacttagaagcttgcaggagggatcctgttaaaccggggtttaggcctctgagaaagcagttacgctcttatgctcatctgctataagattatcagaggggacctgataaagctggtgctaggagtgcctaaaaaagctgaaggctgaaacaaactctgtcttctaggtaaatacttttagataaatgctgacagaagaaagaaaggaggagtctctcaagtatcctagactggcagaacctaataggaagccacctggcaaaggaggaatttggtttttgatatatttgccctagcataatagaacaagtgtataaaagggtggatttggagatgaaagaaaatatggttggcccttgaaaaatagaggagttaaggatgctgaccctccatacagtcaaaaatctgtatataacttttgactcccctagaacttaactactgatagcctgctattaaccagaagccttaccaataacaaacagttggtgaatgcatattttgtatgttaatactattatatactgtattcttaaagtaagctagagaaaagaaagtgttaagaaaatcataagagaaaatatatttactgttcttcaagtggaaatgggtcatcataaaggtcttcatcctcatggtcttcacattgatcaggaagtagaagaggaggaggaaggtgaggggttggccttgctgccttaggagtgccagagttgggagaaaacccagatacaagtggatctgtgcagttcagacctgtgttgttcaagggtcaactgtattaaccaggacatcgagcaataaaaatagaatctttttgattgtggattctgtaatcaaatatttgcctttccaacatctccgtcagtgagtcgggaggtagggagtgatcaaggtgagattttagggagatctcattttgtaaccttttgagaacctcacctcgtgtctacccaagaaacatcaaagtaatgaattgttactgatagattgtgacggacataaggttagaaagtactggtataaatggaaacctgaagcagatttcctttttggaattttgggggttaaatgggaaaaatgatctctgtcagtattccaaatcatttacatctaataaaacgaaatatatgcagagtacaatataatctgaatgtattctgcaatgtactgtgttgtgaactaccactttagtaaccttacattactataatgttttggtcatgtttttttcagaataaactttccaggttataataatgctctaattgtgatcctttccatcactcactaaataattccaatgtttattgacctttattggcaatttccttttgagattttaataatataaatatacataagtgtatgtgtaaaatacgcacgtttatggaggtttataggttattggtttgtgtttaaaaataatatgcaactacaagcttattgaaaattcataatacacaagcgaactttttccctagtcataggtgactactcttaatatcttttcgtgttatcttttcagagatttttttctatgcacatgccagtggtttggggtttttttttgagacggagcctagctctgttgcccaagctgaagtgcactggcgccatctcggctcactgcaacctctgcctcccgtgttcaagcggttttactacctcagcctccaggtagctgggattacaggcacacgccaccatgcgtggctaatttttgtatttttcatagagacggggttttgccatcttggacaggctgatctcaaactcctgacctcaagtgatcctcctgcctcggcctcccaaagtgctgggattataggtgtgagccaccgctctgggccaatgttatttttttttaattttagaaaaggtgtatattatatagtttttgcatgagtttatttcccaaaataattccagcttagtatgtatatctcagatctatggaaataaaaatttctgttgcgttaatactgaagacagagtcatctaatgttgatatactgtaggtagtaaggaagaacactaacttatttaagagtttaccatcatttttccgtgtgatctttttaatagcattttaaaaagttacttgcaaaatttagcctaaacatcaatttttctggaagttttctcacttctgccagggacaggtttagttcctgctcccttcttttgcttatttgcacattgtatatacttgtgttaaccatgttttctgtggctgcctgccccagtgcagaaacagtgccttaggaagtatgtgcacagaatgccttccaacctgcagaataaatttaataattcattgttagtgaattattttctccccttatatgaggaagaactagaactgaggaattccaaatatattaggatcatgtagcctgaagctgaatgttgaacctcaggattttgaatctagaatccatgctctctacccgtggtatattatattgctttttaattcttatttcaggatggttgaggaatctattactacttgatgtttttttaaatatattttcttcaaaagtaaaaacatgtttaattattcaccaaccccttcccaagaaaccactgacatgtatatatttctttcccccagttcagtggtatgcagagaatctatgaatcgaatgtaaagactatttttgcccctatttctaaattcttagtaatttcttttctttttcttttcttttcttacttttttttttttttttttgagacagattctcattttgttgttcaggctggagtgcagtggcacaatctcagctcactgcagccactgcctcccagactcaggtgttcctcccttctcagcctccaaagtagatgggactgtagacatgcaccacacacccagctaatttttgtatttttagtggaaacagagttttaccacattggccagctagtgtcggatttctgggctcaagcaatccacccacctgagcctccctaattgctgggattacagcaattacagtgagccaccatacccagcctacagttgctgctcttaagtgtgattataaaattctggttttccgattcttggcatttttacagtattttcaaagaattcttacgacattctttattgtgttatagataaatatcaaaataatttggaattttgggttaaaattttgtaatacacatctctttagtaactaaatcttgagtgctttttgagggttttccttttgctgtatttaaatatcttttaaaatgtttttgttttaaaggtatttcttgttcttgtccaaggaaccagtttgattcagcgacttatgtctgttgcttatacgtatgataatctggctcctaggtatgcattttaagatatattttatgtgtgtatgtatagcaggaatataatgttttaaaactttattttgaaaaattctaaacttaatagaaaaatttgggggatattatgatgaaatctctcataccttccatccaaatttacgtattattaacctgttgctaaaatgtgtcttgtatttatgagtcacgtattttctgtgtgtttacatgttttcctgaatcttctgagactgaattgcagatatcatgactgttcaccagtactttgttgtgtatctcctaagaccaaggagattttcttaatagctagagtaaaatttttaaatttatagaatttaacattgatatgttatctaacatatagttcatattaaaataatcctattggtattctttatagcagtatttttcttgcttcaggatcaactaaatgtattgcatttagttgtcagttcttctgtttcttttcatcagagataactttctcagcctttctctcatgatacattttcaagtaatgcaggccagttattttatagagtacttttcagtttgagttttcatgattagccttcatgattagattcagattatgtattttttaaaggagtcttaaagtttagactctaaatcattataacctatgtgtttgtcacacacatctctttagtaactaaatcatgagcacttcttgagggtttacttatttcagtcaatgttttattcattcaaattttgtttattaaatctgaagtcatttcgtatttgctgtaataagattttaccagtgattcttttatttggtttgttttttattttgaaacatacaatatatttttattgactagacaccctgctgtgtaatagatttcaaaacttcctgctctatctggaacttcataccctttgacttataccctctgccccaccccaccctaccctaccccaccctccagcctctggtaaccattattctactctcttcttcaatgagtttgactcttcttcagtgagtctttaaataaatgataaagaatataaaacaaataaataatggagctctcttaaaatatagtctcttttgcaaaaattagctgagtgtggtggcacatgcttgtagtcccagctattgggaggctgaggtgggagggttgcttgagcctggaaggtcaaggctgcagtgagccatgatcatgccactgcactccagcctgggcaacagagtgagaccctgtctcctgtcttttaaaacacacacacactcacactctctctcactctcactctcactctcactcacacacccactgctttccttttttgggggggaagtgataaccttaaaggatatatgttaataaattgaattatttttaattcattgctgaatttaattggtggtggtggtgtttttactttacagagttttaaaagctcagtctgatcacaggtctagacatgaaggtaagggttccacaaagttaacttttaataaataaaaacttgaataatatattgatatattttacctttaatattgaacattgtgttttcattttagcacaaaccttttatagtgaactgttttctaatttttctttagtttcacattattcaatgtggctcttggtgagttgggctcattgctgttctttagtgaaatctagccttgctgatagcgatcatttacaagattggctaaagaaattgactctccttattcctgaggtaagataaagattgaaggttagtactgttattttttgtatgttttcatgttattagcattgataataaaagagctaatggaaacaaatatgcgtgagtccataaatatatcacattatctgcttaatcctttaaggtctagagtgttttgaactatgtacaatgtttaagaacttctgactattatatattatgtagcatttatatttttctgaaatgtttatagaatgattattttgctttggattaataaaaaaaagtttttccaggtagtaggaagggcttgagaatttattttggtaatttatgttttagaaaagttctgtggccttttttttttctttctttgagacagaatctccctgttccctgtatcacccaggctagagtgtagtggtgcaatcaaggctccctgcagcctcaacctcctgggaacaagcgatcctctggcttcagcctcccaagtagctgggaccataggtgcacatcaccatgcccagctagttttttaacttttttgtagagacggggtctcgctgtgttgtccaggttggtcttgaactcctggtgtcatgtaatgctcctgcctcggcctcccaaactgcttgggattataggcatgagccgctgcacccagcctgtgttttctatttaagtagaaatagaggctagagagactacaaataaataaaagaaatatattttgcttcccatgttgacactgaggccaatataatttttattagctgtatcttggcattactcacctcatattcctatgtgaaataatagaaacacacagtaatatatttagctccaaagtcacttattttttaaacctgcgttgtctaataatattagctctggctgggcactgtggctcacgcctgtaatcacaggccgaggtgggtggatcacatgaggtcaggaatgcaagaccagcctggccaacatggtgaaaccctatccctactaaaaatacaaaaaattagctgggtatggtggcaggcacctgtaatctcagttactcgggaggctgaggcaggagaatcgcttgaacccaggaggcagaggttgcagtgagccaagatcgcaccactgcactccagcctggaagacagagcaagactctgtcttaaaaacaaaacaaaacaaaacaaaattagttctggatataatgtcatttgtgttctagtcctgtctcaggtaaccattttgacatttggacagtttgcttacaatctatagaatattccgattgaagttgcttctgtgttgcttctagttctgaaaatattttatcctcttactgacttgtaaataacttaaatgattctaaatgtccttactcaattattctttgtatttacctgttgtcattattttgttttgtttctgtttttatggccatgctttaggatttctaaaacactgtatttatatattatggtataccttgagatactttatttgatcatgtgtaatttacatatatatatgtatgggattagaacattatatttattaattatttttatgaggcataatcttgttctgccacccagtctggagagcagtggcatatcagctcactgcagactctgcctccctggttcaagcaattcttgtgcctgtctccagagtagctgggactacaggcgcaagtcaccacacccggttaatttttgtattttttgtggtgacagggttttgccatgttggccaggctggtctcagatacctggccacaggttatcctcctgcctgggcctccaaaagtgctgggattacaggcttgcccggcagaacattgtatttaaaatcacctaaaattatttctgctaacatattaactttgtaatactaactctcactgtttgtggaactttctttttcatctagactgcagttcgtcatgaatcatgcagtggtctctataagttatccctgtcagggctggatggaggagactcaatcaatcgttcttttctgctattggctgcctcaacattattgaaatttcttcctgatgctcaagcactcaaacctattagggtaagattttactgtgtttagaagcagtttctatttttgaaatttcctttgcctcagtttaccgttgtaatatatccttaaaattttgatcatttgactactgtatgtgattttttaccaagaggatagtagttatatactacttaaggtgacagcattgtgacacattgtgtccatgttactactaggaagagactgatttcagctctgtggtctctcatggatactctattttagaaatagcatttattctcactcggttctgggccttgtgttaataagttgactaataaaaaatcataaatggagctctcttctctagtaagtcacagttttctttttatctttatgatattcagaattttaaattttatttcctaccctagttcatatactagtctttaaaaggcttctaatacataataaatttagagcccactttttactaaccccagaaattcagtgtgttgttggatttacattattttcctccctgttcatatcttttttaatgtcagtaatttgagactaatattttcctaaaagttcttacgtttgtcatttttttgcctggttattctgattttacagaaactaagcgtgtactccatttttaaaaagattttgaatactgtttagtggatataggaatttatttcataaagcctctagtttcttaaatgtattataattttatttatttttaaaatgttttcacaaagtataaaatttttttaatagatagatgattatgaggaagaaccaatattaaaaccaggatgtaaagagtatttttggttgttatgcaaattagttgacaacatacatataaaggacgctagtcaggtatgttcagaaaattatatactattctatgtattctcttcttgttaatatgaattatgacatatgttcatgactttattggttattaagtgtacttcattaatctataacttggtggtggtgtcctatttctactatatttgtgcttttccaccttcttctaattcctttcgtgtttttactcagaccttagttgaaacgtcttcatctggtatctatccataatttcctgtctcttctcagtaagatacgtggatgtaacatcttatttggaaagggaaatgtagattttaaatttaaaaatacagctttctataatagcatgtagtttggagtcccaaatacgtaaaataaaattgcagttcagatagaagttactttaaagaaacactgtcagtttttgcatatctaattttcttatactggactaaaatgacatttccattcaaacaaagtaatgtttaaaacaagtaaatttcaggccaggtgcagtggctcacgcctgtaatcccagcactttgggaggccgaggcgggcggatcacaaggtcaaaagatggagaccatcttggccaacatggtgaaaccccatctctactaaaaatgcaaaaattagctgggcatagtcacaggtgcctgtagtcctagctactcaggagggctgaggcagaatcgcttgaacccgggaggcagaggttgcagtcagtgagctgagatcacgcccctgcactctagcctggcgacagagtgaaactccgtctcaaaaaaaaagtaaatttcaaagcaaatcttgccacttaaagacttgcgttttttccagtgtacataaatttagtcgactaaaatgtgtctaagttgtcaattcagaagaaaatgagaaacacataaagaagatcctttgaaatatttaggacacgtttttcttaaacttttaaatgtatttaaatcaaagttcaatatgttcactttacatttaaaagttctgtggtgtttatactttttgctttttagttaacatctgaattcttaaaatctacttttcatttgagaaataattacaaaaattagtattgagcaagttttaatatacttattgttaattaaaatattgatgccaaataaacattgtactttaaaaaaaaaaaacaacctgggcttgcccatttgagctaaaataggaatctgatcttgcttgcttgtaaagtaattttcctttttagagatttgggtttctttgaggggactcaagttagattttgtgaagtctgttttaatgttgttgtttagttataacgagaagtaaagtttttttggaatgaactgtagaatttagtttattgttaaaagtctaatttaaaggtattatttaaaacaaacggtgaattgtgtgtgaattacatctcaataaagtcattaaaaaaaacttcagtgtcttaatagattactatgacttttttttttattatactttaagttttagggtacatgtgcacaacgtgaaggtttgttacatatgtatacatgtgccatgttggtgtgctgtacccattaaatcgtcattgacttattttattatcaacattccattgattgtttttttgtagaatgatcagtgatgtttaagactcatttggttaattgacataatgtataagtaaagagtaggtgtattacgtttataacttattgaatttgggagaactaaattattgttacctataaggaaatgattttaataattttatgtttggtaaaacataaaaaatttatatttgaatttttattttctttttgtattaagacaacgctcctcgacttagatgccttggcaagacatttggctgactgtattcgaaggtaaaatttgatgtgaaattgacatttatattgtcgaggaaagataaaagacataattatgtgaactatcttgcttgtgtgtattttttttcttttttgtagtagggagatccttgatcatcaggatggtaatgtagaagatgatgggcttacaggactcctaaggcttgcaacaagtgttgttaaacacaaaccaccctttaaattttcaagggaaggacaggtaagtgttaagataatcaaatgtttctatgaaatgtgattgaaattttttgttgttacattgtgtattagtccgtttttacactgctcataaaggcatacccgagactgggcagtttacaaaagaaaagggtttaattcgactcagagttccatgtggctggggaggcctcacaatcgtgccggaaggcaagtccgggcaagtccgagcaagtcgcatcttatgtggatggcggcaggcaaaaaaagaatgagaaccaagcgaaagcggtttctccttataaaaccatcagatctcaagagacttattcacttatcacaagaacagtatgggggaaaccgccgccatgattcagtcatctcccaccaggtccctcccacaacaatgggaattataggcaatataattcaagatgagatttgggtggagacacggccaaactgtatcacattgtatgtggatatgttaatttttttaaacatacagacataaaaattgctagaaattaccgacaagaaaagcaaattttgaataaattgaattctggaaatataaaacgggcttgtttttagaatacaaaatcagatgttaattcctgtgactgactgaatatagaaaggtaacctaaggctgggcacggtggctcgtgcctatagtcctagcactttgagtggctgaggtaggtggattgcttgaaaccaggagttcgagaccagccaaggcaacatggtgaaacctcatccctacagaaaatacaaaaatttgctgggtgtggtggcacacacctgtagtctcagctactcaggaggctgaggtgggaggattgcttgagctcaggaggtcgaggcttcagtgagccatgatcacaccactgcactgtagcctaggtgacagaaggagaacgtgtctcaaaaaaaaaaaaaaaaaggtaacctatattttatcagtgtgctttctatagaattgtatattttgaattactgtcctaaactgtgaatcatatcctaatacagtggaattagtaagtagtcattattgggtactcgtttcatattttaaagacctgtgtgacatgaaatctatctctgaatattggaaacacttcgtgactctgaaccaacaaatgtctcattttgattgtctcttgattaaatagttcatcttaccttaacattggtgcatttgtcctggtcattgtaggaatttgttatggtctggagagctgttaccttaaagttactgaatgtgttaggaaatagcaaccaaaaggatagaagattgtcctcataggcatagactaaaggattcttgagatcaacttaagattacagtcttatctgtttgaaatctttgctacttcccctaatgcacaaaactccttcttgtgctatttctttcaggttttttgccttttccattagactcactggaaatgatttgatagatttacagccttgttgattgaagtcttctcttatatataaactagtatataacttttatccccaaatataaatatattaattggtttttctgataacgttgtaaagcaaaagtcattgttaagaaaaaataattttagatagtacaaaaaaagaatattcccatttggtttgatttcctctcatgctatggtgatggccttccaggacttttcatggatacagtaaatacgcatgtataaaattcatatttatagaaattttacagtttataaatagtattctgtgatcgattttcactaaaaaatgagtacattaaaaaagaaaatgtatttttaaaaattgactaagaggcaataatttaaatctttgacatttatgaagttatagaaaaaactgtaaaggcagcatctttgcatacttgtcccattatttactcaagaactcttaaaagtaaaataggttgattttaatccgtagtttatgttagtatacaaaaggatacatcattttacacttgtagccacactgtatgagaatgcctttttcaagcatctgcagattcttatgtcactgagatatttgccaattttgatgttgatttagttttatttctttgttaattggtgaatgggtttctttccatttacttattgtttgtatttgatatttatttgttcagtcagtatatggtttcccattcatttgtaaaagttatttattttgaatatgtcagctctttatatcatatttgctgcatgtattttttccaaagtcttatttctctttattattactatttttttacttctcttctgtttattgatttatacaagttgtcatcctaggacaaatttttgaggctttaaaaggtggatattattagacccaattttgacagatgatgaaactgaggcatagacaggttaaacgagttgtgcatgactgagtcacttactcttcacttggccaagcttttaaccattatacaatactgtctacacatgataacacattaaacacagtgttctatactttgctttttttcacctatcttagatattttcaaattcagtatataaacagttcatttaaaaaaaaaaaagggacagggtctccttattcaagctgcagtgcaggggcacaatcatagctcattgcagccttgaactactagatcaagtgattcacctgccccaacctcccaggtgtctaggattataggcatacgccatcacacccagctaatttatttatttatttatttttgtagagatggggttttgctgtgttgcccaggctgttcttaaactcctgcccttaagtgatcctcccgtcttggcctcccaaactgttgggattaccgatgtgagccaacgcacaccgccatgcttggctattcattttgtaaaagtaacttcaaaatattattgttattatctttgagacggggtctggctctgtcacccaggctggacttcagtggcatgatctcagctcactgcaacctccacctcccaggctcaagcagtcctcccacctcagcctcccaagcagctgggactacaggcaggcatcaccatacccggctaatttttaaaaatcttttgtagagacgggatttcgccatgttgccctggatggtctcaaactcctgggctcaagcagtccttctgccttggcctcctaatgtgccaggattacaggcatgagccaccatgcctggcccagaatattattttatctgcatatatgtaatatatttagcttcataatgatcaacattgtcttaaactatttctagtgatattacagagatctttatacatttaacacatagatttaggaaatgtaggaagacattctaaaagttagaactgctagttcatggagtatacgtttatagttttggttatgttaaaaacgaaaaccaagttaactgtctgtggaagctgagccaatttatggctgtacctacaacctgagattaatttccaattttccagcatttctaccaacatactatacgtttagataatttctaccagtctgataggtgcaaagagattctcttggttttattttgtattatttttattagtaaggctgaacttcccttcaagtgtttgaaagccatttgtgttatcttttctctgactgctcagatccttttcctttatccctgttatgtatgttatagtccttaactaatttgtagaatattttatattaaggaaactatctcactgtaatatgaattgcaagttttttttttttttctgtcttgacttcatgttttttgttatgcttgtttcttatttatttatttatttgagacagagtcttgctctgttgcctaggctggaatgcagtggcatgatctcagcttacctcaacctccacctcccaggttcaagcaattctcctgcctcagcctccctactagctgggattacaggcatgcaccaccatgcctggctaaattttgtatttttagtggagaccggatttcgccattttggccaggctggttttgaactcctgacctcaggtgaccagcccaccttgacctcccaaagtgctggcattacaggcgtgaaccacctcacctggcctgcttattttcgaagccagaatttttttttcatgtagtcaggtgtattgatcttttacagctactagatactgtgttatacttttaaaaactccctgttttttcatgctttcataacttaatattttacatttaagtttttctatcaggaaattgtttaggtgaaaggaatgaaatggataactttttttcagatatgtacccagttatcctaataattaactaatttattttttttctactgattacaaatgcttcctttttcaaataaactaccatatgtatttctggactttctgtttcatcttattgatttgtttgttcattcaccaatatcatatcttaattatgtagatttaatatcctgtagagatagtccctttgtttgttttttgagacagtgtctcactctgtcacccaggctggagtgcagtggtgcagtggctcactgtaacctctgccctccaggttcaagcgattctcctgcctcagcctcctgagtagctgagactacaggcacctggcaccacacccagctaattttagtatctttgatagagaagggtttcaccatgttggtcaggctggtctcaaactcctgacatcaggtgattcgcctgcctcggcctcccaaagtgctgggattacaagcatgagccaccacgcctgaccaaggtagtccattttcattattatttcttttcagtattttcctggctgtttatttttccacataaactttagaatcagttcatctagttctttaaaaaaataaaattgtgttacttttttggttgagattgtattatatttccagattgatgcagaattaactttatgatactcaatttgcctgtggaagagtatgatttgttgtatttatgcaaagccaatcgttttatgttttttatttagaagattctttttcctacaaaatttaggttttaagtatttcttagtaagtttattcttaggagttttgtcctttttgttggtatgttgatatggaatcattgcttatgttttttaacttgtcatttatgtgtagtaagaatttgtgtatacagttgttgcaggccatctgaaattgacttattgttggtagactgttttcagttatctttagctgttagtgttctttggttcttcatttgtttttggtttattatctgcaagtaattcttgtttttcttttattttccccaagcagactcatgtcacaatcatctgcaagtaattctattacttcctgttttacaagtttaactctttccatttcttcaccaaattttttctgaaacattcagaataatgttaagttagttgttcttagcattctttattgaaaaggtcttcatgttcatgtcaaattataatttccccttcgtttcagtgttaagggaaaactttagaagctttcatacaggagagatgtgatctgaattaacatttcagagggtttactcgtatgctagttggaaaattagtctgtgggcaaactcaaagggcaaatgtatgagtcaagggatccagttaggaagtttttcgatggttccagagagggacaatggtgaaaagtgctttgacgtggaatatttattgaaggtagagctcacaggtctcagatttggatatatatgttggatttgagagaggttaataaagaatgactcctaatttttttttttttttttttttgagatggggtctccctctgtcacccaggctggagtgcagtggcatgatcttggctcactgcaagctctgcctcccaggttcacaccattctcccgctgcagcctcccaagtagctgggactacaggtgcccgccaccacacccagctaattttttgtatttttagtagagacagggtttcaccatgttagccaggatggtctcgatatcctgacctcacgatctgcccgcctctgcctcccaaagtgctgggattacaggcgtgagccgccgtgcccggccaagaatgactcctgaattttaagcctgagaagctgagggaatggtaatgccaattattaagaaaagaaaaactcagaaatgtcagagggtaataggcggtaaaaccaagagttctgttttggaaatgttaaatttgaaatgtcaattagatatccaagtagaggtattaaaggcagttggttttcttgtaatattaaggaaaatatgccttaactccaagatatttaaaatctcttccactctaatgatttttacttttttccttaagtatttttaaaaaatagttctagaactgaatttcatgcagaatttggtaaattttttctataaagaaacatgataaatattttacactttgcagctgcataataatctgtcatcagcaacactaccactatcactactactgcttcctcctccttcccccttcttcccctcctttctcctctttcttctttcttttacctttccagtagtgctaatcttcattcttcctttctttctcctcctcccttcctttttcttccttttttcctccttttgcattcctcctttcttctccttttaaagtatgagtatcattcctatctctattgccttgcatagtgtctaaaaactatgttgagcaaatggatgattgcaactcagacctgattcttagaactgacagtcaaacagtacatttgtcttatgcaaaatttgcgtgtacccttaaaattatggctgctcatgatatttatacttcatggaaataaataatagttattaaaaagagatatcatcagagatttagaagatcagattgcattgacatgattaggaaaggctttgaagaagataaagcttcacccaggttggagtgcagtggtgcgatctcggtccactgcaacctctgccttccaggttccagcgattcccctgcctcagcctcccaaagagtagctgggattacaggcgtgtgtcaccacacccagctaaatttttgttgttgttgttttgttttgtttttgtagaggcgggttttcaccatgttggccatgctggtctcgaattcctgacctcagatgatccgcccaccttagcctcccagtgtgctgggattacaggcatgagccaccgcgcctggccagatacagcttttttaatggatatcttttgtagaaaagtaagggaaacatttaactcataggaaagaatatgagtaaaaattaagtcataggaaagcaatggtttcatgcagaaaattggttggttcagtttagcctatgttttaggaagtataggagaaacttggtggccatctattgtgggcacaggaaattatttttatatataaaatgaaagcattattgtcttagtctgttcaggctgctgtaataaaatattgtaaactgggccaggcgcagtggctcatgtctgtaatcccagcacattgggaggccaaggcagctggattgcttgagctcaggagtttgagaccagcctggccaatgtggtgaaacccagtctctactaaaaatacaaaaattagccaggcatggcggtgcatacccgtaatcacagctactcgggaggctgaggcacgagaatcccttgaaccagggaggtggaggctgcagtgagccgagatcgtgccactacactccagcctggcaacaaagcaagacactctcaaaaataaataaaataaaatattgtatactgggtagcttataacaacagaaatttacttttcacaattctggaggctgggagtagtacaagatcaaaactctggcagattcacagtgtcttgtgaaggcctactttttgattcacggagtcttgtgaaggcctactttttgattcacggatggcaccttctcatgaagcccttagatgatgggaggggtaggaggtctctctactgcttcgttgataagggcagagtcctcatgacttaataaccttccaaaggtcccaccttctaataccatcacattggtggttaggtttcaacatacaaatttcagagtgacgaaaacatttaggccatggcaattacttttgtaattttaggctgggaagggatgggatgaagagagattggctaatgaatacaaaaatacacttggagtaataaattctagtgctcagtagcatagtaggatgactattgttaaaaaattttttttgtgtatttcaaaatagctaaaagggaggatttgaaatattcccaataaaagaaatgataaatgcttgaaatcacaggtattccaaataccctgatttcatcattacacattgtatttatgtgtcaaaatataatatattccattaatatatataattattatgtatcagtagataattgtaaaaacaggagccttttaaggttttgatcaaataatgtcaaggatgtacattaacaaaataaatctggtaatggattgcaagccagcagagtgcactggtctttaaacttttattgttgacatatttcttaatcttgaaaaacctaggtgtctcctcaaagattttttaaatttgtaaatttgtgaattttaagtctttgtagacaatatacattcaggaaattattgaattattgttttcaaagacaaaattatggtcctcttttagattaatgaaatgtaaatgctgtagcaacttttattcatctctcttaaaatgtataaactctcaactgtaatcccagcactttgtaaggtcgaggcaaaaggattgcttgagcccaggagttggagaccagcctgggtaacctggtgaaaccctgtctctattaaaaaaaaaaaaaaaaaaaaaattagccaaggtggtgagcatctatagtccaagctacgcaggaggctgagctgggaggattgactgagcctgggagattgaggctgcagtgagccatgatcccaccactgtcgctagcctgggtgatagagtgagatcgtctccaaactctcctttctgaaattttacttagctaaattttttcctaattcctcctcagtatttccacttgattcccccacagaatgtaattgtaatgtatttattagtatctttgaacatcttttattatttgcctatcatacttctctacaacaaaatatatgtaagttaataaaatatttcctgtgtacatgatattgtcttaaatttcttctatatttagttattacattacatttattattaggacatggcaattgaaggagcataaatatactttgttttgccaaactagtatgaaacatttaaaaatgaaattttactgaatatatgcattagtgagaaggatggtccttattaatatagttgtaggtgaatattaagctagaatggtagtgttcattaattctctcttcctattttctatttttatatatgtgaattctaaaaaaccttatttacataatgtttttagtgcacatggaagtttttgataactttttaaattgaatttcttctgaattataagtcaaaaattaccctattatctattgctgtattagttcattttgcggtgttataagggaatacctgatgctgggtataaaaaaagaggtttatttgttgaggactcaggagccttttactcatggcagaaggccatgagagaacagctgtgtcacatggcgagaaagggaggtgggaggtgcaacacttttttttttttttttttttttttttttttaacaacagctcttgcatgaactcaaagagtgagaactcactcattcctgtgtggtaggtaccaggctcttcagggatacaccctgatgactcgaacacctctcactagacctcacctccaacattggggagcacatttcaccattagatgtggtgaaatgggattacagatgtgagccattgtacccggcccagtttacaatattttattacagcagcctaaacagactaagacaacagttcttttattggacaaatacccaaaccatatcagtcaccaaaaactatttttaatattctctgaggtcatagtctgtgtaggttcttctttctgtgaagtatatgagtaggttctttctgtgaaaggcttataaaaataagccctttgccaggtgcagtggctcacatctgtaatcccagcactttgggaggctgaggctggcgaatcacaaggtcaggaggccgagaccagcctggccaacatcgtgaaaccccatctctactaaaaatacaaaaaattaactgggtgcggtggctcacgcctgtaatcccagcactttgggaggccgaggctggcagatggatcacgaagtcgggagatcgagaccatcctggctaacacagtgaaaccccgtctctactaaaaaatacaaaaaattaagaccgggtgttgtggtgggcgcctgtagtcccaactaattgggagtctgaggcaggagaatggcatgaacccgggaggtggagcttggggtgagccgagatggcgccactgcactccagcctgggcgacagagcaagactctgtctcaaacaaacaaaaccacaaaaaattagctgggtgtagtggcaggtgcctgtaatcccagctacttgggaggctgaggcaggagaatcgctcgaacctgggcagcggtggttgcagtgagccgagattgtgccactgcattccatcccaggtgacagagtgagattctgtctccaaaaaaaaaaaaaaaatctcctaaccactttccatatttcctagctaaacttaacgtttctttgctaagaactatgaattacacattctttaacaatagatgaaagaggtgaggtcattatggaaaaacatttcaaaaatttctgtttttggtacgtctttcaagagtttccctgaccacccccaggtttgttgattcactaactcacaggactcagcatatagttatactcatggctaagatttattacagcaaaatgatacaaagcaaaatcatgaaaagaaaaaggtgtcaaggcgaagtctggaggaagccagttgcaacttaaccaagggttgtcttccattggagttccacaagatgtgttcagtgagcatgacaacgcatgtgatgtattgtataccaagaacgttctcttgagcctaggagtccttggttttatcacagggtggctcatgtgggcacatagtgactggataactcaccatagttgccccaactccagactcctgaaaggaaaacaggtctttagcataaacccgttaggcacagtgagccactgttttcacttagagagttttgtatcaatgtagggagctgtttacttaccagtgacgtttgcagactgtaggcaaaggtcagcctttctgtgggtatcaagagtctcagtcttactgtgctatctcttttctgcacagtactccaggaggttttatactgcagaccaatgtaccatagtactatttgggatgtgtgagggtgataacttggtaaaatagcaaaggaccaattagaaaagaataagtggaaaagataacccagcacccactttctcagacagacttaattttggaaaaagtacaacagtactacctttcaacagtataagtaaactgttgattttgccactgttattgttgctattatttattagtagagtgaagtaaggggaaagttaatgcagaagcgccagtcagacttgtcaagggaataatgaggccttaacaaaaactttacatcacttaatggaatagaaaataacaacattgtacgtgaagagtctaagaatgagcttattaggtatcaaaaaggagagaagagtaaaagttgatcgccgccttcgttttctcttaagagaaatgaacacggaggactttcagatgatggtatatcatgctgctatacgtttttgagtagcttaattgtagcctgtcatcctgtgtatatgttaactatatttggaatgtaattaatatctcagtttagataacatgtttccttttactccccaggaatttttgagagatatcttcaatctcctgtttttgttgccaagtctaaaggaccgacaacagccaaagtgcaaatcacattcttcaagagctgccgcttacgatttgttagtagagatggtaaaggggtctgttgagaactacaggctaatacacaactgggttatggcacaacacatgcagtgtaagcattcttcttttcctttaatctttatagattttgaattcagaaataagattttgagggcactgtttaacaaaagaatctgctcttcacacactttaacattataaatgattattggtagggtgttattaaagttaaaaagtaaacattgatgtgaaggacctttttatatgcattttaaatacttcggctttttctgtaaaagtaatttggggccaagtaaaatcaagttttaaaagtcttgaatttttagagaataaattagttttcatctgtatttttttttatttaaaaaattctatataatgttctatatatattaatgaggtaactaatggaggtagaggctgttaatgtaagcaaaatacattgtgtttcatagtttgtttgggggggatcttttcctccctctttcttcagcagcccatgcaccttataaatgggattactggcctcatgaagatgtccgtgctgaatgtagatttgttggccttactaaccttggagctacttgttacttagcttctactattcagcaactttatatgatacctgaggcaagacaggctgtcttcactgccaaggtagaattttcctcactttaaaaatcaaaattataaaccagattttaatattttgttgataaatttttatttcaatgtagtaaatgtttgaaaaaataatttgtgaataaaagtaaatttgattacagtaactagctaatgtgtattttacatagttatacattttagtagattactcataatgctgtagtacagtttagttctcaaaggaaaacacagctatggaatatgcatgctcagtgtatacaatgaatatcatgttgtcagtaaaaacgcattcactgggagaacatatgagaataaaaaacaaaaataaataaatacatatttttattacagagaaaataaggaaaccctgaatccaagtagagaagtattaccagaatcacttagcttgtttcttttatatttatcccaaagtgaatcaaattgtggacctaatttgtttgtgtaagctctgcttcatgttatttttattcactttctagttttcattcttttttaccgtgggctatttttgttttttaaaataataaatagagatgaggtctctctgtgttgaccaggctggtctccaactcctggcctcaagcaatcctcccatttcagcttcccaaagtcctgggattacaggtgtgagccaccatgcccggccaactatgggctattttttagtttgccttttgtactgcttttagagttttttgatgaatttcctttatacttgctcttggattttttatttttatttttttgaggcaggactcagtgtctgtcaccctgactggagtgcagtggtgtgagcacagctcactgcagtgttgacctcctgggctcaagtgatcctcccacctcagcctcctgagtaactgggactgcaggcatatgccaccatgcctggcggagttttttacttttactttttgtagagacagggtctcactgtgttgcccaggctggtctcaaatcctgggcttacaagatgcttctaccttggccttccaaagtactgggattattggtataaagctaccaagcctggcctcatcatgttatcttttgtcttgatttctttttccctgttaagtattgcagtgctttatatactttcactgaattatttattatgtttaagttactctttaaagtctccagttcatagtttacccaagtggttctgggttttttggctttagttattgatactttaaaatttatctctgtacattatgactaaaagtagttgaatgattagttcatttagcttatggaaatatttctgaataaatttggtatacccatctgcgtagtcttataaaagcagttatcaaagaagcatgttttcagtggttttctttttagctggcaacttggtcatgcttcttggttttacttcttcatattgataaccacctttaaagctattaacacttctaggaattagtagaaacagaaggaacactcagatgtgctgattatgagtagatctcataaacggtatttttagttaaaaactaaatttacaagcagaaacaaccccattagaaagtggacaaagcagcttggccagtatggtgaaaccctatctctaccagatatacaaaaattagctgcgtgtggggtgtggtggctcacgcctgtaatcccagcactttgggaggcagaggtcggtggatcacgaggttaggagatcaagaccatgctggccaacatggtgaaaccccatctctactaaaaatacaaaaaaaatagctgggtatggtggtgggtacctctaatcccagctatttgggaggctgaggcaggagaatcccttgaacccaggaggcggaggttgcagtgagccaagatggcgccaatgcactgcagcctaggcgacagagcgagactttgtctcaaaaaaaaaaaaagcctttggccaggcgcagtagctcacgcctgtaatcccagcactttggaaggccgaggcgggcggatcacctgaggtcaggagtctgagaccagcctggccaacatagtgaagccatgtctcctctaaaaaatatgaaaattagccaggcatgatggcaggtgacttaatcccagctacttgggagtcagaggcaggagaattgtttgaacccgggaggcagaggttgcagtgagctgagatcgagccattacactcaaactttggggacaagagcgagacttctctcaaaaaaaaaaaaaaaaaaaaaaaaattccatgtgtggtggtgcgtgcctgtagtcccagctactcgggacgctgggccaggagaatcgcttgaacctgggaggcggaggttgcagtgagccgagtttgtgccactgcattccagtctgggtgacagagcaagactctatcttaaaaaaaaaagtggacaaaggacatgaacagacacttttcaaaaggagacatacatgcggccaataagcatatgaaaaaatgctcagtattactcatcattagagaaatacaaaactaaaccacagtgagataacatctcaaaccagtcagaatagctgttaataaaaagtcaaaaaataactgatgctggcgatgttgtaaagaaaagggaatgcatatacactgctgatggaaatgtaaattagttcagccattgtgagaagcagcttggcaatttctgaaagaactttaaacagaattactattcggctcagctattccattgggtatatacccaaaggaatataaatcatcctaccatgaagacacatccacaagcatgtttaccacagcagtgttcacactagcaaaaacatggaatcaacctacatgcccatcaacagtggactagataaagaaaatgtggtacatatacagcatagaacactatgcagccataaaaaaagaacaagaccatgtcttttgcaaaaacatgtatggaactggaggccattatcctaagtgaactaacatagcaacagggaaccaaataccatatgttctcacttataagtgggagctaaatattgagtacatatggacacacaggaacaatggacgttgtgtcctacctgagggtggagtgtgggaagaggaacaggattgaaaaactacctattggtactattattacctgggtgatagaacaatctatataccaaacttacgtgacacacggtttacctatataacctgcatatgtacccctgaacctaaaataagagtaaacagtaaaaaaaaaaaggagacctgtgtacatatatttctatatctatctatctatctatctatctatatatatatatatatttttttttttttttttttttttttttttgacgaagtcttgctttgttacccaagctagagtgcagtggcgcgatcttggctcactgcaacctctgcctcctgggttccggcagttctcctgcctcagcctcccgaatagctgggattacaggcacctggctaatttttgtatttttagcagagacagggtttaaccatcttggccaggctggtctcaaactcctgacctcgtgatccccccgcctcggcctcccaaagtgctgggattacagatgtaagccaccgcgcccagccaaaaattcttaacagaatttgatatgattctggcaagtactctagtcaagtgggcactttattcttaagatgaacacttcagttaattatattattcccttttctgatgctcacatgaagtttaaagaaagctacatatattctaattgtggtaaaatatatgcaacattaaattcatcattttaaccatttatacatatatacagttgatgggattaaatacattcacattattttgcagccatcaccaccattccatcttgaactttttcaccttcccaacagaaacttgttaaacacttaactctccattctccctcccaaccccccttgcaaccactattctactttccatctctatgcattcaactgtttcaggtacctcatataagtggagtcagatttgtctttttgtgactggctgtgagtggcttatttcacttaggatatcttcaagggttatccatgctgttgtatgtgtcagaagttctttcctttttaaggctgaattataatttattgtatttaccacattttatttattctttcacttatcagtggatacttgggttgctttcaccttttggctgttgtgaataatgctgttacggacatgggtgtacaaacatgtttgagttcctgcttttactacttttgggtgtatacccagaagtggaattgttggatcatatgggaattgtgtgtttagttttttgaggaatagccttaccttttccatagggcttacaccgttttgcatgcataagggtttaatttctcgacgtccttgctaacacttgacattttctgtttgttttaataatagccatcctaatggatgtgaacacaattttttaagtagtaaatacatatagatgcaggctatgtatttatttaaaaattgcgcattaagtaaaattcccttgttgttgcttgactttaataaatttaggcagctctttagccaactcatacttcattctctaataataaaaatataaatccaggtctttattcctgaacttttttgtatcctgaatcaatactttgatacgttggaaaatttcattttgtgtgacttttttcgtaatatggaatattaagcctctcatataacaggagtacactggaattattttgccaattttgttgattccctttgttcaattcctgttgagtttaatatataattttatagtaattatatgctgaacagatctctgttttagtccatatcttgacttcaatttgattataagctgctaaacagcagagccatattacttgcagtcttccataaagctggcaaaaataactaatgtatactcttagcttgtggacgcctattattccacaagactttcaaagttatgagaggtaataatttgtaataagaataatacctactttatagattcattttaatacttgagtgaggtggaatatgtgtaataagtaccttgcatgaatatggatctttcctataaggcttggtgttcaatactaaatctctaatgtgtgagtctagccagattcctgaatttgacttattgatagttgaatatttagacagttttcaaagatcctggctggtattcctcttcagtgtgaagaatatactgttccagaaagagtaaagatatgaataaatgatgatgagatgtcattggttaatatttcaaatgtatttttttaatgtgtaggtttacttgtggaagacaactttgattgcacctgaagtgtttttcattcttgcattcttggaaatcatcagcattgtaccaaataagtgttaacctagaaagtgatttttaaaattctctcttcggtttccttataagatagtaatagctgtatttatgtaacaaagcattacaatttttaatgctataattactaaagaattgaatgtgttggtgtttttcttttatatagccaaaagaatgaaaacagatacagtgtacattgcaagactttctttgctagaatgcctaatttactaccatcatgtctgtgtttttaatggtgttttctcttgattttcagtattcagaggatatgaagcacaagaccactcttctggagcttcagaaaatgtttacatatttaatggtatgtttaagaatcatggaggctaggccaggcactgtggctcatgcctgtaattatagcattttgggaggccaaggtgggtggatggcttgagttcaagagcttgagaccagcctgggcaacatggtgaaaccccatctctactaaaaaaaaaaataagccaggcatggtggtgcgtgcctgtagtcccggctgcttaggagactgaaaagggaggctcgcttgagcccaggaggcagaggttgcagcaagctgagatctcactactgcactcgagtctaggtgacagagtgagactctgtctcaaaaaaaaaagaaacatggagggaaacaaattaggtgtaccctgtgacaaaacctaaaaaagttaaatggagctcgtttgaactggctttgtcataactatgtacctttctttttcttacttttttatttatttatttatttattttgagacagagtcttgctctgttactcaggctggagtgcagtggtgtgatctcaattcactgcaacctccacctcccaggttcaagtgattctcctccctcaaccttccaagtagctgggactacaggcgcacaccaccacgcctggctaaattttgtatttttagtagagacagctttcaccatgttggccaggctggtctcgaactcctgatctcaagtgatctgcctgcctcagcctcccaaagtgttgggattacaggtgtgagccaccgtgcccggagctgtctgtcagttatctctgttatttgtcataataacttctaaaagttatctcagttgtctacattctgttaatttgtcctttgaagaatctgttgtgtctcatccttcttctgtcacaaggtcctccccttttatgcttgcagctttctagctgatttatcttagtatcccttaattacaatgcctaaaactataaaagtgatcaatcttttaaaaagatagtaaatcttacaatattattcccctgcttaaaactcttgagtgcttcttcattacgaacagaatggtattcgagctcatcaccatggcacacaccctctgggttttttccccctacccttcaacctcctatcttatccctctccatttggagcccatcaccctgctgcttcattgcttgtgggtttatttatgccattgtttcctacctgtgtcactcttctccattttcttctgatgttcatttttcaagagtcagcttggtttcaaactctaagagaccatctattccacagattaaccggagtattccaagtcaccatgcctctttgttgtttctgccttgtatatatgttacttttctcacctgttaaatcttgaggacagggattgtgtcatacttctttgtgtatttttgactatttttattttttgaggcagggtctcactctgtcacccaggctagagttcagtggcaccatctcgtctcatggcaacctcgacactgctccactgcctgggaccacaggcttgtaccaccatgcctggctatcttctttattttttgtagagacagagtctcactatgttccccaagctggtgctgaactcctgggctcaagcaatcaactcgccgtaccctcccaaagtgctgggatcacaggcatgagctatcatacctggcctttaatctccttttaacagagctgcaagtgccatttgaattgacaaatagaaaattgctggtttaaatgactattttaaaagctattaaaacaaagttcaatctctgggaaagtttattcggcctgtaaaggttgtatattttatgctttgcaatatagatgtgagtgttttttttgtttgttttgttttgatttttttggagatggagtcttgctgttgccaggctggagtgcagtggcacgatctcggctcactgcaacctctgcctcctgagtagctgggactacaggcatgcgcaaccgcacccagctagtttttgtatttttagcagagatggggttttaccatgttggtaaaggatggccaggatggtctcaatctcttgacctcataatccgcctgcttcggcctcccaaagtgctggggttacaggcttgagccactgtgcccggctgtgagtcatttgagtctcagatttcttcctagaaattccttgacttgaaaatacaaatatcctaggtaatttaagaatcttctagcaccaagaccattaaattaaaaatactatgaaaactaaacagaaagaaatagaagcaaccatttaaaactaacttagtagatttactacctgttcttttgtttttgttatatgttcattgaagaacctataattttcttatttttatctgacacttagaatgttcccctttttatttgcaggagagtgaatgcaaagcatataatcctagacctttctgtaaaacatacaccatggataagcagcctctgaatactggggaacagaaagatatgacagagttttttactgatctaattaccaaaatcgaagaaatgtctcccgaactggttagtatcagaatactgaaaagtttctttgaaatttgaacaaatttgcctgcgttttaactagtttcttattttttgtttgttttatattaaagaaaaataccgtcaaaagtttatttggaggtgtaattacaaacaatgttgtatccttggtaagtattatacctggtttttactttttggagatcttaatatattttcatttatattataatttactagtttttattaattttttatgtgtattgattaggattgtgaacatgttagtcaaactgctgaagagttttatactgtgaggtgccaagtggctgatatgaagaacatttatgtgagtaataatgcacataatttttttactttatgcttttacctatttgtgtatagcgggtttgtgttggtcatcttgatatttttaaacttttttcatgtttttatgtattttcttcttactgtactattcaaataagagttaaacatcaaccataaagctttttcttgcccaatcaaaatttaaatttttaattaacccttcaaaaaagttactaagattcatagaatatcttaatatgaggaaaaacagttttttactaaaatttaagaattcacttttaaaaaaaaaatttttttgctgagcattctgtcaaaattgtaattgccaccttttgtatatttgcatgctataaacaataatatgaaacttttaaatgtggttttatacacaggaatctcttgatgaagttactataaaagacactttggaaggtgataacatgtatacttgttctcattgtgggaagaaagtacgagctgaaaaaaggtatgctttttcaaatgtgatttttattatgttcaccgtagaagtgaaagacaaactaagggtaaactaagattaaactttggtggaaattatatgatgaaggtaaaatcagctgcatggagctcagtctcatggagcaacttttcatctagttgttcagtgaattaccatttattttgacatatactgagctgtatgaaagtggtaatcactcaacttgaaacagtatagattttggggagcagatacatggacgataagtacattgatcattttcatcattatctgtatcgagtctcagatgtctagcttttgtgacattttcttaagtaatacagtggaaccccttatcctcgggaaatgttgcaagaccccacaatagatgtctgaaacctcagattgtactgaaccctatatatactgctttttgctgtgcataacatacctatgataaagtttaaattacaaatgaagctcagtattcttgccctttggggccattattaagtcaaataagggttacttgaacagaagcattgcaatactatgacagcccatgtaataagagagctactaagtgaccaataagtgggtagtgtctgcaacacagataagctggacaaagggatgattcatatcctaagcaggatggtacaagattttatcatgatactcagaacaccacaccacttatgaattgtttatttttggaattttctgtagtagctaactagggactttttgtactagctagcctttccaaagtattttttatttagcaagcactgttgtgagaactttaatccagttaatcctcacagcatttctttgcaatagatgctgttattatccccattttacatgtgaagacatggagtcacagaataaagaaactttcccaatgctgattcctaagatacaaataagcaaatttcagggagataatcaagttgaatttgagttctcattggggcatccagctagaaaggtcctgcaggcagttggctgttacagttagagcttggtgagaggtctagaatagaggtagatttgggagttagtaactgttgagttagagtgttaaataagtgtttatactataatacattcaagctggttcccttccagtgtattgttgttatctttggatgtgtatattttggtacattgatcaaaaatattcttcctcagctttcattttcagtagaatttcttggaaaataataatttagtggtcttcaaataaaaattgccttacacatacagtgggtcccatctgtaatcccagcactttgggagttcaaggatgtgcacttgagcccaggagtttgagggcaacatagggaaacactgttgctaaaaaagttttagaaattagccagacgtggcatgcacttacagtctcagctgttcgggaggctgaatcgggaggatcacttgaggctgggaggtagcttacagtgagccatgattgtgccattgcactccagcctcggcaaaaaattgagaacctatctcaaaaaagaaaaaaaaatgctatacttgttctactaatgcgtgccaaacattatacaattttttccctttattattattctttgatgattcacatgttccccaggttggtcttgaactcttgggctcaaacaatccgcccacctcagcctccaaaaatgctgatattacaggcatgaagccactgcacctggccaaaaggctcttaagagccataaaatggcaagtttaggacagagtagttgagtaaacattttaattttatattgaaagacaaatagaaatcggattgaaaagagcatcttatgcagttagttactaagaacgaatgcagagaaatagaaatgtccttgaatgtgcaaaaaatctaggattaggccagcctgcatttttaagtagtgtattcacatggaacagtagtggaaaacaagattggtaacacgatggcatcagattattgccatccaagttttaggtttatctgtgtgattgaatctatcagaatatctgcctgagaaataatgtaattgttggaaaagacttaagagctaagccaacctaaaagtacagaggacaaagtgacagaagagagacaaggaaagaaagaaaattaggataaaatggtaacccccaaactgggaggagaatctcaagaagaaaataatcaattaatataattcacagagatgaaagacaatgacagctgaataaaagcattgggtttttccagaaggtagtttagtgatgtgttttgtcaggttataggaatagaagcaacattgtcgggacacatggaatcaagcataaatcattgatttttaaagtttggcaacaggccaggcacggtggcacatgcctgtaatcccagtactttgggaggccaaggcaggtggattgcctgaggtcaggagtttgagaccagcctggccaacatggtgaaaccctgtctctactaaaaatacaaaaattagccggttgtggtggctcacgcctgtagtcccagctacttgggagggtggggcaggagaatcacctgaacctgggaggcagaggttgcagtgagccaagaccatgcccctgcactccagcctgggtgacagagcaagactatgtctcaaaaaaaaaaaaaagcaataaaaacagcaaggaaaatagtagccagaaagagtcttggggctcaaacaaaggatttttctagatgaaagatatctgagcatgtttgaaggcagagaataaaaagtcattatacaataagatactaaaattgcttaagaggaggttttccaggtcagtatttatttgaaagggatggtattcatttttccaatttcaagaagggtagttgggcaagttgttaggtggacatagtcaaatgaaagcgtagctatgtaggcaattacacgaagaagacaaactcatctgatgagagttgggttaggataagagttagggacgtatataaaatggagtcagtcaaaagttaactgctgtagaggaatataataaatgagtcaccaaaagatcatcaagggtctgagtcaagttctttggagaatctctaattggaataaatgtattgaataaatctgtcgttcttgataactcccttcttttgactgataagattctgctgtttttctgaaatacctgtcacatctctcccaggtagtcagtcatttttgttcttactatacttttatatctctgtactaacataataatcaacagaaatgggccaattgaggaagtgaacaaagtgcttattatcctcaataggatcatatactgttctattttcagacctctggttttctcaatctattcattttacctcagtaacttatcaatcaccataataccaattttttactaatatgctactgacaaagcattctaaactaagaaaatgacagctgaataaaagcattgggtttttccagaaggtagtttagtgatgtgttttgttttgttttgtcatcttagtttagaatgctttgctgtgctctgtcacctgttctccaatctttctggatctgctcatctctcttacttattgacacaatgcatggtttcaccccatgccacaagctcattagttattcttcagaattgttaggatgaagttcacactctatcattacatacatttgactctgttatacttcatttgtcagtctcccaaataatctaaaatagtgaatttttgaactttttattccctctgcctgtaacatctttcattccttgtttccctaaattcatactttttgtatttttgactgtgttcttggtttaaataaattctcgtttgatatttatgtgcagtggaaaattattccctaaaattcatttttttgtaaatcagagtttgtatatttttgtctgtttaaattgaacttgaactagcaatatgttatggtataggatttaggtgaccagttgattttctgctgttgctgctgctgctgctgctgctgctattgttactgtagtagcagcaattgacacttaactgaatgctgtttgccaggcagtgtttcaaagatagtatcgggtaggtaatctccattttacaacccagcaattgagctcagagaggttaagtaacttatatagggtcattcatctaataagggattacagccagactttgcaattctggttcacaaaaataagtactttgattccttttatttagggaagaaaggaaaactctgaaccaaagacctccttggccctggagaatgatggaactccttttcatgcttccatagcacccttttgtatctttatcatggtgtttaccgtagtctaccataacattttatttttcttatctcgacataggaaaatcttttcagaatggaaaaagttgtgggtgtgtttgctgttttttttttttaaacaaattaaaatgtttatttaacaaccgaattgagtacggaaagatgaaacaaatgcacagtcacgtatatacagtatatcaagggggcggcctttctaacaaggatgctgtagaaagaaaaaaatgtccaaatggggaacagtcctggtttcatcaagaagcttttatggcatttgatgttaaaccttatgtaaatacagtaatctgatggatttggcaaagatttttttcatttccagtcttttaaagtagacacaaatttgcttagaataaagctgatttttaagagcacacaaaagttgaggacaaaggataggaataaattaacaaatgcagagtgatgaagagtaaaaagatactgagcagctgactcatcatccaaggtggttacctaataatcagaggatgaagaccttatactgcaaaagcaacaatagtttcgtatataaacgatacagctgagtttgtagttatatcttggcttctatttattaagaaaaattagcatagttatgtgtaatctttagtagacaacctgcattcatttaaattaaacaatattttctacaatagtgtaatataaggccacaatatttattttgaacaaactctttaaagtagtgattttaatatcagtgttattcattcttttgaaatatagttttttagctgaattaagttatagataatttttacagtactacatcaagactagtaaaattgtttgtattcagatatttatgtctaatatccagtgaaaatttactaccaagtttttacagtagattcgtttatttatttacttatttatttatttattttttttgagatggagtctcgcttgatcacccaggctagagtgcagtggcacaatcttggctcactgccagctccgcctcccgggtccacgccattctcctgcctcagcctcctgagtagctgggactacaggcgcccgccaccacgcccggctaattttttgtatttttagtagacacggggtttcactgtgttagccaggatggtctcgatctcctgacctcatgatccgcctgctccagcctcccaaagtgctgggattacaggcgtgagccaccgcacccagcctacagtagatattaatcattctgacttgcctattgatcccttaagtataattgtagatcggcctgattttagtgtctattctttgattttactaaattaggaatgcaggagttacagaacaagtacacacaagtgatgcagccatacaaggatcataacagctcttcaattaactatgtgcaagctcaaatacaatcccactaatgaacagccaggttccaattcttcatgaaaaggtgctggtggaggttgtcagccaccttttaatagacattcccaatccagtggccagtaaatgagagaacagcagagatggaagaaaaaccttcagaaattttgcagagaatatgccctctttcttcatgatgtttgtgtttctcatgctgagagtggccatgcatgtggggtgtttaatctataaacaggagagactaacagtaccttccttataggattgttgtaaaaagtatatgcgttaatgtacagcaagcccttatgagaggaactccttggggggaatattttctggttaactcaaccaatcccatgtccaatctgaggtttttctttcaaaatgctttcaacttctttccttctctcaatataaccttcctcagactgagagctgtttttcttttcttttttgagtctcgctctgttgtccaggctggagtgcagtggtgtgatcttggctccctccaacctcagcctcccgagtagttgggattacaggcttgtgcactaccgcacccagctaatttttatatttttagtggagacatggttttgccatgttggccagaatggtctcgaactcctggcctcaagcagtctgcccactttagccctccaaagtgctggtattacaggcgtgagccaccgcgcctagcctgagagctgtttttctctccaatgctatggctggctgtttcagcagctctgttagtatcttctgatgtctgagagcgaggtatcctgtcacagtgagaactcttggagatattctgtccagactcatgctgggcatctagtagtactttttccatgtcactggtagaaacagaaacaggctggaacactgcccccattcctattattgctaaagtgtaattctgccaggagccctgcagactcttcttctgcatcgtggggactctgctctgtgacatggtgctagagggtggctgccaggcatcgggctgcccttcagtggtgggccgttggaaaagggcgagcaggagtgctgctgcctagtgctcagggactgactgtatagttttaataagaatgtgatttagaatacttctatagtctcccttctctgtggtttttctttctgcagtttgttacctgcagacaggcaaggtctgaaaatattacatagaaaatttcaaaaataattcttaagttttaaattgcccactggactgagtagcatgataaaatctggcacagtccccacctgggatgtaaaccatccctttgtccagcatgtccatggtgtatacactacttgttcattagtcacttagtggcccttttggttaccttcgcagtattgtactgtttgtattcaaggaacctttattttacttaatggcaccaaagtgcaagagtagtgttcattaacagttgggctttgccaaagagaagctgtaaaatgccttaaagttctcaatatgaaaagaaaaaaatcatacgatgaggttgctaaaatctgtaaaattgtgaacagtgtattgttagaattgttctattttattaatacttgttaatctcttgctgtgcctaatttataaattaaactttatctggaatagggaaagaaaacatacgatgaggttgctaaaatctgtgaaattgtgaacagtatattgttataattgttgtattttattaatacttgttaatctcttgctgtgcctaatttctaaattcgctttgtcataggtatgttggtttaggagaaaccgtagtgtatatagagtttgatactgtcctcagtttcaggcagacacggggtgttctcagaaggtatcccctgtggataaggggaactactatacttcttaactctgagttgaaaattgaaatggatatagcataacagaaatcaaaccaactgaagtatttgtaaaaaataatctttattaatttttttcttgtctctcagggcatgttttaagaaattgcctcgcattttgagtttcaatactatgagatacacatttaatatggtcacgatgatgaaagagaaagtgaatacacacttttccttcccattacgtttggacatgacgccctatacagaagattttcttatgggaaagagtgagaggaaagaaggtgattttttcatttctttctcttgtctgtgattattgtcaatctccataacaaggtaggcataattataaagttgtcatcaactacacagttaacaaaaattgaatcttagaagggagaaggttaagacaatgtcatgcattcagtcagttaaccagtaaatatttagtatctactaggactatgttcctaggcactcttctgtatactggagacacagtggtgaacaggataagcacggttgttgctcttgtggagcttaaatctcgtggggtaagtctttttatgttgttttttgtgggggtttttttttttttttttttttggtcttctgagacagtcttattttgtctcctaggctggaatgcagtggcatgatcttggctcactccacctcccaggttcaagtagttcttgtgcctcagcctcccaagaagctgggaccataggcacgcaccaccaggcccagctaatttttgtatttttagtagagacaaggtttcgccgtgttggctaggttggtctcgaactcctgacctcaggcaatccacctgcattggcctcctcaagtgcttggattacaggtgtgagccactgtgcccggcctcttgctcgtttatccttctttaggaagggtgcagtgagttgagattgcactactgcactccagtgtgggcgacagagcgagactctgtctcaaaaaaataaaaataagttgtaggacatggaccagtagagatgacaggtgaagttaagaagtgggcattgtatgtatacattctactttttagacctattattaaaccatttgaaaaattagacaggtgcagtgacacatgcctatggtcacagctattaggaggctgagatgggaggatcacttgagcccaggagtccagggctgcagtaagctatgattatgccactgcattccagcctggatagtagagcaagactccatctatttgaaaaaaaatttttttctggaagagtagagcagaacctcctcacagctgtgcttcattatatttcttgtgatgtttccacttgtggagagagcagaatttatgccaggataaaggaatttgttaggccacaagtgatgcagtcagatcctggcactgcctccataagcatatctacactcctcagccactgtcttgacaccttgagtcatacccttctcttactgacctaattatctcttcatgttccagttcagactgtaccctcaagtcagccagatctcatcatttccttattctgtattctacttttccctttctgtgtggtagtgggaatacagatcataaatcatacatcatcttcaaacttattagaccactctacattttttttcctcagtatcttttattacctttatattttaaatctttggggataggaagtgtacctttttctttattttgtttctgtctacacaaatctcttaatacgtagtgttttttattaactgatatatatttggaagctgccagtacattggttcgttttccttttttttaaaaggaaaccatgtttaaaccacttttcttaacatgagaataaaagaagtatgctaattcctttttaggtcttaggtttgtctgctcctagtaaagattaaatagaatggagcattttatattacctatttcaaaagattagtcagattaaagaaatattttatatttatactttatattgaagttgtccataattatgtattaacacatggttgtttttctagtggtttgtttaatatgtcctttatggtagtaggctaaggatggtgaatgactagcagatagttgttttgtacctatttaacatataaactatttgtgcctatttctgtaaataaagtttattataaaagtgattctaagtaactcgtcacattgggaaaattatttttattttattaaaatgacttaaaatattgtaattgataaagtttattttaaaaagtgtttctaagtaactgttgtgaagtttggaaaattatttccattctgtgtaaatcatttcaggttttaaagaagtcagtgatcattcaaaagactcagagagctatgaatatgacttgataggagtgactgttcacacaggaacggcagatggtggacactattatagctttatcagagatatagtaaatccccatgcttataaaaacaataaatggtgagttttaaatatttcaaaacttctttaacaatttatggtagttttctgatatgttttcagtgtttagttttctaaaaacttgccacaaaagttggaaatgaggcagacaaaatttttaaatgaagataactttcaacagacagtgtaaatcagttcttaaacatacggatcttttaactcttgagaatttgaatcctttccttggagaaatgaacacagttttgcagacaactttaggagatttatagacaacatttcaactcttatcttctctattcattcaagagctgttcattgaatatcttctacagtgtagccttatatgtgccattagaagttacctgcatgctctgcttgtttcacctcctattgggaggaccacacacacttctttttatccttttatcaagttaatggttggaagtcattaaaccagtccccagtacctgttttttggtcttcagatattgttaggtagggtctggcctataggtactatatgtgtgctaggcactgttctaagtgctggggatattgatttgaagaaaatgtacaattgttaattgattttcagttagcagaataatttcattgagttatttttcactccttcacccatcaggtccatggtgccttttcctttttttatccatttgaatgtttccataagtatattttgaatctttttttgatcataaattttgaaatggtacctttgaaagttctcccaatctcttaatttttcctaatagcgttacatgttatattaaagcaaacttttttatttcttttatgaattcttttgttaatcctaggtcataaatggatctatctgattataaggtgcttaagaatatgttataaaattatatttccaatttctagtagattagaattgtaaaaataagaacttagaatttacctcatgaaataatttgacacttgtaacattggttattcaaaaaatagtagacataatatgaagatactcattatatgcatactagattaatactatatgctctattttaggtatctttttaatgatgctgaggtaaaaccttttgattctgctcaacttgcatctgaatgttttggtggagagatgacggtaagttttattcagaaattataaatggtttgtgtccttccaagtgctttgtcatatcataaaatccaatagcagagtcgcttaactttcttttaattgctatgattaaatcaaaaatttattcagtttatatttattggaagtttagtatgttctcagaaatatttttaaagtgctatttctgctttccacaacagcccgattaagaaggtaagagaaataaaaagcttagtagtatgggagttgaattacagtgccatgagaataagattgagtaaattgtttactcagtgaattctgtgggatcagagcaaagagaaattactgtttactgacttaatctgaaaaatctttgacaagggagtctctcttagcttactgtggctcaagaggctacctgattcacaataagaaaaaaagaaattaaaaaaatgtttggcaaggaagttggcttgagctaagttttaaaggattgttctttcagtgctttttataacaccagcagcaacctggataacactagatactggatagaaaaaggacatcttctatgtgacataattgagaaaagactttttttttttttttttgcccccaagtcggattcttgctgtgtcgcccagactggagtcagtggcgcgatctcggctcactgcaacctccacctcctgggttccagctattctcgagtctcagcctcgggagtagctgggattacaggtacctgccaccatccccagccaatttttgtatttttagtagaggtggagtttcaccatgttggccaggctggtctcaaacccctgaacccaagtaatccacctactgcagcctccgaagtgctgggatcacagacgtgagccatggcacctagccaacaatagatattgaaaagacatttgggttggagtattgtaataatttcacttctctataggcagtttatcctagtatcaattttctgagaactgttttaaaatattctcttgattctcacaagacaaatattagtcatttccgtttcatagattagcccaaataaagttgtttttttgacttaaccatatttgttatgaattaaccatttacagtctggattttatagttgatcttagccgaaagttgagaaatgatacacattccagattttaatgaagggcttccttattgcttctcggtgttcttgtctactctgctgaatggaaaaagaaaagcagtccacttgctaacaatttagaaatgggtagaatagggaagtaaatattgagttactgctaaagccaccactaaaccaattgcatctgtagatgttatgcctagaatgtctccttttttttttttttgagacagtctcactctgtcaccaagctggggtacagtggcgtgatcttggctcactgcagcctccaacttctggttcaagtgattctcctgcctcggcctcccgaatagctgggattacaggcacgcgccaccatgcccagctaatttttgtgttttaagtggagacggggtttcaccatgttggctaggatggtcttgatctcctgaccttgtgatcgcccaccttgggctcccaaagtgctgggattataggcatgagccaccgtactcagccgaatgtttccttttaaaaaaaaaaaaaaaaaaatgaaggaagaagaggaaggctcttctcttaaaaagtagtttttcaaattgcaggtccactttttttttcttttacatattttatggtaaagtatctttaaaaaatgttttgaggccgggcatggtggctcacgcctgtaatcccagcacgttgggaggccgaagcaggtggatcacctgaggtcaggagttcaacaccagcatggccaatgtggggaaaccccacctccactaaaaatgtaaaaattagccgggcgtggtggcgggtgcctgtagtcccagctactcaggaggctgagacaggagaatcgcttgaacccgggaggtggaggttgcagtgagccgacatcgcgccattgcactccagcctgggtaacaagagcaaaactccgtctcaaaaaaatataaaatgtacgctgggcatggtggctcaggcctgtaatctcagcactttgggaggctgaggcgggcggattgcttgaggtcaggagttcgagaccatcctggccaacatggtgaaaccccatgtctactaaaaacacgcaaaaaattagccaggtttgatagcgggcacctgtaatcccagctattcaggaggctgagacaggagaaccccttgaaccaggcggagattgcagtgagctgagatcaagccatttcactccagcctgggagatgagcaaaactccgtctcaaagaaaaaaaaatgttttgaatctttgtgttttaaaatgtctgcctctgtcccttctgatttcattgcccataatgctgcttgtctgcttcccttggctttttaaattttttctgtcacagcacacctgaagttctccagcattaccagtagaatcctcgtctccttactcattaagaaacagtctttaagttctcagaagccccaccactaaattctcgtaatatgccatatgttcacttacctctctgggatcctttgttcagcctccttttgtcctatgacctttctttcttattcaaattctagatctttactgattgcttcttattgcttcatggtcccttttctttcctttgcatcgtgtgtgtgtgtgtgtgtgtgtgtgtgtgtgtgtgtgtgtgtgtatgtattatctttggttgactcttacctttttctgactcttacctttttctgatgcttcttttgctgtctcccatcagttggattgcttaaagtgtgtactgacaaaaccatttcatctgcataaagttacttacaactttgaggttcaaaattatgtttgtgaaggattggtggaggtagatgttttgacatgtcagaataaattacagcttcgtgccaatgagatattttaataatatgctttcctcatttataatgttgctgagaaagaactatttaaattcagtttttatttccacttatttattgcatttaccaaaattaggacaaggccaactactttcttgcctcactgtcatcatttgttttcttttgttatagtaaaattttctcagtctcaactttatagtgttctctatctaaaaataataaaaataataaaaactaaaaaaaagatattaggatatattggccaaattgtgaagtacgtagaatttttatgaaggcggcggtgtttgaaaactacttacaaagttactattaagtataaaatagctgtttatgaaataatttatatataaatatagctgagtatacccattttttcaaagaagtaaaacttttgtatttttaaacagaccaagacctatgattctgttacagataaatttatggacttctcttttgaaaaggtaaccatttttttcatgtataattttatattgttttttcttctgcattgtctacttttagagtaatactttgtcaaaatgaaaataaatttttttcttgcctcttaaagacacacagtgcatatatgctgttttacaaacgcatggaaccagaggaagaaaatggcagagaatacaaatttgatgtttcgtcagagttactagaggtataagttaatttcatttgagcaacattttaaaaatatgttaagtgtttatgcaaggaatactgtagtgtaagaacaggttctacaggttgatatctgcaattctgagtagatcttaagagtatttacaaatagtcttggtaatactgatataagacccgtaaatgaaaatgaatgagattaaatggagtagaaaatatcactaaaagagagtaggcgactgggtgtggtgattcatgcctgtaatctcagcactttgggaggccgaggtgggtagatcacgaggtcaggggttcaagaccagcatggccaaatggtgaaactctgtttctcctaaaaaatacaaaaagtagccgagcgtggtggtgggcgcctgtaatcccagctgcttgggaggctgaggcagagaattgcttgaacctgggaggcggaggttgcagtgaatggagatcacaccactgcactccagcctgggtgacagagcaagactccatctcaaaaaaatttaaaaaggtggcagaaaggttgagggaatcagagtgacttaacaatttgtgaggttagtaatgttttgcttcttagattggatgatgggtttgtaagtgttccttctgttgtgtctcatgatacagacccatgccctcaagcatgcattgtaattgaaatgccattaaaatgtattttacacccaggcgcagtggctcatgcctataatcccagcactttgggaagctcagacaggtggatcacgtgaggccaggagtttgagaccaacctggccaacatggcaaaactgcagctgtactaaaaatacaaagattagctgggtgtattggtgggcacctgtaatcccagctactcaggaggcctaggcgagagaagcccttgaacctgagaggcggaggttatagtgaaccgagatcacaccactgtatttcagcctgggcaacagagcaaaactctgtctcaaaaaaaaaaaatgggctgggcgcggtggctcatgcctgtaatcccagcactttgggaggccgaggcgggcggatcacgaggtccggagattgagaccatcctgcctaacatggtaaaaccccatctctactaaaaatacaaagaattagctgggcatgttggcgggcgcctgtagtcccagctactcgggaggctgaggcaggagaatggcgtgaacctgggaggcggagccgagatcgcaccactgcactccatcctgggcaacagagtgagatactgtctcaaaaaaaaatgtattttacatattaaggaatacaaatgtgttcatttgtagttatgaggcttcatttcagaatgttgtaagtagtaatagtacattattgagtacataactgaatgtgttttggtttggtgttaggaattcagtcagccaaaaacacaaaaaagcaaatcttctccagaaatgcacacctgattaaattgtatgcatttgtctaggcaattcagcttttactatctggataaaaaaaaaattttttttttgtaatattgggatcaagtcttttttttttttttttttgagaaggagtctcgctctgtcgcccaggctggagtgcagtgacgggatctcagctcactgcaagctccaccttctgggttcatgccattctcctgcctcagcctccctagtagctgggactacaggcacccgccaccacacccagctaatgtcttttttgtatttttagtagagaggggtttcactgtgttagccaggatggtctcaatctcttgacctcctgatccgcccatctcggcctcccaaagtgctgggattacaggattgttctcaaatgcttttaactagtatcttgcctgcacatgtgttaatggtaaaaagccaggaatgttgtcttttttcaattccatgaattggatttagcagctgaattagatggtattcattataaatggcttcattagatttgaagctactaaacttacctatttgtataaaaatttatctcaatcatcatcataaccacaattaatttgaatcatttttgtgcacagccttttgccctaaagatattagacaaatctagaccttgctttatataagtacccaacagtgtttaatgacaattagcccacttgtgaagtaaaatgaaattttaaataaaacctttacaatgatgatgtattttgtttatttacatcagtggttctcaaacttctgtgtgtgtgtgtgtgtgtgtgtgtgtgtgtgtgtgtgtgtgtgtgtgtgtgacagggccctcatttaaagtgaggaagcttaatcatttctagcttttgatttaaggtgaaagatgtgtgactcctccttttactggatacagagaggccattgtagggttgttaattggcctaattccagtattgtctcagagaatatggaggcctgaggagagggagaaagtgaacagctactcggtgcagtcagaacacacacaacatgtattaagtttgccgtcttatatgggtgtagttcgtggtaccctgaaacaatcacaacagtaacatcaaaaatcatactggttatagatcaccataataatataatatataataatatataataatgatgaaaatgtttgaaatatttcaggaattaccacagtgtgacagagacagaaagtgagcacatgctattagaaaaatggtgccaatagacttgcttgattgcagggctgccacagcccttcaatttgtttaaaaatacagcatctgcaaagtgcagtaaagtgaagcacaataaaatgagatatgcctgtacattagaaaattcctcattgcagacctaagccaacaattttttctataattgttccagcttactatttttaaatgggtgtgcctacatgttttcttaaaattaaatttaaaatgtaaaatactgtgtacatgaatattaatatggttttagatataaaccagaatgtggttttttagatttgtacatttaaagcatagttattaatcccaaaggataacataaaacattttagaagcataaaagagattaagcaaactaattataaattgtaatgattcttacagataatagaaggtaacagttctcagaaagtgtagttgatagtgattgctagaaaagggtcaggaaatgcttcaggaagttaaccttaaactgaaacttgagagttagagaagaggtaatcatgtgaagaatgcttcgggccaggcaaaacattatgtacaaattgcctaggaaggacagagcttattggcatgttttggaagccaaaaagtgacctgtatggctgtgatggaagttcaaggaaaagtggcccaagatgaggatggacagttaggtagaaaatagctagggtaaggctgggcacgttgcctcacacctgtaatcccagcactttgggaggctgaggcaggtggatcacttgaggtcagcagttcgagaccagcctggccaacatgatgaaaccccctctctactaaaaatacaaaaattaactgggtatggtggcgggcacctgtaatcccagctacttgggaggctgaggcaagagaatcgcttgaacctggaggtggagattgccgtgagccgagatcgcgccattgcactccagcctgggcaacaagaacgaaacttgtctcaaaaaaaagaaaagaaaaaagaaaatagctagggtggctgggcagggtgggcaggatgagattacacctgtaatctaagcactttgggaagtaggtggattgcttgaccccaggagttcaagaccagcctgggcaacagggcaaaaccccatctctacaaaaaaaaaaatacaaaaataatagctgggcatggtggcacgcacctgtggtcccagctgctcaggaggttgaggtgggaggatcacctgagaccagggaggtcaaggctgcagtgagctgtgatcatgctgctgcactccagcccaggtaacagagtgagaccctgtctttaaaaaaaaaaaaaaaaaaaaaaaaaaaaaatccacagaaaatagctatacacatacatagatacagtataaaaaggactatcaaacagacaagtgtttgtaaaacaaaaacagagcaaaaccaaaagcacttatatgatagaaaccacagtattaccagcctttaggtccaggagatcatgttgaccagtagttaggccattatggggttgaagggacaaaaattgtgacacagaatctacaactgagcccatggctggaatccagagtttagaatggggctcccttattatttataaacagtactgaatgagatgggcagaatgctatcagactctgcctgatacagagtctgatacaggggctacagcttaatagaaagtttttgtgcctggaaatgcccaagaactctgaagccggctattcactgattagactgtgatttctggaatatcactgtagagcaggaaccctattaagttctaaattagtgtagtgggctggagaggcaaagagggatagttgaaaatcttcagtggaagattaaagataaagttgggactttaatcagctcaaaatgaaccgaccaaccaaaattccaaaataaaatcagaagtataactctacaaaaaacagctagtaatatcaatagtcagaacatctaggtaaaaatagttttatagaactgacaaaaatgtaagtcatatttaaggtattcagacagatgaagacaaaaacagcattgatcctgcagtcctaatgtcagaaataatttttcatgatttttataaacaaatcacgtctgatttaggtctgctaaccagagttaagtattgtgccaacttttaaatgtaaacctctcttttgtaaccttatcagaatgtaacatgacttatatttcattcaattatatacttgctcttcaaataggatttcagaattcttgcagcatttttataaatacaataaaaacctcacaattgcttgaggtagccagataagtattaataattacaaaatattagtagcaaccatttatatgaatatacttgggaaaaaatcaaaatgaacttaaagtgcatggattttattttattttgtggttttttagaagagactttttgtctaataaaaatattggtaaaatgtaatgaagtaaactgctttatcactaatgttaacatttttattttcagtggatttggcatgataacatgcagtttcttcaagacaaaaacatttttgaacatacatattttgggtaagtttggtaaatttcatagtagatattttacacattttaaaaaaatcttacgtgtgaattttaaatgattatttttaaattctagatttatgtggcaattgtgtagttgtattcccagtacattaccagatcctaaagctgtgtccttaatgacagcaaaggtaataaatatatgaactttaaataattctgtcaaaatttactactttaaaatgattgaagcttttttgctttatcttttcttacagttaagcacttcctttgtcctagagacatttattcattctaaagaaaaggtatgtgttttctactatggatttttttgtcatttatgtttttatcagatatcttttggtttttgttattgttggctcagaagttcatatgctttgactgacttttcttttctagcccacgatgcttcagtggattgaactgttgacgaaacagtttaataatagtcaggcagcttgtgaggtaaggtgataattcaacaactaatgcatagtttaagattcttttttttttccccccctctgatctaagatgctacagcagagttgttttatctgtcacagggagccaaatggaagtcattcttaaaatcatttggtagctgagaaagttataatttatatatcacatccattacactgattaaataattgattattaagtcacttaaaaattcatgttttggccaggtgtggtggctcacgcctgtaaccccagcaccttaggaagctaaggtgggtggattacgagatcaagaggtcgagcccatcctggccaacgtggtgaaacactgtctctactaaaaatacaaaaattagctgggtgtggtggcacatgcctgtagtcccagcacctcgggaggcggaggcaggagaatcgcttgaacctgggaggcagaggttgtagtgagctgagattgtgccactgcactccagcctgacgacacagtgagactccatctcaaaaaaaaaaaaaaaagaaaaaaaaattttttccccccttcatctaccagaaggaaaactatgtatagaaaattcaagagtcttccaaatatttcttaaccagctttattaaggtataaatgacaaaaattttatatattcaaggtatacaaaatgatttgatgtatgtatacattttgaaatgattaccccacattcaaattaattaacacatctatcaccatgtagttatgtgtatgtgcgagttgtgaggacacaagatctcctcccttagcaaatctcaagtaaactgtgcaaaattttttagtctttttttaaatcagttttgtctcaaaacaatacaatattataactagtgtcatgatgctgtacataagatccccagaatttatttaaaacagaaacttgggactgtgcatggtggctcacgcctgtaatcccagcactttgggaggctgaggcgggcggatcacttgcggtcaggagttcaagaccagcccggcccacatgcaaaactacatctctactaaaaataaaattaactggtcatggtggtgtgcacttgtaatcccaactactggggaggctgaggcaggagaatcacttgaacccttgaggcagagaagcagtgagctgagatcacaccactgcactccagcctgggcgacagagtgagactctgtctcaatttaacaaaataaaaataaaaaataaacctgaaactttgtactctttggccaacatcatcttcctatttcttccatccctctcttaactacttttgtatgttgttagaaaatgcttaacatcatctgtcacttcctctttccccactctccccgccaaaaaaaaattcacctatccacctgtctcagtagatcagtttatgcctggttttctctctccatcccctattttaagaggtgcatccctaaggataacccactcaaaggtaatgacagcttaatcatattgccatcttaacttctaggttagcaaccaaagagttgtaaatctccataggaaggcaagtcttacgaattaacagaagtggggaatagcagtctggtatataatagatgaattatagttaaaggttttttgcatatttagaagttcatctgattataccttatagaaatagagtaagggaatctattcctcagaaatttcaaacactaaagtgtaactttttgaaattttgtaatgagaatttggaaacatggacaaaagtagaaagggataataagctgtcacatacctgttcctcaacttcaataaataataataatctttctttcttgtttcatctatcccctattccttttttttccataatggaagaattttaaaggaaacctaaatagatcatgcatccataaacacccagtatatatttctaacataagaaaacttcaaaaacatatgcaaccacaatttcattcactcccagtaatattagaagtgacttctcatctttataacttttttttttttttttacccccagagtgggtgtcactctgtcatccaggctgttgaatgcagtggtgcacagtcatagctcactgcaacctcaaaatcctgggcttgagcaatcctgcctcagcctcctccctcagcctcccgagtagctgggaccacaggcacataccaacacactcagctaattttttttctttttttatagagacagagtctctttgttgcccagctggtctcaaactccaggcttcaagctatcctcctgcctctgcctcccagagtgctgagattacaggcatgagccattacacctggccagaagtgatttattcttgtcatctaatacccatcctatgttcagttttctccatctcaaaaaaaaattttcagttgattggtttaaatgagtggttcaaacaagttccacattttgcattcatctgtttgttaagtcttccttaatctataaaagttactttttttttctccatgccattttttgtcatttgtgctgtaggatttcccacatgctttctttgactaattgcattttcctggtggtgtttaacatgttcctctgtttccttctcttctcatggctgttcgatagatccagagtttctcaagtgctaattagatcataatttgtttttaaacagaaagaaaattaatcatgctcatatcacatattattaataggtggccgggtgacatggctcacgcctataataccagcactttaggaggctgaggcggccagatcacctgaggtcaggagttcaagaccagcctggccaacatagtgaaaccccatttctactaaaaatacaaaaatcagccagggattgtggtgcgtgcctgtaatcccagctactcgggaggagaatcacttgaacctgggaggcagaggtttcagtgagccgagatcgtgccactgcactccagcctgggcaacggagcaagatctgtctcaaaaaaaaaaaaaaaaaaggggggggggaatatatatatatatataattaataagaactaaagattctatgtcacatttatgagggctaagagaatgatattttattatgataaaggaccacagattgtcatgcacattgtgtactataatgtaaatggcattccatggagttgtgtaatgaggtaacccttattatgattttagagtttgacttttatgacaattagagaaacttttctggtaagaacttaaaagaattaaaacattgactagaaataaaattcttatgtgactgttatcccatgtaacaaatatttgttgaatgttaaagtcatgctgtatttttttttaacagtggtttttagatcgtatggctgatgacgactggtggccaatgcagatactaattaagtgccctaatcaaattgtgagacaggtaaggaaaaatatgtttgaaaaaaattatttggaaaagaagttactttcaatttaattattctcaatttgcttataagtgtgtcttaacctaatattgataatagtttgaaaagatctgcctcctatcataaaagtcattttgttgttggtttcaccaggttcttttaacatcagctctcactctaataaggtgattaaaattatgcacatttcctggatataggaagattgactgtaatttcctgttcttttattattagatcctgctctttattattagatgctttatgagttatactgattcttttaaaatccttacacattctaaccatggtagggtactatagtgacctcaaaagctaatgaaaaggctgtaacttatttctgtgattgggtctgaactgtcaaacgaaacagtttgttttctttaaattgttgggtaaaatagacaatgaaatttaaatattactttatagtcacttttcacaaaatcaaaaacttagttgacgtatgccactttccagttactattgagatatatatgcgtgtgtgtatatattacatatatatgttatatatcatatttatatatttataaatttatatagaacatacatatatatgtatatatatttttttagagggttttgctctgtcacaagcagtcctcttgcctcagcaggtaggactacacgcacacaccaccacacctggtaattttgttttgttttgtttttagacagagtcttgttctgtcaccctggctgtagtgcggtggtacttcatggctcactgcagcttccacctcctgggctcaagcaattctcccacctcagcctcctgagtagctggaactacaagcacacaccaccacacctggctaatttttgtatttttttgtagagagagtgtctctcccctgttgcctaggctggtctcaaattcctgggatcaggcagtcctcccaacttagcctcccagagttctgggattatagttgtgagccactgagcctggcctaagttacaattcttataccataaaatttacccagacctttcaaaatgtaaaatttagtggtttttagtatagtcacaaagttgtgcagccatcactactacctaattttggaacatttgccacccccaccccccaccaaaaaaaaaccctatacccattagcaatcagttcctatttcatcctgtcctctctcctcaatacctgacaactactagtctactttctatctttatagatttgcctattttgaccatttcatataaatggactcatacactattagtcttttgtgacttactgcttcgatttaacaatcttttcaggatttattcatgtcacagcatgtatccatattacattttctttttttgccaaatagtttgtcaaatgtatatagtccacattttgtgttacctgttcatcagctgaatatttgagatgtttctactttttggctgtttttagtaatgctgttaggaacttttagtacaagtttttgtttggatatactttgtcacttctttgtgtatgtttttagaactggtaaactgttttttgtttttgtgttttgttttttttttttttgagacggagtttcgctcttgtggcccaggctagagtgcagtgccgtggtcttggctcactgcaacttccgcctccagggttcaagtgattctcctgcctcagctttccaagtagctgggattacaggcgcgcaccaccgtgcccagctaattttttgtatttttagtagagacgggatttcaccattttggccaggctggtctcaaactcctcacctcaggtgatttgcccgccttggcctcccagtgtgctgttactacagccactgcaccagcggtaaactggtgttttttgtttggttggttggttggtgttgtttttgagttggagtctcactctgtcaaccaggctggagtgcaatggcgtgatcacgtctcactgcaaccgccacctcccggcttcacacagttctccctgcctcagcttccttagctgagattacaggtgcccaccaccacgcccggctaatttttgtatttttagtagaagtggggttttgccatgttggctaggctggtctcgaactcctgacctcaggtgatccaccacagcctcccaaagtgctgggattataggcttgagccactgcacccagctggtaaactgtttttttatagtgactgcagtgtttgacattcttgccagtgatatataagtgttctaatttcaccataatcttcagcagctgatactgtcttttattttagccatcctagaaggtatgaagtggtatcttattgtggttttggtatgcatttttctcaaaatggttacacatttttttcatgtgattgtgggtcacttgtgtatctttaaagaatcctcacatttccttctcctagctgctgaccccatgatgagcagcggcccttccccattccactcttcttaaggaattggatactagattttcttttctctgtatctccactagctaaaaggattttttgaagctttgtttttgatcatctgtattactgaaatgtacagtttgttgagttttttctctttatcataaaactgaatttttttaatgctacctttgcctcatttccttagtccattgttgagactccagaagagctccagaataccaagataatcttgtgcaaactataaatgggtggcagagaattttgaatcatgttaatttttcaaatctttgttacctgatgagttggctcttgtttgatctttttctttcttcacagatgtttcagcgtttgtgtatccatgtgattcagaggctgagacctgtgcatgctcatctctatttgcagccaggaatggaagatgggtaagaagtactttttgaataagtttgtgtgtctgtgttgtgtgtgtgtggtgtttttgttttttttttttgttttttttttttttttttaagagatagggtttcttcatgttgcccaggctggtctcaaactcgtaagttcaaatgatccgcccgcctcggcctcccaaattgctaggattacaggcatgaaccaccatgcttagccctaatttttaagtttcttaacaacctgcctacaaaatattttttaaaatccacactgaaatatttgttctgtttaaaaaataatctgtaataatacattcaagaaggtaaaactgtttttgttttatttaaattttgcatctgcaaaatcctctacaaattactttatggcttagtctttttgtttgcattgatttagccagtcacaataactacttaagttattgcggttcatattcattatctcaaagataaaagaaattcagagtttaaaaagtactttttctctcgaacagtatttccagacctcatacattctctaagatctatttaattgtctcttaggtcagatgatatggatacctcagtagaagatattggtggtcgttcatgtgtcactcgctttgtgagaaccctgttattaattatggaacatggtgtaaaacctcacagtaaacatcttacagagtattttgccttcctttacgaatttgcaaaaatgggtgaagaagaggtgaggctatatcttgtctatttttttgattatctaccttttttcagtatttgcaacttaattgcttttattttatatttttaaattttgtttgtttgtttgtttagagccaatttttgctttcattgcaagctatatctacaatggtacatttttacatgggaacaaaaggacctgaaaatgtaagtacagttctatcgtacattaggtattagaggctctggttttcatagtttgcatcgtgcgaagtcctgagatgttagaaccctttaaagtcccttctggaacctggtgttagataatatgaagggtctaagattggttgatgtttttaatgtaattttaatggatatagcaagaaagaaacaactaggtaatgaagttcattcattggtaaggtctggaacaaagcaaataaacttaggcaaagtggtcacctactttagggtcttatcaatagtgaattgtttttgtgaacattttgctggtcacatttttaagttctttgctattaagtttatgagagtctttccaaaatttaagtaggtggtctatgaataatattaaagtattacatcagttttgtgttgttcataacaaatgcattaggttgtatgatctacttgcactctttttcagtccttttcttaaccataagagataagtaccctttatatctccatttaacagatgagacaattgaaacttagagaagttaatttgttttagatcacagtgacttgttgtgctttgatcctcggtcagactactgagctaaaactcttaaacactgttttgtaatgcttcacagaatatacactagtagatcataaaatcttttgagtctgcatttagaagcccaagtgaatatctctttgaaatacccactatttggattatcagggaactataaataagaatttcttattttgtataactggcatttttattaaataggaaatactattttatcatacttgcaatttttatcgtgacttgtcttccaatgagcttgcttataagaaaaaagttattcaagggtttataggtaaggtaagtagtcagtgttgaggttttttgttttttttttgtttgtttgtttgtttgtttgtttttgagacagagtctcactctgtctcccaggctggagtgcagtggtgctatctcagctcactgtaacccccacctcccaggttcaggcgattttcctgcctcagcctcccgagtagcagggattacaagcgcgtgccaccacgcctggctaatttttgtatttttagtagaaacggagtttcaccatgtcggccaggctgttctcgaactcctgacctcaaatgatccacccgcctcagccttccaaaatgctgggattacgtgagccaccatgcccggcagagaattgttattctttacagttctggcagtttaatctaagattgtcctgaatgtggtttagagtgttttacattaggtttaggtctttgtgcagttgtttttcatgttacaagctcctgccaccatctacactgttacataaaacaagtcatttgttctcaaaatgatattaaaactactaccgtattaaaattgaattttattccaacttagcctcaagttgaagtgttatcagaggaagaaggggaagaagaagaggaggaagaagatatcctctctctggcagaagaaaaatacaggccagctgcccttgaaaagatgatagctttagttgctcttttggttgaacagtctcgatcagaaaggtgaaatgtttcgaatttaaaatgtttaaagcatgtttggttttattatttttacataattgtttaccactagtttttccactagctttttattatatatgtttaattatgtaattgttattcactagcttttattatataaatccttttaaataatactactattcatcaactcttgtggcataagaatttcagttttttctaccaaacttttacttcatctatgagtcgtgttagaaatagtcattgaaaaaatatacagtaaaatatctagcaaaatagagcgtgcattcgttctttaacctagcaacttcatttctaggaatctgtgtccaaaatacagaaagatgtatatgcaaatctgtttattgaaaccatgcttctgatagcaaaagactagaatcagctgaatgtccatcaaaagggaactagttgaaaaaacagcatccattcaaaagaatatagctgaaaaaggaagtatggaatttatctgtactaccacagagaaatctttaggatctattactaagtaaaaaaaggtgggaaaaagtgtatatgatatcctactttttaagggaatgctatgatgacagagagagagagtgtgtatgtgtgtgtgtgtatgtgtatgtacaaccaaacctcattatttgtggatttcctatttgcaaattcacccatttgctaaaatgcatttgtaatgccaaaagtggcactcggggagcttttgcagtcattcacagacgtgtgcatatgcagagtggcaaaaaacttgagttgcctgacatgcctttccaggtaaggtcaaacaaggcaacaatttgcctttttgtttcagtttccatattgtaaacaaatgtacttttcacggtgtatgctgtgaaaattttttgtatatttatatgttttgttcgtgattttgctgtttaaaatggccctcagccaggtgtggtggcacacgcctgtagtcccaactacttgggaggatgaggtggatggcttgaggccaggagtttgagtctgcagtatgctactttggcacctgtgaatagccattacagtccagtttgggcaatatagcaagatccatctgtaaaaataagtaaataaaatggccctcaagtgtagtgctgaagtgctctctagtgttcttaagctcaagaaggccatgatatgacttatagggaaaatacgtgttagacacatttcattcatatgagttttaatactattggcagtgagttaaacgttaatgaatcaacaatatatactaaataaggtatctttaacagaaacactcataaaacaaagtaaatgtatcgattggttgacaaaaatattaccagaggctcacagaaacttaatcgtgtatttgccctagtagtaataatttggtatttgctaattcagtatttgccacactttatagaacacaactacctcaaatacaagaattgactataaatcaaaaacttttttttttaatggtttccagtggatagaggaataaaaacagggtggaggggacaggaatggatttttgacaaatttaactttggtatcatataaatgtataattataaataaatgaataagaagtaatctctaaaaatcaaaagcacagtgaagtaaatgaacctaactatatattaaataggtaaatttctagtgggatgtatatgaaggacaaaaagaattgtaaaattttcctaaactgtaatagtaattatattatttgtaataaaagtattattctgaaagtattaatgtatattacaggatgaaacaaataagtaactgttaatgtcattggaaaccaagattttcagcaaaagaaagataaaaatattaaattgtagggttttgcataacttatttaaaactaaatttgaattggaaatatctgtagcagtttatggtatatttgcaaacagaaaatctgttacagaaaatctgttacagaaaatgttttacctaccactgttttctgaaaagacctggaaaccctgtacaacccagaatcaatgagtacccttggcatctagggtatagtctctaggtttcatttcccactgaaagaattggggttccttggaaaaacgactagttacagttcttgggaaagaaatgaatgagaagtttggaatgtcttgtcattttggaaagcaaggaggcagtctaagactactgaggtcatggtaaagaaactcaagagccaacttacggaggtttctactggtcatagattgaacagctttgagcatcggtaataactgcagtggactgtgaatcacatcaaagatgtttaaatccatgagttcataatacctaaaaagaaatttttttttagtttacttgcaacttttggagtatattaggaaatcaaatcattatttttgaaactgataaataatggaaaacagtatcaagcatttattctacttgcaagtatacttcgtggcaaccaaatggtgattgaggggaagtttgtgttcttatatgtattcaagctaattaatgagcaaggacaattggaattagaatatcactgttttggaatcccagatgaaatgatggatctaggcagttgtcaccactgacagaaaaccttacaaaaagactaacccttcattgtgtgccttctacaagatactgttaattaaaaagtcaaacctagatctcatcaagtctggatctgactaccagtttatagaaaatgcagggacagagaaacatgttaagacagcaccataaggatacaatcagcaaagtgtaaatgtgagagaaactacaggacaaatgaccttcaacagataaattgcaaacacaaagctggtggggaaaccaatagattaaaatatttaagagacttttcaactaattatggcaaaaggctttatttgaatcctgattcaaacaagttaattttaaaaatctttttagaaacttcaggaaatgtgtacgctggatattgtatgacagtgcggaattattcatttaggcatgaataatggtaccgtggttgtttttgaaacctatctgttaaagatactatgatttatggattaaatgataaaatgcctggaatttgcttcagaataattcatattgagtggatgggggttcaaatgaaacaagactggctctgattttggtaaatttgaagctgactgatggaatacttgtactattctgttttttaatatagctgaaatttttataagttataaaagaaatatgcaatctaggtgtagtggcttgtgcctgaatcctggttacatagaaggatcccctgagcctagtaattcaaggctgcagtgagctgcgatcacatcactgcattcccgcctgggcaacagaagtagactccatctctaaaaagaaggaaagaaaaaaaggaagaaatatacagtaattttaaactgggagatgaaatgctaatttctagaagtccatttggttttgaagggtctcatgtcaaaaaaaaaaaaaagtaagtaaaataagacccatcctactgttttatatactaaaatagtaagttaattaaatgaaaatgaagtacatttgggctttcatttaccaatcctggaatgttgaaaagttgcccaaaagacatttagcaagcaaatgtagctagcaaaaaatcattttatgatggcaggttaatacaattataattgaatcaacaatttttgatacatgttgtaaatcgctgtaaagtaatacagaaggaagaaaaacttatttccactaatattttctttcaggcatttgacattatcacagactgacatggcagcattaacaggaggaaaggtagtacattctctaatattagacaatttgatcatcacaaaaataataacggttcttaaatgaacaacttttgcttttgacagggatttcccttcttgtttcaacatattcgtgatggcatcaatataagacaaacttgtaatctgattttcagcctgtgtcgatacaataatcgacttgcagaacatgtaagtgctaaggaacagtcttaaagatttttggaaattttaaaaaagaataccctgaaatctggccgagtgcggtggctcatgcctgtaatcccagcactttgggaggccaaggcgggaggatcgcttgagcctaggagtttgagaccagcctaggcaacatagtgagaacccgtctctacacaaaatagaaaaatctagccgggtgtagtggcacatgcctgtagtcccagccactcggaggctgaggcaggaggatcgcttgagcctgagaagtggaggctgcagtgagctgtgatctcgccactgcatcccagcctgggtgacatagcgaaaccctgtctcaaaaacaaaacaaaacaagaatatcctgaaatcctcctctttctgttttagattgtatctatgcttttcacatcaatagcaaagttgactcctgaggtatgtaaacatttgttaatttatgtttttaaaacaattttcagcactgctaatgctttcaaatgagcctaattgttctcgagaacaaatttatcagggtttctcccataacataataacctatttttaagtgtataatgtgaataaaatgaactactaatcatgtcttattacgaatataattttcccaactaaatgtaaatatgtgtatagactcattgtatcagagtgccacctggatgccaggctttaaagttgtttgattgggaacatatatcctaattgtgcccaaagaaaaagtagagcaaccaggactcagcatgtgtgtaaaagtatatagaaaatagaatgcagtgttatataaaagtatttttgtaaaatggaaatgctatagctattttaacaatcgatgtcaaacattactataaattacccctcaggttgctataggaagcttttaatctaaatttttcaatagaacacagttgtctcattaacaatttatttttggggttggggacatgttgcttaaaggatacaaatcttcatgaataagttccagagatctgttgtgcaatgtagcgactacagttaattatacttgaaaatcattgagtagattttaagtgttctgacaaaaaataagtgtgtgaggtaatgcatatgtgattagcttgatttcgccattctacaatgtatacatatttcaaaacgttgtacatcgtaagtatttacagtgtttgtcaatttagagaatatttttataattatcttttccaaaatactcttgacatccagaaaaatctatcatacgtggttcccggttgactttgtacccctcgctgatcctgctgctttatggtagttcaggttcacatgcagaagtactggctgagctctccttccctaacacagatttaaatatagtgtgtagtagaatatatgtttcttctctgctgaaggagatgggttcagattgatctaaatacacagtcatgtatgtgttttacaggcagccaatcctttctttaagttgttgactatgctaatggagtttgctggtggacctccaggaatgcctccctttgcatcttatattctgcagaggatatgggaggtaagtcttgcagcaggtgttttcaatgtttattttcctgaggattttatttttataatatagtcactaccattttaagtaccagtttcttattaccccaagatggttttagtaagtcacaggtttggggaggaaaagagttcctagctagtctcctagttgtattaaagacattcttgtagcatcataaacagctttagccaatttgaagttttcattcccctaccctccaaagttccataaagcaactagaagtcctagaaatacaaaccaagtgttttcaagaattgacagaaatggtagaggaagcaccagccacctttttgcttccagagttactgctgaggtcacaaaatttctccttgtttgagtattggaaaagctcaagaccaggggacagcaaatcttctcccaaaagggtcagagagcaaatattttagactttgtgtggcatacagtgtctgttgaaactactcaactttgctgtggtagcatatgagcaatcatggacaagaaatgagtgggttatgggtgtgtttcaataaaacaacaaaaacgggcagccacagaatttgacctgctggccatagtttgccaacccccactctagattcctaggattcccctttctcatgaagaaactctccacagcagtacagcgagcttcttgtattctcacttagtaccaggttgggcatgtaatcagaaaagtaaagatgagaaaccttagagaaataaaaatacttttaaataaatttccaaatttagcaagacctagaagttatggagttctcatatttgtcttatggtacttggttattttaaattcattttgtaaaccagtgacatatttttctgaacacttcctgttgataaaagtaaaagtagctttaaaaatgggaaaaaaatagggtgaaacctttttaatctctaattgtcaaaaaagtactttagctttgtgtctaatagcatatacaaaaagtaagtaaaagtaattgctcattcagttggccttatattctgttcttgtcatgttatttgtaggtgattgaatacaatccttctcagtgtctagattggttggcagtgcagacaccccgaaataaactggcacacagctgggtcttacagaatatggaaaactgggtcgagcggtttcttttggctcacaattatcctagagtgaggacttgtaagtcaaatatttagaatttcataaaccatttatttattgttcaaagttatgtttcattttgtttttaggcaactacgacatgcccattgttgtatactacgaaattcttggagatgttatttcctttttttttttttttttttttttttttttttaggataggaaaccatgttatttcttgggtaacatcatcactactatcatttttgtttccttgcttgataagagtgataaggcatgatcagcagtaatgaagggaataaaaaggtttgaaaatcctgtcttaaaagtaacttttgagaaggttaaggataaaatggtaataaagacataagctgagagaaaatattggctgaaattatgagttatataaacactttaagttgtacacaagccagtaaaaaagatcttagacaggtagacacatatcaaaaatatttcacaaaatagaaagttgcttggaaataaacatagaaaatgttattttgatagttcaaaaaaatgaaaatttaatttttaaatttcttattataaacattttctatctatttgctgagaaggccctacagtcattgatacttaagtagcaataaacatgtctggtatccagatgttgaattttttttttttttttttgagacagagtctcactctgttgctcaggctggagtgcagtggtgcagtctcagcacactgcaacctctgcctgttgaattcaactgattctttcacctcagcctcctgagtagctcagataacaggtgcacgccaccacactcagctaatttttgtatttttagtagagacagggttttaccgtgttgaccaggctggtcttgatctcctgacctcaagtgatccgcccacctctgcctcccaaagtgttgggattacaggtgtgagccaccgcacctggcccagatgttggattcagaacaccattctccagtaaaagaattcatggctcctaggagaaatcactgattttagggctgggacagggaatatacaagatgtgtgtggaatatcctatagtgtcagaaagtgaaagtactcaaaaatcaaaatggtgggtgtatgtcagagaaacacagagctaacctgaaagaactcccaatggccaaagccagaacagtttgagtaacaaaataacatagcactggattataaccccaaggataaaataaatattcatgagtccatacttagtagaaataaatgattgaataaataaatggagagtaaacaaatctcccatacaaaagaattccatataatatatgtacacatctccccaggaggtggagcttaattcctcactcattgagtatgagcttagtgactttcttccaaggaatggggtgtggaggaagtaactttacagtgaagaaactttacagtacaactcagccgggtgataaaggttaattaacatcattggtaatcaatgaggttgatagtgtgtacccttgatatggcgtgatggcaaagggcacttcatctcttgtggtcttccttccaaaaacctataacctgaatctaaccatgacacacatcagacaaactcagattgagggacattctatgaaatacccgaccagtattccttgaaactgtaaaggtcattagaaacaaggaaaatctaagaaactgtcacagccaagaggaagttaagaagacataatgactagctgtaatgtatactagatgggatcctggaaggaaaaaaaaggacattagggcaaaacaagtgaaatctaaagtggagagtttggttagtagtaatgtacctgtgttgcttccttagtcacaacaaatgtaccatcataatagtgttaactgtgggggaaactaggtgagggaggtgtattgaaattgttctgcttattctaaaataaaaggtttatttgtgagaagcacctttcagtggcgtgaacacatggattggcatgggcactctgcccatgggcctttttttttttttttttttcctggaagtttagttaaccccaccataataggatctttgtaagagcacacagccaagagctatgtgagagctgtgcgctcttaacaaagagatgtgtgccagttggcattcatgtcttgacccctgaccgtaaaaccaacaaaaaaaaaaaactatgctgaacccccaaaaaggtttttcagccagctattatgcctaatactgatgacagtgctgaggaaatggcattcttgtacattgcagtggcattgtttaatattattcttatgaaaggcagtttaacagatctttaccaagattcttaaaaattatatatccttttatttatttatttttattttcttatttatttattttctttcgagatggagtcttgctctgtggcccaggctggagtgtagtggcgtgatctcggctcactgcaacctccgcctcccgggttcaagcagttctcctgtctcagcctcctgagtagctgggattacaggcacccaccaccatgcctggctaatttttttgtatttttagtagagacggggtttcaccgtattggtcaggctggtctcaaactcctgacctcgtgatccacccacctcggcctcccaaagtgctggattataggcgtgagccactgtgccctgctggtttgcccttttaatgtcagtaatactgttttagcgattctagtgtaagtatatggatgcccaacagcatgatttttagtagtgaaaaattttaaactcttcagttgggaaacattgttataatgcatcatgttaaaattacagtagtgaagactatgtagtaatatgaaaaagtgcttttgctgtaacttgataagagtccaaatatttgaatagaattagtataacttagaataagaattaaaataacatgtataaaagaaaagcttcataggaatactcctaaatacaacaaaataaatgagaacttttaatatagagaaaagaaaaattgagacattagtgtcttagagttgccatatagacatggaagtagacttaatgttttttgtagcatacaactagatccaggactcttaagttataggaaggcagttaaccaaatggcaagatggcctgttcttccaaattaaccttcctgtctgttcttaaagaaaaacataatttaaaagtcgtgtttttttctgaagcagaacttcctttttatttaaaagcaagtagcttttataggaaaagaagaggtggttaggtatgtgataaagcaaagtgaaatgttaattgtagaatctcggtggtaggtctgtggtcttagtagagcttttccaaccttatgtgtccaaaaaaataactcaaagaaatgttgaggtgaaagtatataactcacaccaaatgactttttttttttttttctttttgagatggagtcttgccccatcgcccaggctgggatgtagtgctgcaatctcagctcactgcagcctccacctccagagttaaagtgattcttgtgcctcagcctcctgagtagctgggattacaggcacccgccaccacacccagctaatttttgtattcttagtagagatgggtttcaccatgttggccaggctggtcttgaactcctgacctcagatgatctgcccgccttggcctctcaaagtgctgggattacaggcatgagtcaccgtacccagccaaatggtttttttgttttttgttttttgttgttttttgagatggagtctcactcagtcacccaggctggagtgcagtggcgcaatctcggcttactgcaagctctgcctcccgggttcacaccattctcctgcctcagcctcccgagtagctgggactacaggcgctcaccaccacgcctggctaattttttgtatttttagtagagatggggtttcaccatattagccaggatgatctcgagctcctgacctcgtgatccgcccgccttggcctcccaaaatgctgggattacaggcatgagccaccgcacccagccgccaaatggcttttttaaatcgtaaattacttttcttgattgaagttttatgcaaaaattgatcaggatgatacctacatgccaggtttttatatttgaaacacataacaaactgagccttaaaaattctgactaagcagactagtatataggtaaagaaatatctagaaaatggagtattgtgcacaaagtttaatttggaaataaatttgtaaaataaactaaaattaattttagaaaccctaactttgtttgctttgacaatacaatggaaattatcaagttatagttagaatagggggagacaaataatggttgtcctgaaaagaacccaaactcagacattagagagtcttgaggaggttccatagtgaatgttaggagcattattagcctgtgaatctgattggctggatttgaatcccagctctggccactagctgtgtaagctgagatagtcccattgttgtaagcctgagtgaaagtggggataataaatgcaatgcctgccacataaagttatgacgtcaaatagtatacatttggtaaaggctcacaattcttattatagttattactattattgttttaccattatcattatcatcatcattgtttctcaaggcaaaatctagcctccacctctttatctgtgtgaccttggtctttgcttctccaagattcagattttccagagcactgttacctccatccagggtcattgtgaggattaaatgagaagtttatacagcacctaggtcaatgctttgttgatagtaactgcttttacaggttagcgcaactaataagtcactaactcctcagcattataacataggcttaataagtttaacaccaagttctttccttgggtgtaagtttagccttaaaagacttctaaagattttccaaagttaatgttctgtaattagcatatatgtaatcaaataggacttttatgtatatctcattctttctttataacttaaatatatattatctggttacaatttaacacccagttctttcctttggtgtaaggttagccttagaagacttttaaagattttccaaagttaatgttctataattagcatatatgtaatcttatatattgaacttttatgtatatctatttctttctttataacaagtatattttaccatatctgtatgttattacaaagtaaattatcattatttttcaattaagaagaaaactaagactgtagaacattgaatgatttgacctcctcaggtaccttttggtaggtcttctgactgcaaatgctgggttccctctgttaaatcatactacttcctgagaagaaataaaagataaagtgggaaaattctgcatcttaggcaagctaaagaaaagtggtttaaaaattattgccacttcaaaaataacaatggcagaatagaaggtatctatttttatcacctcttgggatctttttgtggggccaaggggaaagcagaaagatactaaaagagatgttcatgtccctttttattcattttaattattaaagggaacagtggctttgtgattaatgactgctgttcagtctattttatatcttacaaggatctgacagttttgttttacattttatagctgcagcttatcttctggtgtcccttataccaagcaattcattccgtcagatgttccggtcaacaaggtctttgcacatcccaacccgtgaccttccactcagtccagacacaacagtagtcctacatcaggtctacaacgtgctccttggtttgctctcaagagccaaactttatgttgatgctgctgttcatggcactacaaagctagtgccctattttagctttatgacttactgtttaatttccaaaactgagaagctgatgttttccacatatttcatggatttgtggaaccttttccagcctaaactttctgagccagcaatagctacaaatcacaataaacaggctttgctttcattttggtacaatgtctgtgctgactgtccagagaatatccgccttattgttcagaacccagtggtaaccaagaacattgccttcaattacatccttgctgaccatgatgatcaggatgtggtgctttttaaccgtgggatgctgccagcgtactatggcattctgaggctctgctgtgagcagtctcctgcattcacacgacaactggcttctcaccagaacatccagtgggcctttaagaatcttacaccacatgccagccaataccctggagtgagtaaaattgatactcttttatctgtatcctcaaatagattggaaatacctgtttttcccctggtgggaagtggtggcagaatatagaatagtctcaccattctttcttaagaacttaatgtgtatttgttttcttaaatacatatataaaatgctgtgttgttataaaattgataactgtgtagataacttttcttagggtgaagttaaagttgcatatccagtaaaacttacctgttttttaatttgtggttttgtaaatgtattcttcatgtgtgcctaatgaaaaaagccagcttcatggtacagttttaaggaattgagtactttgctatttaaaaatcagatacttagcaaaatctacatgctgtggtaaactgtgagctagacaattttatatctaaaactagtagtattccgcagtattttttctcaagctgcatccaaacaaatgaaatgcttaagagatcaatcgagatacatatatatgcagtctaaattgggtcccttttactctgcacacttacttgtaggttttatattaagtttcctcccctcgatgtaaagctgtcaaacctggttaataacttttcactgttgcctcttattctctgttgtaaactgtactttaaagacagaccgtcctttatagacggtctttttttttctagatggtgtaatgagttgtatagaatctcacacctgggaagaataacctaatttctagtcagagaaaattagaatcccaggccggcatagtggctcacacctgtaatttcagcactttggaggcagaggcggatcactcgagcccagcagttcaagaccagcctgggcaacatggcaaaactccatctctacaaaaaatacaaaattagctgggagtagtggtgtgcacctatagtcgcagctgcttgggaggctgaggtgggaggatcgcttgagcccaggaggttgaggctgcattgagacattgtactgcaccctgggcaacaaagcaagactctgtctcaaaagaaaaaatcagaatccctacaatgcaggaaagagagtgagtgtacaagtaccaagaaattgaaaaccaatgccataagaatacaaaatatcaatctttctgacttcaaaggggtcgggataggatttattaagtttcagtaaatttgtctctatcatattcacataaataatatttgatctagttactagatgtgatgtccagaattaaatatactttgacaagtactagatgagttagaatttatccctccatgttatttattgcccttgacatcagtgaaatgtaatgtcttttattgtagaatgtccttatctattagaaattttcatgaaaatggtacttaagtcagttttttgctttgaaaaataagaagctgggggtttcagttcattgacaagtatgtgttagaagagcagtcctctcctgacatgtgcatatgagtctataaaatcacagctagtgattttactaaaatatttgtttttactttttattcatcaggaaattgaactgagcatcattctagaaaagcattttaaatgttggaacaaaggtttacctcatatacactattaatttaagggttatttaggcatttaaaatctttgtgacaaagtaatgatttctcattaattaaagaaaaagtggataggagatggtgtggcatgcctctgggtttacatttgaagttacaaaagtagtgctttaagcagtaataagactaaaaatgaattgtattcacttacagtttttactctttctaaacttgtattttaagatttgttgagttcttttagtgtttattattattgttattatttgtattttagtagagacagagtttcatcatgttgccctggctggtctcgaactcctgagttcaggcaatctgcccgcctctgcctcccaaagtgctaggcatcagccactgcgcccagccaaaattttttaaatagaatttgttactgattttataactttctgaatggaagtataatctagcttatttgtataattttaagagttgattaatgaacgtagaaatgagaaactgaccttctaaaatgctatagggttaaaagatcatatggcttatttggcttttttaggcagtagaagaactgtttaacctgatgcagctgtttatagctcagaggccagatatgagagaagaagaattagaagatattaaacagttcaagaaaacaaccataagttgttacttacgttgcttagatggccgctcctgctggactactttaataaggtaaaaagatgtttttagttttgtcttgtttatttccagtgagatgaggaccatccttttgatgtttaaagataaatcatttacattggggaagcatttgtgcatgtagccactttggaacattttgaaggttcatgaactacttttaaacagtttttggtctggctttggtttgtatttgtgtatgttttatcattttagggttgaagggaacctttatgtatagccttctacccaaagcttgaatagtcttgtttatggcaatttatcctaactcaggcttgatagttcagttctagaggcctccaggaagttttctgcacctttggatgagtctgttaatattttgcattctgtttagcccaaatatatctatctggctttctgatctatatgacttggccaaaattataaaacatagtctttataattaattttcagagctacagaagttattgaatggttacaggaactactacaaattacccttaattccccttaacctagagaaataaagttcaggctaatttcttaaattcttctatgtattacatctaagacttggaagtgttgttttttattaggcacattttttttaatggtactttactgaagacttcactgtaatatcttaagctactcaatctaagatgaggttatttcagattgtcttctttggaaagctttcaaatgtgagtcttcattagtaaacagggaaattaactacgcctttgccggatttcttaaagggattgtttttaaattttggattaattttgaatacaattgttttcccaaagtttactacttaaagctttatttcaaaaaagatttagagcagcctgggcaacatagtaaaaccccatctctatataaataaataagttagcaaataaattagggtgtgacggcatgcacctgtagtcccagctcctcggggggctgaggtgggaagatccttgagcccaaaaggtggaagctgcagtgagccatgattgtgccattgtactccagcctgggtgacagagcgagtctcaaaaaaagaaaaaaaagatttggagctttcttaactcttcttgaaaaaggaaaggaataaagtagaaggatttccagttgtagtctataacaacatttttctggtatctaatgaaagaagacctgttaacagtaatatagctgtgtgagtaattatagtcatgtgttgcataacaacagggttacattctgagaaataaatttttagcctatttcatcattgtgcaaacatcagagtgactactcacacacaactagatagtagcgcctgctacacccctaggatatatggtatagccaactgttcctaggctctaaatctgtatagcatgttactacactgaatactgtaggcaattataacagaaaggtaagtatttgtgtatctaaacgtatttaaacatagaaaaggtacagtaaaaatatggaataaaagacagaaaatggtacacttgtgtagggcacttaccatgaatggtgcttgcaagactggaaattgccctaggtaagccagtgaatgagtggtgagggaatgtgaaggcctgggacattattgtaccctactatagactttataaacactgtacacttaagctacactaaatttattttaaaatactttttcttcattattaatgtactgaactttttttactttataagtttttttaacttcttgattcttctatcgtagcacttaaaacacactatcataacacttaaaacacacattttatagctgaacaaaagtatttatatctttataagcttttcatatttaaattttttttctttttaaatgttttcgttaaaaactaagacataaacacacacaattaggctaggcctagcagggttgggatcatcagtatctctgtctcccacctccacatcttgtcccacttgggaggtcttcagaggcagtaactagcttagagctgtcatctcctctgacaatgatgccttcttctggaatccctcctgtagggcctgtctaaggctgttttacatttaactttttttgaaataagtagtaaaataatgataatatagtaaatacataaaccagtaacatagtcatttattaacattatcaagtattaggtactgtacataattgtggtatacttacaagactggcagtacaacaagtttgtttataccagcgtcatcagagacatgtgggtaatgcattgtgaatgttaccatggctatgaagtcactaggctaataggaatttatcagctccattataatcttatgggaccaccattgtgtttgtgatccatcatttaccacaatttcattttgtggcacatgactgtattttataaactattttcaaggctgacacgtttttagtatttttttccttcatgttactcttttttaattaccagctgatgagtgtttagataatatggtgaattttatgattatccagaatttaacaatcagaagatgagcctattataaaaatcaacattgtttatgtggaaactttaaaaatattcccatatcttctgccattgtagataattagcagttgattagatattaatagacttttttttagttagagtttatttaatattatttccttatgctgcatttccaggaaacagatgaagcagtctcttttctgtaggtaggaaagcagagagcttaaatgatgattttatttctttttattttttcatcacctaagtgttgtgttcttattcagacttctcaaactgaactttatgttttcttctagtgccttcagaatactattagaatctgatgaagacagacttcttgttgtatttaatcgaggattgattctaatgacagaggtaaatattctattgcattttactgtggatattatctcattttaatgttctcaccaagacttactttatagacatttagagtttatggtaaactgttttacaggtggcaaggttttaattatatagatcagtaaacctgaatttatatcccaagaataattaggtcataatttttagggtgctgttcctttttccatagtaattccatacttttcccattattttgtatttagaacagccatttgaaatagactagttttattcatttgtagggacaaaaatgaaatacatgtgatttcattaagggcacacataatttcccaaaagcctacttatttgacagtatagaaactgaggttaccattgtgaacccggaaaatctgagacaggtctcagttaatttagaaagtttattttgccaaggttgaggacgcgcccgtgacacagcctcaggaagtcctgatggcacgtgcccaaggtggttgggacacagcttgattttatacattttagggagacatgagacatcaatctgtatgtaggaagtacattagctctgtccagaaaggcagagacaacccaaagcaaggcctctccttcctctggggccttcctggtcacaggtatgtgagagacagatggttgcgttcttttgagtttctgataagtctttccaaaggaggcaatcagaatatgcatctatctgggtgagcagagggatgactttgaatagtatgagaggccgatttgccctgagcggttcccagcttgaaggggcccaagatattttcctttcacaccatcctcagaggaaaccagaaggactattacagggttaaaatcagctgtttatgcttcctataattcttgaacatccacaagtatgagatggctgcagagtcaccagaggtacgtgagccctttagtctgataaacatgccaagagtaccataagaattcacaggtaggatgttttttcagttaatgataataaaaaataagagaacaggtttgcactttgaagaatgtggatttgcaaaggtaagggggaaaacatttagataaatgacaataagcactgaggcaaagaaatattggttatgtttgaggaaggctaagtattaaaaaaaaggtaggtgaagaggagtagtaagaatttcattctttaaaatgcaacagatgtttatgctgctttggttgtatttttagaaaaaaaaaatttttttttaatgcaacagatgtttaaatgtctacctctgtgccaagcactgtggtaggtactagggacacagcagtgaacaagacatactggtttctgtccccacagcttacaagttacatactgtacaagtacattgttcatattaggtactgctgcaggttctgggctaagaattttaacatttgaactgtgggtattacagtgtgtaagctgtagtgaactggtggaagaggattcaaagaagggtgctgtatagtaaaataggaaaaaaactaagggcttaattaagctaatacagttaaaggaattaaaagatttaacaagccaatataaaggaaatgaattcctaccttttgcagctctttttacctctttcaggcctactcttttgagtatggctgacagtcactttaccattgtctttggacagagaccctggaaagttggttaaagcagttgcctattctccctaatcttttgtgacctactgctttgtaattttgaagacttaacaatcttagagcaagtacttttttaaaaaaatgtgattaaactatttcttcagactagaatatacacacaaaatagcagagctctgaaggtgaggaatgtttaaaagagcttaatgagagtttaacttcaggatagaaagcaaatacgtttgctttgcacacatgtgcacacacagtctgagtctgaaaacatctatcgtagaggacgagtactaccattttgtggctcagtaagcaaaaatgaaattaagttttcaattttttcaaatcatttgtagtctttcaacactttgcacatgatgtatcacgaagctacagcttgccatgtgactggagatttagtagaacttctgtcaatatttctttcggttttgaagtctacacgcccttatcttcagagaaaaggtttgctcattcctacttcttatgttttgttcgtgctactagtaaagagagagaaggttttaaaatcatgtgccccagagaaattgtttttatcctagtttatgcacagaagatgaggctgaagctagctaaccatcaggaaatgtttgtcatgaactcctgatgtaaagctggaaggctcttttatgtttttgtacctgcctgaaaaatacgcaagcaggtatcaagatttcagagattggaaaacatttccaaacacagtaacaagctgggcactttgtaaagattctccagctggaaacttctttggcttagattagatcatttgcagtttcatgcgagatgactataaaacctacctgtcttatgtccctataagatactgtgaactctgaacttcttcatatacattcctagaaagtgggacatattatcaatgaaatatgttctttaagaaatctagcaggtttaacattagtagtaatcatctcatgaaaatgacttagctttcactgaagatgtttttgtaattaacctgaatttctagcattagcattctgtagtttacagtagaaaacatttgtgaggaagtttgatctcagatggcatatttatatgtgcttttatatttgcagatgtgaaacaagcattaatccagtggcaggagcgaattgaatttgcccataaactgttaactcttcttaattcctatagtcctccagaacttagaaatgcctgtataggtaagttacttgaaaaattcacccgtgtaaaaacctagtggaagaacattgttgtgagtttttccgtgatgttaagcctgtagtgtttgaaagatacttgtgctttttatgtgtaactcacactagctagcaggtcctaagaaaataaagaaaatttcttaactggctcataattacattacccacatgataatgggcagattacttaatatatacagtctccccgaccttagttcatctctagcttcctccagctctaaaatcttgttatcctatgtaagcaaggttgaaccatataaatgtttacaaggtagaactgacattctaaaggataagagtacttatttcactgtgagttcttttgcctaaagatacttctcagtagctgtccttaggctctgagtattgcatctttttattgattgcatatttataataaaatgctaatttgtggcttttaaaagacacccattataaatttatagtgatttttttttcactacattagaaacttctcgagagaccgtaactattttacactttctcaaaatagcatggataactaactggctgtcatatataagcagtccgtcttgacgttctgtgcaattacttctctagcaagaggggaagggcacacaagcagtaacctatgatcaccagaaactgcctatagcctgtcatcgtgagatttattccttcctgtgtgattggagattgagaatcagtccagccagcatcgtaaaacattaaaagtagattaaggattatccctcaaagcaaaggaactttgaaccttagttttctttctaagctgttttggttgattttatgagacacataatcaacgtacattaaataatctgggctggctcatgcctgtaatccatgcagttcgggaggtctaggcaggaggggattgctcgagaccaggaattcaaaagcagcctgggcaacatagcaagacctcatctctacaaaaacaaacaaaaaaaatagctgggtgtggtggtgcatgccggtagtttcagctacttgggagcctgaggcaggaggatcacttgcacccaggagctcaaggctgtagtgagctgattgcaccactgcactccagcctgggagaccaaaaaaaaatccctcactgtatgttgccagaaaatatctcatacttaaaacaaaataccaataaatagtgttttaatcttttgtttccaaatgatgccctattgtcgttaataactctgttgatctaaacttgattgagcataagacagaatttctactcgtgtcaggagcttagttttagactcattaaactggttgtagtgaggcaatcataggatttgtaagatggaaagtagtaggcagatataactcttaattttttgctacccaaactttgtttttattttcagatgtcctcaaggaacttgtacttttgagtccccatgattttcttcatactctggttccctttctacaacacaaccattgtacttaccatcacagtaatataccaagtacgtatttatctagcacagtacttcaatatggttcgcatttaatcgttctgcacactgaagcatggagatttattttttccatttattcttactgtacacttttaatatcttagtgtctcttggaccttatttcccttgtcgagaaaatatcaagctaataggagggaaaagcaatattcggcctccgcgccctgaactcaatatgtgcctcttgcccacaatggtggaaaccagtaaggtatgttgggatgccaggaaaatccatgttgctatagtacaaagtaatttgaaatttttcccctggcagttatgaataggttagacttaagtgaccaattttgtggatcctaagaagattagattcatttggactttttccttttagtgctctgaaatgttggttgaacatttgcaaaaatcaacaataagcacaagtagtaagttttttttccccctcaaaaattaccttaatagtaagtcttaatatttgtcactaggctaaattataactgggtcatatatctaaatttgaaaagtcattaggtactgtttttttttttttaatttggccatataatcaatgacttcttctacttcccttaaattatattcctttgacctaagcataatattgattgatagatttgtcatcatttttagtctggttcctttcttctaactcatattctaaaataatgccaattctaaattatagagacaaggtacattgatacaggataatttatcttagtttcaacttttttaaaaacaatttttccctttatctttctttacccacacttcattcacactctcccttgcttgccatcttcggattttcagtatacttgagaagttcttataagataaaatatttaaaataattaacattacaggaataacttggaatctatttcaaaagtcaaacttaattcatttttcttgatatgtctgtagagctaaagtgtcacattttaaaatcctacagtaattttactttattaaagtatatagaaataatgggtaattttaattcatagcatttgcacactgaaaataaacttacgacaattaagatcataacattactagaaatttggattttaaaactaggttcttatagaatataaatattgaatcagctttttagttaaacttattacatttgcacaaaatatgctctttattatacaatttaagtgcaaccattttatcatctttaaccttcagggcaaagatgacgtttatgatcgtatgctgctagactacttcttttcttatcatcagttcatccatctattatgccgagttgcaatcaactgtgaaaaatttactgaaacattagttaagctgagtaagtataaaagatgagcagtaaattccactgaattattttaagcccctagtcattcaggaaggggagaaaaattatgagacaatcctttttttctttttttaaagtgaatgcttaaaaatattaatattcttgggaacattttaattttcattaagaaaacaccaacttactggtttccattgaatagttctgcccagagtttcagctggcctataaaggagtgtggagtagggctgatcacttctgtacatagaagcccacatcctccaccatctgcccagcagattctgaaaacaaaaaacaaaactgctctgcttagggaggcaggcgtagaggtggactccccagccctgctcttgagggtgcgatgagatctatagtgccagctgtgctttggagctggcaatggcaagagcagtgggcttgccagtgtgaagcagaggtgcatatatgagtaattaggaggtaagtctcataaaataggtgagtgagaagaagagaaacttgaaaacggagatgatgagaaacagaaaacaaaaccatcagtgaattatgtggcggggggtctcgaatatctttagtaatattgtctctgcagtaatgtgcctaagagctgttagagaactgctccctttgggtaacattcctatagctgataagtttttcagagacatgcagctctcctccagaggtcctctatctcaggacttccagagttctaggcgtctgtgtcctccctcttgacttcattagggatgggccaggatcctctccaatgttctatagttttcagagtgggacgtgaaatacttgcggaactactacccagatcaagaaataaaatattgccataccctgcaagtccttctttgtgcccctcatcagtcgtagccctctccttcctatggaaaaggttttgatacattccaggtagggcagaagatgtgaccctaccttagaattcattatccaagaagaagaaagtggtaacagctgtcagggataattccacttcagcaaaaccatcttattggcaagtgattagagcatttttagatttgaaagctggttcctggtaacctggtattattagctggttttatatatggatggctggaatgccaagatgtagggggatgagaatatattcagattggccgtttcaggattatgcacctgggtcatggtacttggtaaaaggccaaaacccatcattggcagtaatcaggtgtaagaaaatatccaggagttctagtagtacagccttgctcccatataaagaagggtaattataaaaacactttttaaaaaatttttggtaattgtgttcatataatttatactaaaagttacgtgaggaactattctagctactcggacagctttaaccaaatattgaatgttctaccctgttttgggttgtcttgtcaacccaagtgcacactttcaggggaattaaacatggtggagaaatggaagaaaggaaagaatacttgccgtcacatcagctgaatcagcttttgtgattcagtcttatcacttttgtaaccatgaagcactatcaatgttgcctcatagggtttagttctctatattagcactattttatagaactttctataagggccggacgtggtggctcacgcttgtaatcccagcactttgggaggccaaggcgggcggatcacgaggtcaagagatcgagaccatcctggccaacatggtgaaatgtctctactaaaaataaaaaaattagctaggcatggtggtacgtgcctgtagttgcagctacttgggagactgagaggccagagaattgcttgaacctgggaggcggaggttgccgtgagccgagatcaagccactgcactccagcctggtgactaagcgagacccagtctcaaaaaaaaaaaaaaaaaaaaaaactttctatgaggatggaaatattctttgactgtaccaccatgcatagtagtcagtagcccatcatttgtgagtgttgagaacttgaaatgtgactaaggaactgaatttttactttaattttaaccaaaataaatttaaatagccaaatgtgactggtggcacagcattaaatataaatcaaaacctccacaaattgagcaagaaaaaaatttttcttggttaatacagaaaattggacattgtcttagatacaaagttcttaggtcttagacaaagacctaagaactttcctattgtttcctaaaaacaatcctatcattaatgcctcctataaatggaaagagttgtgtcccacagtttgagctgaccgaatgactgtttccaaggagaggcccaggaaagggcttgagaaaagaaagtccacattaatgaccacacagagttggtagagaattttaatttgtataatttcttcaagaaattatatttggcaacaagaaatgaaaagggtaagtttaaattggttatatctttaatcatttgaacgttgaggttacatgtccaagggccacaatattaaaatattgtgaccattggtgagaacatctcaagacctataatggattgcaagtcatttccagttatgaggaaaagtctttgtggtaatttttatatgggcaactgagcagatcttaagattggttagaggataaagagaaatatataataattacagatttgaattgcagagaacagtagagttgcagatactaaataataagcgagagggttggagtgtttttgaagtgaggatggtgaggggatggggttggaggaaacggaaagaaagggaaagagaattcaggaagggtgaacaaagctgccaactgccatctgaaaaaaactgtgtcggcaagtattttgatacttaaaaacagcagaagcctgggcaacatggggagaccccttctctacaaaaacattttttttaattagccacatgtggtgtcacacacctatggtcccagctactcaggaggctgaggtggaaggatcactttagcccaggaagtcaaagctgcagtgagctgtgatcacaccactatactccagccagggcaacagagagagaccctgtctctctgcatgcgcacacacacaggtttagcctaaaaaagctctcgaaaaagagcaatggtaagagggactggcactgctgatgtgtaaaatacttagtaaagttatggtagtttttattttattttttagaatttaatagatacttcacagttcaaaatatcagaaagataaatatcaagatatcacagaccttttctcaccatttttattttttatttgtccttttttcaaatgtagatgtttttctcccttatttcacaacagtaaactataatgattaaaaccatgtagtataggttcagaaatacataggcaaagcagtgggtaaatagcctcaacaaacataaagatacatgaggacttggtagatgataaagatgacatcccaaattggtgggaaattggtgggaaataggtggtagtgacataactggttagctgtctatggggcaaatctttaatatgtcactctttagaccaaaattaataccaggaggattaaagacttcattgggggcagggcacagtggcttgcgcctataatcccagcactttgggaggccgaggtgggtggatcacctgaggttaggagttcgagaccagcctagcctacatggcaaaaccctgtctctactgaaaatacaaaaattagctgggcgtggtggcgggcacttgaaatcccagctactcgggtggctgaggcaggagaatcgcttgagcctgggaggcggaggttgcagtgagccgagatggcgccattgcactccagtctgggtgacaagagtgaaactccgtctcaaaaaaaaaaggacttaattgtgaaaaaaatcattgaaatattaaaggaaaacataacatcacatgaataccaccatgagatttgaaagaccatgctacctaggacacaaaacccagaaacaataagaagttgaaagttttgactacataaaaattgaaaatactacatggtgaaaatgccataaactgaattaaaacacaaacagctaattgggaaaatgtttgcatacttaacagataaacagccaacactgccaatatataccaaatttttaggatttggtaagatgatgaagaacgttaagtaaaatcagcaaaggacatgaataggcagtttagacacaaaaaagtgtttggtaaccacatgagaagttgcccagacttactaataaagcaaacaatttgagacagagtgtcaccctgtcgcccaggctggagtgcagtggtgtgaccttggctcactgcatcctccacctcccgggttcaagcaattctcctgtctcagcctcccaagtagctgggactacaggtgcccaccaccacacccggctaatttttgtatttttattagagatgaggtttcaccatattaggcaggctggtctcgaactcctgacctcgtgatccgtgtgcctctgcctcccaaagtgctgggattacaggcatgaaccactgcacccagcctatttctctctcttaaaaaaaaaaaaaaaaagtctatcagatagggtgaagctcagatgatacccatatggtttggggaaagaagagatcttataatggagtactagtcaagagtccatttgggaggcaatttggcctcccaatatacagaggatatttattttcactttggttgtaatgggtaaaaactggaaacaacccaaatgtctatcagtaggagcttggttaagtaaaccatagttcacctatattgagacatgaaaacaaataagacaggcatgttcattgaattacataaaaatgtaaaaataatatgcagaatataaacattcttataaacaaggggaaaatcgctcttagtacatgtacagaaaaaagtagaggaattttactctataaggatgaaattatagaatgctttcattttctaggttaaatatatctgtaaggtttaaattaattgtaatgattatgcattggttttgtaattttaataagttattttaatattatggaaaactggtactgccggcccggcacagtggctcatacctgtaatcccagcactttgggaggctgaggcaggcagatcaccaggtcaagagatcgagaccatcctggccaacatggtgaaactttgtctctattaaaaatacaaaaatctagctgggcgtggtggcgcacgcctgtagtcccagctgcttgggaggctgaggcaggagaaccgtttgaacctgggaggtggaggttgcagtgagctgagatggagccactgcactccagcctgagcaacagagtgagactctgttccccccaccaaaatagaaggcgggcttggtgacatgcacatgtagtcccagctactcaggaggctgaggcaggaggatcacttgagcccaggagttcaaggttacaatgagctgtgattgggccactgcactacagtctgggcaacagagcaaaatcctgtctcaaaagagagaaagtaagtattaagtaaacaatagtacaggtgatggcagatgtgaagaaaatcatgaaaatgctaacaaatggactgaagttgcggaaaacattgaaaagcttatgggctttggaatcagataaatctggggtagactacagtcttaactatatcaatactgactttggaatgaatttgagaggattatataatctctgtgagcctaatttcctcatccaaaagaagcgcaaaattaggataaaacgatggctctcaaaattgatgagaaaatttaatataatgatctgacatacctagaaaatgttcatttccttctttaattgttgttgttttgagacaaagtctcactctgtcccccaggctggagtacagtggcacagtttcggctcactgcaacctctgcctccagggttcaagtgatttctcctgcctcagcctcctgagtagctgggattacatgcccaactaattcttgtattttattttttttaaatagagtgggggtttcactatgttggccaggctggtcttgaactcctaacttcaagtgatccaccaaccttggcctcccgaagtcctgggattataggcgtgagccaccacgcctggcctatttccatctttacttgtaaaatagagatacttataacagaataccacttcaaagtgattagagatcataaaaggcctctatggtatttttttgtttgtcgtggtagtgctggcttcttggtagttgtggaaaatagatatagagattgctttatatttagctggatgtgatgactcacacctgtaatcccagcactccgtaaaaccgaggcagctggatcacttgagcccaggagctcaagaccagactgggcaacacggcagaaccctgtctctacaaaaaatagaaaaatcagctgggcattggaagcacacaccagtagtcccagctactcgagaggctgaggtgggagaatcatctgagcctgggaaagtcgaggctgcagtgagccaagacgatgccactgcaacatgctttgggcaacagagtgagactgtctagaaaggaaaaaaaaaaaattgtttagggctgggtgccatggctcatgcccataatcctagcactttgggaggccaaggcaggcggatcacttgagctcacgaatgggagatcagcttgggcaacttggtgaaatctcgtctctacaaaaaatacagaaattggccgggcgcggtggctcacgcctgtaatcccagcactttgggaggtcaaggtgggtggatcacgaggtcaggagatcgagactatcctggctaacacagtgaaaccccgtctctactaaaaatacaaaaaaaaaaaaaaaattagccaggcatggtggcgggcacctgtagtcccagctacttgggatgctggggcaggagaatggcatgaacccgggaggtggaggctgcagtgagccgagatcgcgccactgcactccagcctgtgcgacaaagcgagactccgtctcaaaaaaaaaaaaaaaaaaaaaaaaaaaaatcgtgcatggtggtgcatacctgtagtcccagctactcaggagactgagctgggagaacggcttgagcccaggaggcggaggttgcagtgagctgagatcgtgccactgtcctccagcgtgggtgataagagccagaccttgtctcaaaaaaagaaaaaaaaattgaagattattttactttggggggatagtaggggagaaatgactagagaaattgtagtatacagtctgcttgcccataagagggttaatgtcagagcagcctctagttcagaggttagtgggttagcagactctttttgcaaagaggggacactatatattttagactccacaggccacaaggtctctgtaacatactgttttttgtttggctaatggtttttttgttttgtttgagacagagtctggctctgtcacccaggctggagtgcagtggcacaatctcgtctcattgcaacttctgcctcctgggttcaagtgattctcctgcctcagcctcctgagtagctgggattacaggtgcgtgccaccacgcctggctaatttttgtatttttagtagaaacggggtttcaccatgttggtcaggctggtctcgaactcctgacctcatgatctgcctgccttggcctcccaaagtgctggggttacaggcatgagccactatgcccagcctggctgattttttttttttttttttaacctttaaaaatgtaaaagccagccggatatgatggctcatgcctgtactcccagcactttcaaaggccaatgcaagaggatgaattatgccaggagtttgagaccagcctgggcaacatggcaagaccccatttctacaaaactttttgagagagtttgctctgtcacccagactggagtgcagttgcataatcttggcttactgcaacctctgccttacgggttcaagcagttctcctgcctcagcctcctgaatagctgggattacaggtgtgtgccaccacacccagccaatttttgtatttttagtagagacggggtttcattattctcctgcctcggcctcccaaagtgccgggattaccagcgtgagtcaccatacctggcccaaaactttttttttttttttttttgacagagtttcactcttgttgtccaggctggagtgcaatggcacgatctcggctcaccgcaacctccgcctgccgcgttcaagcaattctcctgcgtcagcctcccaagtagctgggattacagggatgtgccaccacgccctgctagttttgtatttttactagagacggtttctccatgttggtcaggctggttgcgaattcctgacctcaggtgatccgcccaccttggcctcccaaagtgttgggattacaggcatgagccactgcgcctggccccaaaatatttttttaagaaaattgtcccagcctgcagtcttagctactacggaggctaaggtgtaaggatcacttgagcacagcggttcaaggctgcccctgatctgtgatcacgccactgcactccaacctgggcaacagagtgaagacactgtctgtctcaaagaaaaagccattcttagctcacaagtccatataaaaacaggccatgggtcagatttggcctgagggccatagtttgctaacccttcctctactttgatgagtaattaggatacaggaacatgggaacgtaggaactctcttccctatagccacagatgtgatgacatgtccttgtttacctatgtgtgtggtgataccgtggtgggtatatgctgccaaacaccaaccagattaggttaggataaaggggaagtagcatttccttgcctcttgtgtctaaagggactcatcttgacaggaaaataaattggcttacctgtggaagggatcctaggcatccttggtaagttctgagtgagtgacctgacttgcctgtgtaggatgttctcaagtccttggtctaacccacggtttggcaaattacaacccacatgctgcctgtttttgtataaccatggctacctgctagctaagaatagttttcatatttttaaatttttttttaatatagaatattttctgacatgaaaattatgagattcccatttcagtgtttgtaaagttttactgaaagacagccacacccatttccttactcttgtctaaggctgccttcacactgcctcagcagggttgagctgtgttaacagagcatggccacaaagcctcaaacactatttggcccttcccagaacaagtttgctgactccttgtctaactcagtcttttcttaactggaagaggatggtctgtgttatatttcttcttctccatgattatacttgccctggggaccctaggggatgtggaagatgggaaattcatttaggactgtggtaatgaagcttctgtactttcagagataggatgacagaggataggggcacacatcttagtgacatattttacatctggaatagtcaagaagtggagaagtaaattcatagaggttccaaatagcactctctgacatagtgccagatgcggtccactcagaagatcctgggaacaagccaagaaactggtgttaagggccgcatttacttaaatgtaccacaaaggtcattctatctttgaagaaagaaggtaaaagaggaaagatatgtttaattctccacttttttttttttttttttttttttacctttcccctcctccctcctgcagtctagccaccctatgaaaattatctaataggcagagtggtaccttaatccaagaaagatttggagccacttgcagtaactttttcttttcccagataaagttctaatactcaaaaaagaagagttgatttaagtcccatatccttcaggaatgaggtataggatataaataaattcaaagtaccacattctaagatatttcactaaacattggaatgaatttttcccctttatgtactttaaaatatagaaaatatgcagttatgactagaaatagctgtaatattgtacctgcagagttgagtatctcactagtataatttataattataacctattctgatttcttttcaaatattaggtgtcctagttgcctatgaaggtttgccacttcatcttgcactgttccccaaactttggactgagctatgccagactcaggtaaagaaaatgagttttagatgattggtctttaatcttatctgaccaagtggtcaataattttaggaacagtgggttgaagacttgctgaaaagtggggacattttagaatcttgataggtaacatatgaatgaatgaaaatactagctattacatattaggcatctagtttccctttgatttttttaacttaagtagatttctatcatagaggatattttaaataagctggttataattgaatttctcatttatagatgtatatcaacagttgtggggaaaatccaaaacagggagatagtgggggaaaaggcacttgccacttcttcctctccttcacctccctgtctctacctcttttccaccattccaaaacctctagcagaaaccctgtcagcagtctgtcctttagcttttcataatctgtagtttttcaggggtctgatgcacttgttttcttacagcgatctccttgaaaacaggaaagattactgttcctaccttaagtgtctaagagccaactccttaaaattaagtggctgcataaataatgcttgttaagttacaaaggcagaattgggaagaggaggaggtactaatgtttggctcattccttggatcaggcataaaggatccccactacctttcagtccctgaaaaaactgttgattgtactgcctggttgcatctgctctaccccattggaagagatgaatttattcaccttccttaggtgcaacccttgacccacatcatgctttcctgaagtattttgagtctggttcagcctcctaccaggctgtagtgtgctctggattctcctagatgtttgccatcctgtactctactggtggtttctctacttttccaaaacagaactcaagtgtagagaccttatcagagtcatctccatcccctgaagaaatgccacgttgttctctacagtagaaatctttcagaggctagtatacactgatcttagctcacttgacttagcatacagtaggcattcagaaaatgacttttatcagttgatttttgagctgagtgttctgttcagtcaattggagatctcgttttccctctccactgctactgctgttctttttcattcttcctgatttgggtagtttcttggtttctgtactctcccactacctattgctccctattgctttctctacttctgcatcgcaggactcccttcgcttgacttctttcacagacagaactcactgtgcccccaaatttcccttaaaacaaagcctaaccatataaggcctccaaagcttccagtgctatagaagcagccatcctgagcaagaaacagaggcagaggcacaggctgtgactggtagaccaaggcaggtttttcctagtgttaaggatctcaagacctgggtcttggtcctacttgaatcctaatttcttgactgaccttgagtaatttacttatgacagctgcatactttaataagatatacacatatgcatatatatatatatataatctaaattttgtcctatttaaaaaatatattgcttttttccatataaattattaaaatgcacatttaaatctatggagtgtatctgcttaaagacatactacttgtgtttaagagccatgactatttgaaaacaggaaaaccaaattttagtaaaatttccatatattgagaccactgattctgtgtgagataattaggaaagaagatttattgtttacccttgcagtgtttatggggggaaaaggtatttacagaattactgttgctagcgagaatatacagtaaagtttaaaacattttggagaattgattttgattcttaaaatgtgtctttttgcaacatatgctctggttacctataaatacattaatttggcccttgaaaacattcacatcctattctttgttagccttatttttccagtccttgttaactctctcagtgctggataataaacctgcatttcttttaaaacatttgttcagtttcggcatcagtgtcttcccccagcactcccttaatctaaattagtaacattttactgtatgaaaaatagttgctgttaactaaaaattcaataggtgagttagacatggcttttcaagtaggattttcagtggcttcagattccatcatacacaagtgtatgttttttctgtgtaagttttttccgtgtaagttttttccgtgctcaaccgtaagtgctcaaccatcttctccccactttagtctgctatgtcaaaaaactgcatcaagcttttgtgtgaagatcctgttttcgcagaatatattaaatgtatcctaatggatgaaagaacttttttaaacaacaacattgtctacacgttcatgacacatttccttctaaaggtacgtagtactttggaaactcagtgtgtcatttctaattagttaatgcttgtggtttcattatgctggtcttttggagatttttttaaatcttctttttcaggttcaaagtcaagtgttttctgaagcaaactgtgccaatttgatcagcactcttattacaaacttgataagccagtatcagaacctacagtctgatttctccaaccgagttgaaatttccaaagcaagtgcttctttaaatggggtaagaactatgcagaggcggcggcacacacttttaaactgtccttcagttaactgtgtggccttcatatgattttactctcgtaactttaacttactgattcaaactcttaagccatgtgcgacaaaaaaacaagttttaaatacacgtttactatgccttgtatgtacacagcacactctatcaccttggaagctacaagctggtatcattaaatgctgaaaggtaataaagggaacatcttagtggtcttatctctagttgggtatatttttggaaacaatacttgtgatgtttctattactgcctatggctcctatgtaactgaaacaattaatgatctactgatttaaaaaaggcagttaaatctagagcattagttgccttgtgcagactcccatgacagccatgtcctagaataatggaacactctggaaatgggctagaatgttgagcagcagcctcccaaatcacagtatgcataaaagccaaaacagatgacagagctcagtaaggaagaccttactatttgtgacatccatcagaattttaacttgagaaactgatttcaaggtttgtttttaaaattcttatatttccttttccatttttcagaaaacactatttcaggctttggtctgacttactggttcgtgggcataaaataatgctattagtgactttaagaactaatgaggctgggcacggtggctcatgcctgcaatccaagcattttgggaggtcgaggccggtggataacgaggtcaggagattgagaccatctcaatggccaacatggtgaaaccctgtctctactaaaatagaaaaaattaagccaggcgtggtggcgggcgcctgtagtcccagctacttgggaggctgagggaggggaatcgcttgaacccgggtggtggaggttgcagcgagccgagattacaccactgcactccagccttgccaaagaacaagactccatctcaaaaaaaacaaaaacaaaacaaaaaaaaaaaacaactaatgaaatgctgtagtatcttaacactggctttctggttttatcattctaagaatcccagagaaaccagggtattcttaggaaagaatggattcctgggaaaataaacatctgcaattaactgtaaacaactgcatcaaagtgttggctttagaatttgaaatgttcctatctgggtttttgtaggacctgagggcactcgctttgctcctgtcagtacacactcccaaacagttaaacccagctctaattccaactctgcaagagcttttaagcaaatgcaggacttgtctgcaacagagaaactcactccaagagcaagaagccaaagaaagaaaaactaaaggttagctttatggactactatcattacctttagggtgggaggagggagtaatacacttggtgtaactggtttaagagttgtgtgttcagctgaacctcctaaatataaatgctagaaacaaaattaacttcccacatccccccctaacgtgatcttaatgactttcagagaagtttcccttttggcatgtgttttcacagatgatgaaggagcaactcccattaaaaggcggcgtgttagcagtgatgaggagcacactgtagacagctgcatcagtgacatgaaaacagaaaccagggaggtcctgaccccaacgagcacttctgacaatgagaccagagactcctcaattattgatccaggaactgagcaagatcttccttcccctgaaaatagttctgttaaagaataccgaatggaagttccatcttcgttttcagaagacatgtcaaatatcaggtcacagcatgcagaagaacagtccaacaatggtagatatgacgattgtaaagaatttaaagacctccactgttccaaggattctaccctagctgaggaagaatctgagttcccttctacttctatctctgcagttctgtctgacttagctgacttgagaagctgtgatggccaagctttgccctcccaggaccctgaggttgctttatctctcagttgtggccattccagaggactctttagtcatatgcagcaacatgacattttagataccctgtgtaggaccattgaatctacaatccatgtcgtcacaaggatatctggcaaaggaaaccaagctgcttcttgacattaggtgtagcatgtctacttttaagtccctcacccccaacccccatgctgtttgtataagttttgcttatttgtttttgtgcttcagtttgtccagtgctctctgcttgaatggcaagatagatttataggcttaattcttggtcaggcagaactccagatgaaaaaaacttgcatcttcagtatacttcctaaagggcaatcagataatggatatgttttatgtaattaagagttcactttagtggctttcatttaatatggctgtctgggaagaacagggttgcctagccctgtacaatgtaatttaaacttacagcatttttactgtgtatgatatggtgtcctctgtgccagttttgtaccttatagaggcagattgcctccgatcgctgtggttcttattatcaaaattaagtttacttgtatacggaacaaccacaagaaatttgattctgtaaagaatcctctttagctgtggcctggcagtatataaatggtgctttatttaacagaatacctgtggaggaaataaagcacacttgatgtaaaaataattgttttatttttattgacatgactgattgattgattgctattctgtgcacttaattaaactgattgtgatgacttttcatttgttta

SEQ ID NO: 162 - DNA, 3496 bp, Homo sapiens
gagattccaaagattttatgccaggagatggtaggaagaccaaataaatatttcacaatatcacatccctaatgtaggtcctattatcaccattctcattttgcaggtgaggagactgaagcatgagattaagaaatcaagaccgccttccccctgtagggccggccggcgagtcccagtgagagcggagggtgccagaggtagggggccgagaaacaaagttcccggggctccctccggggccgcggtcggggctgcgcgtttgaccgcccccctcctcgcgaaggcaatggcttccaaactcctgcgcgcggtcatcctcgggccgcccggctcgggcaagggcaccgtgtgccagaggatcgcccagaactttggtctccagcatctctccagcggccacttcttgcgggagaacatcaaggccagcaccgaagttggtgaggtggcaaagcagtatatagagaaaagtcttttggttccagaccatgtgatcacacgcctaatgatgtccgagttggagaataggcgtggccagcactggctccttgatggttttcctaggacattaggacaagccgaggccctggacaaaatctgtgaagtggatctagtgatcagtttgaatattccatttgaaacacttaaagatcgtctcagccgccgttggattcaccctcctagcggaagggtatataacctggacttcaatccacctcatgtacatggtattgatgacgtcactggtgaaccattagtccagcaggaggatgataaacccgaagcagttgctgccaggctaagacagtacaaagacgcggcaaagccagtcattgaattatacaagagccgaggagtgctccaccaattttccggaacggagacgaacaaaatctggccctacgtttacacacttttctcaaacaagatcacacctattcagtccaaagaagcatattgaccctgcccaatggaagaaccaggaagatgtggtcattcattcaatagtgtgtgtagtattggtgctgtgtccaaattagaagctagctgaggtagcttgcagcatcttttctagttgaaatggtgaactgataggaaaacaaatgagtagaaagagttcatgaagaggccctcctctgcctttcaaaagggtggtcacctacacatgtttaaggtgtctctgcacatgtctcaagcccatcacaagaaagcaagtacagtgtggatttcaaatggtgtgtaacttcagctccagctggtttttgacagctgttgctgtggtaatattttttacatgtgatggtgatagtctctggttctccccatccccacaaaggctgttgaaccacagcaccaggaagcctgagaatgaatcctgagggctctagcccaggctttgtcccaggctttctggtgtgtgccctcctggtaacagtgaaattgaagctacttactcatagtggttgtttctctggtcttgagtgactgtgtccacagttcatttttttccggtaggaataactccttttctacatccacactccatagagtctctccttttcagatatcctgggatgaaagaatttggctttttttttttttttttttttgacatctgttttcactcttaggcttttaaacaatagttattgctcttatccctctcagattctaataactgagagtgatggggctatattgaatctctgtatgcactgagaactgagctatgaagaggatcttattaaactgctggtctgactttatggattgacactgttcctttcttttattgtgaaaaaaaaaaaaaaccctgaaagtcttgggaaccccctaaagtcttttgggaatcctcaaaaagcatgggaagttaagtatttagctacataaatgttgtaagatcatatcttatgtatagaagtaataagaccatttggaattactggactaattgaatagttaaggtttctattcgggacaataaaatgtattttgaaagtgctgctaactattgatgctgacagtgtttcactcctatgagtgacccaaacatattataaatatgtggtaaagggaatggagcctgtggggttgagcagaatgttgtactagctgtgcctggactgagtatagcagctttatgattatgagaaaacaaattctttatttttttttctgttccaaagattcatcctatggggtggccataaagtctagaattagatactaatattttgtcattcattataacatatcaataaaccatttgttaaaagatttgcctggtttccagacttggtggccaccttgaataattcttgctgtcttctgggaaggatgatgaaatttattcctgctgccttaaaaatatgtatcccttcttcacccatcatgactgtccccagtgagtgtcctttactattcttgggagtgactcctgtctaacttttcatactggcgagaagaaaagaggcctattttaacactttagtggtgttgaaacacattacttactttctgaagatgtcccagtgaatcctctgtcaattcactgccatatgtaatctatatgataaggaatgcatcttccaagtactgcccaaactcttgccagctcctctcccattgtcccttcatgtgaatatttcttggctaccttagtggaaatatagatcagtcttctccccatccatcctctcaaacataatgagattgtttactttttagatttatgcagtgaaaatgcccagtcaggtctgaatcgtcagtgcattatattgaccctgagcactttagaatttagagttgcaattgaatgccagctgtggagatggggtgcatatcagatatataaataaagctcaggtttgctagggaaccaggtatagagaaaaataagtctgatatgaggaaaattgcacaatttagagtagttatgccgtagagaaaatttccacaaactaggaaatgtagagagttattctatagaatactcaaaagaggaaagtatgtgatttttggaaacaggaaaatcttcaaacttctttcttcacttccctttgtgtttagctgaccctccaatgtgatcattgcctttggagtttgggagaggtacgggaagtggcctgatgcctgcttccatacttcactcctccatccatccttccctccctcttcccctccagctaaatggacaattctagccaacattgagtcactcaataagtctcaacagtgggtgtgtttgctgagattgtccagcagttgagcagtttggtctcacctccctcgctagttgagaccaaaaagagacaaataactttttcatggtctttgaaacataatgcttatttcgtggtcaatggctttaaaaaaatctgtttcttgttttcttcaacaaactcactagttttcccttaaatgatattgtaaaaattaaagtaatcttgaaaatgttttgacaaaagtaaaattaaagggacaaaaaaaaaaaaga

SEQ ID NO: 163 - DNA, 19540 bp, Homo sapiens
agatatctccggcgccgcccgccattttgactccagtgtctcgtttgcagtcggcgctttaggggaactgtcttcctccgcaggcgcgaggctgggtacagggtctattgtctgtggttgactccgtactttggtctgaggccttcgggagctttcccgaggcagttagcagaagccgcagcggccgcccccgcccgtctcctctgtccctgggcccgggagggaccaacttggcgtcacgcccctcagcggtcgccactctcttctctgttgttgggtccgcatcgtattcccggaatcagacggtgccccatagatggccagctttcccccgagggtcaacgagaaagagatcggtgaggattgggaccgtgggtgggcgcatgagggccgaggagaggcagggactccccggaggaggtttgggaggaagcgactccaagtctgagggaagagctccagtgcgccagggccagcccactagcgaggaggaggaagccgcctcggtgggagttggctgaggggtaaacggcaccgacgtggatgcagcacctactgtgctccctcgcggttgctgtgtggctggggcgggcaaggaccccggtttcttcgtcggaggtccgcgcagggctcttgtcctgggagttcttggctcagggcatgactgtcgagtggacagggaagggccactcagggactttaggtttacaatggggaaaagtaaacttgtgggttgtaagcggtaatgaaaggagggggtcctcgtgtgtaccaaccactcttagatagaaatgagatggaagaggtcccaacagcctggcaaaagcaatacagtatttttaaaatggtgtggccttaagaaacgcagcggttcgggggaggagacttttagaattatctttcaaacacttaagggaggagctgggtggttgggtggagtgacagaaggaaagcttttgtgcggaagaggaaactctggaaaaggcttttctggcttagtgtctagccctggtcggcttagtaaagggcaattagtgttgaaggttgtgcgtccacacctacttagtggctcagtggaaagcacgtcgcattatttaaatcctcttttaaagtaaaataactggaacaacgtttgacggtgttggggggtgctgtacattggctgataacacttagcaaacactgatcttactgtgtgaagtaataattagctgcggccgctgagcagagagcatttacattttcctactcttgaagtgaatgtgtgcctttactaagtacaaggaggagttatttctagagaagggaagaggctgaagtagccaaaacgcgcactattttgtatgtgggtgaatttttatatctagaaacagctgttttagaattctggacttttgttgtcttagggatgattgattaggaagggactttaaccctggttttaataaccatttttaaagatacaaacacagaaaaaaaagggaaaaaattgtagcagagttcacacagaaaaaagaaaaaaaaagatgcaaagaacacagaatttgtgtccagttattattttaactgtattttaagactagaaagtatgtcgcgaagtgggacaaagaactcaaaagttcttatcagtccagtgggtttttcttttactttagtacaccataatgttatagacgagtgatctgccttttttttaaatctgtattttacttcatcctgataaaccattttgaaaactttgcggtcctgttttctctctctcttttttttttttgagatggagtttttgctcttgttgcccaggctggagtgcaatggcacgatctcggctcactgcaacctccggctcccggtttcaagcgattctcctccctcagcctcctgagtaggtgggattacaggcatgcacacgcccggctaatttttgtgtttttagtagagatggggtttctccatgttggtcaggctggtctcgaactcccgacctcaggtgatcgcccacctctgcctcccaaagtgctaggattacgggcgtgagccaccccgcccagatttccggttttgttttctaagagatggatagagatggatagcatacctacataaagtagaaccatccactaagtgttcccccactagccccctgatttctcttttcttttctttctttttttttttcatatttaggtctcagtgttatttcctggatacgttataaaaacttactagctaagtgccagatatctagaagaacttttgctttttctgagctttttttaaccccagtttttttctttgtttctttttttgaattatcatttggatacaaggttgaacatttctctgcgtagctttttaaatctatgaataaggatttactttttttcttttcttgggtgttaattaaaagccaagccaagtttagtttctcaaggacatacggagagtagaggcaagatttccatgaatgattaaataattctgtgatactactgccttgagctactgccctttttcacaaggcactgccacagatcatccctttctggttatgaaattttggggaggaatgtaaagaaggagctaaatctggtttgcttggttcagcagtgactcagatggtatgttactgttttacagatattaataatgtagtgttgtatcttacggctgatttcccatggcagcctttcccttaataaggtcattaaatcatacatttctgttgctaacattaaacagttacagataatgtaataaaggtttaacttaaaaattttttttcaaagcactttattacaaactttgtgctaggtttataaaattgtaccagtatttaatctgagcacttaaatcattttattaaagtgccaaaggcaatttgatatacctgttatccagcaaagaaacacaaggcaattattagtaaattttaacagattaatgcatttatttggtaggttttataatggctctatttcttgagtttgtatatatttgagaattatgttataaatatgttattatttcattgtctttgctatctatttgaaccaattttttagtaattgttaccgctcttttacttttttttttgttcctttgagactgagtctcgctccgtcgtccaggctggagtgcagtagcgcagtctcagcttactgcaacctccacctctcgggatcaagcagttctcctgcctcaccctcccgagtagctgggattacaggttcgtgccaccacacctggctgattttttgtatttttagtacagatggggggtttcaccatgttagccaagctggtctggaactcctgacctcaggtgattcaccctcctcggcctcccaaagtgctgggattacaggcgtgagccactgcccccggcctactctttttttttttttagacagagtcttgctctatcacccaagctggagtgcggttgtgaaatcttggctttctgcaacctctgcctcctgggctcaagcaattctcccacctcagcctggtactacaggtgcatgccaccacactcgctaattttttaaattttttgtagagatgaggtcccctatctatcccaggctggtctcaaactcatgggctcaagtgatccatccaccttggcctaccaaagtgttgggattaccagtgtgcctgtcctattaccactatacacaaggagttccatgattgtggtcaaggtagaagaaaaatatagagtaaccttaaaatacagtctaggctgggcacggtggctcatgcgtgtaatcccagcactttgggaggccgaggtgggcagatcacctgaggtcaggagttcaagaccagcctggccaacatggtgaaactccgtctctgctaaaatatacaaaagttagctgggcgtggtggtgggcatcatgatggtgcatacctgtaatctaagctactcgggaggctgaggcagggagaattgcttgaacccgggaggcagaggttgtagtgagcggagatcatgccactgcactccagcctgggcaacagagcaagcctccgtctcagaaaaaaaaaaaaaaaaaaaaaaagtcacgtatgaaaaatttaagtcttgcttatgcttgctaagggagagcttaattttagtctcatttactagatgttcttgaaattgaatgcaagggctgttcctcgtatacaagttacataaatattctccatagagacttttaagttgaattttaaaacttgcttcccttatttgtgaacttagcatttttttcctcctaaaaatgcttgtaaaatgtttttaaaatgctttaaaaatgttttcaaagatagatgtggttaaacaggaatccaagttaaaaaaaaagtgtgcctgatgcagtgggtcatgccttaatctcaccgctttgggaaaccaaggtgggaggatcgtttgaggccaggagctggagaccagcctgggtaacatagcaagaccctgtctataaaaaattgtttttttgccgggtgcggtggctcacacctctaatctgagcactttgggaggccgaggcgggcgggtcacaaggtcagtagttcgagaccagcctggccaacatggtgaaaccccgtctctactaaaaatacaaaaaataataataataattagccaggcatggtggtgcacgcctgtaatcccagctactcgggaggctgaggcaggagaattgcttgaacccaggaggcggaggttacagtgagccaagatcaagccactgcactccagcctgggcgacagagcaagactgtcttaaaaggaaaaaaaaaagtttgttttttgtttttgtttttttcagttagccaagtgtgggggcatgtgcccgtagtccctgctacagctactcaggaggttgaggcaggaggatcatttaagcctacgagtttgcctctgcactccagccttggcaacagagcaagaccctgtctaaaaaattaagcaggcaggggttgcaaattcagaggccaggcatataaagaaccctggtaaaaggaacaaataaggctgtaggtttgggaaaattgtaaggaaacctggagcagcatgctctttctgaaatcatttgtatgttaaaggtatctgcaggcatttgagggtcaccaagtttgtgaattttgtattaagaaagttatgtggctcacatctgtaatcccagtactttgggaggctgaaggtgggaggatcacttgagcccaggagtttgagaccagcctgggcaacaaaaggaacacctacctttacaaaaataaaaacattaaccgggtgtagtggtgcatgtctgtggtcccagctacttgggaggctgaggcaggaggatcgcctgagcctgggagttcaaggctacagtgcgcagttattgtgctactgcgctccagcctgcatgacagagcaagaccttgactcaaaaaaacaaagttatgtgacggctagtaaagttaatgtcatcttatgctgtgctaatatggggtgggtgggggactctgctgctttgattaaaccacacctgaagtattgtggttagttctgggtgccacttttatgagggccagtactaactagaatttatccagaaaagtatgatgaagttaggatgggaaatggacttgaaaccatgtgatctaaggtatgattgaaaggatagagatctcttagcctggtaaaaaagattcattgatggctatcttcaatatataaatgccatatgaggatagcagcaggcttattctcttaggtcagaatcagtactgagtgggtagagtggtaggaggaagattttgagtcattaaaaacggtctcagttgcaccaaaatagtgtaagccttattatgaatatcatagaaaagtaggtctcaggctttttgtttttgctttctaaaccacacctatttgttaaggtgtcaagaattgggcagataacatatttaaatcactttagaatgggagcataaatgtgtgctttcatattcattccgtaaatatttactgagcacctgtcatatgccaggtgctatactagctgttgatggagcatacattcaggctgaagaagtacattttgggggtgggtgtgtccatgtccaggttctctagctatatcagtgtaaggggttcttatgtgaacagcaataacatagaatatattaaagcttaggtgttggaaagtttaaaccagaaatacataaaaatatattattatacagtgtacaattgaccagacaactgaccacaaaataggtaatagggaaaattaagaccaacccaaaataggtgatacactgataaagaggctcctttccccaaattgaggaaattgtagctgagtttgcatgcatgcattgcagtatgagcttgttgatcatgctttttgttaaatatggaagtaatattctccatatactctggtaatatgccaatttttgttaggaatacaaaatttgagtaatctgaatttaaaatatatgacattgtccattttttgtccttaaaaaccaaaataattccatttttgagtcagtttgaggcctattaggaagactcttaaggaccagtatttgagaatcacaaatataatgcattttggttttttttgtttttttttttttatgacagtcttgctctgtcacccaggctggagtgcagtgatgcagtcttggctcactgcagtctccacctccaagattcaaacagttcttatgcttcagccttccaagaagctgggattacagacacactccagcataccaccatgcccggctataatgcattttcttttattttagcttattttttttttgagatggagtctcactctgtcgcccaggctggggtgcagtggcactttcttggcttactgcaacttccgcctcctgggttcaggcaattctcctgcttcatcctgggattacaggcgcccaccaccacgcccagctaatttttgtatttttagtagagacagggtttcaaaccatgttggccaggctggtctcaaactccagacctcaagtgatccgcttgtcttggcctcccagaatgttgggattacaggtgtgagcaaccacacgcggcctataatgcctttttaaagcactggtttggagggttggactagacaacctgtaagtctcttctagttctgagggttttgtgatttttgtgacctgggcctgaaaagggtaaaaatacttgtttggatagtgtattttgtagtgctttcctttgagtaatggtgtaatattgtattttatggtgaggtatggtttttgaaagctaagaaacttaatttggaagatacttttcctgccaactaagtttaatttcttgcattttaaatgttaataatttgatgagaacgtaatacaatgcaaaagttaggacttttgtaattgttaggtctaattggtcattacattattattgaccagttttttttacggaaactttcttaaaaactcttgcattgggaaattttagggaaatcactttatcaaaacttggagatagtcattatcgttaaggggtcttcatatactgcataccccccgttagaggatggaatgcagaactcactataccctgtctgcatagaagagggaagaaactcaatcccaaagtaatatggaagcagtctcacatgtattgttggttatatatgatatccagtatttttatttttccttttagtgagattacgtactataggtgaacttttagctcctgcagctccttttgacaagaaatgtggtcgtgaaaattggactgttgcttttgctccagatggttcatactttgcttggtcacaaggacatcgcacagtaaagcttgttccgtggtcccagtgccttcagaacttgtaagactgttacttttctgtattttgtatctgtttgtggaatttaccattttctctcagtgtagggtaataaaaacattttgatatttaagttttactttatagatgatgtcgtgagttttaatcatgggctgaatatatttattggaaattttgtgtaaagaattctttgggccgggcgcggcggctcaggcctataatcccagcactttgggaggccaaggcaggcagatcacttgaggtcaggagtttgatacccgcctggccaacatggtgaaaccccatctctactgaaaatacaagaactagctgggcgtggtgtggcacacctgtagtcccagctactcgggaggctgaggcagaagaattgcttgaacccaggagccggaggttgtagtgagtcgagatagcaccactgcactccagcctgggtgacagagccaaataatgtctcaaaaaaaaaaaaaaaaaaagaattgtctggtgttatttatacattaagtttttctgtatgttaaaagtcagattgtgtctaacaagtgtatatatatatatagtgttgtgccagagtaggtgacttctgtgatgtgaagctttttggattcactttggattttacattttgttggataaccctggtgcatagtagtagagacaggggtttcaccgtgttggccaggctggtctcgaactcctgactttaggtgatccaccctcctcagcctccctaagtgctgggattacaggcgtgagccaccgagcctggccctttgttgttgttgttgttgtttttgtttttaatggacttatagtccctctgtttggggtaaattgagtttggatgtttgttgaaagtttttctaaaatgtatcatgtgctatattggatctttccctgttttttttgtgtctagcagaccttcatggttatagtcactaatgttctcattacatataacttgaggtctggaacctatgggaaactgatcattatggtttgaggatttttttccccctttaaggcaattttctgatatcagcttgaccatatcttaagttactgggtttttttgtttgtttgtttgttttttgcttatttatacttgtgtttttaggttgaaggagcaccagttgattcggtggttttgaggaaaatttgggaggcaaataagttataatataaattgctttattgttgaacttactactcagtcactgagaatttctattaatgtccttctctcgtagttcaaatatcaacctttcccttcctatctataggattctattgttatttggtgtcattataataatattgaggttattttaacaaacacttgtaattattcaatgtccagaggagtccagagtgaataataatacaatttccatctgacttcccccactccagtctcttgcatggcaccaagaatgttaccaattcaagcagtttaagattgccaagacaaaatagtgatggtggtcagaaaaataagcctcgtgaacatattatagactgtggagatatagtctggagtcttgcttttgggtcatcagttccagaaaaacagagtcgctgtgtaaatatagaatggcatcgcttcagatttggacaagatcagctacttcttgctacagggttgaacaatgggcgtatcaaaatatgggatgtatatacaggtatggattcatagtttttaaagcaaatgtattattttatgatgcagggcactgcttataggcactggaattgggatttgaggatttcagcttactgaaaagcaagaattgatggcataggtgcgtctttataatagacctgaatgtcaccttcttcagctcatgattttaatttaggaaaactatggagttcatattgcttcatcactctttagagagtattacagtaggaaagggttttccagggaatgtttagttagttgtcctttataaactagttatttagttaatgactcacatgtcaaggtgttttctttgtttatgctttttcaatgattgatagcttagaggttttcgaggtaaatcagatttcagtaatcatctcaccttggaaaggtttagtgaaagtttagatagattgagaagttaaattctttgggcaactagaaataaatgtgttgcttattgcctaaaacactttctggcatataatatgtactcaaaaacataaaggatttttaaagaagcattaaaagaacatgtacattagaacataacaagtgatactaacataggtgataatgagtcaaaatttgggttcttgaaaaaaacaagatgaacacatagattgtcttagaaaacaaagctcttacattattagttaaatacattttttttcactgggatcatgtttgaaaactaaagttgtgggataacttgtatcttttgaggagcttaacattcctaggccagggaaataacaagcaaagaaataatttgattttatattttaaagttcatgcctgtaattccagcactttgggaggccaaagctgggggatcacttgagcccaggagttttagaccagcctgggcaacatagtgagactccatctctccaaaaaaaaaaaaaaaaaaaaaaaaaaaaaggccagccgtggtgacttgtaactgtagttccaactatttcggaggctgaggtagggggattgcttgaacccaggaggtcgaggctgtagtgagccaagattacgccattgcactccagcctgagtgacagagtgagaccctgtctcaagaaaaataagaacaaaacaaaaatatattaatactgtcttttttttcccttttctatcatatttaggaaaactcctccttaacttggtagatcatactgaagtggtcagagatttaacttttgctccagatggaagcttgatcctggtgtcagcttcaagagacaaaactctcagagtatgggacctgaaagatgatggtatgtcttttttccaagctatgaactaggatttgtttcttgatactactatggagaggtattgggaacatgtggggcatttgactttaaaaatgacatgtgatcaaagttccttttctctgccttaacacttaggttcctttcctgaatagatcaaagaaaaacataaatgtgacccagaataggagccaacagttattcgaagtaaatgatctgatattattcagaaactaaccacataaatctgtatcaactatctgaggaccaaatatggatcaggtttgggattttacaggaaccagtctgtgtttatgtcctcttagggagggttattaacttactgtattggctgagtgaaaatttaggtaggtcttgaagtaacttagtatctaataaaatttaaattgaaacatgacctacataccagaacttataacatgtgaatattagtaaacgttaaattggctaggttaagaagtgcttttataaaaagtgaaagatttactgtccaatacaatagaaagatacgttggtgtcaagtactcacctttctctaaagccttacaaagttttggagatgctacctcatttgagatgagcatctcttccctttctcagtccctaatgaaagagtttatatgtttaactaaaaccttaaatgtaaggtctgttggtgctctaacagcctcaagctggaggttaacaggcttgcctaggggtaataaagcttaaattgaattagtaggaaacaaaaccctcagatctggagatgttccagctgatagatagtaaccattccttaataaagttctatgctaacattaacaaatcatgaaggaccttctctgtgttttatctgctcagctgttgaggtgcaaagggatgccaacagttgaaatattttaataatttttttattttgcatatcgaatgatgcttgcttatctcaaactaatttcagcaatgtacatgttttaagaacatagtcttagtaaaatataagctccaagatagtggggtccttgccttatttccagttatatcctcagtgccggcatagggcctggcatgcgtaggcactcagtaagtatttgtaaaactaagagttcagtatacttaagcatagttgtgtgctgtgggtataatacacaaggactttggagtgagttgtaggttctcaaaaatgaagaatgaaaaggcattttgaagatggtcaagtttcttaaccttgctgttgtgttccagttgcttaacttttaaaataaggggattggactaaaagaattctgtcttttttttttttttttttttttttttttgagatggagtctcgctctttcgcccaggctggagtgcagcggcgtgatctccgctcactgcagcctctgcctcccaggttcaagtaattcttgtgcctcagcctcccaagtagctaggattaccggcatgcgccaccatgcccggctgattttttaatgttttttagtagagatgggtttcaccctgttggccaggattgtctcaaattcctggcctcaagcagtccacctgcctcagcctctcaaagtgctggaattacagacaagagccaccgcgccaggccccagactttttcttgaagggctagatgttgaatatttgaggcttgtgaaccatgctgtctgctgtagagcacaacataaacacatggacaggattgtgttccagtaaaatttaaaacctaagcagctggtgtatatcggtaacccttgttatagataaattgctttcagctataaatgtttgtgatcctttgctttactgctgttttgaaatactgctcatttgaagtggattctagggttaatacagattatttctttttgttcaggaaacatgatgaaagtattgagggggcatcagaattgggtgtacagctgtgcattctctcctgactcttctatgctgtgttcagtcggagccagtaaagcagtacgtgtcaaagttcttgtacattcattatgaattggattatgataatgtgtgcataatcattttaaatctaagtaacctatgaagtctgtgctcggtgtcatgaatattttaaatgttttatttcatgatgggggagaatttgcatgaaggaaattaaatatagttattgattgccaagtgagaagttggattgtttttagagataatagataataatgggcatatcagggttttttttttttgtaagtctagaaaagtttatgtgctgtagaagagatctagtctatatgttaagacattcccttgctaattattttcttctctgttgttctatttttttggtccagtttgctgtttttaaagttttgagtcccagctggtcctgtacatttaactgaaaaaaaagtaacttaaaataatataaaaatagcactcatgtatgtcctacagttataggtgaaatttgatattgtttgtcttacatagcatacctatagacagcttaagtaaagtgactgttaagagggttatgcttattgatgaactcttgtagttgtttaccagctctgttagtatagttaaattgatctcagtagcttcaagtatttataaaatggttgaagtccaaatacatgtgataattacaatacactttgaattaatggagggtgggaggctagttgaaatgcattttatttacccaaggagtatgttaaaatgatagttataaatgttggaagtttaaagcaagatactcagtttagttctttacaaatcataagaagaacaaaattagatgttgacattgctattttaggctgtgtgttttccatatgcttcttgctttccctgtcacaggtggtggcagcaatattggtgtgattgaggttatgctggcaccactcgcacacaggcgcacaatggtgttagctgggcagaaagagtggcatctctggctaccgggctgggggcgacctttaccataggatgaagtaaccttgcattcggctgcaaggtgtactgtacgtacacaggtgctggtcgatgtccactttctgcttttctttctttctttttttcttttttaaagtaatttcccccacagtaaaatacactgactcctgagtaaattgattttccagttttatggaattgggagtctgacaagtgaaaccaatttaatgtaaagtatttggctttcaaatggtttctctgtgctattttttggaattctttcagattccagagatatcttacgtctttgattcaatttaaaatttgtacttattttcttttagaaataatgtattgtgtctgtgcagaaaaaaaaaaaaccaaaaaggattgctttactccaagaggagagattgtcttaggataaacctccaagctcacatttaatataacagactgaagtaaacattagaatcctgtttagagctattctgcacagttaactactgatctttagaatctaaaattgtatatgaacttattcttaaataattgaaccgttttatattcaaatgacttatgatcgtggttagtttgggaaaaataagatggttaaattttgatttattgaaatgtaattgtattattttcataaaatagcattttcattttgtaatgtggtttaacatccttgttgtttgccaaagaaatttcatttggctgtgaatattctatttgcttgcagtatctgtttctcttcctaggctcaagttggtgacccaagcctattgtaaacaagtgattatctcaaagggagatgccaatggagtaacaatttgttaaccttacgttttctgtctgtatatttttttaaaaatctggtagtttctggaaaaaaaagagaagggggtttgtagtacttaaccctatttatttccgtatattttagttaattagtttttggaataaatggatttcagtatagctttgtggttaaattgcattgcctttattttatgtttaggcttatttttaaattaacatttaacagaaacatttgaaatagaatttgcatgtctgccttaattaacttaaagactgattttaatctgactatgacactgagcatattctttaaattactcataatttataatgcttaatataatcttaattaaatttagcagttttagtataagatgtgccattttgtcctctgtatgtctgaatgaagctataacatttgcctttttattgcaggttttcctttggaatatggataaatacaccatgatacggaaactagaaggacatcaccatgatgtggtagcttgtgacttttctcctgatggagcattactggctactgcatcttatgatactcgagtatatatctgggatccacataatggagacattctgatggaatttgggtgggtacagcatgaattattttagtctataattcatctccacctatcaagttatgtgaataattacaatcaccaatatatgcaacctaaaattacagtctattctaatttaaaatgttggtattatttaagcccttgactaatggaaagccttcgatataaattctaaaagtaaatttggctctcttgatacaagtcttgctacttaacagtacccagctctctatagaagtactaattatgtttagagtttttgttggagaaaaacagttaaaaccaaagttggacttaatcttactgtcttaaatcataaaagattttttttttttttgacagagtcttgctctgtcgccaggctggagtgcagtggcgcaatctcagctcactgcaacctccacctcctgggttcaagcagttctcctgcctcagcctcctgagtagctgggcttacaggcacctgcaaccacccctggctaatttttgtatttttagtagagatggggtttcaccatgttggtcaggctggtctcaatctcttgatctcgtgatccacctgccttaacctcccaaagtgctgggattacaggcatgagccactgcgcccgaccataaaagattagttcttttcaggtgactttaatttggatgtatcatctctactgagtcttctcagttatattaattaaggctactttaaacactattcaaagacagatgtactttgtacctgggtaattttgttttcttgaagtgactgatatccactgaaaacatatatttgacctcaggcacctgtttcccccacctactccaatatttgctggaggagcaaatgaccggtgggtacgatctgtatcttttagccatgatggactgcatgttgcaagccttgctgatgataagtaagtatgtgcattatagcttgactgacttactattaccttttacattcttaagccttaaagcctttctgcagttaagagttttaatgtctcttcctcaacacaagcccctgggagattttgttgtgtcttaaagaatatcggcctgaacaattatctgtgtaaactaaagataatgcatgcctctccctgtgttccttgtttaacttgtttaggcatagtgggttgatttttagtcagcttttagcccagcttacagagattttttaaagtaatgtcttaacaaaggttgaagcagaaggaaatttctaaagtgaaacaaatagtaaaaccaaaagaattacaaataaatagtaatttgtatccaccatgattgagattagaatatgaaatgtcacatgaatgatatgtgctgcttgttggtaagaagcagaaactagttgcaaccatctgtgttcatgcatatagcattgagtagttcggtgacgtcaattcataaggcagctcttctcttcccagaatgttagcaaacatatggagagaggttttttttgtttgtttgtctgcaaccattgtttcctgtttgctcagatagattctgcatgttagttctctgctgtatttgtagacacactcagcctgggtgaaaagctttttttcctttcctggttttttttgtttgtttattggagacagggtcttgctttgttgcccaggctatagtgcagtggtgcaatcacatctcaccacagccttgattttctgggctcaggtgatcctcccacctcagccttccgagtatctcacaccacaggggtataccaccacacctggctagtttttttaaaaaattttttgtagagacagggtctccctatgttgcccaggctggtcttaaaagtcctgggctcaagcagtccacccacctcggcctcccaaagtggtgggattatggttgtgagctaccaggcccacctagcttttaaaaatgtcttgggaaaagggtgaaacagactagaagttgattgtattgtaagtgtaggaaagtaaggagaaagtttccgggtgtgaacattctaggtttgaacactgggaaggagggaaggcagccatgcattgtagtctcttaagtgaaagtttatccaatttaccaactgatattatagaccttaaaatattttgtaattgtataaagcaagttattataattgcctgttggtgtgatgtgtgtattttgtgactcataactcaatggcatttctttctaaattttaaaaaagttgcttttaccttacattttctacaagatactaaataatttatttcattttcagaatggtgaggttctggagaattgatgaggattatccagtgcaagttgcacctttgagcaatggtctttgctgtgccttctctactgatggcagtgttttagctgctgggtaaatatatttttctcttttttttttttttttttttttttttgagatgtagtctcccaggctggagtacagtggtgcaatctctgctcactgtagcctccgtcttccagttcaaggagattctcctgcctcagcctcccgagtagctgggactacaggtgcacaccaccagtcctggctaatttatttgtttgttcgtttttccagtagggtcgggatttcaccatgttcgcctggctggtctcaaactcctgaccctgacctcaagtgatcttcccgcctcaacttcccaaagtgctgggattacaggcgtgagccaccacacctggcccatttttctcttttctttaagggccaatttaagggggcttttagcagctagtaatttattgtcagtaaaactctaataagtgttcttcatagtagtgttaccttgtcatggaatacatcattggttagttcttcctggttgggttttaatgtgaagtttgtgactccactactcacatgtattgggtgatagttgtttgagctgtagcaacactgaaatacatatacttgggtgactaagcatgtgctttgtttctgtttaggacacatgacggaagtgtgtatttttgggccactccacggcaggtccctagcctgcaacatttatgtcgcatgtcaatccgaagagtgatgcccacccaagaagttcaggagctgccgattccttccaagcttttggagtttctctcgtatcgtatttagaagattctgccttccctagtagtagggactgacagaatacacttaacacaaacctcaagctttactgacttcaattatctgtttttaaagacgtagaagatttatttaatttgatatgttcttgtactgcattttgatcagttgagcttttaaaatattatttatagacaatagaagtatttctgaacatatcaaatataaatttttttaaagatctaactgtgaaaacatacatacctgtacatatttagatataagctgctatatgttgaatggacccttttgcttttctgatttttagttctgacatgtatatattgcttcagtagagccacaatatgtatctttgctgtaaagtgcaaggaaattttaaattctgggacactgagttagatggtaaatactgacttacgaaagttgaattgggtgaggcgggcaaatcacctgaggtcagcagtttgagactagcctggcaaacatgatgaaaccctgtctctactaaaaatacaaaaaaaaaaaaaattagccaggcgtggtggtgcacacctgtagtcctagctacttgggaggctgaggcaggagaattgcttgaacccaggaggtggaggttgcagtaagccaagatcacaccactgcactccaacctggacaacagagcgagactccatctcaaaaaaaaaaaaaaattgtgttgcctcatacgaaatgtatttggttttgttggagagtgtcagactgatctggaagtgaaacacagtttatgtacagggaaaaggattttattatccttaggaatgtcatccaagacgtagagcttgaatgtgacgttatttaaaaacaacaacaaagaaggcagagccaggatataactagaaaaaggatgtctttttttttttttttactccccctctaaacactgctgctgccttaattttagaaagcagcttactagtttacccttgtggtataaagtattataaattgttgtgaatttgaagaatccgtctactgtattattgctaaatattttgtttatactaagggacaattattttaagaccatggatttaaaaaaaaaaaaaaaaactctgtttctgcaggggatgatattggtgagttgccaaagaagcaatacagcatatctgcttttgccttctgttgtttatcttacctgcagatattaagaatgtatgcattatgtaaaatgctcaattatatatttttgttgagttttttaattaaagacttgt

SEQ ID NO: 164 - DNA, 43084 bp, Homo sapiens
gatccccgcccctgctgcccgccacgtccctcacgtaccactcggcagaggcgcggggaaacctggcgtactggctgtggcttctctagcgggactcggcatgaggctggcgcggctgcttcgcggagccgccttggccggcccgggcccggggctgcgcgccgccggcttcagccgcagcttcagctcggactcgggctccagcccggcgtccgagcgcggcgttccgggccaggtggacttctacgcgcgcttctcgccgtccccgctctccatgaagcagttcctggacttcggtgagtgcggcccgggaccttgggcctttttgcgcggtcccgggcggggagctgcggccgctgccccaggccgggtcggcgccggccagctctcgcctgaggcgcacccctcctcctcagcgtttccgcccccagcgccttaggtgcttccttcctccctccgaagtgccggcgctggctggcggcgtaaataacggtgggcgtgtggctttgaccgtattgttgaaaacaaaccagctgggccgcgggacgacctcccgcctcccggcgcacgtgtgcaggtgcgcgctaggccaggccccttccaaggagtcggacccgggtgggaggccgagcgtgggcacccccgagaatcgcgtttggattccgtgcagtgatgatgaatgcccagttttgcatatgatgattgcatagaattggcgtgataatagggaaggcagattataactggcccagggtttcttagaatgttttccttgccagtggcttaaaactgttggcaccaacagcacatttcatcatcagcaagtaagtcttgggcacgtgttgagtgcatgaggacaagatgctgtgaagtttatttaccacattatcttggttttctctagaagctgttcaacaaattgcagaaggaattgcatagttaggcattttaacttttacatcccacttcccatgtgaaggcgatgaggggaaaagggaaaaccttaatgaattcataaaatttgagtacaaaggttatcttctgcattgtgacttctgcattgaacgatacctgcatggttggcaactttgtcttaaaactgtggtttgtagtggcataatttttggctcaaagccttaggtttttgtttttactttaaaatgaccctagttcgaggaaggggcgaatttggtggtattcatgagtatgccataaaacttttacaagctgttttcctttagtaccttaatttctactgttgacaatctagtttttgctaacgttttctcttctaaagcagcaagaatagtaagtttaaaatgcattactggaataataagaccttttagtttaattttaaatggagctgtttgccaaaggacattctacaacgattctgcttagggagtgatatgggatcctgatatgggagtgtagaggggtcaggagactttcagtaaccagacaattgaataggacctacttgaagatggtgcaaacaggcagtggtgaattttgctgttgcttgaaagctttcctctgcacttactcttttttcccgtgtgtgtgtgtgtgtgtgtgtgtgtgtgtgtgtgtatttttttttaaaaatagaaatggggtctcactatgttgcccaggctggtctcaaactcctgggctcaagccatcctcccacctcggcctcccaaagtgatgataggtgtgagccaccatgcccggactgcacttaatctttgcttatggtaattagcattagtggttctatatggaatcagtgagtcttcctatgcaaacatcaaaattttcctctttcttttgagacagggttttactctgtcacccaggctggagtgcagtggtgctatcatagctcactgtaacctcaaatttcagcctgagcctcccaagcctagaactaccggcaagcaccaccacgcccggctattttttattttctgtatatgtgaggtctcattgtgttgcccaggctggtcctgaaccgctgggctcaaacagtcctcaagcctcggcctcgcaaagtgctgggattataggcgtgaaccactgtgcctggcctcctgtttttaatttatttttttaaggctggtcaagttaagcagtgggagtggagaaggaacaaagaaatctgtaaccggttgtgatcaattagttgtaaataccactgcattcggaccagcttaaagtttctgtttcttagacaggcacttactgtttttaaacctagagttagataacagattttctaaatgatagcagcaacggggtgtacaggatagacttttccaggttctgctgttaattttataaagccttgctcagacatgctcaggttacctaacttctaaaatgggtgatcactttaaggatgcaaattagggagacaagagtatcgtaattgctgtacagagccattggaatgtcagtaattggaaggtcataactctggagactgggttatctcatccctcgcctcccacaggcaggtgtatctttgcctcctattccctgccccatcgtggtgattctatccctctggccttgccggataacttcctctctatttctctcagcctcttgccttctgtttccttatggcttttacttactgctttacccatcatgtttggtttcaggatcagtgaatgcttgtgaaaagacctcatttatgtttctgcggcaagagttgcctgtcagactggcaaatataatgaaagaaataagtctccttccagataatcttctcaggacaccatccgttcaattggtacaaagctggtaagattctcatcttgtgtttgcaatttgatggagttgtggactttattcaaggttacagcaaatgcttttttttactctttggtggaatcttttttgttttgttttgttttgtttgagacggagtcttgctctgtcgcccaggctggagtgcagtggcgcgatcttgcctcactgcaagctccgcctcccgggttcaggcgattctcctgcctcagcctcccgagtaactgggattacaggcacgtgccaccacgcccagctaatttttgtatttttagtagagacagggtttcaccatgttggccaggatgatctcggtctcctgaactcgtgatccacccaccttggcctcccaaagtgctgggattacagacgtgagccaccgtgcccgaccagagtcttaaggtagtagcagtattctttttttggctgggggcaggtgggggcaatgtatttgggcttgtgccctgaatcgtggactccacaacttcttgattttgagaaagccagtcaaaactgcactgaaatacagatgctaaatttaggatttatgttagtatatcttcaaggatattataagaaaaaatgtctgcaatttgttgatgactgggtatttatgtatattgcctttaatcccttcaacaaccttgcacagtgggtatgattctctccattttattcattgttattatttttatttactttttgtttttgaaatggaatcttgctctgttgcccaggctggagtgcaatggcatgatcttggctcactgcaacctctgcctcctgggttcaagtgattctcctgcctcagcctccagagtagctgggattacaggcacctgccaccatgcctggctaatttttgtatttttagtagaaatagaggtttcaccatgttggccaggctggtctcaagctcctgacctcaggtgatcctcccaccttggcttcccaaagtgctgggattacaggcatgagccaccactcctggcctacttatttttttgagacaggttcttactctgtcacccaggttggagtgcagtggtgatcacagctcagctcactgcaacctccacctccctggctcaggtgatcctcccacctcggcctcctgagtagctgggaccacaagtgcatgccacacccagctaatttttgtattttttagcagagatggggtttttccatgttgcctacgctggcctcaaactccggaggtcaaggtatttgcccacctgggcctctcaaagtgcagggattatgggcatgagccattgtgtctagcctgtttattattttttaaattaatttattttctttttagagacagggtctccatcacccaggctagagtgcagtagtgtgatcatggctcactgcagtcttgacctcctggggtcaagagattctcctgctaaggcagctgcctcccgagcagctgggaccacagccatgcgccaccatacctgaccaattcttttatttttttgtagagatgggggtctcacttttttgcccaggcaggttgtgaactcctgggctcaagcagtcctctcaccttggcttcacaaagtgttggtattacagacatgagccaccgcacctggcaggttaactctgtacagatgaggatgctgaggcacataaaggttaaatcttttgcgtaagacagtaccattgatagtggagttgggattcaaacccccatttgtccatctctgctataccgtgctatagtcagaatgatgaaatatatgaaaggatatatgtatttttaataaactgtgtttattgaagggtatctttttataaattacaaaagttaaaatgtttatttttctgttttaaaacaattagaagtttttggaattgtgtagaaaaagtgtgatctcttcccaaagataagtagagatgttaagggtatacactcatggagccacctatatacagccttcattaatgttactgatttaaaagtgttgttcttttaagcactgtatgcttcaaacaaatgagttgcccagagttaagtcttaaatggaaaaggtttagctgcagggcatttcccagttatgattcatggagattcaagttttctttttgtaagcattatagcgtatgggagaagttgatctaatcgcaatttaaaaaagcaaaatatgactgctatatatatgataatcagatgctatctagtccaagtatggaatagttataagtgtggattaaatgggaagcatttgtttagtaattatgatgggatataatggagaaaatataatattccatggaagatttttcctgtttttaaaaaattcttcattagaagtagaatatgctgctttttgaagcttatcagtcatgaggtctgatcggtgcctgttgtaggtactcaaatatctcttggatggagagcgtagttgttcttgccaattaagaggaaattaagggttaaagcaaagcagcagctgctatcagaatcccttaactttggaatgcagtaagacatattgcttgtcagaaacagctttccaaaccaacagatggaattacaggtttttaaagcacttccattgctcctagatgcctgctaagttaggacagttgcagataaagtgcttacagccaagtggagcagatcccttacactgtcgaagaaagtaattcagtggtagcaagttatttttagctctggccccgcagtgccattgtacttgcctgcaagaccatcagaaaatcatttggccttctctattttgctcattccttaacagatgctttgatacttcgaattgttagataaatttaaaatgtacatttttatgacttttgtgttttttgttcagtttaaaagaaccatgtagattataggctttcaataaatacttgttagttggacataaatatgtaaaattaaggttttaaagcacagatatttaagatacagtcttagagcaagagaggctgtcctccttttactgataataagacaaattaagtcatttgcccaagatcacatagttactggtgacagatctcagcataatcagtatatatactgtaatgtacagtggtaaattaaaaaaaaattaaaagccattttagaatgtagaactcggaaaatcttaaaattcttaaatttgacctttgcttttaggagaaaatgtgcaccttctaccattcattcccagcactttgcttgaatgtgcatgggtgtaaaaattatacttcaaccataatttatagcagtattctaaattaaaaattataaaatgctaaaaatagcttttgagctaattttcatgatattgaactttcagaatataaaagaacaaacttatcctattgatctgcattttaggtatatccagagtcttcaggagcttcttgattttaaggacaaaagtgctgaggatgctaaagctatttatgagtaagttcactattttgaccctattcttaaacctattattaggtcacttgggggaaattggttaacttttaggtttctactactttagaacatgtgatatatgtgactgtagcagcccatacaggcaggacaaataacaatcagcaaatttgactaggcataagaaatgcttcgtgttcctctttaacaaaagacaaagttcaggtgtgatgatcagtggaaatgtaggtgtggcctcagtgccagttggactgttcacctggagggtgcatgctccttctaatggacaaccaccttcagccccagctgatctttgccatatgaaaatactgcccatatcatctgattgttttctgattttaaaggaaagctacaagtctagatttgtaatgtaaaatctctcacttttgaaagattggtaactaattaaaacattttttaaaacacagaaggcctagaagaacatggttgcaggtctctagtttatgctgtatggcctgcaagatgatgtaagtaatatgacaatgttaataacccatataccagaattggtaaaccaaagtatttgccttatgcagctacctgcttattgcagtgaagggtactgagagtgtaatgaccatctcttgtcctcagttagttacacatgttttttggactgtctttaaagtgaacagtaacacttcatttttttaaacatgattttaatctgaaaataacttcagcaagagtttactccttgcttaggtattgagcagactttacatgaatgatgttttttaatctttaaaacaattcattgaaataatgctgtttgtgcacaaagagggtaagtagtttaaggttacatagttagcaaatggtagaatccaagcagtcttactttaaaagtaaacattatgttatagagccttctgaaaacagtcattcagagctgtggaaaataagtagtcaagcagaataatacagatttgtgtttctttgaagcagaaagaaaataataaaggagtgactagaatgatgagttgtttgttgtttttgaagagttttgttgtttgtattttagtttaacagtcttgttttgaagcgcattactaactaggaattccaaaaatgttttaagcagtggaaacatcattggaataagttaatagtactcaggatgatgactttgaataggaaagcactcatttggaagtgtaaattcagatgggttatgttagaaaattggtttcgttactgcataattaagacttcttgggccgggcacggtggctcacgcctgtaatcccagcactttgggaggccgaggcgggcggatcgtctgaggtcgggagttcgagaccagcctgaccaacatggagaaaccctgtctctactaaaaatacaaaattagccaggcatcatggtacatgcctataatcccggctactcaggaaggctgaggcagtagaatcacttgaactcgggaggtggaggttgcagtgagccgagattgcgccattgctctccagcctgggcaacaagagcaaaattccatctcaaaaaaaaaaaagacttattttctcttttatttagttatttaaccatgcagtgtcttctaagtgacagagatgggaagactagatgatttgaagatttgtcttttaatataattgtttacttttcctctcccattttataaactcataggatgagtgaaatgagaattcttttctgtttttctgtcctaagtgtttccttctctctttgaaccctagggaataggtccaaaacaggcaggctttattggctcattcatcttgattccttgcagagcagagcaggtgttctctagaggcaagtgctttgtctcctcctatgcagaatgtctctggaataccatcctcttagccagtgctcagatgaccttagttgataacagttaaaaccattaacattttttggattacgttttgtggcagccttactcttaggaagccaagaaaagaattaaatcttgaaagttttattttggaggtctgtatactttcatagatttggtatattttatgatctgaaatacatttaaataagtataggaaaacatgaaccgattttccttttattaaattggggattttttgtctagcatagttggttaagcttatatttttgtattaagtttacttgtcaaaatatttggctgttttgacagatgggtttgtttagctttacagatactgtgatacggatcagaaaccgacacaatgatgtcattcccacaatggcccagggtgtgattgaatacaaggagagctttggggtggatcctgtcaccagccagaatgttcagtactttttggatcgattctacatgagtcgcatttcaattagaatgttactcaatcagcactgtaagtgtccctcatgagtcaagagaagaagctaaatgagatgtgttggcatattttaaatttatttaggaaagttccatttaggtaggaaatttagttttaccttttggctaattaagaaaaataaatagactgccatcaagaaaggtgtttttattgaatgtaaaatactatgtttatcctaaaggaaaatatttgttctgtttggtacaatttaaacagtattcagatttggaaaagagcattaggtggtttagcttattttgttggtttttttcctttttggatagctttattgtttggtggaaaaggcaaaggaagtccatctcatcgaaaacacattggaagcataaatccaaactgcaatgtacttgaagttattaaaggtaaatactgacatttctccttgcaaaaaaagatacaaaaatcaaaattattgttatttcttactattaaaacatctatttgtatcatgagataaaatggtaggcacaaatgcatgggtttgaaaataaccttatagtattatttgtgcattatgtataggatgactattttattgatagaattatttgttaggcaaagtttggtgatactatagaggatatcttttttgttttgttttgttttgtttgagacagagtctcactctgttgcccaggctggagtgcagtggtgtgatctcagctcactgcagcctctgcctcctgagttcaagcgattgtcttgcctcagcctccccagtagccgggattacagatgctcaacactacgcctggctaatttttgtatctttagtgcaggcagggttttaccatgttggccaggctggtctggaactcctgcctgcctgcctgcctgcctcggcctcccaaagagctgggattacaggcgtgagccaccgagcccagctgagggtatctttcacttaaaaaagaattgaagtccctactgccctgtttctaattcttacactatgagcagtaattcataacaatttggtttgaatcatttcacacttttttctatttataccacttgtacacatacacaattgatgttggtcttacattgttgtttttagaaaatggggtgctctatgtttttttctacaagtttacagacatcttgctgttcagtacatctggatatgctccaaggttttgaatggctctatggaatgtatcagtatgtgttaattaattctcctgttcatgcacacttaggttgttttaatttttttctgttaccaccaataccagcagtactgctgtgaacatccttaaatacacgctcacttttgctagtattttagaggtgagattcctagaattaaaaacatttaaatgcatataaaattttggtatctccaaaaaggtttcaaacaatggataagagtgtttcctaaccaactcttaagttttgttacatagatagcaattattttctccagcctgttatttttcttttttacattgttggtgtctttttagcatatagacttttacattttttttgtagttatatttgtcattcattgtttatggctattcagctttgtcatgtcacacttagactttccctgggccaggcacagtggctcatgcctataatcccagcactttggaaggctgaagcgggtggatcacctgaggtcaggagttcgagaccagcctggccaacatggtgaaaccccctctgtactgaaaatacaaaaattagctgggcgtggtgacccatgcctacgtagtcccagctacttgggaggctgaggcaggagaatcgcttgaaccagggaggtggaggctgcagtgagccgagatagcgccactgcactccagcctggttgatcgagactccgtctcaaaggaaaaaaaaaaaggaaaggctttccctggttgggggcagtggttcatgcctgtaatcctagcaccaaggcaggaggatggcttgagcctgggagttggagacaaacctgagcaatatagggagaccatgtctctaccaaaaaaaaaaaaaaaaaaagcagactttcaccaaactatcaaagtatattttcttctgtagagagttcaagactttgatttgtcaataccattgccatcttaatgcgtgaaagagaagtatatttattaaatccttttttgttttgttttgattcacactagatggctatgaaaatgctaggcgtctgtgtgatttgtattatattaactctcccgaactagaacttgaagaactaaatggtaagcctgatgttgtctttttctcaataattagtgctttgattacttgataagggataagaatttaaatgttttaatggaagatgactttttatcaacttcgttggatatgaaggctaaaggatagtaatcatgtaaaaaatatatctataaacatatgtaatttagtcagattctttatgaaaagatttggctttttgtatcacattttctttatttttaattgataactttgattctttgcttattttttattttctgtttagtcatagaaagaaaatgataccaagaaagttacatttgacttttacatgcacttcactaatgtaagacttaccctttttctacttcctgagttgtaaataattttctgttgttgaggacatagactggggttataaaagaggaaagaaagatgctcatctatttgagaatctgtttgtctctgatggttttctttttaccctgattagtgccttttggacaaaaagggtttagatgccttgaagagggattgatgagtctctttttcctgaaagcatggtagtttgacagaaaaaagcatttcctaagatgacactttaagaaggtgtgggaagaataaaacaaaataggcttttactaagctgtattctggaccttagagtgagagagcagtgaagttatgcaattgaaaatagcattgcttggtgattttctaaagccatattaactcttttgagccatgatggtagcatagcatttggtaaataacaatcacagtgtacaagtaagtgatagtttgcaaacctgaactgctgtgagcaatttccagatgtcccatttttgttcccaagggggagtttattcagaggaaggtctgatttattggttgaattagaattctaagatatcatgagtcttaatcatttgttctactaaatgtctgttttatacacacccctatcaccacccccagtggggctcctattaagtgtttaaatgtagaattaattactgtctcgagaaattgatgctagctcatattttttattcagctttatatccatcgaaatgcctgaaataaaacaatattccacccaggtgaaacattttgaaaatggcttaaagaatgtatgggctgggcgcagtggctcacatctataatcccagcactttgggaggccgaggcgggtggctcacaaggtcaggagttcgagacaagcctggccaatatggtgaaacccgtctctactaaaagaaaaatcagccaggcgtggtggttggcgcctgtaatcccagctactcgggaggctgaggcaggagaattgcttgaacctgggaagtggaggttgcagtgagccaagatcgcgccactgcactccagtctgggcaacagagcaagactccgtctcaaaaaaaaaaaaaaaaaaaaaaagaagaagaagaatgtatgcatgcatgtgaattggactgtggaatttaaagattttaacacttctctatttggaaagtaaaattcctacccgaaagttaagcgatcttaaaaaagactttaccatcctagagaaaaatgggcgcatgggttggttcgattgtgatgcaagattgtgagaagtgaccacaggactcttgtcatcatcagttgtaaatatttgtgggtatgggttcaaacactaatacattgaagaaatggtgtggcagttctcccccaggtaatactgtcctccgtagttaatgttttcttttcatcactacacagtttattcttaaaaatgctttaagcacatctctctgtactttcatatttttctcttctgctctgtagcaaaatcaccaggacagccaatacaagtggtttatgtaccatcccatctctatcacatggtgtttgaacttttcaaggtttgtaaaatagtattacataacctttaccagtacttttctgaggttaggaatctgctctgaaagccaaatattccactaggttctcctattaagaagtgccatttcacatcagtatcatatcacattgctggagatcagctttttatcaacacagggagacatctccatgtagtggtgagctcagactatggagtcagaaagacctgggtttgaatcccaattatggctcttaatatgtgtgtgaccttgggcaagtcactcaacctctctgagcctcagtttccttttctgtaaaacaagaatactgtccaggattgtttatgactattgggaataacatactaagtgtccagtacagtggcaacgtattacatataggtgctcaatagagttatctttatgtttttataaaacaatatttagaagagtgattctcaacttgctaccctcaaaggaccagaattctttttttggtctggcttttcttgggagggggaggtcatttatattgacttacagggtttctgctgtaatctttgctctttacaacaaaatttgaaaacaaattatgctactaatattgagagtatcttttttccccgccaataatacttgctggttgacaagaaaatgggtgaggagtgaggggcacaggtcctggtgggtgaaaatgattgccctctatcagaagcttgtagtctctcttcagttgtgtttcatcagccagcagcaaactagaggaaagagggggtggctttcaatctgataatgtaaaggaaaagtgcactgaaacacagaaaaactgaccgaatatcttagaacagcagcagaatgttctttcttccaagacagcaaaaatgtatttaataccttacaaaatcttttttaaaatatttattttattttttgtagagttgaggtctcactctgttacccaggctgtccttgaactcctggcctcaagcagtcctgccccagagtgttgggattacaggcataaaccactgcacctagccctaaaatctttttatccaagtagttaaacaagtagtgatgggcacttcaagcattaacacgaattttttccttgaaattccagtggcataaagatcttgtgccctatgattgaggcactccgtattatattgtacataatgtcagtaataatggctttcacctggaacctaatcttaacctgcctttggtggaaatgatggaatctcctccataagaggactcaatcgcaattgctgtgccagggccacacactcttacttccaaattcggatgcctttttagttacatctagtttatatcattttctactgcaatgctgaatgtcatgatattgtttaaggcttctgatatgttggcactgtgtaccctatttcctttagaaattagtcaaagcagctttacaatgacaatacccttaatttcaaactagagataaagggattcattgctccatcaaatacgaccatcgctgttactactatatgaaaaaaattgctttcctttaaagaaatttatgacagttttttaaatagttctaaaaatatagctgaaactacattttcaaaaatgttttgcccatcatttactaaaattataaaagtgtttgaacagagttttctgctttaatgtaactagttaaaagtgttttgaagtctgactttggaaaataagcaaaatttagttggagtctttaggtcagaatatccttcaaatcccccccaaattgactccattaaaaaaaaaactttaaatgtggttataagaattgtgattctttggcatatttccatcaaattttaaaacttcaaatagtgcatatgtacttgaaaattacactttctcttttctaaaaagctgtatttttaatacaaccctaatgtatttcagaatgcaatgagagccactatggaacaccatgccaacagaggtgtttacccccctattcaagttcatgtcacgctgggtaatgaggatttgactgtgaaggtaaatgtgtttaatggtttgttttcttttttttttttttgtaattgatgaacagacatgcaaaggtaaccatacgcataatttctaaaagacataatctactctcaggggaaaagaatcttgtctgtaatagataataagcacattgcttcattgagctggtggattatagttatcccttgagtcttttctatgcaggtcccccgtcgaggtgattcaagttaaaataaatcttggagacagacaatttatcattaatatctctttgataagtaagatctaaaatatttgggtagttgcagtattatggagatagtattttatatataatttaaaaaattttaaaacagtgctttctaatctactggtttcatttgattctcatgacgtaggtaattttatcctcacttttacaggtgtggagactaagacacagtgattagctcaggatcacacagggcagaaatgctatgggacatgatatccagtcttctgtccccagtgctaggccttttctattacattgttcaggtggcccagtttcttcttttacattttattaaaaattgttttctgtcacccaggctggagtgcagtggtgtgatcatcactcactgtgaccttgaactcctgggctcaagcaatcctcctcccatggcttccagagtaactgggactgcaggctgcaggcatgcaagcctggctaattaaaagaattttttggtgggtagagactaggtctcactttgttgcccaggctgatctcaaaacacctggcctcaagtgatcctcccaccttggcctcccaaagcactagtattacaggtgtgagccactgtgcatggctccagtttaagagtatgatagtgtttttcttttttaataatcatttaaaaatttatattaaagtaataaatgcagagactataaaaattcaaatgtgtcagttcctggccctttgtaggcctcattactcagagattcttagtctttctttacttttttttttttttttttttttttttgagatggagtcttgctctgttgccccagggtggaatgcggtagtgtgatctcgcccactgcaacctctgcctcctgagttcaagtgattcacctgcctcagcctcccgagtagctgggataacaggcacccgccaccacgcctagctaattttttgtattttagtagagacagggtttcaccatattggccaggctggtctcgaactcgacctcgtgttatccgcctgcctcggcctcccgaagtgctgggattacaggcatgagctactgcacctggcctaatgtttacattttaaacagtaaatattacctttctgttatagtagttgaggagttagctctctttaatagagcacctgctcccctcccctcccctagcccaagggccagtttccctatactattatcccaatatttaagtttgtatatgaaattcgaagctgagaataatcatcctgcaaaattttgaaggcatccattgttccttttttaaaaaaggtacaattcagtggaattcataaggttattcaagtattgccgctgtctcattttagaacattttcatcagtcctaagaaaaaacccaagtactccgtcaggcacagcagctcatgcctgtaatcccagcactttgggaggccaagttgggcagattgcctgaggtaaggcgtttaagaccagcctggccaacatggtgaaaccccatctctacaaaaaatacaaaaaattagctgggtgtggtggcaggcgcctgtaatcccagctattcaggaggctgaggcacgagaatcgcttgaacccagcagcagagggtgcggtgagccaagattgcaccactgcactccagcctgggtgacagattgagactccatctgaaaaaaagaaaaaaaggaaaatacgcagtacctatgaagtcacttcccgtttttctctcttctagcccttggcaaccactgatctattttctgtttgtgtatttctctttctgggcattttatataaatttaatcatgcagtatgtggtcttttgttactgacttctttcacttagtataatgttatagtatgcatttgtacttcattcctttttatgaccaaatgatattctgttatatggatataacacctttgggttatccattcatcagttgatagacatttggtttgtttctattttttggttattataaataatatggctatgaatgtttgtgtacaaattattgtgtgaacatgtgtttcagttatcttatgtatatacctaggaattgaattgctgaatcataggaaactctgtttaacttgagaaactgccaaactgttttccaaaggacctgcaccattttgcattgtcatcaacaatgtgtgaaggttcctgttttacctcgtccttgtcaacaattgtagtctgtcttttttattatagacattattgtgagtgtgaagtggtatctcagtgtggtttttatttgcatttgtctaatgactatgatgttgagcatcttttcatttgctgatcggccatttgtgtatctttgaagaaatgtagattaagatccttttttcagttttaaaattggctgtcttttattgttgagttgtaacggttctctctcatgtatatgtgtatatatatatagggattctatgtgtgtgtatatatatacacacacatacatatacatatatacatacatatgtgtatatatacgcatatatacatatatgtgtgtgtatatatatacaccctatatatattctatttgtgtgtatatattctatgtgtgtgtatatatatatacactctctctagatatatatatatgtatataggggttactagtccctgatgagatgtatgatttgcaagtatattctcccattccgtgggttcttttcactttcttgatagtatcctttgaagtacaaagttgtgtttttttgttttttgcttttttaaatagagatggggtcttgctatgttgcccaggctggtcttgaactcctgaacttaagcagtcctcccaccttggcctcccacagtgctgggattacaggtgtgagtcaccacacccagccaaagtttttagttttgaaaattttcaatttttttttcacattgcatgtgatttcagttttatgtctaagaaaccattgcctactccaaagtcttgacgacttatgcctatgtttctaagagttttatagttttagcttttatatttaggtcttcgatccattttgagttaagttttgtacatggtttgaggtagaggttcatcttcattcttttgcatgtggatatccagttgtcccagtactatttgtgaaaaacctattctttccccattcaattgccctgtcacccttgtcaaaaatcaattgctcataaatgtatgggatttatttctggattttcagttctatttcattgatgtatatatctctcgttatgcaagtacttaatgcctgtctcaatgattgtagctttaagttttgaaatttgcaagtgtgagtcctacaacttctttttcaagattattttggctgttatgggttcttgcatttccatgggttttaggatcagcttgtcaatttctgcaaaaaaacaatgccagctagaattttgatgggcatcatttgggaagtgttgccatcttagagttaacaatattaactcttctaattcatgaatacaagatatctttacacttacaacacagggcatctttataggtcttctttgctttctttcaataatgttttgtggtttttagtgtacaagtcttggacttttaaatttattcctaagtattttattatttttgatgctattgtaatggaattgttctattaattccattttttggattgcttattgctagtggataggaatataactgatttttttgtactgatcttgtatcctgcatccttgccaaatgtctttattagtgctagtaaatttttgtggattacttagaattttctatataaatgatcatgtctctgcaaaaagatgtaagtgtggctagaacctctagtacagtgttgaatagaagtgctgacaggagacatccttgtcttttttctgatactaagggggagaacttcttgtctttcactattaagtatgatgttagctctgatttttttcatagataccctttatcagattgaggaaatttgcctgtattcttagtttgagtgtttttatcatgaaaggatgttcaattttgtcaagtgctttttctgtgaagattgaaatgattgtgtggtttgttctttgttctattaagtagtgtattacattgctttttctatatcaaaccaaccttgcattcttgggataagtctcaatttttttatggtttatgttgttttgttgaggatttttacgttgatgttcataaggtatgtttattggtctgtagtttcttgtgatgtgtttggttttagtatcaggatgacactggccttatagaatgagtagggaatttccctctctttctacattttggaagagtttttgaaggattggtattaattctttcagtgtttggtagaacacagcagtgaagacttctgggcctgagcttgtctttgtggaaagacttttgattactagttcaatctctatttgttatatattcatatttatggatagctatttataaatataaataataggccaggcacggtggcttaacgcttgtaatctcagcactttgggaagccaaggcaggtggatcacctgaggtcaggagtttgagactagcctggccaacatggcaaaactccatctctactaaaaatacaaaaattagccaggcacggtggtgcgtgcctgtaatcccagctactcgagaagctgaggcaggagaatcacttgaatccgggaggcagaggttgcagtaagctaagattgtgccattgctttctagcctgggtgacagatcaagactctttgtctcaaataataataattaaataaataaatataaacaatacatttgatatctatttagattgtccatttcttcctgagctcctgagctgtgtctatagtttgtgtgtgtttttttgtttgttttttgagacagagtcttgctctgtcgcccaggctggagtgcagtggcaggatcttggctcactacaagctccgcctcccgagttcacgccattctcctgcctcagcctcccgagtagctaggactgcaggcacccgccaccatgcctggctaatttttgtatttttagtagagatggggtttcaccgtgttagccaggatggtttcgatctcctgacctcgtgatccacctgcctcagcctcccaaagttctgggattacaggcatgagccaccacgcccagcctatagtttgtgtttttataggaatttgtccatttcatttaggttatctaattattacacacaattgttcatagtattccctaataattctttttatttttgtaagattggtagtgatgtccccactttcattcctggttttataaatttgagtcttctttttttttcttggtcaatatagctaaatacttatcaattttgttaatctttctaaagaaccaattttttatttcattgattttctccatttttctattctgtatttcattaattacactctaggctttattataatttccttccttctgcttgctgtggtgttattttgctcctgtttttctagtttcttaaggtggaagttttggttattcatttgagacattttacaactataattttactttaagcactgctttgtctatcttacaagtttttaatgttttgttttcattttcattcatctcaaagtattttctagtttccttttggatttttcccattggttaataggattgtgttgtttaattgccacatacttgtgaatttcccatgtgttctcttaatcatttaaatttcattctgttgtgattggaaacatactttgtatgatttcaagtatacatctattgagatttgttttacagcctaacatagggtctgtcttggagaatgttccatgtgtacttgagaaaagtgtgcattctgatgctgttgaatgttctacagatagctattaggtttagtaggtttgcagtgttgtacaagcttgtctttccttgttgatcttgtaattgttatatccattgttgaaagtggagtattgaagtcatctccaattattgttgaattgtctatttcgcccttcagttccatcagttttgcttcatgtattttggagctctgttgagtacatatatgtttttaattattatctcttttttgtgtattaaccttatatcattaaaaaatgtactattttgtctcttataacagtttttgtttaaaagtatattttgtttgaagttagtgtaaccatcccaactctttttgtttctgttttcatagtgtaactttccagacttttagtttaaacctctttgtgcctttcagtctaaaatgtgtctctttatagcatacagttagaatttaaaaccattctgccaatgtccaccttttaattggaatgttcagatcaattaaatttaatataattactattaatgtaattaacagtaattttggtttatgtttgccgttttgtcttcaatatatgtcatatcattttttattatttctccattatcactgtcttttgttaaaatattttgtattatatcattttaatttcgttcttgtttttgttactatatttctttgagttttttaagtaattatcctggggattacaattaacaccttaatttataatctagttcagattaataccaatttgctttcaatagtatacactgacttttctcctaaataggccttttcccctccccacccatcctttgtgctgttattgtcatataacatacatttttgtacattgtgtgcctgtctacagagatttataattattgttctattcaattgtcttttaaatcagataggacacaaaaagagttacaaacaaaaaatatactcatattttcctttagatttacttttgtaataacttttactggcactgtttatttctaaacatggattcaatgttttgtctagtatccttttgtttcagcctgaaggattccctttggtatttcttgatagcccatgtctgtcagtgatcatctctctcagtttttgcttatctggaaatgtcttaatttctccttcatttttgaaggatagttttgctggttatagaattcttgttgatagtctttttctttcagcactttggaatatgttatctcactgccttccagcctccatggtttggatgagaaatcagctgttacaatcttattgaatattgcacatatgtgatgagtcatttctctgtttctcagactggataatttcaattgacctgtcttcactctcactgattcttttctttcacatgctcaaatatgctgttgaacccctctagtgaaattttcatttcgtttatttttcatttcatttattgtacttctcaattccagaatttcaacttagttctcttatataatatctatcctgtttttttcacctttgctaaatgttgatgcatatcattttattgccctatattttattgttgtatcgtttaaaattttctattttgagacatccttatactttagttctttagtgtttgtttacggagtgtgagtttactgactcaggtatagtttattgactgatttttccttgcctgtgtatgggcaatacttttttgtttttttcatatcttgttatttttatagaaaactggacatttaaaataatatattttgacagctctgcagatcagatactgctgtctccccaaggctgtctttgttgttgttttgtaattttttttttttttggagttaattcttttaagtttgaattctttgttgtgtgtggcttctgaagtctctgctcatttagcttagtggtcagctaatgactggactgagatttcctcaaatacctggaatcagtaagtttcccagtctttgccaagggactctgtgtgtgtatagaagtgttcaggagaatatcttcaacactcagccaggcagttaacaactgtgccttaacctttaggtcctgctcgcatagagcaattagaggtgagagcttagggccttctcagtgtctttcctgagcatgaccctgggcatgagtatggccttccagattcccaggagatagctgaggttttcaaagcccctatggctatctcattccctagaccttcctgttaagctttttggttagccttattgtttgccctagctgttgtccagtttcttctgcagccctcaaattaatcagttacttctaattgtttttgacagatgtttccagggatgggggtggggtgcaagacttttgtactggggagctcagagtcaggtcaaataaatacagtcttcccagcagctaccaggctgctggtttcactctgattgcatattgattggagggagggggagcagatgggagcaagttaaaatgcttactgttcttatacggattcagttgttttacttgaataaatgttccccagattgctgcatgcctttagttaatttccagaattctgtcaaagtagattctaaatgatttttgcacccccctcccccgctctttctttttttttttttttttggtgctttgatagaggagagacttttgcaggttctttctcttctatttttgctgatgtcactcctgctgttctttttgagaagacaacgtttattacaattcctcttccttcttatgtgaccagttttaggtgtctacttttgtttaactagagtttttaacttttttttttttcttttttttaagctgtgctctgaagtttcagtgatgtgacttggtgtgggccttttcttacttactgggctgtggtctttgaacttcccattattttcttgatattttccttttcactgtgtgtttagtctctttctgatagtcatattaagaggatgttgggcttcatgacatcactccctgttttttatcgcttcaactttttattctattctgtgagatttccttgacttcagattcccagcccttctattgaacttttatttccattatcttacaaatttccaagaatccttatttttaaaattaatccctttttagaattctgctctagttttattttattgctctaaggatattatttttttttaattaatttgcctctgtaccctgcattgtccgtttcctgagtttccttttgtccgtttctctctcgtttgttcattttaaagagataggcacaaaaaagtcaataaatggcgatgccatctgtttgctgtaaaaacaatatgaatgtatcacttttttttttttttttttagctcagatgctaatgtgtctattttttggttagttgtgtgtcagctactttcccgttaaggtttacagtcaagaaaagacccattggtcttctggtttggggcttaagttgtgctgcagcatgttctttcttgtacctttttctgcttctattagaagtgctttatttagcattttggtctgcagctgctttctattgctattatccgtcattgcatagatcaaggtttactgagttcttagactctcagaagagattacttctgtgctggtggatgggcttaacctcaggaatctgtctttatgatgtaaagaaaaattcataatgacccagcaatcctactcctatgtctatacctcaaaggattgagaatatttaggcaaaaccttacacacaaatactcatagtggcactattcacaatagtgtacaggtagaaacaacccaaatatctatcagctaatgaatggataaacaaaatgtggtatgtccatacagtggaatattatttggccacaaaaggaatgaaatactgataaatgctacaaactggttgttgtaacattgaagacattatgctaagtgaaagaagccaatcacaaaaggccacatattatatgatattatttacatgaaatgtccagaataggcaaatatatagggacagaaagtagattagtggttgcctagggatatgaccactaaaggagctagggtttcttttggaggtgatgaaaaattctaaaattgacagtggtaatggttgcacatatcgatgaatatattaaaaaccattcaattatatactttaagtgcattaattatatggtatataaattatttttatcttttttgagatggagtctccctctgttgcccaggctggagtgcggtggcatgatctcagcttgctgcaagctccgcctcccaggttcaagcgattctcctgcctcagtccctagtagctgggactacaggcgcctgctaccacacctggctaattcttgtatttttagtagagatggggtttcaccttgttggccaggctggtctcgaactgctgacctcaagtgatccgtctgcctccgcctcccaaagtgctgggattacaggcatgagccactgcgtccagcctgctatgtaaattatatctgaataaagctgtttaaaataaaataggcttgtaaaggtctcaaaaaagagtgttctagaagcctgctatgttaattatatttgaataaagctgtttaaaataaaatagaaaggcttgtaaaggtctcaaaaagactgttctagaagtcctgtctgtattaggctctgccttcacctgttgtttctgctcctcacatccaaggtcacatgaaggcatctcctcttgcagcctctctttacatgttgaattcttgctttttcttcagtcgagctttgatccccattacttaccctagacttttagaatcaaggcttggttttgtttcttccccattttttttagcttgttcaaattattgacattttttaccttttatcctcttgctaaaaatcctatacaaaagttgttgtttctgtcttacagccctagctgctctttcaattctgtgtttagtatataatctataaataacctatgtgttatagccacatgtcttttttttgtgtgtgtgtgtttttttatagatggagtgttattctgttacccaggctggaatgcagtggcagaatctcagctcaccatgacctctctttcccgggttcaagcaattctcctgtctcagcctcccgagtagtggggattacaggcacgcaccaccatacctgactaatttttgtatttttagtagagacagagtttcaccatgttggccaggctggtcttggaactcctgacctcaagtgatctgaccacctcagactcccaaagtgctgggattacaggtatgagccacagcgcctggcctacatgtcatttaaattaaaacttaaatgtcttggttcatttactgttgatgattttacagacttaacagtgaaaacgctgttggctaagaaactttaggaactctgggtgaatacagggaatgtcctggctttagagctgtcatctagtcagtagtggttcatttcatctgggcctagagttcacatgaattaacctagggagcctagtgttactgggaataggaagttagggatggcagctcttggttagatgacattgacaagtggtgcttttgtgcactgaagagaaaactttaaaaataattggcaaacttctcttccttggccttcctgttgacattacttatctcattatcttaataaggtttcgtgttagttttcacatctctctttcaatacatttgtcatcaaaggtaccattcttcttgccttgaatatatacagactaaatatctgtctctccattattccctccctcccttttcctgaagaacttggatcctccaataatctattactgctcttttggaaactcttttgcctactttaaaatccactggctccagtttattgtattgttggctgcaaagcaaagtactactttgactgtagtttctaactctattcctgtggcttagtttgccctttacctctagcaacatgatgcttctcacatcctctctgtcctgtctgcttatcccctcttattttcccatgcagcctgaggctggaaatgacttcttattttgtacttgctaggttgttgttacagtctccgtggccaaaaggttaaggaaaaccaggaaatatttactcaagtctacctttttatcttagtatctattctaatatgttctttactcccttcatgtatttatagaatacacatacttcctattcatgttaactagcaaatgtgcagcagagcattgaattaaaggatgagtaattaacaaattgatggatttctcaaaatacccagagctctttattcatcttactaaaataaattactttacagggccaagagcaatttcaagcataatgctgcataaaagttttctggtttttttttttttttttttttttttttttttactgagcagagtctcgctctgtcacccaggctagagtgcagtggtacaaccttggctcactgcaacctcctcctggattcaagagattcttgtgcctcagcctcccgagtagctgagattacaggcgtgcaccatgacgcctgactaatttttgtatttttagtagagacagggttttgccatgttggccaggctggtctcgaactgctgacctcaagtgattcgccggccttgcctcccaaagtgctgggtttataggtgtaagccaccacacccagccacaagttcctaataaagtccttgtatactttattattgatagtgtaattacttaattttagatgtattcgaggcacatctttcaatggtatttcaaggcagatttttttagttataaaaatcaaaatatctacataattaccattataaaggtaatatatatatactgtaacaatttttaaatatataaaaactcaactataagccattcagcctattgacttttaatacatattattcagtactattttaatctatatatacataaattaaaagcagatttgtttgtgtatgacaactatattgttataggcagtaaaatcaattcagattctgtgacaaaggaaaatggctgtagtagattagaatataagctggatagtagctaggaaaataagtccatgttaactttgaaggaaaagaaaaattgtatgtaaataaattactaaatttgatttgccatactgtttgagttgaaaaatgatatgaaaatgtaaagacctacatgccttacgaacatatcagaaagttttctggggttctaggctgtaaaattgctggtagatggaaatacaaagtagtggttctgtctttttctccctgaaaatgaaaattatactgtttttttcctgttaaagtaattgtgaagaaaattcagaaactgaaaaccccaaacaagaagagaaaattactcattctacagacaataaaattagatatcatttcagacctttttataatagaatttttgcagagtattataaatgcttctttgtaactgttttttttttgtttgttggttggttttttttgctgcttaactatctcttatgccagtatatggagttctatataatatctaattaatggttaacaatattctattttagaatgtactttcttttacttaactaatcccctatttaggttgtttacttttaggtattctgcatagagctgtgatggatgttctcatatatactttgcatgcttttctgcttattttctcaggataaatttctggaagtgacattgttgtgtgaaaggtacatgcttttttttttttttttttttttaaatagaggcagggttttattctgtcacccaggttggagtacagtggtgagatcatagctcactacagcctcgaactcctgggctgaagtgatcctcctgcctcagcctcccaagtagttggggattacaggcatgcactaccacatctgggtaattttaaagttttttttttttttttttttgtacaaacggagtctcactatactgcccaggctggtctggaactgctgggcccaagtgatccccctgttatggcctcccaaagtgttgggattatatgtgtgagccaccagacccacccaatatatgcttttctttttttgtttgtttttgttttcttaatttagagacagtggctccctctgtcactcaggctggagtacagtggtgccatcatacctcactatagcctccacctcctgggctcaagtgatactccttcctcagcctcccaagtagctgggatcacagttgtatgccaccatgcccagctaattttagaaaattttttgtagcgatggggtcttactctgttgtgcaggctgatctcaaactcctggcttcaagtgattctcttgtctcagtcacccaaagtgttgagatcacaagcgtgaatcaccatgcccagcctagtacatgcatttttaatttttttttttttttttttttttttttgagaaggagtcttgctctgtcacccacgctggagtgcagtggtacgatcttggctcactgtgacctccatctcctgggttcaagcaattgttctgcctcagcctcccaagtagctgggactacaggcatgtgccaccacacctggctaattgttatatttttagtagagatggggtttcgctgtgtgggccaaactggtcttgaactcctgacctcaagtgattcacccatctctgccttccaaagtgctgggattacaggtgtgcatgtttaatttgcttctagtcaccatgctgcccaccagaaaggagtaacagatttatagttacatacaagatagggttaacttgtgcccagttctgtgctataatgcactgttaatgagactcccggaaatatacaaagccacagcagtattatgatggagtttatgtattagagtttcacatattagaggagttgggttgggttcaacagcgagggaaatgcttatattggcaacttggattgtgttgtattcattttcaaaagcagcactcaggctgggtgcggtggctcatgcctataatcccagcactttgggaggccaagacaggcagatcatgaggtcaggagaacgagaccattctggctaacatggtgaaaccctgcctctactaaaaaaaattagccgggcatggtggcaggcgcctgtagtcccagttactcgggaggctgaggcaggagaatggcatgaacccgggaagcagaggttgcagtgagctgaggtcgcaccactgcactccagcctgggcgacaaagcgagactctgtctcaaaaaaaaaaaaaaaaagcgctctcccaccagcagttaaactgtgatgctatgagtatgtgttgatattttgctgttttgaggatttgggcatagagcacgatccttttcttaccttagatgagtgaccgaggaggtggcgttcctttgaggaaaattgacagacttttcaactacatgtattcaactgcaccaagacctcgtgttgagacctcccgcgcagtgcctctggtatgttatcaagaaataatgaagtgtgtttctgtgaattgccttccacatgctgtagctgccaaataagtaagttaagccgtcatgtagggtactccacaaggaagaaagaagctcttagaaatgcacactttcccctaaatttaaacagccttcagaatacttttttttttttccaactgaaatgggcacgagacagagatttggagttcttgttacaaagtttgatcgtgatatagcagtagttttcctgtgtaaaaccacattttgaaatatggttaaccacattatttctaatgtggggaataaattactggttttagtagtgtttggtcaacactgaattactttttagtgttgacttttttctcaagtacttgtcattagaatgatctcatatcctagactgaaaaataagactaaaattctaatctgttcaatcaccaacctgaaggcttaaattataattgctttgatggtgttttgttaatcttagttccacctattttcaggtttaataggatcaacttttgaattgactccatccttatctttatgttctaactcccccacaaaaagtatgttgccaaaattttgtctgtaattctagaagaactctattcttctaggcttggaaacttctctgacatttccagtagagttatgctgtaacatgatgggggtatagtacaagatagatctattttagaccccttcctaggaagttactaggactttattctgatagttttgtgtccggaattggtgggtttttggtcttgctgacttcaagaatgaagctgcggaccctcgcagtgttacagttcttaaagatggtgtatccagagttacttcagatgttcagatgtgtctggagtttcttcctcccggtgagttcctggttttgctggcttcaggagtgaagctgcagaccttcacggagagtgttacagctcataaaggcagggcgtctggagttgtttgttcctctcagtgggttcgtggtcttgctggcttcaggagtgaagctgcagacctttgtggtgagtgttgcagctcataaaggtggcacgtccagagttgtttgttcttctgggtgggttcgtggtctcggtggcttcaggagtgaagctgcagaccttcgcggtgagtgttacagctcataaaggtagtgtggacccaaagagtgagcagcagcaagatttattgtgaagagcaaaagaacaaagcttctacagcctggaagggtaccagagtggcttgccgctgctggctgtgggggcctgcttttattcacttatctggccccacccacatcctgctgattggtctattttatagagagctgattggtccattttacagagagctgattggtgtgtttttacagagtgctgattggtgtgtttacaaacctttagctagctagacacagagtgctgattggtgcatttacaatcctttagctagatacaaaagttctccaagtccccacccgattagctagacgaagagcgccaattggtgcatttacaatcctttagctagacacagagtgctgattggtatgtttacgatcctttagctagacagaaaagttctccaagtccccacccgacccagaagcccagtccagctggtttcacctctcagttttgcctgatgcatagcacaaatgctatggctgcagctgtactatagttgaaatgcttgctctagtaatgtccttctccaattcagatacatgccctccaggagttggcatccatatgtcaaggggcagacagacaatgtcaaatgataaacatgagcatctttttacaagtctagttttatcctaaaaagtagagggatagaagggagctgctgtttttgtagtaaacgaatattgtagaatttttatggagagcggcatagtgagctagtccagactctggatctaaactctttggttctgtttctgatactgctgcatcttagatgtgcagccttgggaaaattattgacctctggatgccacagattccccacttagaaaaatggagttattgtgagaattaagtgagttgatacatgtaaaaatgctctttatggtgcctggctcatggtaaatgccatgtaagtgtgtgttattttaggatgtaaaatgtatgtgaatttttaagaaaataggaggcttgacctggaacaggctcctccatacatctacatgcccttaacaaggctaagactgttactaatttcttgcagagcctcctttctgctgacatcgctttgtagatggtcccagtcagcaggcagtagggtagctggagaaaggccagctgatgcccacaggagtggctttcttgtctacctggttacggagggcttcctccctgtggataccttcttgtgggtctttgcatggataggctatcttcacactgtaagtccggagaggaacatccacacatctctgttccagacctccttctcatccttcactcagttttgttctttccaagtccttaacaagccagccacttgttttgccactgcccatgctggaagggtttactttcactgctgtctttcaggcctgccctccaaccttgagagggattgtagtaggaaaacggcagcttactttcagatggtgatagcacatggggtagatccaccagtggactaggcccatgttgtttttcttccctgttaactggttataggggaagccctatgagtcagcccataagtatggtcaagagagagcacgtggtaaagtaggtcaggtatcatgggagcctgaaccacctgctcatacagttttcttcgggccacttctaagaccagttaatgtatcgctcagagtcacaacaggaaagaggtagctcactcaaattatgaaagaaggcctttttacaaagaaactaattacataggtgtaggtaaagatagcacaggaacccagggctagcagcagcaaagctatcaccaccttggatcatgagggatgaggagaaggcaaagttagcagaacccagaggaagggaaagctgcagagtagctgcttactctccaggggcccggcctgcccaaggcaacctcagggaaggaaccaggggagtaaatacccaccttgacttcctctgaactcctgctgggttttccaagacatgctgtaagcagagggcatgggaatccagtgacaatccaggttagcctcccagggcagggaggtgtgaaatggaatagttgatttgtacgggcaaacagagactctgggtagaaaagtcaagttatagttggtggagttaggtaaagctggagcctgggtttgtgaatagcactctgattcttgagtccatacaagctcatagttagcatgctatatggaatgtcatcaaacatatgacttggtaataaaaaccattttcccatttatccagatgttttgttttgtattaaggaattggtaggatttatccagataaagaggctattctggatactgggaccaaaatgaacagacacggaatgatatgtttaaggaacttaagagcaagaggtgtagttgtgctggactggaaagtgggaggcagagacctgatcttaccaggtctagaaagctctttttagaagcttaggttttgatttctaagacagtggggtaggggtggtgggagtgctggtatgttttgaagatttttaagtggaaaagtgacccgtcagtgagaattaagaaagtagatctatattagagatatctccaggctcagaatgtggctggaaatttatgatattaagtcatgagatatatctattaggctgcaacaagccattttctactcttgctcctaaaagagataacacattttatatgatattgccaagagcagtattgagataccatatccggaattggtttcttctggtaggttcttggtcttgctgactttgagaatgaagctgcggaccctcatggtgagtgttacagtttttaaagatggtgtgtctggagtttgttccttcagatgtttagatgtgtccagagtttctttcttcggtgggtttgtggtcttgcttgacctcaggagtgaagccacagaccttcgcagtgagtgttacagctcttaaaggtggcatgtctggagttgtttgttcctcctggtgggttcatggtctcgctgacttcaggagtgaagctgcagaccttcgtggtgagtgttacggctcataaagatagtgcagacccaaagagtgagcagcagtaagatttattgtgaagagtgaaagaacaaagtttccgcagtgtggaaggggacccgagcgggttgccactgctggctggggtggccagcttttattcccttatttggccccacccatgtcctgctgattggtccattttacagagtgctgattggtgtgtttacaaacctttagctagacacagagtgctgattggtgcatttacaatcctttagctagacagaaaagttctccaagtccccacccgacccagaagcccaactggcttcacctctccatcccccctctaaacagtataccccaactgttgttgggaattgggcgatgaccgctgtagctacttcttgctggataggggcaaagaaggggccctgcagttgtagtgtcctccagaggggaactctttaggccagtgaaagggccagcgggtcagtccaggggtccttgatagaagttgttagttgagttcatttgggattccatttgtaagaccatctatagcttgatggccttgattctagaggaaacaaatttgacaaggaggttaaaaatacagggtccgaaggtgagtaatagcaagatggctgtcacaggacctagaaaggggagaagccatgttgcccaactccagaggttggtataagagtttgaaaggtgttgtctgatttcggaagacttttcctgtaaacgccgggcggcatctcatactatccctgactggttagtgtaaaaacaacattcttctcctaagaaggtgcagagtcctccattctcagcagtgaggaggtttaggccttggcggttttggagagtcactgctgccaaagagtctatttgggattgtagagtaaggatagatttcgttatttcttgcaaactgtctaagaaatcctttgagagtgtttggtagtaggataatgaagtagataaactggctgttccggttcctgtagcagtggccatttctaactctgtaagtaggggtattagttgtatggccctgcgctgatggacttgagctttgaggggcactgatagggtctgatttccataagattagaagttaagataataaatgttacactgttaacttttagcaaactttacttttgttgaaaaccttgtaagtttggaatttcaattattccttgctattaataagacctcgttcagtccatattaacttaaaattggtatagatggctccttcctgattctgtaagtactttaaggtttggctgagtgcaaacagctcgcatatttgagcagaccaattattaggcaattttcctaactctgcttctacaatagtttccttattacttactgagtacccattgtgtctttttcccttaatcgcctgggaggaaacatctattgtcctgtcctgaagggagttcctcctgtgtctggtcggaccttcagatttagatcccctgttaggaaacctgctgggttaaggatttttgataggaaagctacgggttgtcagtggtctcagtgcttccgggctatgcccttgtttacactgacaacaaggtggtattggagtgttatagggttacagagaagaccttcaattatcagttataggttttaaatttaccctggcttttgaaggaatagggtacactgttttttctttactacttctatctctctttctctttgacttctttgcctctctctttctgactcctctttgtctcttcctctctctgactttttgtgtctctctttctctctctctctgactccctctttgtccctgtctcttcctctctctgtctctgactttgtctctttctttctttctctctgactccctctttgtctctctcttcctctgtctctctctctgactttctgtctctttctctctttcctttctgctggtctttccctgcctctgccagctgcttatgctgctcttctcccctctcctggagaagtccgcagaccaagaacccactggaaggaaccaattccagacacaatacgaccgagcaggccagcaaggaaaagcaatatgctttttcgagaccaaccacaagtcattttatagaaagaataaagagttttaaatgaccagagggaagtcagctgatacagtactcaagtaaacctcagcttaatcattgtcaatgcttaaatattaattatattaaatataatgcatctctcagatgcgggctctgatagccccgtggtactcaatggcatctatcttaattagaaaagtatttcagtgtgtgtctttctgaatagaattttgtttttctcatcaaacaggctggttttggttatggattgcccatatcacgtctttacgcacaatacttccaaggagacctgaagctgtattccctagagggttacgggacagatgcagttatctacattaaggtaatagctgtagtcttcttgatttaatatttcttttgatgataagaacagatgtccatacttaactgtaatgaaatttaactctaccacatgctgtttaaatagaaaaaaactatggttttttgctggggatctcacccattttgatagatgatcccctaaaactatggggaaagagatttgtatcctggagtgattaggactctgtctattaataggaaaaaaattgggttaaagtagagaatcataagttatatatcatacaagtttaattttaacataaaacacatgaatggacattgataacgccaaacttttgatgtactgccaaggctttttttttgtatatgggtctgcagattggagtgtcacattgtcttttttgcaaaagctgtactgacagtgcatcattttagtttctttaaaccaacaagtgcatactctttttggacttttatgcagtcctttacagatacctcctgactgatttgacagcaagttttatgtgactttccttcatgagtctttccaaaacattcatcttagttttcaaggaaacattcccctttttattctttgcttatgtaataaattttgtaattatcatgacagaattgtacaaacagatttgggaacaagcacaagtgactcttggtaagcatatagcttacctaatggacacagaagcacttagtctgcttgcctggagtgttcaatgcattaaggagggttccacacattttacatggtggaaaaacactaggttccatcattccccttcttcggctaactggtggctgtttatgcctgatttagtgactctagtttcttgttctggccactagatggcatctattttataggaaatgttgaagaatttatattggaaaaaatatctgaaaagactaaattctttctagatggtattttttgtttttttaaccatgtcaattgcgagggaaaagggcaacatcaatgcaatgtttttcttttttttttttttttgagacggagtcttgctctgtgtcacgtaagctggagtgcaatggcatgatctcggctcactgcaacctccgcctcccgggttcaagctgttctcctgcctcagccttccgaatagctgggattacaggcgcctgactaattttgtatttttagtagagatggggtttgaccacgctggctaggctgatctcgaactcctgacctcaggtgatccgcttgccttggcctcccaaagtgctgggattacaggcatgagccaccacacctggcctagtgcaatgtttttatgacaaaatgtaacattttgatctagcccaggagtgtccaatcttatggcttccctgggccacagtggaagaacagctgtcttgtgccacacataaaatacactaatgatagctgatgagcttaaaaaagattgcacaaaaaaaaatctcataatgttttaagaaagtttacaaatgtgttgagcttcattcaaagccatcctgggccgcatgcagcctgtgggctgtggattggacaagcttgatctagcctgtagatcaagaaattctggaatatttagagaaatatggaggtgaaaggttttttgttctaccttagggaaaatagaagataagaagtcttagagaatcattaaaattgtcaacatcaaagactttagcattatcagaatgagattttcttgttcagggtgttctgcatcttaggaaatgcctttggcctgggatggaaatactactgaaaaatcctaacttgaagaagataactagaaatgtagtttatctcaggttccagtgacttataggaagctgaaatacaatggagaattactggtaataatatatggaaaactgaaatcatgcatgatgcagaaatcttgtgcacagtgactgaaattggaggccggagaagacacagattcaaacccagggccaataaatgttcacgaaaaagctaagatgccttagacatagatttctatttattaataatgttataatgagtttttaaatttttatgtatttatagagtcaatatcttgctttgttgccaggccggagtgcagtggtacaatcataattcactacagccttgaacccctgggcttcaagtgatcctcctctctcagtctcccaagtagttaggactacacccatgtgccaccatgtccagctgatatttttattttttgtagagacaggatcttgctatgttgcccaggctggtctccaactcctgagctcaagcaatcttcctgtgtaagcctcccaaagcactgggattataggcataagccaccgtgcctggcttgtgatgagttttttttaaagcacagtgactatgctgaaaaaaacactatttcttctagtaaataattaaaatagagttcattaaatttatgtgcatctattaagatacatatatcgatttgtatgcttttacatttaaccaacttcttcagttagccaactctgatctgggtcatgttttgtgtaaaatttcagtccagcagcttccaggatggctggggaattactgtaagcaacaaactcagtcaacctgcacatcagtcagtgccatagatttcataaataacacgtttcaaatatacataccatttaaaagtatatttaggtggtataaggattaataagatactaatagaatattatttaatttgtcgtaacctttttgccattgtctattttctcaaataatgaattctaaaaaatgccagacttaataggtcttaggtttttctttttcaggctctgtcaacagactcaatagaaagactcccagtgtataacaaagctgcctggaagcattacaacaccaaccacgaggctgatgactggtgcgtccccagcagagaacccaaagacatgacgacgttccgcagtgcctagacacacttgggacatcggaaaatccaaatgtggcttttgtattaaatttggaaggtatggtgttcagaactatattataccaagtactttatttatcgttttcacaaaactatttgagtagaataaatggaaactgaattccatttgtgcccgttaaacctcctaaaggatgaaattgcacctattttacacttatattttcacagttaattgaacatatttttaaacaactgtagttttgggcaacttttcactttgtggtagacttcagaagtgtggaaatcttcgggtttctataggaaactagttttttttttttaagaaatactttcatttatgtttgctagaaacattttctaaatgatagtgattagctggttagccatcttcctgttatttggaggagttctgccatcttttattcggtagtgacagctgtaatatggtcttcatgtttatcagtgacttgactacaagtaaagcagaaaacagttggcctgtaatcacagaaccagccacccttcggcgtctacatgcattgtcttagctctgaggttaatttaccatttttaaattttattgtaaagaagtgtaatgactagctctctgtggatctatgccaaaatcatgggccatcttttctaagtgtacttctgattaatgcaaggggaaatttttatactgaaaacaaacaaacaaactagcagctactaaaatagagaagaaattgagggcaaagtaatatgtctccaaaactgaactgattgcttgttgagattacctagaaagcttttggaaaaaaatagagcttttctgcatcctactccagatacactgaatcggaatccctagggctagagcctagaaatctcactttttaaaatgcttccaaggtaagtctgatgcctaccctaggttgggaaccactctttcaaagtaaacagtgatgacacagcatttgctaaagtaacatctgtaggttttggtttccacctatttaaagtcagatttatagactcgaggagacagaaactgaatcccacacctggtgcaattagaagcataattagaagcagaagaacaaaatgccacgtaaccaaagcatcagagccatcattgcacgtgtctttttttcttttttcttttttttttttcaagacagggtctcgctcttttgcccaggatggagtacagtggcatggtcaaggctcactgcagcttcaatcttctgggctcaagtaatccttccacctcagcctcccatatagctggaactacagttgtgcactaccacacccagctaattttttgatttcttgtggagatgaggtctcagtatgttcccaggctagtgttgaactcctgagctcaagaaatcctcctgcctgagtctctgaaagtgctgggattacaggcgtgagccaccacacatggcctattgcacaagtcttgacaaacaacatatattttctaaaactatccagatttcattatcagggaaaagtttgcttaggtttattacagcagtccttggcatttgtatggtaatttgtactttacaaatactttgatatattataactctattggtctttgaaacaaagcgatacagtgtaggtggtatcattctctttctcactcagtgtggcccagagttgctcagaattggagcagagcctgagacgtatctgcagatcctgtcatcagctggcaagtccaggagactgtgtcatttagagactgtgttgttagttatccctcaacatcttctaaggtggcaggaaataatattggaaataacattttaaagtaaaaattttaaagtttaaagaagagttttgccacttaaacaggggagctttgtctggaaaatacactgagttgaaacacttcatccttggaaggattatataagatgaacagttgtgataaatgtgtagattagagggatgtgaatgggcagttagtccagtgccctcatttaagaggccaagatcctgattcagaggaggcatcctttgcccagagctgcttagctaatctgaccaaatgttgggaaaaatgtctcacctaacccactattccttaattatggattttgtgaaaaacaatagaacatgttaatgagtaatttatattagttcgatgtattacaattttttagctttaaattacagttttcttataatgttgaaatgttttagaatcctttgaatctaagtatttgtttcctaaatgaaacatttgtacaacatttgatgtttttacttatgaaatattctcctcccccaagaaaatttaaactttttctctctatttaaaagctaagaaatgttttaaaggaaaaatgaaattatcttcctttagcttatttttaaggtaaaacagctttttactctgttattgtggtaatggacagaatattacatacaaaaatattctgggagagctttttcctagttggttttaaatcattgtgccacctgaaaggtttttagattttataggagctaatttgtccaccagcattaatgtaacacagtgtagttatgaaaatatattgaaggacaggaagtggacacgaagtgatttttgtaacctgagcagttaatgaatgtgccaacattttctaggaagggacagcaagaatattctgctctgtagttaaaatactggctggcttttgatgtcttcatgcttaattgtgatcactttcttgcactgtgatgtttttacgtgaatatgttgaagtagaagtctaccatattattttataaaatgttttctgtatggcaataaactgaaaacatggatcaacccttcttttgaaaataaactgagtcaatttagccttttaaaaatatagtcatctcttttaaatagaatcctcttccaccatcaaggctcaacattttgtaagcatccaaaaaattggtaattagggggcttgcactaaatttcactatcttcagtagagaggaactgtttggaacttagatttccaatgtgtatattctaatggagaaagcaagaggtagagtttgtatgtttgacttaccttagatttttattttccatacatactgcaaatgattgacttgttgcataaatgaagatcttctgttgtgtgcttttcaaacactgtaaataaatttgaaatttgaa

SEQ ID NO: 165 - DNA, 71470 bp, Homo sapiens
atacacacagactcacagcgagaccgacacacactcccatacactcacacacacaactgcaggcagcgaggctcgggaagtcaggccggcttttcgccccggcgccttctctgctccagccggccgggtctccctgggggcccggagctcggccgggccgcgcagccccgttagaggacgagctcggcggacccccgctcctccatgggcaaacgcgggcggccgcgcaaggaggcgcgctgcgagggcgcggggctggcccccgccgcgcccccggctgtgccccccgccgtggccgcgccccagcccccggccctgcccgaggaccccgctggggccaagcccaggtgccccttctcagacattttcaacaccagcgagaactcgatggagaagcacatcaacacttttctgcagaacgtgcagattctgctcgaggccgccagctacctggagcagatcgagaaagaaaacaaaagtaagtttgggggcccctgctcttcctcggcgcccggttctttctttctcgcccacttgggcgacccctgttgcgagctcggcccgtcccccccccgcccaacatacacatccagcccttggcagtaaagccgatgacaccggagaaaggacacgcacgcacaaagctgctaaagatgtaacaaagacgggcgagggggagaggggcctgtcggtgcgtcggtctgtcctctccggcgggctggggctgggaggatggcccagcggaggagcgggggagtgttgttgtttgctgacaactgagccgagagctcatctctttgaggtcgcttttcttccttttttttttttttttttccggagccttctcaggcagacaagtgttgtttttctgttgctcgttcctgggtggggtggggattagaagccgaaagttggaaaccataggcagagctcagaggttccagaaagaaaacacacagacacacactacaacaataacaaccaaacagctctccacggcgtgggctcggctctgtctctctctctccctcctacttcgcctttttccttccctctagcagcaggactgggctcaggccatcacgtctacggacacagtccccctgcacgtccgttgccgtggggtgccaccgccgcccccccccccccaaagaaggaggccggcggggccaagcaacgccagcagctcgccccggacacgccgtcctgagcccgggaaacttggccgtggggacgcggctagaaggaaactttgggatctttgagaaacaatagttggggaagaaggtgtgggctgttctgtgctttttctttattttccgggagacggctcttgagtgagcgcacagggcaagcaaggcaaacgccttcctggtcgatttctactccccccacccgcccacccccagattcacgtggatagtagtgcgtgggtgggggtgtgctgggaaccccaccctggcctggcttcttttttgtatttatttgtttcatttttgcccctaccagccaggtcacccagctttccccaggcagtcgactcagcgccctaacgggggcacgcgtgtgcagcgtatccagcaccgtcctcagaataatagctgtgaaaaggaggaagggaactaggcagacagaccgacagatagggggaaaccgggatgtttaatgtgtccgaacaagtaggaagatcaatgaggcgcgagtgtgtgtgtgtacgtgtgcgcgtgtgtgtgtgagagagagagaaagaaagaagaaaggtcccgattgcaacgtgtcagatcttgcaaccttccccccacccaacacaacaaccctcagacacaaaaacaccattgctgactgataccccaggtcttcagggttaaaggaaccgtgtgttggcagcgcaattgtgcagacgctgtaaggccaaaacgaggatttgtgttgtgaggtcggtggtgcgttcttttctttctcttctcgcctgttttcccggagtgcctgggttgcgagaaaggcgcatcgcaggctgtgcagccgaatcgcttcgcaattattcatgctggtcggagggggatggggcgcgggaagctatgtgtgcatttgtctggagggtagtttctgaaaagccagagctggtggggagctgggtgaagacgtggttttgtttggtgtgtttgcttttgttgcaggggggaggggcgcgatttcttcagctacccccatccccggctaccagttctctggagtctgtcccgtggcgttggctctgactaggggtacaccccatgagggcacgttggcagtgtgtggcaaacctggcttgcccccctaccccagccaccccccctcaccagcgaggtgtatggaggaggcggtcggagattcctcagcgtcccgccccccacttcgcacccgcagacaatcggagacctccccctgccccaccccccaccccccaccccgccgccctggccgccgccacctcgttgtttaccccgtgccggggctccggcgtggccaccagtcacgtaagcagagagccgggcgcgccgggcttgggctgccccgcgcggggcgggcccgtggcggcgtaaccgggctccagaggctggtgaagccgaggggcttcctcccagcccatcgcccgaggcgtccgccctgcaaatctgccagcccccgagaggggtttggaaccttagcacccaagtctaagtcaacttcatgtgcgtaataagtccctcggccccgcagcccccctcctccggccggctcccggcgggagtatttttagctctcttgcttcttttcgccgctgctgtttggctctaaatgacgtgatgccaacggcccccagatttccccgagagcttggggcgccgcgccgtgcccagtttggctgcagagaccccgctccaggccctcgccccgtccccaacagctcgaacaggctggggtgacctccggcaaactccgtgcgaccatccgccaggccctctgttatcccccttgcaaagagaagcggtccacgggggccactttatcccaccccctctcctcccctcctcctgcccggtctaggtctctgggtacggaaaacggcgggccctacatctgcctcgttttatggggggcgcttcttcgcgctggcggcgctcgtcgttgttttctgctcgctgcacacaatgcccgcgcgtcacggcaatccgcgtgtgcacagcaataacgcgagtcggggggcgggtcgtgcgtgcgcccggctcgggcactgcgggtcgctcggcgcgcgcggggcttgttttgctccagagctctgctttccgaaacgcttacatcattcagtcgttgggggagggagagggatctgggcgttccgataggattccagcatctaccgggtccctggtttctggaaggaagcagggaccctagctttttagtagttattattgggggtggggttgggtagtttgttgtgtacgtctttttttttttttttttcggtcactactgcaaaagggcatcgttggccgactcaggtgcacaacctccccgccttcatttcagcgagttcccctataatcacttgatctcggtttctccgccttctcctcctccccctcccagctagagacacatggtttccacatggagacaaacttctttcctccgactggacttgacctagctgcgtcgttcagccaatcggcagctccagcctcttctgacgtcacgcgttgctggggccggaggctgggtggggggtggagccaggctgcaagccaggaaatctctgggagctgtagtgcggccagctggtccagtctcttcttaaagggacgctcttctgtccggagatgagtgtcgggccccgattctccatttcgggttcggtgagacctttctgagatgcatggtggaccctggtcacgagttaacacgttccgtttttactgctgtttgcgaagtacttacttggcaggagcttgccttattttccatcgtagccagaactgcttttcgttcccttgttgaggtttccgtactggtagtgttcaccaagttgtggccacatggctgaattacttccagtggagaggttgagttttcttggaggaggggttcaaattaagtcacattgttgactgtctgctgtgtgcaaggcaggggggattccctaggaaaggcaggtacattctcccaaaactccaactgatgtgaatctctacggatcacaaattgaaggcctccagaaatattaatcatgaaggctgtgatcctattaccacaaattcagaaattatatgtaaataatctctgacatcatcacctatatgcattttgagtccagtggaagggtgggaattaaggactgactaataagtagaaaaagatcttggaaaaggttaaaactaaaagagaagaacagatccataaagggatgttatgtgcataagagccgactggcaggtaagtgaaacaagctgtgagagcaggtaaggtctggaggagagaaatgggcttcctagtgtctggaggaggttgctttggaggcaacacttaagatagggaaggacgatcagatgagagtagaaagccataaggctccttggagtggatcacctgggtttgagggtggggtgctttcctaggggcacggacagcccaagaaacagcctgttcctcctggtagaggaagctgctgttgtgtggtgtcatttggccccaccctgccttctgacttaatctcctcttccttgccctgaaacctctgtgtctgtacagcagatccaccagcaagcaggcttcacagtcgaacctctgtgctcgacttagactcttccactgtctagaatgctttcattctcttactcccctagggatatctgtatcctaccttctcttcaagacttagatcagtttccacctcctccaggaagcttcccctagctatttcagcccatttggctctatttgttaagtcattgtacttgagagaatgaaacctttgcagtcacatggagcagggcccagcttgctactctactgcttactggctttgtgactttggacacaacttacttagcctgaggttccatttcctttttgcaaaatggggataacaatagtatgaccctcatatcattgtcaaacaactcaatgaggcactgcacttaaatatttaacgtacctgagatataataggtgctcaataaatagcaacttctctgagctttgataatcagtaccatgcacttctctacttgcttcctgtgtgttagctttacctttacaaggagtttattagtaacttaagagaaaagatcacttacagtattcaatgcatgttacccattgcatatagcacaccactgggcatacagtagtagatccttaatataaatgttttgattggttagatttgtcatttactgctagctatggcacgaggatcaggtttggaggccaggggacacgtgacagcctttccgaagatttggagacgagtcagaaatactgatctccaactcccttgggtggtgagaccaatccctgcaagaagatgatagttcagacctgaagagctgagactgcatcctgtgaacagctgtgaccctgagaaacaaataagaaagaaggagactagagtgacttctgctgaaatcgagggctttgatggcaactaatgttcaagctggtcacgtttttgcatggcagcaatcttatgaattcatacattcttcaaatgtacattgaatgtctactatgtgcagatgcttctttctgaaaactctgtaggttgaagtatggtgggggtggagtagggtatttgtctttagtggagttatgtgaagagcattcttaaatcaggccctatttcctctgcatcccaaattatgttccccagattcaacttattttttccagttttaaatatgatctctgctgactggtaaataccagaagaaggcttttttgaggatattgttacggctttcagaatcacggagctcccaaggactgtgtgtcctggaaaggagatccagggaaaggggacagggccttggaagttagagaagttgaattgagccattcctggtttgggagcaaaaaggaggctccattagctaccaaggcaaaacagtagctgctcatccatctctcatctctgatggaaacagtctcccactgacacatccagaaatggggattcatctggagatgcctgggcaaaagtctagaggtgaaactgaggaaaatgaagagggtgctggcgtgcagcagcagcaactaattgtatggcataatatcaataatggctacaatttattgaacactgactatattccaagtatggggctatgcattcattatctcccctgatcttcacaacaaccttctgatggatgcaattttattaccctcttttacggaggagggaactgaggagcagggatgccaggtaatttgcccaaaggatatatagctagtaagtcgcggagctgagttttgaacttaggcctctgattccagagcctgtgctcttaaccatatacacatgtactcatttcacagccaaggaatgaagtccagagaagtgaaatgacttactcaaggtcacccaggaacctgaagcagagctggtatttgaaacaccttgtttattgtccaaggtcttcctgcacacaccttgcttagaaaaggtttcgaagtgaggctggagtcagaagagccaaccagagaggctttttttctttttttgtctttcagagttgttcaactctcctggccttaactcaagtttagggctcctaggaaacaccacccccctcctgctgcctttcccaagtctgtcctctgggcatattagaggacttggggctgttgctatggtactggggccaacagcaggttcatcaaaagccgggtcttttgccttttgaaaaaaaaacccagccctgcagaagcgaattggccacaaagatttgcatcagtcattgtggcttgttctgttttagatccccctgcctccctaccccaccccctcctccctaccaccaccactttctataaatacagttggataaatattgatttaaactgggtttctggaggagaagcacatgcttgccctggcttggtcttcacttagataccaccagtatgtcaggcctgacacacctaacccccgacagctctggcttccaaatgtcctgttttggggagatgaattgtggttttgtggcttttgagtttttttttttttttttaaaggagagaaagaaaaagaaataaaaaagtaacaacccagcaagaaatgggagtcttcctgcagaatgaggaaagcaattttcagcaggcagaaatgggggagctttatagtaatatggcctcctgaaccattcttctcccttcccatttttctttctgctccacttcagtttttttttttgttttttttttttttttgagatggagtctcactctgttgcccaggctggagtgcattggcacaatctcagctcactgcaacctccacctcctgggttcaagtgattctcctgcctcagcctcccaagtagctgggactacaggtggttgccaccacgcctggctaatttttgtatttttagtagagacaggttttcaccatgctggctaggctggtcttgaactcctgaccttgtgatctgcccaccttgacctcccaaagtgctaggattacaggcgtgagccaccacactgggtccaggttttgtttttaaaggaggcaggtattagcacagagcatcagggccagaaggagccccagaggtcacagagcatccatcatctgtacagtcatggagtctgagacccagagagggacactggcttgcccaagatgacacagcagaggcagaaccaggtccttctgggctgtgttccctcctacctgatacgagaatgggttccaggtagagtcccaacctgggcatttgtttcacaggtccagtgctcataaagtcagcaattttcaaacctggtttactgatcccagggtgtgtccggttattgcaaaggtcattgcaacattctcaatagtctttcaaaatgaagctaatttcaatttgccatacttagaaaaatactatcttttacatttgggggctgggaggagggaggagctagaaggtggtggcagtgatgaggtggctatcccaagccttgactgaggaggaggaattcaagtcttggaggatccttctggaggtggagctctaggctcacagtggggagagagaaaaaaaagagagggagggaggatggaagggaacgggagaggcttcaattccctgtcccaaggacagacacctgctctctggctcttctaacttaaaggaagcaattgtctctgatgtcattgtacccgagtggcctggctagaggtgttaaagctgtcaacagctgacttgatctttgtggtcaaaaataatgggcatttgccatcatcatgctgagcaggaggctccttctttgcttcctcatcttggcagaagtgtgctgggccccttgcttatgaaatgttttgaaagttcaggtgacccttggtttgagcagtacgctccagggaatatatgtaaacagaatcctttttcaaaaaaatttagagaaactctcttgaaaagcccttgtggcaactattttggtaagatgtggaattatgttgtgagccattctccctaaatttgtgtttattcattcattaattaaaccagtacataaggagtacatacttgcttaatgggaggcactgtgctaggtcttggaggtagagtccttgccctcatggagtgtattattccagtgccaggttttagaggtagagttcctgtcttcatggagtgtactgttccactgccaggttttagaacttcacttgtcttaaagtgaaccccaacaatgcaggatggcatttgacttgagtatttttgtctttggttctagctatcattatagacagaataaaaatttagcctgggcttccaaaaggagtagttctttccctccctgtctcccctatctgtgtttaatgttttttttttttttttttttggagacagggtcttgctctgttacccaggctagtacagtggcacaatctcagctcactgcaacctctacctcctgggctcaagtgatcctcctgcctcagcctcccgagtagctgggactataggtgtgtgccaccttgccccactgattttttgtattttctgtagatacaaggttttgctatattgtcgaggctggtctcgaactcctgggctcaagccatcgacccacctcggcctccaaaagtgctgggattacaggcatgagccaccgtgcccggcctacaatcctttgtgtttttgtgtttgtccttgtaatttctacagatgttttttttttctttcactgcctgagcttaggaaactgtgtaagcaaccttgtaagtaaatacattccactcgcagttctttacagataggggccttctgcacttggaggattgtccacaccagcattcctcccaagtccactctcctgtacaacatgctcttggccacagacctctaatatccaactccagtgtctgtaaggaaatttagacacagcaaaattagaaagataaacacactgtccggagggagagggagattgagaaattcaaactgaagccaattaaaggggatctggattacctactatttgaaatttctttttctgtgtctttattgccattagcaaggatacttgaataaaggtgatttgggagtaggaaggctattgtattaaagtggaggacatgcccagggctgctctgggcaagtgagagctggtgtggactttgtttttatttctacaggggcccagaactaccttatggtgcccctgtgttatcttcctcttacctccaccacagcctgaccgtcctgccatatttcttggctcccaagactgtgtgtgccttgcatacaacttactttcatttttttctgccagtggtactgagctaagtttttgttgaactgagctaagttcaacaaataatttctaaaacctgccagggagccaagctctgtgcttggtgattccaaagtgaagcatgtatgatctccagttccaggtctatcttctagttcaaatgatagacgaatagaaatcagtcaacaattcttgtctgtcttctgggagagtgtgataacctgtccccaagagagctgctgacaagtgcaatgtcttctctgttttccaaaggagtggtgataatgccctcctagtattgagcatttactatgggccagcacaatgctacgtgctttatattaaattctcacaaacatccaatatgcaggtgctataataaccctcatgttgtagatgaggaaagccttagctttagcaagactaactttcctaaggccacagtctaataaatagtggagtagagactaaaaccccagatttttctttcttcctagagagaccttagggctctgggaaaagccccagggagtaagaaatgtgcaagagtcaagaattggaatctggaggctgggcacggtggctcacgtctgtaatcccagcactttgggaggccgaggtgggcggatcacgaggtcaggagatcgagaccattctggctaacacgctgaaatcccgtctctactaaaaatacaaaaaattagccgggcgtggtggcgggcgcctgtagtcccagctactcgggaggctgaagcaggagaatggcgtgaacccgggaggcggtgcttgcagtgagccgagatcacaccactgcactccagcctgggtgacagagtaagactccatctcaaaaaaaaaaaaaagatttggaatctggaatgttttaagttaggctgagggtgcccttgaggatgcctccctggagcgacttccttttctccccactcttgctagggtagagagtgggctgtcagaacctccagggccctttgggtgttgacagtggagccaaatggctcctttctctagacggagatggtctagggtgtcactgcttgcacctgcagtagtaccttgcccagcaccccctggggaactcacccaaccagtaggtctcctgtggttctgcatactagggtgtcagggtgtgaatccacaccctgtcaggcttattaggcttcctggaggcgcccgagcttgtagggcaactgggctggcccatacatggagccaagggcttctgccagggaagccagaggagagaggcaagtgtgagctgcagagatgagcattaggtcctcgctgccaccgtgacagtgtgggccagctggttccagtcagacaatgacataggccaaccactttctctcgctgatccagagctaggaaacaagggatcttaaatataactgcatttgtctgggcgaggtggctcatgcctgtaatcccagcactttgggaggccgaagtgggtggatcacctgaggtcaggagttcgagaccagcctggccaatatggtgaaaccctgtctctactaaaagtacaaaaattagctgggcatggtggtgggtgcctgtaatcccagctacttgggaggctgaggcaggagaattgcttgaacctgagaggcggagcttgcagtgagccaaggtcgtgccactgcactccagcctgggagacagagtgagactccgtgtcaaaaaacaaaaacaaaaacaaaaaacccaaaatataactgggttcctattactcacttttcaaaagcccttcaatagcttctttcctgcctcacttaaaataaaatccaaactccttgtcatggccttcatcattgccgttcggagtgagtgtgattggaggatggagagccttggtaccccctgggagcttgtcagaaatgagactccaggtctgctgcagtagaatctgcatttgccacaatacccaggtgatttgtgtgctccttaaagtttgagaagatgtcttaaacagtctttgtgatcatcccagaactcctcacccagccacctaaccttatcccatttttatcatttatcctgtatcctgctcatcacaatttacacttactctacttgcttatcatcagtctggagggctggaatataagcacatagaggacagggaccataagtagttttgttcattattttatctttggcatctagcttagtgcctggcacataacagatgcttaaggaatatttattgaataaatgattagttttctgtctttatctttctgacctagtgtttctcaacacaggagctgttggtgtgacagttcttgtacagattagtttggaatatggcaggatttaacatccttggttcccacccactaaacgccactggaacgcccccagtcattgtgacaataaaaaagacactcctacaatgtttctaccgcctcctagtgtgatgggattgcccttggttgagaccattgctttaaccaatttcgtttgacctgacgcgattgaacataacatgatgtatgctgtagggtccaagggtcagaaaattcaagttccaatctgttcatagcctgtgtgaccttgggcaaatcacctatcctttctgggccttatttgtaaaataggaatctcagaggtgtgctgaggattaaatgaactgactggaggagcagcaccgtgcatgttggccctagttatgtggcagctagtaggcaaatggatgtgtattgttctaggatctagggacaatcccagcttcctcaaatcaaaacactattgctggaagagctggtgagatcagctataccttggacaggcaagagaatggtatttttattataagtgctgcatctgaggctgagagaacgcagatacaaggcagcaggagctggttgtgtggtttagtgttcagggcctggctagacctaactgtgacctccacaactttctgctgcctggaaaagggtggtgatgccaaggggtgggggcagggcaactcgaggccagctcctggcaggggagggagggttacccagggctttggcaagaatgtggggcatcctcttagcagcaggagaaggccttaaaaacaagttacatctaactttgaaagaacagactattgcaataccaacatctaggaaacacaacaaaaaatacagtttacttttgctttcaaatatagatgcagaaatcctaaacaaaaatatcaactcttggaactgaacagtgcttcaaaacaataacacaccgtggctgaccaggttatttgccagatattgctgaaagtcacaaaatctaccagcataaatgattacaggcacaaattaaagaataaaatgtgtttacactaacaaatgttgaaaagtatttgggaggcatttctaatgaagaaaactacttcggcacaacaaagattgtttcctgtggtggtcttttaattatagtggaagggtgaggttgggcccaaggtttgcggtcatcaccaggagtgaaggagttgactctgatggcaacctttccttggggaagaatgaaccataaacagaaaaaaacagcatttggatcctttgggaatgcaacttcgtcttgatatttaaaggaatgggccccacgggtttaaaaaagcctgagttctaacccttattccatcagtttgatagacagctgttggccttgggcaagttaccatacctctctgagcctcagctttctcaagtgaaaaatggggactgtattgagaaacaagcttaatgacacaaacttctatgacataaaccttgaaatgttatttggggaaatattcacttggcatggccctagcaaaatcctcccaaataccttatcagtagcaccctggtgtcaccccaagtggggtgctccaaagtaagcaagccgcttagatgtgcatgttaattgagtcctgcaatgcagatgtcttcttggatccaagttcatgcaaaaaagaaggaaaaggacatttgagagattaacacatccattataatcactgaaataggctgctgtaataagggccatttaataaaatgtaagaagcccttttctaagagggaagagatgggtcaggatggaagtcaagtgcagctgtttgagcatttgccagtggtctgatctcaccagtaaaactggagttaaaaagcaacaaacttccagattcagccgtctcagataaacactgcctccccctggcgttccccccaccccatgtcctttccctttctccccagctcgggcagcacctgagtcgcttggtgcgtttccgtgtggttgggatgtcagccggcagccctggcgacaggagccctgggaggcggcagctacctctcgggtttagcattacgtcatcccttctagacccaaatttatctcggctgcacacagacccgcagctctgagctgccgctgacttgaggagagcttacgcatgaacttaggcaaggctgactcactgggcgagggaaaggttttctgctgttcttcacgtttctgggctctgggggaagaggaggggaggaggctgcagtagtcattttgggatgggagatggaaaaatgtataactgttaacggttctcatttaagagcttagagttcacctcccgtgtccccagtgttgattatttgaaaacgcccatccttaaagataattgcagaaaacagtgccctactcagtaaacactttgcagtttcagggaagttctcctaagtgcaaggtgtcatcaacacagtaactttggacttgtaacttaacctcatggccccttcctctctccccatctcgcctccctgaagaaaagatacaacacatcagcctccattgtttatgaatctgcaataaatcacttggaaattgtcactaagtaaactgtgctgagaaaggacccttaagaattgagggctttgcctgcttccttcagaaggcagattgtccccatccgtggctgtgatcgttataggcctggggtattctgggggactttctccattttcaaatgactcccttgagagagagatatactttagggagaggacagaacagagactatgggtaggattccaggttcttatgtcagtagactttggaagccttgcttttcctgtttccccatctgcatttgtagtgcaaactagttcatcggaacaaaagaaaggctatggctgcctctgggttcctccgggctgagactgttgctgagggatggtttgtgggtagcattactttcctgtggatagagccctaagctttgtgctggagaggcccttatagctgatgtccaaggaaggactccaggaggcagccagcgcagggagaaggaagtggcacttcaattgcttttagaaaaggctggagatttctgtacatgaaccagcccttaatactgcccaccatgatcatcatctctccccttcttcaatgcaggtggccttttggtgagtctcgctctactttccatgtcctcatctccctcttggccatggctctagaagaagggctctaggttagttcacctggaggtcaactgtgaaaggccatgcataggccccaggcctcttgcatgtagccatctcttcctaaccagctatggttctgtgacctctggaattaaagccatcttgaattcatgtatattttcagtttgtactacttttcttgattgcttgtcacacaagtttacctcctattgagaaaagtagagttgtatttgtcctggccagggacactttgggaggctgaggtgggcgagtcacgaggtcaggagtttgagaccagtgtggccaacatggtgaaaccctgtctctacgaaaatcaaaaaattagctgggcgtggtggcaggcgcctgtaaccccagctacttgggaggctgtgtcaggagaacccgggaggtggaggttgcaatgagccgagatcgcgccactgcactccagctggggtgacagagtaagactccgtctcaaaaaataaataaataaataaataaaaaataaataaattctaccctcaactaacagatgttctaaatgaatggtattttctttaaaataatccagtcccacccctacccaacatggcccttgttgagggtgaagggaggttgttaccaacacccagtgggaaagtccagatccaaaatgacctgggaaagtccagatccaaaacgacctagtcaagagctaaaagaacagtccctttttgaaagcctttacaaaaaaaaaaaaaagttcttctgtggcttgcgaacacctctcattttgggtctgcttgcatttgatggaacgtctatttggtcttaaatgtggtgccaagtgtaatatttaaaaggactggcagaattttgcagcttgtgacctcactggagattttgttcactttaccaaaaaaaaagaaaagaaaaaagaaaacaaaaggtatgagggaaaggtaagaaaacaaaaggtatgagggaaaggtatattaaaatgcagcatgaagccgataacatttttaagagggtaagatttccatctcaagatggtattttctgcaggagccaatggaatgaccacgggagggggaaactcccccctcaccaggagcttcctgttattttggatgtgatgtcaagcagcaggttaatataattggggtggaaaaaagttatgggtatgtttgcacggttcccagcttgttcctagagcattcaagtacgattctcttgttcttcctctccctagatcccttgttcccaactgggggacaggggagggattttgtgccccaggagatatttggcaatgtctagaggcatttttggttgtcacacctgaggggtggtggtgtgctactggcatctagtgggtagaggccagggatgctcctaaacatcctgcaaagcacggaacagagctcctgctccaaggaggaattacccagatcaaaatgtcaatgatgctaaagttgagaaaccctggtctagactttgaggattttttaggtggaggacttagaaagagagtggccatgaatgagcagtcagtggctttttttttttttttttttctttgagactgagtcttgctctgttgcccaggctggaggccggagtgcagtggcgtgatctcggctcactgcaacctccgcctcccgggttcaagcgattctcgtgcctcagcctcccgagtagcttggattacaggcacccgccaccatgcccggctaatttttgtatttttagtagagacagggtttcaccatgttggcaaagctggtctcgaactcctgacctcaggtgatccgcccacctcagcctcccaaagtgctgggattacaggcgtgagccactgtgcccggccagtggtagtcttttaatgtggtctccgctctctaacttcctttttagctacagaggagagcataagagaaaacatcatcatcgcttctatttactgagtgcctagtatatactaagtgctggaattattatatttaatctttgcaaaaagcactactgaatacacaaacctcgagagcaggtctgcgtccgtttctctcttactatgcaaactaagtctagtacagtgcctggcacatggcacgccctcaacgccgtggatatgatcatatccattttatacataaggaaaatgaggctggaagagttcacacaggtctcagtgtaagtagcagagtcaggatttgaaccaaactgttccgcaccagggagaattttctggcgtctaaaagcactagtgaggagaggagaaagttttaaaaagtaagattaaagaaaaaagtaactacttgtctgtgtggaagctgaggtggaagaagggcttcatggaaaccctctctgatgaaatcatccctcgtttttgaacagcaattttggcttttccagtttctgtgtgcgctgttggtgcaggtgtgttactcttcttattttgcagatgagcaaactgaggcacataagttacatgagaaagtaggagatagaggactggaacatgatacttcgaataaagaatgtctcagcccctgggcaaccgcagggagtcgctgagaaacaagtttccccgggagtagactcccagctcgctcaaatccttcccattccacatcgtgtctggagggaggaaaaaaaaattcttccctcccagaagcaaagtcccgcaacttcttagtcttccctagagacaggaaaggaaacccagcgggactacaccttccgacgacctttgcgaatcttgcggaacgcaggcgccctgaaacggcgtgtgcactacgattcccggcagccgcgggcgggtgcgggactacatttcccagggggcagaggcaggggcgggagggggcgggccccggcgctgctcccgcccctcccccgtgctcgcggggagaggtaaacaaaccacgcgcgggctgcccgcggcacggcgggcgcggctggcgcggctggggcggcaggggcggcggagagcgcgccgagccgcggccgagctggcccgcccgcccgtcgcacatgttccggaacggcgcccggccgtagccgcctgcggcgcctcctgtcggcccgagaagggagtgcggagaggcgccggtcgccacccgcggtgcccatggagcgggtgaagatgatcaacgtgcagcgtctgctggaggctgccgagtttttggagcgccgggagcgaggtaatggctgggcgccgctgcgtgagcccgagcgctactaatctttttcggcagtgcggtgcggccggtaagggagggcacgcgtgtgaggtgcgcgcatgaggtgaggtgtgcgcgcatgtgaggggaggggtgtgcgcgcgtgagggtagaggagcgcgcgtgtgtggggaggggcgtgtggggaggggagcgcgcgtgaggggaggggcgtgtgagggaggggtgcgcacgcgtgaggggagcgcgcgtgtgaggggaggggcgtgtgagggaggggtgcgcgcgtgtgaggggaggggcgtgtgagggaggggacgcgcgtgtgaggaggggcgtgtgggtaggggagcaggcgtgtaaggggggcgtgtgaggagcgcgcgcgtgaggggaggggcgagtgaaggaggggagcgcgcttgtgatgggaggggcatgtggggaagggagcgcgcgtgtgggaggggcgcacgcgtgaggggaggggcgtatgagggaaggggagcgcgcgtgaggggaggggcgtgcacatgtgaggggaggagtgtgtgaggggaggggagcatgtgaggggaggggagctcgcctgtgagggaggggtgcgcgcgtgtgagggaggggtgcgcgcgtgtgaggggaggggcgtgtgaggggaggggagcgcgcgcgtgaggggaggggcgcgcgggtgtgaggggaggggcgcgcgcgtgtgtgtgaggggaggggtgagcgcatgtgaggggaggggtgcgagcatgtgaggggaggggcgtacgcgtgtggggaggggcgtgtgaggggagggccatgcgtgtgtgtgagggcaggggtgcgcacgttaggggaggggcgtgtgaggagaggggcacgcgcgtgtgtggggagggtcgcgcgtgtgcggggagggtcgcgcgtgtgtgaggggtgcgcgcgtgggagggatggtgcgcgggggggaggggcgtgtgcgggaagggcgtgcgcgtgtgggaggggcgtgcgcgtgtgggaggggcgggtgcggggaggggcgcgcgtgcgtggggaggtgtgtgtgctgagatcgtgagtggaggcgtgtgtgagaggtcgcgcaggtgctgggggaggtgcgagggtgcgcacggagggtggggctgtgggtgtgcggcgagcgggaaggagacgggtggagggaagttggagagagggcggtctggggctggagagagggtgaccgtggagaagcttggagggccccggagcgggagagggtgctgggagataagaggaaggaggaacacggatgctggggggggtcaggggaagggacgaggccgggagaacactgagcgggggaaaaccggtggagaggggcctttgaatacctgcggggtgatgagatggggtccctttagcggtggcagcccaaggggctgtagagatggcgcagaaagaccaggaactcggagactgtggtgtcgagagagaaaatgtctttctaagacttgttcgaagtacacaaaaatattgggcttaaagagactctttagaacagagagagttgaaagtaaaggggaatttttgaggcaagcgaagtcaatgaggtgaatggtaactggtcacaaaatttttgttctaaagcatctgaaatctcaagttcttgggagagaaggattttggaaaggggggataaactctttggtttagaggaggtatcaaaacaccttccagctggtggggtgtcacaggattgatgtccaggcgagggacattaattttctaaccaaaaagagtggaaacattttacctcttttcctgctttcaaaaacctgttactgcaaagacctcggatttgtgggtcaatggatttgggtactatattcttcttaccgtatctttttttcttgctttcttcagagtgtgaacatggctacgcctcttcattcccgtccatgccgagcccccgactgcagcattcaaagcccccacggaggttgagccgggcacagaaacacagcagcgggagcagcaacaccagcactgccaacaggtagcaagctgggaacgcttagaagagggaactggagggaaggagcacatttctcctgtaatcccaagtctgaaggagcagcacttgatgggttcctttaccactaccctggggatttggcccttttaaaataatgaagtctagaaatcataacctggttttgcatggaaggaaaggaatataatctggaaagacaaccaaagaagttcttgctgggattattaagatggctatgccaagttgagagacttggcagcatgtgtccatgcatgcagccacctgctaaaagtaatcgtgggctggctttcaatattctggccaagttttggacagtccaagaagattaaaaaaaaaatcagaaataggtctggcagggtataaagcagaatcaagggtttgttaaaggaataaaaatatttaggtagaattggtagtgagcggatgtggttatttgtttaaggagaaaagggaagaccatgctgtgaaagttttgcctctttaaatgatgagatcggattggttggtgggctcttaaagcaaaaaggaaaaaaaaatctgtttatctttcaagcagaatagatctttaaaaatatacttgtctagatgtacttggaaaggctgggcctagtggcttacgcctgtaattccagcactttgggaggctgaggtgggaggattgcttgagcttaggagttcaagaccaacctggatgacatagtgaaactttgtgtcaaaaagagaaaaaaatagatgtactaagatgtagctgacttccatttttgaaaacttttgagtagtatgtggctatctcttcggtgtttttattctagggagccagtgaattcctaggattcatctcataggaagttttcaaaaggcctttcttaacagaagattaacagatggctgccttttccattgataaggggaattaaatgagacctttatttctgtttcccagagctttgtctagagaatataataaacattcattttgaggaggacagagcaatccctgggtaaccaaatttccctgaaggctttggggagcttcagtcaggtggttggttagtcatttgggacagcagattgggtcagaatggggctcttgattcagaaagcctgaggcttctacagataataattggaactcatgaggttggatcatcccactctgtatttcagacatcaccgaggaaaaactaggattcacttttctcctttgacttctctatagagctgcacgtttccttttttagcttcttttcattaagactactatatagtttttaaacttaatttcttaagttataaaaataattaaccataagcttgatgtactatctgtgttgtgtgtgggtctagagattttgttgtagtatggtgtatttgagatgaaaatatgtagtatgatatacagcattttaaaaaatgtacatttgcttgcccttacggtttcagtgtttaagctatcaagaattaagacctattcaggaatttatgtgtctttcaatccacatagattaaaaaacttttttttttcaacttggagacataggaagagtacacataggaaactagacctgggttctgtcgtgctgcaagtatttaagcctttcctattttctagaaattaggtatataatttcagtacatttcccatcccttactgtattcatctgtaaaataagatgcattagagtctcaccaaggtccctccttctcctgaacttctatgactctgatttattgacagttttagagattggttactatattagtaatttagtatgtctcccatcattgcagatgtgacatttttaggaactcaaggattatagaggcataaataagatgcacattcctaagttttatcaattatgttaccggtcattaataagaaactcttagtcatctgttgacttacgctttgctcagcttggggtttgggctaagtgatgtttctctttcatgctagtgtctctgttaggattctaatattatgtgtgggaccacagtgctaattactgtgttttagcatagcatgtcggaaaatttgtaaaactgcaagcatgccatattgttctgatagtgcccaaaggagaatatgtgtacattagaccacctaaaacaggagaagatactttttttatgggaatataagtagcaagaaagagagagagagagaaaaatatattttagaatatattatctcaagatccaccaatgtgtgggttttgggctggggcttatgagagagaactagtatgttaaaatgaaacactagaaattatttctcctttgccacttatttaaaatgcctgcttcatggaagtaaggagagctgaggtagaaattccaatactggggtatttggacaatagtgttggtccatttgaaagaggacactgtaggcttcttcttaattttaagtttactattggattttaatgagattttattatgctggttacataaagcagaaagttagaagacttacagaaatttccatgtatttatcatctgaaacaaggaaaggaatggacttcataagtatatatgtcttattttttcctgatcaaaaagctactagtgtggaagtagctgttattttattactatacatcttgaacactgatgtatgttataaaatgacatttgtttctctgacatcgtagcatctttaagatataatggtgattgactattttacccctgatattctcaggtattatatgatatgcctgataaaatgttactttaggcagggtgcagtggctcacgcctgtaattccagcactttgggaggctgaggtaggtggattgcctgaggtcaggagttcgagaccagcctggccaacatgatgaaaccctgtctctactaaaaatacagaaattagccaggtgtggtagtgtgtgcctgtaatctctgctacttgggaggctgagacaggataattgctggaacttgggaggcggaggttgcagtgagctgagattgcatcactgcattccagcctgggcaacagagtgataatccaccccccccccctcaaaaaagtaactttataaatttatgctgaaagtagttaactcctaatattataaattcctattcccctttcccccattccttaaaatcttattttcaaagaagtaaaaaggagagaaaataaatgatataatgtgatattacaaatatgttccttgcaaataccagtaattttatcatttgggatccttctgatagttggaagtggcacctataatatataattaaaataaatgcttgattttactgtggtcttggtcacagccttctggcacacttccaaaaatcaacattgctaagatgttactgctgttagagaatgtggctgcaatagctatctggctttttggggagcatcagataagttcaaattccagcttctttactatttggtaccacaggtgaaaaatctcaaggtctgtcatccttaaaactctactaaataagccatgactgcagtgtaacactgatttcttcctaaatatctcttcagtcggccttctttcctgttaccttcattactatcctcctaatctcagctaccatcatctcttacttggacgactgcagtaacttcctacctggtgtccctgcaactacagtttttttttttgtctggttctgttgcccaggctggagtgcagtggcgcgatctcagctcgctgcaagctctgccttctgggttcacgccattctcctgcctcagcctcccgagtagctaggactacaggtgcctgccaccatgcccggctaattttttgtatttttagtagagacagggtttcactgtgttagccaggatggtctcaatctcctgacctcatgaaccgcccggcttggcctcccaaagtgctgggattacaggtgtgacccaccgcacttggccagttcttatgaattacattggccagccttcttttgattccttcagtacgcgttttcttctacctcaagatctttgcatactttctgttccctgcagggaatcattttccctccccctttgttatctctgttgaataacactcttcttcagctcaatcataagttcctcaggaatgtttcctcatctgccgtagtagatcaggtcttcacatacttcatggcacccctatttttccttcatagtgttcatcacatttgtagaaatacagttatccagttgtttcttaaattcgtgtcctattcactggattaaaaaccctgcgaggcgggcagggattgagtctcttctgcttaaacatttatccctagtacttatcacagtgccccgtaaatagtatgtgtttcttaaagaatggaaggttttcaaactccaagcagactgtcttaaattgaatttcttttttgtgctgagtaccatattagactggaaggaagagtgataaaacccctgttttggcaaactctgattactttgtgttccaagggatgttaatgatacatttggaaaaacagcatgtagtatttaaagaataaaaatctctaaactgtcaattcttttaaacaagcaggctacagaatgctacacttaattttgaagaacattcagtgtcatcctgtgtcatgaaaataaaataataccaaacttgcatattgaaagaaacagaagtctttcagatattggcaataaatattcatatgagcctgtgacacacacatagtaattgcattgttttaaggtaatctgggaagtagtaaatagccaatttatgctttaatttcaagttgatatatttcttctctttagtgtcctatggatactaaagaatctcataaaagcagtatctcagttccactttctaagattgaggacactaaaaaacaacttttctgttgtttataaggctttagtttaatttttcttaaactgtagaataaagaaatgctttagtcttattttagatagaattattgtattgttattttttagctttgcatccttttcagctatcttcatggatttttagtttttctggggagagggatggtggtgaattattttcctaggatagtttcaaaggattttttccagtagtaatttgagatgctttatcttctctttattctacgtgaacctatttgttcacagaagaattgaatgaagccttatttttatttttgtgtaatttttttctactattctgtgtttttcaaatttttttatattaaaaagtagtttctgggtctttgttccgtagaaaactcccaaagtttcaggacaaaaatgtagattagtagcagttaaactcttaatgatgttgttattattcttaagtattttctgcattttgagtgattaacacatccagtgaaatgtgttttgtgatagtctgtcttctaccaaaattgacttaaatgaaaaattcccaagaattacttatatgccttatactaaaaaaactgaggctttcctttaaatgcttctttgaagtgtaagtttgctattgctgggtttcttaaggttatattcctctatggaagtattgaaggaaacttgtatgatcatgccttgtaagtcagtaggacagctgtttctgttcctagtcgatgaaaggcatttttgtcaaaatattgaatatatgatgtagaagatcacaaaatgtagaaagggaattctttagtacaattctctgatttatgaagacaaaatattatcactcattttatgattaaagcacatgtggcttagagatggtgattgcttaagccttacagctgtagatgatggttgactttattgtcaagctggattttaagcaatatatgcatcattgttataatcaggcagtactgttgactggaagaaagctttctcttctagatttctccttgcaaatgaaagaacattgcctgcttttgaatatagcatgattctttgtcatttcttcagtaaggacagttttctagatactaatctaatcaaagaggcttgatggtatgctttgacagagtgtatttccaggtcccatttttagtgtgattgtatagtgctgatgaaatataaacatgcattttttgttagattgtttttttgttttggtttcctacattttaaaacacagtcagtggtaccataattaacagcattacccataatatcaaacctatttttttgaagttgctcctaacttttatattattattaatatactcagctcctccccatagatgcaggtgttatacatctatggtaccactcgtttttcccccaacagttatttactgaatgtttatttcatgcctgactcttaaaatgattacctttggaagtcagatgagttaggaaattgctgatattttctgtacttttaaaggttttttagaatattgctctgtaatagaatttgttgttaacaaatgaagtagtctagataattagttgtttaccttaatgtgttttttaacttcgagaatatgtttaagagcaattattttaaccttcaaaattctctgtagtttctagtgttgctgccttacctaagaaatattattttacaaacaatatttaactttagaatgtataagatgcttcttaatttctgctgctaccaggtgaactagttattttaaattcttaacattttataaaggtaatatatgtatatagtttaaaaagtcaattaatactaaatagcttataaaggaaaataacatccccatgccccacctctctccatccaatttctgcttcttagagactaccacttccgataatttcacagcttcttctgttgtttgctttcatatttctaaatgagaagcgtttcttgctatagaagatgagaatttgactgtcatactctttgactaacagcagattaatatgccagaaatgaagatttttaaaaagtacatgagagcaaatattctccaaaggaatgatgtttccaaatgagatactttgtagtactgtttattattaatcacctacagaaaaacattgatattttactctcatctctgagtactttatggtaaattattgcctcagtttcatgatgaggtttattagttaaaaaaaataagcttggccgggcacagtggcttacacctgtaatctcagcactttgggaggctgaggccagcagatcatgaggtcaggagatcgagaccatcctggctaacatggggaaaccctgtctctactaaaaatacaaaaaaattagccaggcatggtggcgggtgcctgtagtcccagctactcgggaggctgaggcaggagaatggtgtgaacccaagaggcagagcttgcagtgagccaagattgcaccactgcactccagcctgggtgacagagcaagactctgtctcaaaaaataaataaataaataaataaataaataagctctattggccgggtgtggtggcttatgcctgtgttcccaacactttgggaggccgaggcaggcggatcatgaggtcaggagttctagaccagcctgaccaaaatggtgaagcccgtctctactaaaacacaaaaattagccaggcatggtggcacacgccagtaatcccagctacttgggaggctgaagcaggagaatcacttgaacccggatagtggagtctacagtgagttgagatcatgctactgcactccagcctgggcaacagagtgagactccatctcaaaaaaaatttttttctctattttcttctagcagtttataatattaggttttacatttagatttaaaattcatttagagttaatttttgtagagggtgtgaagtaaaggttgaagttctttttttttttttttttttttttttttttttttttttttgcaaatggacatccagttgttccagtatcatttgttgaaaagactatactttattcattaaatggccttggcacctttgtgaaaatcagttgaccacagacttgtgagccttatttctggattttctgttctgatcctttgatctaaatattcatccttattctaatgccacactgtcttaattattatagtttttcaaaaagttatgaaatcaggtaatgaatgtattccgacttggttcttctttttcaaaagttcctttggctattctaggtcttttgcatttttattttaattaatttatttttttgagacagggtttcactctttcacccaggctggagtgcagtggcatgatcatggcccactgcagccttaaccttctcgggctcaggtgattctcccatcgcagcctcctgagtgaggagctgggactacaggtgtgcactcccacactctgctaatttttatattttttgtagagataggctttcaccatgttgcccaggctggtcttgaactcctgggctcatgcagtcctgccacctctaccttccaaagtgttgggattacaggcgtgagccactgtgcgtggcctgcatttttacataaattttagaatcagtttgtcagtttctacaacagagcctgctggaatttttattgggattgcactggatctataaattaatttggggaaacccaacatgtattaactattgaatcttctaattcattaacatgaattaatagacatggtatgtctattacttagatattttcaaatttcagcagtattttttaggttttcagagtatgggtcatacacatactttattaaatttttccttaagtattctttgatgctattttaaatagcaattaaatttggcattttggttttgtgaactgacttcgctaaacttaattgttctaatagtctgtatattccttaggattttctaaatagacagtaatgttgtttgcaagtaaagacatttttatttcttccatttccttctgtgtatttccttttcttgttttatttcactggctagaacctctagtacagtgctggatagaagtgatgagagtggacattcttgccctgttcctgatcttatgaaaaaatgcattctttgaccattgagtgtgactatagtttttcttagatgccttttaggttgagtaaattcccttcttcccttatttgctaagagtttttatcatgaatggatggtaaattttatttaaatgctttttctacatctatttaggtgatactgtcattttcttttttattctgttaatatggaggattacattgatggatttttgagtcttaaacctgcattcctgaaataaatcctacttattcatgttgtattttgtactgttgcagtactgatactaacaacacagagctaaaacaaacttcacaggtttgaggatttagtccccaacatgtctgccctcgctacagatgccagccataagttcaggagtcctcaggccactctcacatctgaccaactggctgcaaattcagaggttcctacagccccttcaggtttgataatttgctggaactacttataactcaggaaagtgctacactttgtctgtgtttagagacagagtctcaactgtcacccggagtagagtgcagtggtgagatcaaagcccactgcaacctcaatctcctgggctcaaggcagtccttctgcctcagcctctcaagtagctaggagtacaggcatgcgctacaatgtccagctgttatgcttataattgcaagttttattataaatgatacagatcaggaccagccaaatgcccagacacagagagagaggtctgggaggaacctggacacagagcctctgtgctttttccatggaatcaggatgcattactctcctggcacatttatgtgtttaccaaccatgaaactcacccaagtttcaggttccagagtttttattgggatattattacataagcatgattgattgaatcattggttatatggttgtcaattcccagtacttctctcccctgtgttgggccacaatcagtgactcaaagccccaaccctctaatcacatggttggtctttctgatgtgaccatcccctatcctgagttatctctccttggcataaactcaggtgtagtccgaagacccactatgaataatgaagacacacctaattactcagaaaatttcaaggttttagaagctctgtcccaggaactagggtactttctgtatattattgggttcaatttggcaaaattttgttagaatttttgtgtctgtgttcatgagagatgttagtctttgttttgtttgttttctatgtaatttgtcagggtttggtatcaggctaatactggtctcataaaatgatttggaaaatgttccctctctctttattttttcaaagattttatgtaggattggttttatttattccttaaatgcctggtaaaatttgccaatgaagaactttcaggcctggagttttctttgtgggaaggtttttttaaaaattattattttaatctctttaatagatgaaaggcaattcagagtttctgtttcttcttgagtcagttttgatcatttgtatctttcaagaaatttgttcatatcatctaagttatcaaatttagatgatgtggacaattattggcataaagttgttaataatattctcttatccttttaatgtatgatgtatgtagaatctgtaatgatgtacactcttgatactgtttttgtattgtaatttttgtattttattcttcatcagccttagaggtagtttatcaatgtgttgattttttaaagtcagctttcaattttactgatattcactatttctcattttctatgtctttcattcctgtccttggtttttattatatttctctacttcagtttctcaacgttagcagtcttgacatttggggtcagataattctgttttgtgcatcataggatgtttagcagcatccctagcatctcctcacaaaatgccagtagcctcctcctgattgtgataaccagaagatctccagacattgtcagatgtgttggtgggcaaaattgcttacagttgagaaccgttgctcaacttctttcagtttagtttgttcctttttctactttcttaaggtggaatcttggatcattgattttggacactaccctcccaacagaaggatttaaagctaaacagttgtgtttaagcactgctttagctacattcaacaacttttgatatgttgtgtcattaagttcagaatattttctaatttctctgcaatttgttctttgagctgtgatttatgttccaaatattgggatttttctaattagcttactgttgctgatttctaattaaatttcattgtgattggagaacttactctgtatgatttcagtacttttagatttgttaaaaatcatcctttacaaagcacatttgtttgagatgtagtatgccaaaagatttgtcaaggacttacattagggtgtttgctatatttgaagtaagaattgatttttaaagaattcagtttgtatgctattaaaaaattttttcctgtttaccaaagtaaaatgtacatacaaaaaaagcatacaaatcctgtgtacagctcaatgaatttttacaaaagcaaagaaatattacaaatcttagaagccccctcctgacttttccagtcactgtcaccccctccccaaggtaactgcaattccaacttttttttttaattccaactttttatgccataatttagttttgccagttttgaactttatgtgaatggagttatgtagtgtgtactttttgtgtgtgtttggcttttttcattcaacattatgttgaaattgtgtagattaatccatgttattgcacaatagttgtagttagtttattctcattgctgtgtaatattacattgtatgaatatttcacaatttatccattctactattgatgaatgcttccagtttggggccagtatgaatagttctatacaagcattcttttgtatgtcctttggtgaacatgtaaacatatattggcttggtatatgcctgtaagtggaaatacttagtcataaagtatacatatatccagctttgatatgtaagttttaaggaaaaaggttattgattatagttattgttgtgcatcctgtttagatacttgatgttcgtgggcttagttattgtggtggtaattgttttgtcattgttaagaaagaagcaatacatttcttatgaggcattttttctaaaagtttatagtattcaaattttactgtttttaatggtttttaaaaatgagatgtacttttcgatggaaacaaatgcagaaaactaccgtcttaaaagaagaataataataaatagaagttttactgttccactaatcccagtatattttcaatctcaacccctttggtatatccttgaaagatacctgctctactatagctaaaattttctggtttttttgccctctacatgtatgtgtaagaattgtaagctttaggataccagttagttagaatttagctttgtagaatatgctcttttcattgtgtggagggcaacatctgtgaggcactttaggattagaaagtaagttaaatgaaaatgttaacaaagtagggattggctcattaattctgcaaaattagaggtcttttcttttgctagaagagagtattgaaattctggagtggggatttttattttctttccacagtggtactactcttgagccaaactgtaccatttcgtatagtttcatttctatggttcatttctttgactgccaccaaactacaccctaaataatcacaagtttatgtattggagctatgttgtagtcaatgaaaagtcacatatctggttaaggtagtcacatttcatagataatgactcccattcaaatagggaatacattaggatgcctctcttaaagggatgctgtttgcgaaaaagattacctgtgattcaatgataaaatgatagaaatgtctttgtcattggaagttgttaagtgttcagggtaagggtgtttgaaaggaagacacaattcattagtgtttgctctcagaggtgcattttattgggagaagaaaagtgggctaactagatgggttattcagaacatctcagccttacacagggaatttatcataattgaatatttcaatggaacattattggaagggcttggttggacacatacctcagagaagcaaaggggttgtttctgaatgtgctagtgtgtgatacatttaattacttgtttatcgcctgtactgtttggattactttctctgtgtacgtataattaggcatctctctctgtaatatactcctaaaccttgtactgtcctcacagctgactaaatgataaagtagcttcagtcacctatcttttctttcagtttctctttccatcattatggttgttgtttgcttatttccaggctaattcaaagtgttattgagaacctatcaatttgttgtcccatgtagtatagttaataacgttttgggtaacataattttagtcttttaaaaaagtaataaaaatactaacagtagctagcatctattaaatacttattaggagctagatgtttttacatctgtttctctaattctcacagtaacctggccaaggcatgtgtaatactccagttttacagatgaggaaactgtaaaccagcgaggttaaataatttgtctcaaagttacacagcctgtgtgagtgacagagttaatatttagattcatgactttctttctctaacaccatgggtctttatgatctttttgtgttgtttgctggttttgctttggacttcacaactcgacttgtttgcttatcttatcccttccacttggaatggcatctccttaacagtttcagactctactagtagcaaatgtacctattatttaagccttagaccaaatgccacccttctaaagcttttcttacagtgccatttggaagtaaactgtctcttttgagctcccacaatactttgtacctttctttgtatatttattttgccttcagttataattattgctaaacatatcttaatttacccaatggagactgtctttgatttcctgtagtgtaagacagccttgaacactgaaggtactcagtatttgttgacttgacattacaggtaaaaacccatcaaaataggagtaaacactattgatgcttttgtaaaaaaaattggaagaacatggcaacatggtaatgatttgtatatttatgatcatttttgcttctcgttatttgaaaatcttgctaaattttgctggtggtataattaaatgtggcatgcatttcctggtttggtgaaaaggttcataatcttagctatcattttctttaaaaaaagataataaagaaatgtctgtttggcaggcaggaagaacctgctgttttaattttgttcacagcagtgggtcagattatgatcttttggagctagctttgataatagactcaatataatattggaattcaacaattggttattgttgagtatattatctcttgcactgatggctgtcagtgggattgccagactgtttagaataagtttatggctgtttagaataagtttatggcaaatagtctgctcttctctaaatacaatgtttccatttattacttactgtagtattttatatgtgcattgtctttttgttttgtttttagttttcttctcagagagaggcaattaaaccaaaacttgctcaccagtgggggtggggaatcttactattgattatttattcaaattttgaattatattttttcttctaaacgtctttaaataggccttttccctcttctaacttgactgattaacatttaattcaaacaaagattaacaaaattttaaacacttttatggtgataaaggcacactgtggttataatttattgaattttgagctccgagtctctgttaaactaggatttctgactgtgcttttatagtttcttctatctgaattcttgaaacatcataagactctatttacttccctcaaaggagaagtccttttgttaagataatatttttaaatgaatatcagtctttttcatttcatgtctcttggacttgatgaaattactcatgaagcaaaaggtggataggagacagtaactcaaagaagtcttttggcccttaagctaagacagtgggtaaaagttacacaaattatgagaccagcaaaagcactcttaattttaaggtttgagaatctgattattaaatatccattgaaataatcagattaaagccataaatattctttaagcatttgacattaaccagaatctacaaaatgattaaagttttagttctagtgacaggaatttaaattctccttcataaaattcctgttgttgttaatgttaagttattgcaaaagtaacacatgttaattctagggaactagtataacaattctaatagtagctaactttagagttcattatattttgctatttagcataaacctgttagtccttataacaatcatatgaggcaaatactgttatttttcctatttcatagatgaggaaaccgagcacagagaaatgaagggactttactgaggccatacagtatttggactcaggcagtttggccttagagtctgtgcccttaacctctgttcagtattgcttctcactgagtggttaagatttggggattgttaagatagacctggattgaaatcatggctgccactttatactcttgggagaggagtatatttcttgacttctctgagcttcagtattcttgattataaaacaaaggttgttttagggataaaataagatatattaactgcttatcccactgttccccagatgctgtgcttgttcaatagaaggtatcatttaaaacaaataatgagaaacaaaaggaaaaaagtcaccaaaactaaacaataaccattgctaacatttcgagttatccagtcttgtaaaacacgtttcttgattttattaatatattttttctttatattaattttctttcatgtataactttttcttgtttttgtttcacaaaataaggtgggaagacttggatttgcctgtatcactaagcagtaacgcaagcctttttcagcttctatgctagccaaaacttttttttctctgtttagaagtgggtagatggagatagaggaggacatggaagtacacccacttttttttttcctttttaaataaaaacaggattatgtttaaaatttcttatataacatctgcagatcaacaaaatctaggatgctagaagtagggagaacatgtgctagtattacttttattaaaataacaatgaaactccagtttcagactgttaagagttgttaactgaaaatactatatttgtataaacaatcctaatgaatgtagactatttcctctcgatgagtgagcttgtagaagtctgaccatgtgttgcattgttaaataaattcactaggtgtagcatagcagtaactaatctgtctttctatagctttagcaacaaagcatggctaatgcttttttttttttttgtcttttagatctacacacaatgagctggaaaagaatcggtgagtcagtgatgaggtacagctttcacttacgtttaaaagcaaactcaccattttacctgtgaaaataatgtaatagtgcatatgtagttgtaattttatttttcagatgtatagcccattgtgaatctgatatatatgtattttctccaaaaaatgatttaatagtaagcttatagcagctagaagacataaatacatttttaaagcttactcgaatttgagttttaggtatagcctttatttctgtctctgaaaatgagttaattgttacaagctcatggtttaaatgtagttttgctaaagggtaggatttctaaagagtaggtaataagcattacaaattggagggcattgaatttttcttcctttgtaatttgttcattcattcattcatttattcatgcattcaacaactatttatcaaacatgagctgtatgtcagtgccaggcaggcagaatgctttatataggaaatacaagaatatatatgatagtttttgtccttaaggaattcagaactttgtaagggaaagacaggtaattaaagtactatataatgtggtaagtatggtaatggagaagcagaaggtactagagggtactgaaagatattttagaaggtcacctgatacctttttgaagggagtcttggaaagttctgcagaggatggtgagtgagcagtgtatactgaggaaactgcaaaaggttcagtgtgactataaaagattgtaacatgagtaaagcatgccaggtgttgaagagtcttgtctaccatgcccaagagtttagacttcctgagacccatagggagcagttaaataattttaaagtggattatcatatgatcagcctgtgtcttggaaatatcgttttggctacagcttgaagaattggttggttgggagaagggataccagaggcatgaagatgcttttgaaggctattgcagtaatctaggtaagagatgatggtggccactgagatagaagtagacaaagtaaagagtatggaatggagtcaatagaaattggtgattagttagctatggatagttgagtcttagatgatattactgttaatcaagaaaagaaatagaagaagaagacaaatttggaagagaacataagaattgtaagagtaaaatactttctttttggtgtagagattagattaatagcagccaggcatggtggctcatgcttgtaatcccaacactttggaaagcccaggtgggaggatcgcttgaagcaaagagttcgagaccagcctgggcagcaaagtgagatgccctccatctctaccaaaaaaataaaaataaattagctggtgtggtggcatgcagtcccagctactcaggaggctaaggcaagaggatcacttgagcccaggagttgaaggttgcagtgagccatgatcatgccactgcactccaacctgtgtgacagagagtgagaccctgtcttaaaaaaaaaatgagagagattagattaataacaaactgaaatcatatgtaccagctgtttttgacaaataagatctcatgaccttcaactttttgtcctccctttaacaaaaaatatattggctagcccaactgcctcattgcaagtaagtttaaatgtcaaatccccttgaaaaggcttagcatagtttttcaggcagactcagtggcttttactactttgcacagtgctgtgttcttgtctcttattgtaaggctgaataggtagcattgtaattatttctgccaaatgactatgccccaaatgcaaagatactgttttgttcaattttgtatcctcagtgcctagcatttgaggcatgtataggagacaatggctctagtattgagtgaaggataaaactggaactcaaagttgagtggtctagtcaaagacattttggtagttagtggtagaaactccttcgttttaaagaatcttttctgccttttatttctgatttattaaagatctggatggataaaggaaggacatatctggctattttaaacataacaaaaaagactaagaaatgaaacttctgaggctcctaaaaataaaaccttaaattgaagtttactctaaattagatcatagagtatgttttgggcccatggattaaatattgataaacatgtggcttttatagttatttcatttgaatgtggtccttgggagaccttcattggaaacctggtgaaaaccattaacactggactagggactctctttagtaactatttggaatggagctttaaaaatctttgattcagtgatgatgagcattttttcatgtgtcttttggctgcataaacgtcttctttcgagaagtgtctgtccatatcctttgcccactttttgatggggttgtttgtttttttcttgtaaatttgtttgagttcattgtagattctggatattagccgtttgtcagatgagtagattgcaaaaattttctcccattctgtaggttgcctgttgactctgatggtagtttcttttgctgtgcagaagccctttagtttaattacatcccatttgtcaattttggcttttgttgccattgcttttggtgttttagacatgaagtccttgcccatgcctatgtcctgaatggtattaccgaggttttcttctagggtttttatggttttaggtctaacatttaagtctttaatccatcttgaattaatttttgtataaggtgtaaggaagggatccagtttcagctttctacatatggctagccatcagagaaatgcaaatcaaaaccacaatgagatgccatctcacaccagttagaatggcgatcattacaaagtcaggaaacaacagatgctggagaggatgtggagaaataggaacccttttacactgttggtgggactgtaaattagttcatccattgtggaagtcagtgtggtgattcctcagggatctagaactagaaataccatttgacccagcaatcgcattactgggtatataccaaaaggattataaatcatgctgctataaagacacatgcacacgtatgtttattgtggcactattcacaatagcaaagacttggaaccaagccagatgtccaacagtgatagactggattaagaaaatgtggcacatatacaccatggaatactatgcagccataaaaaatgatgagttcatgtcctttgtagggacatggatgaagctggaaaccatcattctcagcaaactatcgcaaggacaaaaacacaaacactgcgtgttctcactcataggtgggaattgaacaatgacaacacatggacacaggaaggggaacatcacacaccggggcctgttgtggggtggtggaagtggggagggatagcattaggagatatacctaatgctaaatgatgagttaatgggtgcagcacaccaacatggcacatgtatacatatgtaactaatctgcacgttgtgcacatgtaccctaaaacttaaagtataaaaaaaaaaatctttgattcagttttgtttaatgcattttgcagattatttctgactcattgataacctttttaaaaaccctcacagaagatgtgtgcatcacccatagtattactttggtatgccattataagttgtttaatctagcatctagctgtggcataggtataacacatgtggttttattacctgggctgtgtgtaatctccaataaaagtcatttgttcctattttatttacttagatataagactttcaggctggtttcttaccctaccttacttcacttaaggcatgatttcctcatcatcttctaatagctttggaagtgctaatagatattctttattagcccaaaggactaataaacattgtttatttctcaaattatttcttccactctctctttactctttttcctcctttactctctctattccctgaggcttcattgaaagatgatatagaattaacttttccaagatatatttgtttttaaaagggatttttatcaacaaaaataaaactcgaatttagaataataatctgtaccctacttctgggaagttaccagtggtggtctggcaaaaaacaaaaatactggtagacttaggataggggaggtggtttagcaagaaggtggcacaggaatatttttaaaatttaaccctgtattatttttacattttaaggcccccatccagttctgtttaacagtcctttttaccaaggcatcatttttatttgacgtgttaaacaaagaaaagttattctagctttggcatcctttaaaataaatagaattttggctttacctttgatctgcctttgagtgtgatgttatatgaagatagtaactcactatgaaaagattagttttgtctttgttctgaaaagacattcctgaagtaattcatattccttaaaatttgccactttgtataacatattcatgtcagaaattgcttttttcctttttagcgtggttctgaaatcttggatataagcttctctgagttagataagctggaacaactgatacctcagtatcagttgttactgattacagtacattaaatacaaaaattagacaggcatggtggtgcatccttgtaatcccaacttcttgggaggctgaggcacaagaattgcttgaacctgggaggtagaggttgcaatgagccaagatcacaccactgcattccagcctcggtgacagagcaagactttgtcaaaaaaaaaaaaaaagaaggtacactaatagtgtttttcatactgaaaaatgaaactcactagtggtctatgtgatcatttagtgaatcattttgaaaaagaaatggaagaaaataccaaagtacactgcatgaagtaaagttaaatatggaattgtgaaacctgtgtatactggattatgatataaaatactgtgggtcatagtcaaaacctactactctggatataagcttctctgagttatgataaaaaacataattatttttattggagcaaatgcagtgagatttggagtaggtgattttaaattgctggtgaatggctaagtaattccagatagctatctcaaacaaaaccgtgagattgttgaagccctggggtctggccttaaggagataatagccaccaaatgttgaggttcatactaccagatctccgagggaagcctaatggtggagatttgggttttggcaggcccagagtagttggttgtgatccacaattaccccaggattcccatagcccattagggagctctaggtagtttcaggactgatagagaaattcagatttttttcttggataggtcttgggagctgatatctgcccaaatccttgttggttatactgagtatgctctagatggttcagagcatttgttacctatgtaccaaccctgtccccctaggcccacaacaggtcataataggcctaggagatggaggggaagcaaaatacttcagttgttctgcattcctcaggaacctatgtgaatcatctcatggtaaacttaatgagactttgagattgaagaattaagatattactttgcccattggcttatcttacagtttgggtcctttgccagataagacacaattcagtatcagtacagattttagattgcctcattgttttttcattttcttaattcaaattgctgatgatgttttagaaagaatcaacaactttggccaggcatggtggctcatgcctgtaatcccaacacttttgggaggctgaggcaggtggattgcttgaggccaggagtttgagactagcagggccaacatggtgaaaccccatctctactaaaaatacaaaaattagccaggcatggtggtgcatccttgtaatcccaacttcttgggaggctgaggcacaagaattgcttgaacctgggaggtagaggttgcaatgagccaagatcacaccactgcattccagcctcagtgacagagcaagactttgtcaaaaaaaaaaaaaaaaaaataacaactttaacaggactctgatggtcaagaaccttagtgctgactgcaggagaggccatttaaccttaaatagctgttattccatcaaaacaaaaggcttatccttattataactttggcaaagctagaagggccaaggagaagtgactaagtatttgttaaaaaaaaaaaaaaaaaaaaaaaaaagagaaggatgtctagtgagtagtaataggtattctccatataaggactttcacctacctctgagggaaaattggaaattagcatttatagagttcttactgtgttcctccactgtgcaaggctattacataattctgtaaggtagaaaggcagaaagtttgagtcaaagtgtcaaaaactggccattttatcatcatagctacaatttgaaacaagatggatacaaacacaaaacagttctaatcatgatcctttttgatcatgaatatgagagttacggttaatatcaatctttcagcaacaattaataaataccatgtgtggcatcatgatagatcaaatgaagtataagataccctattctattctagttaaggttaaggtcattatagtttggtatttatatttcacctttcagtaccattatctagttaagttaccagtaaatgtctagaaaggtacactaatagtgtttttcatactgaaaaatgaaactcactagtggtctatgtgatcatttagtgaatcattttgaaaaagaaattgaagaaaataccaaagtacactgcatgaagtaaagtgaaatatggaattgtgaaacctgtgtatactggattatgatataaaatactgtgggtcatagtcaaaacctactactctgggtagttaaggagaatgtatactgagccgtgaagaagagagataatttgaatataagaaaagaataaggaaaggagtcagtgtgagtagagccatggaagcaggaatgtagcatcataagctgtgttcaggaaggagtgggtagaccgtattgagttaaatagcagagtcttatcagattagtagtggaagatgaggctgaaaaggtggtttggaattagactgtggaatgttactgaatgccaagtaatttggattttattttattggcagtggtgaatttttgaggcttttgaagcaaagagataggcatgtacaaagcatttaaaaaagtacaatctagtagctgtagaagcagggagaccagtttggatgctttctgaagtagtccatataataaaaagatatgagtcagcactcaggtgatagaattgggaacagaaaggaaaacaaaggtctaagaaacactataaataaaaagtattttctgttaattggtactacttatttcttcacatagctgcaaaagttatcttctcttagtgcctactgcagcaaggaaaaaagaagtgatcttctcaaagaacatatcaaattgagtcatttctctatttacagtcttccattggcttctcactacaattagataaaatctgtggcctacaaagtgcaccactctatcccttctgtagctcttctgacattgcttcctttcctttctttaaacacagcgtgatcatttccatcttagggcttttgcacttgctgttccttctgcttggaaagccctgctctagttcttcatcattatttagttctcaactctcaggtcatctgcttagagaataataatcacctcctggtcacactctatcacattactttttatgtcgccttaacatttatatctgtctgagttatttattcatttatgctgtctgacttctttcactaaaatataagtttcaggaaggcaggactttgtcttatttaccctagcacatagcagtcattaagtaaaaattcattgaatgaaaaaatgatatgtgatagtagatttataatcaacatgttttcacattataatgacttcagtgaaaagtgatgaagatatatactcttgagagttcagttgacataataaaagaattttataataggcaaatagaaaatttaatgaattcttaagatgtaaataaattatatgagaaaacttgataagtaagaacagcttaaaggatttttaccatgccggagtttatcgtacttttttagaagcatatggactcatttagtcctttaggataccatacagtgcactaagataaggataggtaattttataaaggagaacactttatctgatgaagtttatgctatacttgtgggatctttattcctttctcatcccatgacttgaaaatggtaagcatttttacaaggaaaagatttgtttatacttgtaggcaagaatcctgtaaaaaatttcaaatttttcatgttagaatttttgatggattagttctgtttattccaattgtttggacacgataatgaatgcatttttttttctatactgcctatcgtgtccccattttacatggatgttttgagagagtgatggttttggtctgccttatcttagaacaaaacgtaagagtaaatctttatgactgagggttaggcagtgttttctcttggtacatcatcagactaatttaggattccttggcaggaagaacatatctgaaatcgttttcactgcctattttgtatgcttttaagatatttgtttaaaaagggcatagtttttttacacggtgtacacattctacaaaaaaatgtacacttgttagtaggaaagaaacaacattggtttgacagaactttctttaaaactcttacctcaactaatagtacttaaagggtatttgcttgcattaaagtcaggttgcagggttagggaagtcaaacttttattctaggtttgaaattaacctataacttcagctggattaaaagtctacagttttagattgggtcctgtaattttggaaagtttagtcaaaatcccattttagccttggtttttactaagatgcaaagggtattagtatgtctcaatatgaaaataccttagagtaactttctcaacctgataaacagcattaatgacaaacccacagcttatggcacttgtaatggtgaaaaactgaatcctttctccctaagatcagaaataaggttgtcaactttcatgacttatactcaacattgtactggagcttctacccagggcagttagataagaaaaaaaaaataaaaggcatccagattggaaagaaagaagtaaaaccatttctgcttgcagatatcatgatcttatgtacaggtatacttcatttattgcactttgcagatactgcattttttagcaattgaaggtttgtgtcaagcaggtcaatttctaatcgcatatgttcacttcatgtttctgtgttgtattttggtgatttttgcaatattttaaactttattataatttcatacgttacgatgatctgtggatctgtaatctttgatgttattattgtaattgttttagggtgtcacaaaccatgcccatataagatgcagacttaataaatgttgtgtgtgttctgatggcttcactgactggctgttgccccatctctctccctcttattgtccctgagacacagctatattgaaattaggccaattaataaccctacaatggccactaagtgttcaagtgaaacaaagagtcacatgtatttcactttaaatttaaagctagaaatggttaagcttagtgaggaaggcatgtcaaaaaccaggatagactgaaagctagatctcttgtgccaaatagccaaattgtgaatgcaaagggaaagttcttaaagggaattaaaagtgctactctggtgaacatccaaatatgaaagttaaacagccttatgggtgatatggagaaagttttagtagtctgtatagaaaccagccagaacattctcttaagccaaagcctaatccagagcaaggccctaactctatttaattctgtgaaggctaagagaggaggaagctgcagaagaaaagttggaagctagcagagtttggttcatgaggtttaagaaaagaagtcatctccatacaaaagtacaaagtgaagcagcaggtgctaaggtggaagctgtagcaaattattgagaaaatctagctaaaataatcaacgaaggtggcaacagattttcaaagtagacgaaaccatcatctattggaagaagatgccatccaggactttcatagctagagcagaagtcatagagaagggaagtcgatgcttggcttcaaagcttcaaaggctgggctgtcttaataggggctgatgggctgatgtagctggtgacttgaagttgaagccagtgctcatttaccattctgaaaattctaggcccttaagaatgaggctaaatctcctctgcctgtgctctgtaaatggaacaataaagcctgaatgacagcacattgtttatagcatagtttactatttgacgcctactgttgagacatactactcagaaaatttttttaaaaaattattgctcatcgacaatacacctggttacccaagagctctgatggagatgtacaaggatattaatgttattttcatgtatgctaacacaacatccattctgcagcccattggaccaaggtgtgatttcaactttcaagtcttattatttcagaaatacatttcataaggctgtatctgccatagatagtgaatcttctgatggattgggcaaagtaagatgaaaataattacatgtacaatagcatctaaaagaataaaatacctaggaataaatgtaaccaagaagatgaaagctttgtacactgaaaactattaatacaaaatacttttgaaataaattaaggaagacctaaatagatgaaaagatatcctgtgctcatggattggaagacttaatattgttaagatggccgtactttccaaattgatctatagattcagtgcaagccctatgaaagttccagcttcctttttttttgcagaaattgacagctgataatataattcatgtgaaaatgcaaggtacccagaataaccaaaacaatcttgaaaagaataaagttggagagcttgcatttcctgatttcaaatctcactataaaactatagtaatcaaggcagtatggaactgaccaaagaacagacttactgattagtggaatagagttgagcgtgtagaaataatttctcacatttatggtcaactaatttttagcaaggatcacaagacaatgtaatgtattttcaacaaatagagcggacacaactggatacctacatacaaaataatgaggttggatccctacctcacaccatacacaaaactcaaaatggatcatagacctgaattttttaagagctaaaacaataaaattcttagaataaaacataagtgtaaatctttatgatgttgcattaggcattggttttttacatatgacaccaaaaacacaaccaacaaaagaaaaaaatagacacattagaatttatcaaagtgagctgggcatggtggctcatgcctgtaatcccagcactttgggaggctgaggtgggcggatcacctgaggttgggagttcaagaccagcctgactaacatggagaaaccccatcgctactaaaaatacaaaattagccgggcatggtggtgcatgcctgtaatcccagctactcgggaggctgaggcaggagaatcacttgaaccaaggcagcagaggttgcagtgagctgacattgtgccactgcactccaacctaggcaatagagtgagactctgtctcaaaaaaaaaaaaaaaaaaaaaaaaaaagaaatggccaatatacatgtgaaatgcttaatatcagtagtcattagggaaatgtgaatcaaaactataagataccacttcacagttactaagatgaccatctagggttgctcaccaactttgtagtcatccattcatcataccagttaccactgatcagagaaaggtcttgaaaagtccactgagtttgcagtttggcacttaaaaactgataatgtcatcatcagctgatggcactgcacagatggctcaacactttgcaattacttaagacatgtaattaaccacaggtaagttttcaatatattatgtggtgccagtatgtaatgtggtatgagtatttaataatggagaaagattagtctctatttagcatatgaaaagaatatacctttctttcagctggaattaccgtcttccagtaatttaccaaaataacaaacataaagggaaagaggaaagactcctgatatacgttctctgggtttcttagaaaacatggaattgttcctttggccacagacatgcgattctacaaaaaagatgatattgtagatatcaaaggaatgggtactgttcaaaaagaaatgtccacaaatgttaccatggcaaaattggaagactgcgagcatgctattagcattgttgtacacaaacaagttaagggcaagttttttttttggttttttttttttttgagacggagtctcgctttgttgccctggctggagtgcaatggcgcgatcttggctcactgcaacctttgtctcccgggttcaagtgattctcctacttcaacctcccaagtagctgggattacaggcacccaccaccacacctggcaattttctttctatttttagtagagatggggttttgccatataggccaaactggtctcaaactcctgacctgaagtgatccacccgctttggcctcccagagtgctgggattacaggcatgagccactgcgaagggcaagattcttgccaagagaattaacatgtgtattgagcatattttttaagcactctaagaactgaggtagcttcatgaaatgcatgaaggaaaatgatcagaaaaataagccaaagagaaaggtttctgggttcagctgaagcaccagcctgctctatccagagacgcgtactttataagaaccagtggaaagatgcctgagctgctggaacctattccctgtgaattcatggcataataggtgtttaaaaaacaaacaaacaaacaaaaaacaaaaaccctctggaaaaaaaaataaggggggaggtataggttttaaggatttctaattaacaatgaaatctaacaaaattaagactagatattgaaagaatttactagttttataaatttcatttaacaaaattaagactagatattgaaagaatttactagttttataaatttcatttaagatgtaacagaatataacttgattatatttgttatgccttgaacaacaaaattaagaagtatagttgtggaggaaaggaaaaacaacattgtccagtgatcaggaagtagctactgatccagttttctggattttatttctggcaaataaaaatggtggttacttcccatttttagcctaaaggtagaaaattgatacccatacttttaattattgcaaaagtcctgaagaagataattatattctttgtacttttttagacagtaggagtccagttgcagggctgaattatagagggttactgtagaacacttatgtcttggaaagtaggggccactcatttaattgaattttcttatgaaactcttagaaagtaggtgacactcatttacttgaattttcttaggaaccggataaatatgtaaattaacattatcaaacagtatgaagaacagtatcatttatcagagagctatataattcatgtatttctttttgtatgcaagtaaatgaatattttaactgtaatttctatagggataggaatactgaaaactgtagaccaactaaaaatagttgtcagagggcagagataggcacctgttagagttagaattgaatgctatatgagataaagatgaagtaatgtgcaggttttagagataaaatagaggaaatgtagccaggataaaattacacatctaaaatgcagtctgtacaatgaagtcattgcagttgtgtctagatagattcacagtttctatactgacctttgttagaaatagttcattaagactaagctttcttctccctgacctaggttacatatacagcaaggtgacagaggctcattcggagacaaagactgaattgtaggaaccaagtgtttttagtacttcagctagccagttattaaagtttaaagcaattctacaactgatgtgtgggaagaaatgagattatgagatcttaaaaaataatcagaagtactgtaacttgaaattcagcttctaaaattttgtatagaaataaacaaataagtcagacattgaataattgacatggtatattatagcgaagttgtggtagctttttatgcaagtgattgcagagtgcctaacttaagctgtaacttgtttaagaaaacaattcttctcaaactatgaatttgtaatttaaaaaaacaacaggaagagtttaattaatagattttcttgagatattttagatgatgcaatgtaaacaaatttattttatatgcagctttgaggaatgtgtttgattcataaactgactatacctttagtactgatgcttgtaataattacacaggagaatcctactagactttaaggcaatatgttattttgctaaattcttttgctgcatattgtaaaggaatttgtccattgtaaatgctgtgataaatattgaaaattgaatagtaagcacaattcaaatactttttcttaaactagaatcttcttcatttaaagataatttctattctggtacaaattttggcaattaaagcatgccaagaggaaaatcagtaaaaaatgtctttttattagatgagagactttgttagtatcttgcatttatattctaaaaatgaagagattcagatattttgatatattttagctgttttgaggaagaggataattctttacttcttgcttatctttttctacttattctagtaaataatgtcaatcccatgacagtgaaagtcccgtaagtgttactagtgaaaaactttaggtctaaactaggattcagtaatgacaacagaatttcctaatctgattactagctaaccagttctttaagacgaatttgtttggaaaataattaatcagcactatgacaaacacatgacatagtgcttatactcacatcttctaaatcaagaaaagttggaacttaactcataagtaaatgacttccttgttttgttgttattttgggaaaagccaatggagaaagataggttttaatactaaacatgattttggagccaaattgtcaaaaatgatacccagaatccaacacagatggcccttgggagatatgtaatgcattgacatgagtatcgtaccagaagtcagaagacataatttttcctttcatctctactactgataggttgtgaatgttgtataagttaaaccacttcttggagtcttgcttttcttggctattaaaggaggatctctagatgatcttagaaatccctgcctacatgtaaagttttgtacagttttgtgaatttttgagttaagtaattattggcatattagaaacttagttgttactctgctgtttctgaagcattttccttgatacaggtgtgtgtgtgtgtgtgtgtgtgtgtgtgtgtgtgtgtgtgtatacgcccacagatatatacatatatataacacttgagacacacacacacacacatgaaatgaaagaccagcaggaaaaatcagcttagaatctcacttcatttaaaatttggtactttgtaaatatctaaagattattataatacatggtactgtagctataataaggttttaatttataatgaagaactttgataagtagtaaatatttatataagactagaatttgccctaagaaacatatatttgtgtgtatactacaaacacattcctcaaagctgtgtgtacacatacacacactcatatggatagatatagatacaaattctgaaatttaaatgctcaggaacattcaggaccctgtcccttttggaaaactacttaccactgacttctaaggaaatgtagttaatctggtaagcattattgtgttataacttctggccacttttttgtattctctgacaagtttatatttgctcaggctccagaaatctggttttgtggttgtaactgtattatattgttgtatctcatcagtcactttaataggctccagtgatcactggatggagtgagccatataccaggaggaaagagcacactgctcttacacaaaacaaggagcacagcttagctcatctaaaatatttgtctataaacaatctgaagagaaagtagctacaggtcagtatgttggaatctttcttcctaaccatttagacaataaaagtagcttttaaataatgtcctcactgctttgataatctgccaagccccattcctaattctaggacatgtctactgtttattttttttgcttgcagagttgctaagcgttggaaatgagagctgtgctgactgggtccactagatagttatgctgtgtttaattgcagccttctatggattggccattttcacttctcattgtccccctgtagcatttatcataatgactattcaaaccattttttttttttttttaacccctccaagagagtgtgaggcaaaagccaaagctctagaggtcatcaaatcatattgtggtttacagacaggaccttagttcctctaaaattacgtgatagagatgaatgatctttaagatttcttctagactaaaaatttctgctatttgaagtacccaatcccactttttactcttagatctagtttttgaatcaatggctaggacccatatctcccatctcctagtctaaagatatttccagtataccattgtgactcttcatttctccctttgctgaaaatatggatgcctggtctgagctttttcatcttctcctatattttctacctttataacttcagctcagattgactatatactccccctgccttgtgaacttctactcatgtacagataggcatgaacaagaataacaaaagtgtttataataaaaattagaagtaacatgaatttctgttaacaggggaatgactaaataaatgatgatacatccataccatgtagcaagtaaaaagaatgatgtagatgtgtatatgtgtatgtggagagatttccaagacatattaaatgaaaataagcaaattgcaaaatggcatttcaatatgatctcatttatgttaaaaaataacaaagcaaaatcacatacagttggctcttgtatctgtgaactccacatccatggattcaaacgactatggattgaaaatatttggggggaaaattgcatctatgctaaacatatacagactttttccctgtgtccttattccctaaacaatacaatataacaactatttacatggtattcacattgtagtgagtattataagtaatctagagatgatttaaggtatagaggaggatgtacataggttatatgcaaatattacaccattttatatcagggacttcagcatttggggattttggtatcccccattgatactgagggatgattgtatttctatatgtacatgtatgtgtatgtaaatgcatcgaaaaggcacacctcaaaagagatgtcagatggatacacttttgttacttctggggaaaggagtgagattcaaggggaaacgatcatgttgattttattgtcatagtttctgtagtaagagtgcattaatttgtgaacttaaaaaaagattttttttgagccacttagtttacagtactttaaagtaagatttttaaaaaggcaataggtgtattctattcatacatttccacagataataaaggtgggagagaccttagaagatcatctagtagagtactgaaaatctaagtccctgtaagtaatatgctctaccagtctggttaatgacaaagtcaggatgagaaactaggttttctgattcgcagaccagagttttttacactaccttcaagatgcacagctaagatacataatttttcacaaagtgtttcctgattatccaaactgatctctctaaattcctatctcagattcactgtttgtgtcacttgtatgaattttaacccatactactttatactgttatttcctccctttctagatcatttatattcttgctagagcatatatattccatgagggcagaaactgtaacttgcttgtctttgtatctgacacggtgccttgcacttagtacttaaggtgaattagtaaggaacatttctgtagcaggctctgcacctttcgttagattcagagaaaaaagttgactttggccaagtcaaataaatagctgagttttttttgtttttgtctttgctggtaaaacctgccatgtcgagatagaaaatattttaggaaggcacatagtgagatatttgctaccctgcaaatatattccctttccaaggaaaatagttttgttctccactcctgcttcaaagagaacagtttgtccccatagaatattctaggtaatatgacccacttaggaaatatgtggtgattgtgcttcataatgggacctctttgctaaagttgtaccatgagaaaatgcctcttgagtgcaatggttttacagatgaaagtacattttttttctgtatttgaattggtacagcagaccaagaaactccattgtgacttcaagtttactataattagcatagaagctgtgacagatcttttctgttatgaaaacctttccttagaatttttggaatttatacaagtatctggcccttgaggtgttgttaccctgttctgtctaaatagctctataatttgatatagcatctttgtagatttcagcttgcttttcgagatatactcttttctatgattttcatctgcagttgtgttaatcctattttccttctgatttttttgtttcttctcacagctatttaatttgacatcatttaaggcctgtagaattatttacagaaatagaatctttcatggaagtttccatgatctgctggaacagtgatcttggacagagccttaggaagacccattcctttttggaaagctaattgtctctcttagtttagaattaatagctttaggaaaatatctcaggatgttctaaatttccatacatgctgctagctacagagattgttattgaagtggccaatgggttcatctggagccatttttctgttaccataatttaaaagtgtgtgtgtgtgtgtgtatgagagagatacatatacacatctttttttccacaaaggtatatgagttacatatatgtgagttctgagtttgattcatttgaaggctgtgaagcaattagagataagaggttattaaaaagaaagtaatttataactattttagtgagtttcaaatatggtataccaaaacttgttcctgctgtattgggcattgtattagaaattttgaaagtagttttgtttagcacattctgatttgctgtgcttagaaagaaatatattagtaattgattttttttttttttttgagatggagtctcgctctgtcaccaggctggagtgcaatggtgtgatcttggctcactgcaacttccgcctcccgggtttaaacgattctcttgcctcagcctcccgagttgctgggattacaggcacccgccaccacacccagctaatgtttatatttttcatagagacggggtttcaccatgttggccaggctggtctcaaactcctgacctcgtgatccgcctgcctcagcctcccaaagtgctgggatgagccaccacgcccgtcctagtaattgatttttaaatattcttgagatcataaaattttaaacttcatccagatgaagatttcttatgtagattaatttactcaggcaaattcctgttaactttatcatattatttttctagattttaactggctttataatttgccataataaaattccattcatttaaaattgtagtcaacaatgttttagtttagtattagttgaatggaatataaaaaaattgatttttaaacattagcttgaggctagtgctggttagtgctttatgttaaaaattttttttttttcaaatggtggtcctcgatggagaaatgttttctagaaatggtatacagaactgtattctacttctatttaggattttttagttcggatatgaaaaagctggagctcaaatatatgtttgagtttggcaccttcaatttgcaaaatggacacatctttcttgacaggtgaaggttttgatagagctctgagtacggaggagttagatgctagtacaggcccaacattggttaggaataaataatagttaagaattgtttatcttttagcaacagttttactatattcaataaagtacaatttggctcctctctctgactcttcttcctcaccctttgcactttagatgacataacaaggaaatacgttaaaactttagatttagggtttgtttcaaacttccttgattacttgatcttgaaaatttaggatttgttttgaacttcctttgattgtcaatctagggtgacttgcaagtaatgggtaattatgctaatgtctcttaacagtcttatataccccaagatgatgttttctgatttgaaatttttggtggaaatggagttcatttgaagtggtatagttcctgacactgacagaggacttataaagataattacaaatcaactgacaagcacttattagacattgtgtgctaggtaatgggaataggataaaagaagtagaagtcctgagccctgctctggaggattatagtctaggtagaagacaaaagatattataagctcctataagcagcatataattaagtgctaagttgtatgtgtttgagatgggagttgaggtaaactcatagcagggggttatcacgggctgaggctaatatgaactgcttagacatgagtggttattcctctgcatggttctctcttggagtttgccgtaattggtttttatcatgttttcagtatgtttaaaagggctttcaggagaaacactacatctgagtctcttttgctcttttaatcattatagttgtcacttactctggggtgaaagtgaacttgcagcttttcagcatggataagatagatataggcctgagagtacatttggagaatgtgatacaaccttcttactaatttatggtcgcttttctggtatgtctctgatgacagctaaaatacagagtctttttcttttctttctttttttttttgagacagagtctcgctcagttgcccaggctggaatgcagtggcatgatcttggctcactgcaacctctgcctcccaggttcaagcagttctcctgcttcagcctcctgagtagctgggattaagggcatgtgccaccatgcccagctaatttttttgtatttttagtagagacggggtttcaccatgctggccaggctagtctcgaactcctgacctcgtgatccgcccacctcggcctcccaaagtgctgggattacaggtgtgagccaccgtgcctggcctaatacagtgtcatttttaatggctgtgttttctatgaaggagtgtctacaatggttctccctctttttgtggtggcaatgttggtgaatgcccaaatgtcttgtgaaaacaaccaaaagcctcaactgggacagatcaatctatcattacctctgagtaaatgaggatacctgaacatccagttccttagccctccataatttcttagaggtcattgtgttttggagtactattgaagatgtcaactttattctagcaggccctatatgatgaagagcctactaacttttgagatcatgtatttcacgttgtacattatattttatctgagtgcttctcatcctttaatagagaaccccaagcaagatgtttgcatgggaaatcttgtgccttttaaaactttctgcctgctttagtgcatcaacctgtgattattgatttttaaaaattttaacccataacctatctcttataagcttccctaaaaactaagattgataggggattttatgccattacagaaaaatatatgtttaatagaatcctttattttctgatacttttatcctgaagtaactagagtaaagctgaccctttaaaatctaaaatcaaatgagaaagatacaggctttctaatgttgaagtgtaatggctaaattaagataagggagaaacttggaaattaggaaaaggtacacttagatttcttcatcagaaatcataatgactaaaatgagggtgtctattccctttgaatcctaaaagaggaattctcaaattaaaaaaggcagtcttaatacaatatgtggtaactatatggggacttactaccccaataaaaaatagaaataaaatcaaaccaagtttagatcagttctttgataaaatattgctattgggctttagtaaggagatgttaggggtatgtttctgtaatatattggttactgtcttggaggacagccatcatagttttttctgagccatctgttggtgtcattgtcaaaagtgaactctttggcatttggaccattgatgcaaccaaatatgtcatttttcttcagaattgtaatgtttgtaggctttttccatcttgattcactttattccagcctgattcacaattattcctttacagaacagcttgtattcgacaaagctgtgaaaaaaatcactcttctctaaataaggttctttttttgattagaaatcccatctttgcagttaaaacatttgtaaacataacacaatttagatagagctgattgacttttcaagactgctatttttataatggaaaagaatttttcttaaagaagcaatttggtgatggggcccttagaatgtccttgaaaacagctggaatttactgctagcatatattgggtcagatgaatgagggagcatgggtttggctgatttgcaatgttcaagaaatattgatattcttagaagacaatacagaatatatgttgggtcttattttccaaaatgtcaaagtgtccttcatatgccttttgttctgtgagataacagttgttggtgatcctgaaagatgttttagaactttcatcctgcagtatctgaaaggaaatgtagccaagattggaaaatttaacctccatactctactggcttctttagttggagtagtggtcaatatgttcttgctgttggaatatacttaggcgagagagccacacaacctgcctgatgaacaactaaaatattgactggcaatggtaacaaaataaaacatgttcccctccacctgtctcttccttcttttctcaaatccctggaactgtatagatttttcagggctgttctcctgagctattgatgaaatgaaaataatagcacttgtgtagcagtccttagaaaactgtaatggtattgagctgaggctggaatcatataaaataaatactagagctttgattcctctctcatttaatcttttcctgggcttttctagaggagagtcaaactaagatttagacaaatataaatagaagcaagtcacacagtgtaatgttgcaacccagatataacttgaacccagtcttttacttgataaagaggagataattgtaattgttgttaatctatcaaacacctttcccttttcagaagggttttaaaaaataaagtagttcttaaggcatgttcactttctatctacctaaaagtgctaatctgtaagtgccctactatatataacactgagaaaatttctgccttatcagaggagggcatgcccaggattggtgccaggtgttgtgttatgctaggctgcctccaaaagttactctcaaaaactactcttcagttgggccctttgtggtcaggaaaaaaaaaaagtgatacagtataatgaaagagaggtcaaaacagttaagtaatttagaaataaaaagacataccaaaacattgattctctattattatcagggactatggcgtattttaaattctgtaaattttatttttccagaggttgcaaatggcctgtaaatgcttcagttattaacaacaacaacaacacatacacacatacacactggccaacaattcctctttgttaccctttttctactgcaaattttatctcctcctcaccaaaaaacaaactgcattttgattttgggaaaattgttctaaaatgggactttaaaaataattcctggctggcttgactggattggcagatgtccagcaatgccaaaccatttgccatctgccagtagtaagcatggttaccacttttaatcgtttagctctctatttcaggttgctcatattcagtacaaattatgaatattcgccttccagggatgaattaattcttgggccagattgttcctgttccatttaataaaatgtctttcctcctatatgaatattccccttaaaatgagctattatacaactcacatcttattagtagggccacttttaaaggtgctttgctattttcattttctgcttctagatgaacagctatattacaaagcattctttaaatgtgctgttttgtgctatgtaagatcaccattttaattagagatcagtaacagtatttcgtcatttccctcttccatcctggacaataatttgatacaataaagcagttacactgggctctgggtgggaatagagctgtgagagttagacttaaacttttgtagaagagaagacttaattcttgcattttgtacataaaattaggtcagtgtcttgtagaacattatcactgcgtctcagatctcacttgccagcacgtaggaagtttgttttggtttcaaaatgtactttaccccatggtggctggcagggtacaatactattgacatcactgtgtttcaaatagaaagttaacaagtagctactgttgtgattgcagattgccttcccagtccctgtgagagaatgctttttcttttggacagcaacacttctcagccccttggtaccattaaatcagccaatgggggctgccagaatagagatgaacaccaacaaaaggccaaagagtagaaaaactgttaataaggcaaaaatctttaatcagtttccaaattgatgtgaaagataattaaaaaatattctctcccatcgatggctaagttttgacagtagtccaggttcagagcctgatctctctagagaggagtatcccttccctctacccagacccctggaaagttgccaaaggaaaataagctattttgtatttagaacaaattgccactgttttctccagtgatgtagccctatttcccagactttgaaacttggaatacagaaagttcttgtgtgaccaaagaagaaatatggtgaatgaatgatcaagtttttctttttaactaaatccttataaacagataagagaggggaagtatgcatagaaactaaatttagcacagaatggatgtcaagtgagcaatttctgttaaatcactttggagtttgggttccttgtgggagttccagtgaagaacaaatgcctctggaacaagatttaattatttttttttttttcaaatgaggctgtcaaaaatgaagtcttccttagacatgaatgcaggataattaaaaaaaatagttgtttatatgttctgcactatagtcttcaacttagcaagcagtccatggatctggtaagcatacactagtttctcatttattacatgggattaagaactgttgacttaatttttttcttctttgcattgtggaatattgctttttagactttcccttctcataccttggttttcttagctgtttgttttcctagtcctaggcccctttcactgtaaatactttgataaagtcattctgttgtaaaagctgcagttcttaaaccctttgcttcactattaaaaaaggtgttggccggttgcggtggctcatgcctataatcctagcactttgggaggccgaggcgggcagattgcctgagctcaggagtccgaaaccaccctgggcaatatggtgaaaccccgtctctagtaaaataaaataaaaaaaaattaggcttggtggcacatgcctgtaatcccagctactcaggaggctgaggcaggataattgcttgagcctgggaggcggaggttgcagtgagccgagatcgcgccactgcactccagcttgggcaacagagtgaaactacgtctcaaaaaaaaaaaaaagtgttgactctcatcaagagttaggttggagactgttggttactctacatgtagacatctttggtggtatgcaccttattaacatttgctggtgatttcagctgcaccagaaaaaaaaaaggttaagagttctggcattcataaatagatctctcacaaatgctggcctggcatctgattatactgtttggaggtcctggtgttgattgttacctcaactttggtgagttagagagtcccagaaacatccactagaagtattacatctctcctccccactgtgtgccagtcattctgtttatttgaaaaacagaaatgactaaaagtatggattcactctcaattgaaatacagtgtgattagtatgaaatcaagtatcatctgaggaaggagtatggcaaggatgatcttgtggaagaaattgtttggccatggcctgaaaatgagttagatgcccaccaggtggacatttggagagaatgcattccaggtagagatattggcaagtataaaagcacatttggttatggaagaggtttgcaagggtatgagttatgggaaatgaggctggaaaggtggtaggcagaggactaaattatagtcttcaaacaggtaaagattatactactgacaacttgaaaaatcgttatagcatttagctcagtggtataataaggcactattgtttactgatgataattgttattgactgagtggcacttcatgttcttcatatttctgagttgtaaagactaaatgacatttcagcctatgtggtatctgtgtagtttgagaaagaatatgtgactattttgtcatcattaatttacatctccctttcctctctcttccatatcttctctcccttctcccctgtcccttctttttccctctccaaacctttgagagacataatcccagccatgagtcaaaaatgatgttccaaagtccatagtgatgtgttgtgatttgctgtagcagtttgaacatagattcctggaggccctgggatgtagtacaggttgagcatcccaagtccacaaatctgaaatgctccaaaatctgaaacattttgagtgtcaacatgactctcaacagaaatgctcattggagcatatcagacttaggatttttggatttgggatgctcagctgagtataatgcaaatattccaaaatctgaaaaaatgagaaatccaaaacatttctggtcctaagcatttcacataaggaatactcaacctgtctgaaataatatgaaatttgaagtcttcttttaaaaacacattttgcattatctgtgtttgtttttatataaaatatttttcttccaaatttttgaaaaaattatgacttctggaaaggatagtataaccctgtggcttcaaatatcctctggctcagtgttgaatacctctagaggtatatatagcctatgctaagaactatttatattttattgaaagaaagtggttttaaaaagtctcccaagaataagtaacatgcatctcaaccattttaattcttatttgtatacagataagccctttcatgctgaggctgacaatgtgacagaataatttatattattatattatatattatatgtaatttgtagaatttgcagctttattataccacttgttaatatttctatttgattattttataagataccaattaagaaggctatttaagtgaaagctgcttttttgaaaagtgagaagagagtcccagctattttcctaagtttttatttctgtcatcattgagtcccatgactaccacaatcagatctgacactagggacctgccacttgccacgttactacctgggagttaacagtctgtttattttctgtgaagtagataatatatgagttgtaggtgaaacatacgattatcaaatgccattttgtagaaatagcttgtttagcttttttttttttttttttttttgtgagatggagtctcgctctgtcaccctggctcgagtgcagtgatgcgatctcggctcactgcaacctccgcctcccagtttcaagcaactctcctgcttcggcctcccaagtagctgggactacaggcatgtgccaccacgcctggctaattttttgtgtttttagtagagatggggtttcaccgtgttagccacaatggtctcgatctcctgacctcatgatccgcccgcctcggcctcccaaagtgctgagattacaggcatgagccaccgtgcctggcctttgtttagctttcttatttcatgaaccgaataagctgaacagcagaatatgatcatacatgttttagtaaataaaactcatgaaccacaatatgcttttgatatatcaggatccatttttaatgtcatttttcattaggaaaacaggcaggcagggttttttggggggataaatttgggttttcagaagattctcaacacattaagttttagagacactttggtatatatgtgtaggaaaagtagctagctgctgtcacgtgcaggagtgtgtgttgggagttgagaaacctggccacaagccactgcagctttgaagaatgtggctcatgagaggactcatagttcattacgtaacattcagcagagcggaaaatataagcactgtctccatcacttgacttgctttccattttgatttagttatctggtaaagtctaggtatcctatagtggaagaatgaaagacaagcaggttccaatgaaggaccatgcttccaaaggcatcagccagtggatcgtttgtggggccaggcgggggttagatctattattgttggacaggggtattagagttttgaaagactacttgaaaaacataatcaaatgatacttggagtttgttccgaaagggtattctttcctctctcttcccacaacagtgtgcgcttcctattatagttgatatacctgtgctttaaaatagcacagctactagtagaggccattttataccaaaatcatttcccttcatgttctgtggtacatcagtttggcagtagaggttacagagtttgaaatcaaaaggagcattggttccttcagggaaaaatgataccaatctaccaaaataaaagccaaacagactctcattgttctttatcccacaaggggcttgccctttttgaaggtgtggttaattttgataggactcttctctctaacagggttagtggctgggaattaccttttcccctgggcaaaacccactttaaaatctcattttaaaacagaactcaaagtgtctttgaaaataaaagtactttgggaactcttcattgtgtaaccccatccctctcagcaaggggactccagttttctcacagggcacttcctgctgcagtacctaattctaactttgttttactataactcatgctaaaataggaaaggtttcagctttacagtttttattagctgttcatgtgtttttaaaaagtatgtgttaaataaaaataaagtaaatgtccaccaaggagctaaatttttaaaaatcagtttccattaagtctagttctataaatgtttcagtaccaggttttttctacttgctgtttgtctaatgttcatcataatattcagaagagcagccttaactttccccaaccttctttcccttcttttactagaggtgcaggaccatgcctttcatgaatcgttattctctatgtcagctcttctctcccttggagacttgaaaaacatcatcatatgatacttgcagtttttttcctcagtgaataaggattttttttttttttttttttttggtggagtctcacactgtcacccaggctggagtgcactggcgcgatctctgctcactgcaacctctgcctcctgggttcaagcgattctcctgcctcagccgacagagtagctgggattacaggcacggaccaccatgcctggctaatttttgtatttttagtagacacagggtttcaccatgttggccagactggtctcgaactcctgacctcagaagatccacccacctcggcctcccaaagtgctgggattacaggcatgagctaccgcacccagcctgtgaataaggattttcaaatcaaaccaagcttttttcttctattgcttgtcctttttccttcccccaaagtcttacagcacccatgatttggcagcctcatacaggaggctcttgagctaccagtcacatgagaatgaaggcaagaaaagaagggaccagatggcatcaaaagatatgcctttctaggtcactggtggttaagcttgcaatctggttaccaacagggagacttatgggggaaagggtggagagcagcatcattgaaaaggaagaataattttgccatacaattgctgttctaagaatttgcaggagagaaaaaaaacttagacactgaggagaatcgatttttctgatttaactctttccagtttacagttacagggcatccattgctcttggaagggtacatttacctaagtggcagctaaggacatgtggtaactgtgtgcattatttggatgggactctccctcttggtcagctgctgttcttcaactgccattaaccatttgttattctactctccaaatgcctgtttcatttaaatacaaaaacttaaggaaatgacatgtatcttccacaggtacacctctgtccacaagagcagaggaaataattcactgttcatctttcatattaataccgattttggaggactgtatttacaaaatatgaagaatggcatcactggcctttgtgagatatctcagggtatattttcttggtgtaagctgtatctcagagcagatgaataattatttgacaataaaatgttcagtagtggctaaaaaaaatatcttttagagcattctgccttccctgttcatttaggcatttttcaaactttggtctgggtacctcctgatttgtcggtgcattgcagatcctcagacagctgaaactagctgattatttccatatagaattccagctcagttgttttcccttgaaggagagaaaataaggcattttaaattttatgtttaaacttggtcccagtctataaatttaggtcctttactttttaaattacctagaaaatcctcgctttttcatacacaaattctatattattcaagtccaaagtcaaatttgaacctcttttacaggtctacctcctccaattacaatctctccatttattcagattttttcaattttatgtttaaacttggtcccaatccataaatttaggtcctttacttttaaaattacctagcaaatcctcactttttcatagacaaattcaatattctttaagtccaaagtcagatttcaacctcttttacaagtctccctcctctgattacaatctctcgatttattcagattctgttgtccttgatatctgtatgactcattcagtatggaccaaatgaaacaaagtaatatgtttctttctgtagtcttgagtgtaaactcttaaagttaacattttttttttacttttccttctcaagcaagtgtctggaacagtgctgagtatgtaaaatccatgtaataaatacatggaatgattaaagagagaaaaaattttaatatgttagttattttcattctaggttttagcaagtatcacaaaacggaaaatagactcacctttcttttccttgatgtgaaagtttatggaatcattttgattttcctttctttcttttcttttctttttttttttttttcttcctgaggcagagtttcactctgtggctcaggcagaatgcagtggcgccatcttggctcactgcaacctccacctgctgggttcaagcgattgttgtgcctcagcctcccgagtagctgggattacaggcgtgcaccaccatgcgcagctaacttttatatttttagtagagatgaggttttactgggttggccaggctggtctcgaactcttggcctcagtctgcccaccttggcctcccaaagtgctgggattataggcatgagccaccatgcccagcccattttaagtttcttaaaaactaaaaaataaaagataattcttacatatactgaagttttggagttaatttgaaccaaattgacaaggtattcttgcggtaatgtgcttgttaactttactagttgctttgttgagttttttagaagactgaatttaaagcaggattgtctattagtgtagctgccagtctttgtttccacgctccagtcatattatatgagtgcagttgttatcatatgccataataatcttaatgaagagtttaaaggcactttttactctggtgttttgttgttgttgctgtttgtttgctttttttggtctgctgagcaagagcactgtggtcacatgagaatcctcacctaagaaattttccagttaaaaatgaaaattttgttaaaggttctatgcatttgggtagtacagcaggggaggaaagtgactttgaagttgttaaatatcattaaggagaatccattgatatacctttgatttagggattcctttatccacaccagttacgtcaggtttcagcctggacccaattattagacctgaggtactgaactcaataaagaaatttgaaatggaaatactgtcagacctttaactatagttaggttagtaggtgctagaagaatcttaattcattagccaaacctctgacctcactacccttaatcatccttgcttgtcatgacataattggctgcttattgccttctcctacctctcttttcaaattgctagcctttgagaatttcacttgacattatttcttgtctattaagacagagaaagcgcatagtttggtgtgtgaattagcaaaaccattttagtcctctttcagaagagaatggagggtgtgtgttttgttcttgatgcagttaagacagttaccaaaagttcaattataggtctttaaggactaggggtaaactgtgaacgtatttgtggattttcttttcagatatgctgttaactgctgaattaccttaccccttatgaaacacaggaccaaagatgtggactagtattgttttaggatgaagttaaatactcagaactctctcatcaccatgatcatagttcttttagggcacagggaaggtaaatccatgaggttctctgctagcatttctaggagaaatttccctcaactttcccacaggaaggatagattagagaatgcaatgactttcagtaagtaatttttgtcacctgttgtccttgtggattggaggcaggtagtgagagagacgagagaggaagagaaaaaagaaataaaaattaagctaacgagctagcacacttagataggaagcaggggattattttatgggttatttctgtggctagaattgaccacagggcatatattttgtctaaccctaccctagctggtcacagaattttgctgtttctgttgtattggagtataagaaatcaacatttttataagtgaaaagtggttgaatatcagaaatttcatgtggttcaaactaatatataacaacatgtaacacactgtaggatggctacagttgtagagaggtagggtgtgtgtgtgtgtgtgtgtgtgtgtgcccacacacgtgcaagcaagtaaaaggtgggaggggggaaatagaaacttgtgagcatattatattcccttggggtaccatagctgaaaacctctcctctcgcctgtggttttagttattcaagatcaaatacaattgtcctggtatgttttcacacttccatattaatacagttgagacagtttatggggtgagttaaaaaataaaccatcttgacagagattaccattggggataataatctaaagtgagtgttgtctaaagagtacaacagaaatagcagagactgaaatgcggccacccctacattctttgacagtggagaattaggggtgtgacatctatc

SEQ ID NO: 166 - DNA, 71470 bp, Homo sapiens; identical to SEQ ID NO: 165

SEQ ID NO: 167 - DNA, 405 bp, Homo sapiens
actgcgataggaatcatgtctggtcgcggcaaaggcggaaaaggcttggggaagggtggtgctaagcgccatcgtaaggtgctccgggataacatccagggcattacaaaaccggctattcgccgtttggctcggcgcggtggcgtcaagcgcatttccggtcttatctatgaggagactcgaggtgtgcttaaggttttcttagagaacgttattcgagacgccgtcacctatacggagcacgccaagcgcaaaactgtcacagccatggatgtagtatatgccctaaaacgtcaggggcgcactctgtatggcttcggcggctgaatctaagaatacgcggtctcctgagaacttcaaaaaacaaaaacaaaaaaacccaaaggcccttttcagggccgctca

SEQ ID NO: 168 - DNA, 7667 bp, Homo sapiens; identical to SEQ ID NO: 152

SEQ ID NO: 169 - DNA, 1833 bp, Homo sapiens
aatgatttcactacagactctctggaaagcctgggagctgaattccggaagatccccacatcgatgaaagcaaagcgaagccaccaagccgtcatcatgtccacgtcgctacgagtcagcccatccatccatggctaccacttcgacacagcctctcgtaagaaagccgtgggcaacatctttgaaaacacagaccaagaatcactagaaaggctcttcagaaactctggagacaagaaagcagaggagagagccaagatcatttttgccatagatcaagatgtggaggagaaaacgcgtgccctgatggccttgaagaagaggacaaaagacaagcttttccagtttctgaaactgcggaaatattccatcaaagttcactgaagagaagaggatggataaggacgttatccaagaatggacattcaaagaccaagtgagtttgtgagattctaacagatgcagcattttgctgctaccttacaagcttctcttctgtcaggactccagaggctggaaagggaccgggactggaaagggaccaggactgaacagactggttacaaagactccaaacaatttcatgccctgtgctgttacagaggagaacaaaatgctttcagcaaggatttgaaaactcttccgtccctgcaggaaaggattgatgctgatagaagagcctggacagatgtaatgagaactaaagaaaacagatggctggagatgacatttatccagggtcactttgtcaggccctaggacttaaatcgaagttgaacttttttttttttttttaaccaaatagataggggaagggaggagggagagggaggacagggagagaaaataccatgcataaattgtttactgaatttttatatctgagtgttcaaaatatttccaagcctgagtattgtctattggtatagatttttagaaatcaataattgattatttatttgcacttattacaatgcctgaaaaagtgcaccacatggatgttaagtagaaattcaagaaagtaagatgtcttcagcaactcagtaaaaccttacgccaccttttggtttgtaaaaggttttttatacatttcaaacaggttgcacaaaagttaaaataatggggtcttttataaatccaaagtactgtgaaaacattttacatattttttaaatcttctgactaatgctaaaacgtaatctaattaaatttcatacagttactgcagtaagcattaggaagtgaatatgatatacaaaatagtttataaagactctatagtttctataatttattttactggcaaatgtcatgcaacaataataaattattgtaaactttgtggcttttggtctgtgatgcttggtctcaaaggaaaaaataagatggtaaatgttgatatttacaaacttttctaaagatgtgtctctaacaataaaagttaattttagagtagttttatattaattaccaaactttttcaaaacaaattcttacgtcaaatatctgggaagtttctctgtcccaatcttaaaatataaaatatagatatagaagttcatagattgactccttggcatttctatttatgtatccattaaggatgagttttaaaaggctttctcttcatacttttgaaaaatttcttctatgattacagtagctatgtacatgtgtacatctatttttcccaagcaatatgttttgggtttagagtctgagtgatgaccaagattctgtgtgttactactgtttgtttaataggaacaaatatagaaataatattatctctttgcttatttcccgttaaaactataataaaatgtttctagg
